United States Patent 7,868,149 (PLANT GENOME SEQUENCE AND USES THEREOF) - sequence listing, part 22

SEQ ID NO: 10718 - DNA, 40543 bp, Oryza sativa
gggggcgaggacgcagccggcgcccgcgctgcggaggctgtcgtgccagcagctgaggcgcgcgacgggggggttcgcggcggggagcaagctcgggcagggcgggttcggccccgtgttccgcggcgcgctgccgaggtcggggcaggccgtggccgtgaaggtgatggacgccgcgggatcgctgcagggggagcgggagttccacaacgagctctcgctggcgtcccatctccttggctgcggccacggccacggctcgccgtccatcctcctgccgttcgcctactcgctctccgcgcagccgcggcgccgccggatgatgctcgtgtacgagctcatgccgaacgggtcgctgcaggacgcgctgctcgggaagaggtgccccgagctggtgtccgagtggccgcggcggctcgcggtggcgcgtgacgtggccgccgcgctccattacctccattccgtcgcgcaaccaccagtgatccatggagacgtgaagcccagcaatgtgttgctggatggtgagctccgtgctcgcctctcagattttggcctcgcgcagataaagtcggaggagagggatgaattagagagtgctgcaattgagggcaatggaaatgagagtagcaatccttgtggcggatgtgatgatgacatgtctgttgctgatgaaaatgctactgctgttgctgtcaatggggaagacaatgctgccaagtcaccggaagatgatgaggggtttaccatggcttctcctgcagaggcagcatccacttcaggatgtgataagactagtgtcagtagcggattgaatggccgaagctgcaatggtggaggtgctgcagcatcaggagctgggaatgactggtggtggcgtcaggacaatggtggtggttctggtggtgtcaaggactatgtgatggaatggattaggtcggagatcaagaaggagcggccgaagaatgattggattgcaggagcatctgcaaccacccctgccacctcaacagagagaaagaaaacaaagcgcagggcgagagaatggtggcgtgaggagtatgctgatgagctaaccaagaagcaaaaaaggcgagcacttgctaagtcaaggagtgagattggtccaatggctagcatgcagtggtgggagagggactgtgacttagaggagaagggacgatcaaggtggagaatgatgaaaagctggagtcgtaggagcagcaatggcaatggcagcattgattggtggattgacggtgtgagaaggagcagcagggattgggctagtggggaattcgtgcccaagagtggtggagcagtgagcagcacaccaagcatgcgtggcacagtctgctatgttgcacctgaatatggtggtggtggacctctatcagagaaatgtgacatttacagctttggcgttttgttgttagttcttatttctggacgccgcccactccaagtgacggcctcacccatgtcagagtttgagaaggcaagtcttatttcatgggcaagacatcttgcccgtgttggccgcttgcttgatcttgtagaccctgcgctgcgggatgttaaccgtgaccaggcgctgcgatgcattactgttgcactcttgtgcatccagagatcgccaagtcgccgtccatcaagtgaggaggtgcttgaaatgctctctggtgagggtgaaccaccgaatctcccagtggagttctcaccgtcgcctcctggtgggttccgtttcaggtcccgcaagaaaggtcggtgagtttattttgttggttagatgaaataggtagtgttacttttctgctgctgcttgccttatcttgtacaccactaatttgtgtacactaccactaatttttctgttgaattgatttgtttataaagatcttgatggggaaaagtgacggtttcagtttcaaatcttaagaactaaggttcacataatgcaaaatgcataattgcagtttggcaatttatgtacaacactaacaaatttatccatttgatgtatctttgtacaaagatcttgatagggggaaaggtctcagtttcagttaacatttgataaggactcagtacccatttttcgaaatgcataaccgtggtttgatcactcctgaattgcaaatttagtatataaactatgatatcaatacattgctgtacagagatctttatgacagaaatggttgtaatttcaattcaagtttgacaagaactctgtccccataaatggcatacatcatacatgatgatagttggttaacaccaggaatgtggaatgttgtgcgtgctagaaagacagcttcagaatatttttctattttggattggaaagctcgcttcttttgctggtagactgggaagcatcttgcttttggatgtatagtgttttgctgggccctgtgatagtagctgtttatttcttcccctggacaacgactttctccaggcgtacccagttatgtgataacttttcatgttcacagatctcttccacttctttttgcactgagatggcattataactttattcagctagtatattctacatattgctgcaaacagcttagagaatgctatatgaaaagggcttctttagaatcttttgctagtgtagtgtggtcactggtcagaatttggtaaaagatggtttaggtatatgcatacttttcttgtgagatctgattgcttgatgccgtagagttgcccgtgctttatctacaatgtggtgtgcatttattgtcacctttggatttagggtaaccaattcaacaatgcttttatctacaaagtgatatacatttattaccaccgttgggtttatgataatcaattcatcaatgccttatctaccaagtcatgcattttattatgaccttcggaatgatgataattcggtcggtcatgccgtcagggtatccacatattatggactaaacaatgtataaatgtatttatgatggacaaataatacatataacatatactataatttatgatggagtagtataatttgtagagatatttacaagtttaaataatatcaatattaataacatggactagtgttagtgagctcggctacaattaaaatatcaagaggtggggtgaaagtaaaagaaggaagaggaatgcttcatgctttggcaaatatcccatagtaataattttcagatatccgtattattatattattatttgtacatgttagaagctttagtttcgtatttgtatctatgaaaaactatccatatttgtatcattatcagtatctgtaccattatcagtagacgattatctaatctgaattatatccgcatttgtttttcttcgaaacggactaagattgtgttcttttaagaggttcaggcttcagcacccgaagcgagataagccattagcacattattaattaagtattaattattataaacttgaagttaaatttatgtgatttttttataaaaagtttactccctccatttcatattaccccctccattccataatataaggcacaaccactttttttagatgttccataatataaggcatgcgtgcatgtagacaattaactatgaccacctctccaataaattattactttttaaaatcctacactcttatgctctctaattctattggatgtatgtattgtatttattaagatgataataattatttcttggtctttggtttagaggtggttatgccttatattttggaatagagggagtacttgtcgtcttaacatttacgcccctttacattttaatacctgttgtttctacattccaaagcacttttaggggtgatctttctttctacccttcatcaatgcacttttatctttctcattggcttatgttctttgaaaaaaataattgagatgtatttaatcagtggagatgtatttaatgaggggtaaccatgtaatctgccatatctccttggtttgagtgagatttgctagaacgacaaataatataaaacggaaggagcatataagaagttttttcacgaaacatacagttagcaatttaaaagatgtactgtggtaagctagtagctggagtagtaactaagcataaaactatccactctatttttatccctacgtggaagactttgatcggtcccccaaacatcttagacgtttcaaatgcctaattaagtcctcggaagttcacttcaggttaaaaatgtcagacgtcaataagtccagccaatggacatcaaacctagatgtaggctatgttcaatgggaaaataaatctcaaaagtaagaaaaagtattttgtttgattcgacctgcagtcgggtatgaaatgaagcacattagcactcactagaaaatactatccgagaggctaatttctgctaattgatgttatctaaggatgattttgaccaacgaaagcttggagagctttggatggacacctttggggcaatttataatgcactggagaaagccgcattatgtcccagtagtctgtttcttaatactgctgtcgctacccggctcagggggagaacggcagtgaagaaatttagcatgagcgaaaattaaacattaaacctgatcaagcagattattgcccatcagagctattcagcacgacaaaacaatagtatgacaaactatcatttgctaatagtatgacaaactatcatttgttgttacaacttacaagggggtatactagtatgaaaaatatgaggtcaatcaagaatatgtgttaagcctgtcacgttctgcaactgcaagcatctactaattttcaggatagaagggcaggcatgctaagctcgagccaaggggagcataacagcatacacaactctgcaggttttgtcattttatttatattcctctagaaggatgatgtacttctggccattgatcttctgcaggtgtgagattttcctcagattggcgagaaaaacttccctgtcctgcagtacaagaagaataaccaagacatcaacattttgcccatgcattgatttttgggaagtgtaatgactgtaacagggcattgacaacaaagtatttgacacaataacagaaatgcggactatggactcttactccctccggtcataaatatttgacatggttgactttaaccataaagtttgatcatttgtcttattcaaaaatttaatgtgaatttgcaaaaatataagtcatgtttgaagtaccttttaatattttattaaaacaagtcccaacaaaataaatgtaattataaaataaaatgtaataagaatggttaaacttcagggtcaagatcaattgtgctaaatatttattactggagagagtagtaatcaacaaaaaaaagtatgtgctccatacagtgcctttatgtgatgtgtgtgtcacgaagaaagatatcaagaaactcaagtagcatttgataaattcaaggccaaaaaaataaaaccttgaattccaaaacgtgcagttagaatatgacgtcatgctcagtactgtatttgtataaaaggattactagatgtaacagtccagaacagaacaaatcagaaagataaaacatcctacctctggacttcttagtcgaggcgaaaatctgggcataaaatcttttgaaaaatctcgcattgcgataggtgcatataaacgaagtaccaccctgatttcctccactgtaataggagatacatttgtatcacttctcgctgaggcaaatggttctgaagttggttccaaggaacacgaggtctcctccttcacgactatcttcttggtatcctgtaccaaatatatcattagagaaacaattcagtgcaatgtaattaaatggttaaaaacttcgttcacatgttttgagtgaaatgaagtaacttacaggctctatcttcggctttttaggggtagcacaagtttttgaatcatcacccctttgtctcctcttttgattggatttggaaacatgtggagtgctataaggatgtccgagaactgttggtttagaatggttgtcttcctgtggttcacttttgagttgatcctgctgtttcggagcaagtactggcgatggtgactcatcttcctgtttagatgaaacaactgtaagcataacatatattccacaaaagcatattatatgaagattttcaacaggaacaatgattaaaaattattacatccgtgtcttcatcgtcatcatcagactcgttttgtcccgcggcacggcggagcaacttctttagttccttaccagatttgctcaggcctacccctccatgtttctcattatcatcctatgagtagtcacaagttcatatttgaaaatgtattagcaatactgtggtaaatgcatcagcaactgtaagccacaaaatggtgtactagcaggatattgcacgaatgccatattgccatgttgactgataagtatgatccccgaaaaaaaaatgataagtatgagcacaagtgcatctatttctgtccacacctgcttaatttctggtggagcagggatttcaggatcagctaaatcacctccttcctctgggtcaacgtccacagcttcatcatcatcagtaaagatctcttcatgttcccaatcatcacctgataaatagcagggtccagctaaagaacttcagaagcccattaaagggctaacatacatgcattgatttacagtaatggtttactttattatacgtaacaattaataactatttggaataaatagaaataacaatgtccttatgatacataatttataaaaaaaaagaatagtatctagccagcttacccttttcaatttcatcatccaaatcaaagtctctgtctttactaccttcctcctccctaccctttgtcataggcacatgcgctctttcttccccactgcctttatcagatttattttcatccccattcttgttgcctttcttcaggtgaacctgatctgtttctccttcattagcatcatcgagctgcgtcacatctgaactaaaagcagcagctccatttgtagccgccttcatcatccaccgtccatacccagttgctgtgcttctcctcctgctcatcttctcttcagcttcttccaaagtcagctgtttgtactgtgaaattttactgaagttatacctgtaaaggcataccaaatatgcaagcattaaaagagtgattcctgtttgatggggctcacagtattgctattccttgtcaaaaagattttggtggtgattattgttgaaaatgaagtggaaaataaatcaacatatatatcgtgagtaccaggaatcagcgggaacagcgtgtacatccttgccatgcatcatcaacaaataatatgtcgaggctgcagattgtaagccctgaatttgaccttggtactgatagtcacctgtatcatcttccaaaatacatgactttctgttgctgcaattctcctgttatttgacaaatatgcgtgccacacgttaagaggatcaaaagcaaaaggcagggttaagttcttgagtttctatcagtcaatgaaaacaatttattgcagataggtctctttacatgtacattttccatgagataagcgatttaaagtttgtgccattaaggccatctaatagcatgcgaccaatcaatgatcttagatatttattgcttcgctccttgttgcttcgaatttatcgtgttatgcagatggaaaaaaaaaactatgatgatcatccatgataacgaattaagtagtacccatatattgccggtaggttgccgtccttgctgtccctcgggatgaagagaccagctgcggctccccgcattctccctatcggagaagggcggcacaccggtggtgaatttgccgatcgtatattgcttctctccggtggtatccaccaggacattgtactcctgcgcacgagcaacgggaacatcaaaacttcaggggaagggcaagcaattcccaaaacagccaagcggcggcggagacaatgccgacgcgcacggaaccaaaagccctagggtcgccggcgcacggggagtactaagcagtagtgcattacccggatgaggctggcgatgggggcggcgcagacggggcagcaatcgccggagcgagccatggcgctgccgcaggagacgcagagggtggcgtggcggcaccccgtgccgtggaggtccgacgacgagccgcagcgctcgcacgccgccttgagcacgaggccgtcggcggagacacccatgccgtgcgccgagcgcgctctctccgccttcgccgccgccgccgctgctgctctgctctccccctcttcgtagggttttggtttggttcggttccgttttgggcggagcgggggaggcgacgagagcgaggccgaggccgaggcgcggtggagtactggcgtgacgtggcgccggttagctagaaggggggaggggctccgagtctgtctcagtttggtggggacggaaacggagtcaaactgatctgaccggtgccccgcgcggcgacaaggtagtggaccgtgctgggctgggccggaccgtgttccatacacgggcttccattttgcagtggaaaaagtacgctgaaggtccctcaacttgtcatcgagatataaaatcgtccttgaaccacaaaaccaaaccggatacaacgcatcctccaacttataaaatcagtgcaaactgatccctcggtgattttgactctgttttgtccaatgtagcagctgacttagagtgggacccatgtgagccccacccgtcagcctcttcttcctctttcctctcttcatctctcctctcctctcctatacacgggcggcgggggagggggggagcagctaggtgtggccgccggacggcaggggagcagctggctagcttgggcgcgggcagcaagcacaggcggcggacagcgagggagcggctggctagctgggcgcgggaggcgggcacaggcggcggtgggaggaagctgcgcagggcgggcagggaggagcgacacacgggcggtggttcctcgcactctctgccaccagagccgccagctcctcctgtgcgggcgctgacggacgcccgccgccatcatcaccatggccgctggacaccgacaccgatgtggagcggtcccctccagcggtcgcgcccgctccagcttcgactccaaccaggcgaaagagccgcggatcgtggcgccgcgatggtgcctagctcgtcgggaggtcgaggcaagccaccatcgccagactccccaagctcccgcgagctcaccggcgacaatgaccgcccctcttgcgtgttccttggtaagaaaatggggatggctggtcgagctcggtgacgacgccgcgcgcaccggcctgccggcccttctccccatgccccatcatcgagaagatggggacggccggtcgagcttggtgacatcgccgctcgtgcctgagcgccaccacccagctcctccccagccggccgccgcccgtgcccgccgcaccggtcttccacgcccagctcctctctgtcgtgcgaccggttgagctcggtgacaacgtcgcccacagccgcgcaccagcctgccggcccttctctccatgcgtcgccgtcgagaagatggggacggccggtcgagctcagtgacgccaccgccctcgcctgagcaccaccacccagctcctctcccgccgaccgccgcccacgcccgccgcatcggccttccgtgtctagctcctctccgtcgggcggtcgcccatcctcacccgccgtgcccagctcctctcccccgctaccggtcgctaggaaaaggaggagagatgaagtgtggagaggggggggaagaagaggctgatgggtggggcccacgctgagtcagctaccacatcggacaaaaccggagtcaaaaccgtcgagggacctagtttgcactggtttgtaagttggggaatgcgttgtatccagttttgtggttcaaggacaaatttataacgtgataacaagttgaggggccttcggtgtactttttccttttgcggtcgcgcaagcctgggcggcatttcgcatcttggcccgagcatgaaagaaatttgcaagaattataggatattgtgtgctccataaagggaaatttgctaggattataggatattttatcctatatcatcttattacaaatgctcattcctatttaattttgttacaaaactaccctggtgcgcacgtgattaacccgatcaacatgttttcttaaattatgagttaatagtggtatttacaaaaattaaatatgtctagagtatagtcttgattttttttgttatttcacaaatatagtcgttcatgagagctggaacattgtcatgttgagtttctctatatgaaaaaaaaataatgaaatatgaagaataagtctaatgcaagtacttcataattcggctaacttagcttgcagtcttcctacaatagcgataacaaaatgatttggttaagcacgtgtcgactagggtgatttttgtaacaaaattaagtaggaatgtcaaaattcaagtgacttatggggtggttttgtaattttcccttctataaaagatgaatgaaggtgaggaaatgctttttttttttgctcgattatatggaagacgcacatgcactcacaccgtgactaaaatggtttaagtgaattttcttcaaacattaacttcctccacctcataaaaaactaatttctgattatgaatttaaatgtagcctgctttcagcttttaaattttatatgggacgaaggaagcatgttttagtaactccagaaaaaaaagtatgtttcaataacttatatggggcggggtagtagttttccgccttggtagttggtagtagtatacagtatatttaaacacatttatcacggtcgaagcgggcaataatacacagagtacacatctgatactctgatagagcttggcggatcgaatcatccattttctgaaggaacaagctatcgacttgagtcttgcaagcaagtcagcaaccaatgtctaatggaacggctcaacttgtgttatacgggatctctctttaactaccatacgctaaattaagcggcattattggtctctttaactaccatgtgcgctagttaagcgtccttgtttgtctttattgtggttaacaagtcttctcccaacggtgctctcagtactaacagagtgtgaaagccattaaacatatggatcgatccagccaagccagctgctgcaagttgatcgagtggacatgcttgagaattgagatgagacgctcgaacagtgcacgaaagcagcagctaccaaactacgcttgtcggctgatcaggctgcttgcgcgtgcgttttctccaagctgggcgtctggtggtggcctggtggagagcgctgtacgcgcttgacgctacacaatacactcgccagctgagctgagctgagctgctggccctgcgcgtcttaatagcaggattaagctgcagattgacctcgcaacagtcggagatgacatctacacaataatacaaacgttgccgatcgattcctggtgttactggtcattatcactcgttgttatcgttcatttatgaatttaaaaacttaactttaagttagttttaaggttttctcataatgatttatttttcaacattaacttttaaaccattaaaaacacatatttaagcattttatatacttattacaccatttatttcatattataagttgatttgatttttttaatagtcaaactctttttaagtttgaccaagtttataaaataaatatagtagtattttcaacacaaaacaaacaactatactatcaaaatatattttatgttgcatttaatgaaactaatttaatgttgtagatgttgctaatttttttataagtttagtcaaatctaaagaaatttaacaaagaaaaaaaaatcaaaatgaacttatatgatataaaacacagagagtattatttttctacctgatgtcggatgatgccatatctacagttggtgggttgcgtcgtcacgctgtgtctgcctacctgggccctggggaaaaatatgaggtattcctacaaaggcggcttagcgctatagtcaattacccgtgacctaatactttaatactactatcattccccatcatgcagtctgcataaagcggtgtttcaaccttcgcttgagattgagaagttgtgccatcttcaaagaatcaaagtcttcgacgtacctgtaatttttaacgtatagactgaaacaccgggtgagagcatgcaggtgaaactctaggttacgaccggcgcacgcagcttggattaggtttgggtgggagggtgcagccgtgtagaccacggggagacggcagaatttaaagcgtacaaaagcatttctttttgcgaatttgtggtaagtttgttattattggtacatgatgaaatctcaaatgacaaagtatagaataatttctaccatgttacaatattatacatccgccttgtggggtcagaagcggtaaagattagatccgaagcttattcgcccggaacttttgacagtgaacacatgccaaacaacccgatttgccggtaagtaaaaaggtactaccaagtaaaaagggaaaaaactcagtggagaaaaaaaagaagaaaagccaacgtgacaaccgcccatccagaaagcaaagataagaggtcgtgaggtcgtttcgtcactatagggagtgtacttggctatggagagtccatcgctcgtcactctcccaatctaatgctgatgctgatatgattgccaatgtgttacttcctccattttacagtataaaattttatagtattgttaatatttatttatatgctaataaatctaacacatatatatgtatatggacaatactaaaaagtcttatatcgtgaaacggagagagtatgtatacttcgagaattgtcgatactctcggtagataatgccatggcagcaaccaaccaccaccagtagtccagtacagtagtaccaatatcatagtggtggtagttgcagtcaatagcatggtctcctcctctcgatcgatcacagcctgctccttccggcgtgtacgtcgctgccggcgccggtgtggcggcggacgaagtcggtgacctgcgcgatgaactccgcggcgcggtcctccttgaacagctccatcgcgtggtacccggcgccgtcgagctttgcttccacggtgacaccggctttctggagtgcctccaccagcgtcctctgccggtcacgcggcgggtccttcatccggccgagcaccaggcagggcggcagcctccgcagccgcgcggcgtccacgccggcgagcatggtctccgggttgcagtactcgtggtcgcggtcggcgcccagcggcagcgcgagctcccagagcaggtcgttcgccgggagcggcagcacgcggtcgtccaccgacgactcctccgcggccgtacgcttcacgccgccgtggtgcggctggttgaggatcagcccacgcagctccacgccctcgtccaccgccgccagcgccgcgcggaacgcgatgctcgcgccggcgtggctgcccatcaggaacaggggcctgcagcccgcggcgtacgagcgcacccaccggaccgcgtcggcggcgtcctcgaacgcggcggggaggcggtgctcgggcgcgaggcggtagtcgacggaggcaacgaccgcggggatggtggccgcgagggccgtgcaggtgttgtggaacggctcggacgccgcgcggaagaggacgtacccgccgccgtggaagtacagcaccagcggcagcctgcctccgccgtcggccccgacgcatgggccggacggcacgaagaggcggacggtggtgccgttggcgtcgttgagtggcgcgtcgttggagtgcacaatgcggcgcgccggcccgttgaccccgtcgacgggctcccccgccggcgccggcgggaggagcctggccgcgccgttgcgggtgagcgagccgtcggggttgaaccggatgttgaggtacttgtacgggtccatttcgcgatcgagatcgagcaccgcgctccggaggaagtagtactgttggtggtggtagctaggcaactcgccacggagcatggcgcgcgcagcgcagcggatatatagctcgcgcggcgggggcgcgggagactgtatgagggagccgacggtgacggcgactcaaaatactactccttccattcggtgatagtttttcttgcatcgtttgaccacttgtcttattaaaaaaatttgtataaataaaaaaacgaaaagttatatttaaagtattttagataataaagtaagttaaaataaaataaataataattataaaatattttgaataagataaatgaacaagcagggcaagaaaaaatcaaaatcctacggaaaggagcgagcactagtggaacggagggcacgccgcggtggatcgcggatgatggagcagcggcaggatcgggtacctgacccggggacggggaaagggatagggacgtgacagagtggcctgtgtcgcatttactaatggcgccccatctaactccgcgaggtacgcacccgcgtccagcgagtggccgggaaacgggcacgcatgcaggctgtctcgcgtagcgtggagttgcgcggtacacggccaccgcggctgcttttccgccctgcacggcaggcggcccgcaaagttgcaacttgtgatctgcgtgtgttggatcattgatgagagttgataggagtaaatagaaatggcatgtcactccccttgatattttttttccaaagcgtaaaatagacgcattcacttgtaaacacgcgtgcagccggctgtatttgtgaagagaggaatagaaaagattaagaaaataagtaaaacgatgtaaactattagttcgcaattagttaagtattaattattttaatcttgaaaaaagaattaatatgatttttaaagtaaccttttcatagaaagttattttttaaagaaatataccgtttaatagctcggaaagtgtgcgggcgaaaagtaatgtttttcccttctcgttcaactatcaaacactgcatatagtcctataaacacacataaacattctatctttattggcacgttcaacaaccatagataattagatatcttattgttcacatatcacttcattaataaaaataattagtcgtaaataccaacacatattctaaccgagtgtagcttagtttgcgatatatatatatctactattataaaaaattgaagatgtttttgtcggtacattgatacgttattcttgtttgagtcggtttttaatttcgttcgcttttggaaatatagggtctgttccgctgcacgttacagcccttcttcacagccaagctgctgcttgtggatgcagcgaaagaactagcgactagttgccttcagctgcctagcagctactgtaacaagcagccgaacaggtccatagatttgtgtttgagtcattcttttttatatttgttcgcttttgaaaatataaaagaagtcgtataagaaatatcattaaaacactcacatgctaacttgagacgaaagtccaactcctaatcgcaactcatgattttctaaaaagaaaattcaagcgagtttctagagtaaattcaccctggctaaaccgtataacaataataagattaaaatggtcttcacacgttgcaacacatgggcaatttttttctagagagtgtgtgtataaagtacaaaatgtacaataaatatatattgcacgaatactacttgcgctagtgtttattactatactagcctatagctcgtgcgttgcaatggaaaaacaaattgagtttgtagcttagtaaattagttaataagtacttattagtttaagtaatagtataatttttttgttgaacaagtaagtgaatttaaaatttggagggaatcaatagtgaaattgggagaacctgttgaaaggtgatcgaatagtatagcttgtggggcctagatgttagtggtaggggtgtggaaatggacaccaccactattaaaatattttaagtagtatatatatatacggcttatgcataagagttaaaaataataattcaaataactttgtcacattttatttatactgcgttaaaaaggcttttttatgtcaatgatagttatgtttatttgatagagataagtgtcgattttttaggtcacgactatacatggtatggagatcgttggtaccaaggtatatgcgagattgagataaaagagatggagacaaggattttatacagatttgggcgccttatctgacaggtaatagccctactcttgttaaccgaagccgatgttgcttttattcttcataatcacacaagtacaataattgggataacctatctaactatcatcgacttggtggcatagatcaccaacatgtattcgatgacagggtagtctttctcctcgagtacgaactcatcgagatcggagatggcgctagatccctcttgtcggcctctgtaagcactagattgggtttgtctaggcttatctctgatgtcgatgtctggcggcgtattggtttgttctaacttgtgtgtcccctcccctcctaggggatgttcccttgtccaattagaactagggagaccaattaatatgaatacaatccgagtattacttatagttttcatatagaactttatttatcattccttatccggaacttcttctatatataaggtataattccatataaaacttggtatatagtgggccccgtctaacttagtcgattactattagttatatggtatccataatcatgataataagcattaaacgtgaagataacatcttaattgcattattcacataaaagatattgttcaaagaaattgcaacgtagaattttacagtatgtttatgacatgtttttgcagatgcaaatgaggcaaaagagaataacgaaagtgggttctcaggaaagagcatgaagacgagctaggtttatgcgtgctccaagagttaaggaagagaagaaaaaaaaatacctatgctattttatattattttaaatgataatgttagtggtggtgttcgaattgattccaacttcacaagctgacatatggggctataagatcaacgcatgtgaatgcacgtttttgcttcggacatggcattatatatctaattaactaactatgcaataaaattgtattttttgctgaaatttttatctctataacatccgttgcaatacatggtccttttgctagtaagagaaaaggttatacctaggagcatatttgaaccactaaaatgatagcttatactccctccatttcaaattgatctatatatagttttttttgaggttattcctaaatgatctacatatttgtattcatttattaagtctattcgttatttgtgcattagagtaaatggacattgatgcatgcatccatgtacacaagtatttataacccacatgcaatatcttgatttgctattggctaagaaatagtggggatggtacatacattgagtttgttgctagagtaaatatagtatgggaaagttattagcttttcttggtcttggtgtacctatgaaatatgtagatcaatttggaatggatgaagtattattaaacatatggccttcaaatgaaatacttgtgatagtatgataatagattctaatatctgaaaaatatggtcattacatgcttttacttcttgaatacacgatatagatgatttattgctatgaaaaaaacttttcaaatgacaatactatgtttagtactccctccatttactttggatagtaatattttatcttggcacacagaccaagaataagcaattctacttatcatccatttaaatataccactagtcattcctcgtaaacaagcgattcgttaatatttacatttctcgatgcccatgtaaccaatcttgtgtggaagaatggagagtcacgcattaaatttgagaaagtcattaagatgataggttgttggattgaaatatgcctatcaaaaataaatttttcagatttagaaatatgactatcaaagatagatggagagagtaatatttgtcactaaagttgctctatgtactgtaagagaagaaaaggaacaaatttgagtgtgatatgctcatatgttagatttgtccttttcaaaatataatatatatatatatatatatatatatccctccatcccaaaatatatttatcttttgattgtttttgtttattccaaaataaccgcatcttttaaacaatcattgcatcgggttttatgaaagtaagagataaatatattataccaatcctaacccaagacactagacatagttttcataaactccacatcatcaagaaactagtattagacactactctttcaatacaaacaccattgtttcatacttaaattctatactacttatctcatatgatatcttaaatgttgtgtgaaaccatgtctcatgcaagtcctggtttcttctctttccttatttattcacttggcacatcatctttcattctaagtggtaaattatttaatgctatcgacacatcctagttattgggttgggactggccttaggactagatagtgggagacaattgtattgatatttgaaaaaagtaaaaggtattttagttttttatttggtatgtgtagaagagatgataagagggagtaagtgtgagtcatgtttatgttttttttatgacacatattgtattaaactattaatgctgtcaagtgctataaacaattttcatagcaattgcatgatatttgacgaaacgagggtcgagggatatacccccctcgagtctcatggactggaagggttttctcccgtactaaagtttgttagtgttcactttcatgcacttctcattttaattttttttactgatatgggctgcaagcctccctttttctaaacacgtcactcttgttgaactcatcacgcatgactcgccgattttgcaccgagtcccattcaacaatcagcttgcgatatactgtagaagttctaattagcggctgaataaacacgggtccctatcgtttggcttatttcctaataagccaaaacggcttattgggaaataaaaatgaatttatagatgaaacttttataaatgtgttcatggtgacttaaaagccaatgttataaaagaaactatattgaaaatatctaaaaatcaatctcaaaattaagtttaaaaatttaaaatttagctttttctttgactgatttagccatccgatggcagccacgggcggcgtacattcagacttcaacaccagaggtgtacggtacggaggaaaagccacctcgccagcaacatgcccatcgcatcgcgtgaaacacggtgcatattgttcggtagcccctgcgagattttgtctgcaactgcaaagctccaaaagcgcactgggctgggcgagtgagtgtgccaaatgccagtgtgtgcttcgtccggtggctaatttagctgacctctgagactggccccagttatgcaactagccccgcaacttttttttttctttttcggtacaccgatgacaatcatgccaaggtgcgtcccgttccgtcccctttagctgaccttgatgaacctgatgtgggtatcgccggaacagagcccggatccccaccgtacctttcatggcatcgctttttggggtaaggacgggacatttccggcgtacacacctgcgcggctggtgggagccgtcggcatcggctgccgtccgtcccctggccggctctcggcaaaccggacgacccgagaagcgcgcagcccgtagctatcggcctatcgcgcgcggcgcactaggcaggcatcctagtttcaccgggttgcgctgtggtatgggcggtgacacccgtcgagctcccgacccatgcgagctcgcggcgcgcgctaaaaaaacgaagcgacgacgccgcgtcgctttcgggtatcggcacggaagcggcacgcgcgcgaccgcatcctcgtgaagattggtggcaacgggtttgaccgatcgggagctaagccggcgctcttccgctcttggacggctgggagaagttttatgggtgggtcagctcctggaacccggaagaagtggacggaatttggaatcggggatctttccgccatgtgcgtgtccagtcgccaccgaagaaaaaatagacgcgccgttttatccattgctttttctaaacgtgactgaaaggaggcaaaaaaaaaacaaattcttgatttatttctgtgtatttattggaggaaggctacagggaaaccactaatagaagatgagtcaaatgatacagcacaagcgcatcatctttgttgtgtccgcataaacttgccctctcggcatcggtgctcggtgaacctgtcgatttcttcagcttaagggcattagtagtgtgcccacttattttcgtatggtcatgtactccacctagacaaaaaagtgaatgaagccacgcatcacaaatttcaatctcccacagtgcaccatggtctcagctgataaaatcaataacccaccggttcggggtcccactcgtcattctaaaaaaaccaatccttatcttccttcccagcctccacacgcacgcggctacgcaaagaccgtcgcctcacttccttcgtgagcccttccctaccgtcgccactttctccaacgccgacgccttacatcctggctggcaccccttcttttcttcccgaccggcgccccgctccttcccaggccgacagctgcgtccctcacctccccaggccggagcagctctccctccccctctccctccgttgttccctccccgcctccgacctctttcttcaccgagctctctagatccggcccgtggctcgccggatctagactcgagcggtgacaatgggggaagcagtggctgctcgacagcatcttgatgtggtaggcccgcggcggcctttccccttctcccttctagcgctggcgcgacgtccctctccgccacagctcagggagacggccgacgagctcggcggtgcggagaggaggagaacgacgagttcgccagctagggtttgagcaggggcgtcgacgagactctctctggcacggcggcagctgtctccggcgacgatcgccgccgcctcacacagggtgtggggtgtgggcatcgcacagagccacgaagcgcgaagccacgacccccacagtgcaccgcgccgttctccccacgccgcgcagcaacttttctgacgaagaacgcacgcccagttttggctacacgaacctcgttaggtcacgctctaatcccagctggtagagaatctcctacgtggcgtgggttggccaaatgccacgtgtgtgcactgtgaatgccctaacgaagatagtaagtgtcgacgggtgatacccgtagaccggatatagagggtattggggtacgttggtacaaggatctacgtagtacgacatcaagcaaacaaaagacaagaattatactggttcaggccccttgataggtaatagccctaatccagttgatgtgggattatatggtagaaaacacaggttataaagagaataagggaacttgtcggatccggcgagattgtagtcgagttgattcaactagctctcgatgacttggctcctcgtaagctccggcttcgtaggctgtggaggttatgttggctctgagattcgatgtctaaaccccccggggggggcccttttatatcgcagatgaggaggtctcctcatagaactcggaggtatcagaccttatacgatatgccaacgacccagttctgcccgagtaggattcttcccatctatagattccgtgaaaggtttccttagaatatacaggaaatatccgcctgtgcgtgggtatgccatatcgatatgtaacgtatatcgaagggcaaatggtatgcctaacccgtaaccctgacagtagcccccgacttctgcttaaattgaactcgtgcaaccatttgcgacttcgggtgtcgagactgttgtcattcccggtgcgagaaccgcggagatagaccgtagtcgagcacgccatttgaagcccaacggtcacaagcgaattttaaactgaagtccaaaaaaccggcgcgcgtaacgggaccagaaatttccggcgggcatctctctctgttccctggaatttgcaccgtcggtagtgcgcctatttaaaggaattttgggagtccatcttgaagtccgccaaacctgttaaacacacaccacctccaagcactctttgccttctctgccgccgcaagaaaccctagttcatcaacctaggctcgctttccggcgaccttcgatcagcaatggacctcggcaaatcagcttccaccagtgcaacgttgaagaaactccaggaggatggcgctcttcctagccgtggaaccatggagagggaagcaggaggtactaatcctcagcccatcttgggtcgcatggttgcgatcgaagattatgttctctgcggttttctccctccaccttccgaatttcttctcctggttttgaatttctatggcatctctcgtctccatttgaaccccaattccatcgccttccttagcatctttgtgcatctttgtgaggcctacatcggggtagagcctttccttgatctttttcgcttttactacgaactgcgttggatggaatccaacagggtatctggttgcgtcgggttccgacttcgggatggcctgaagtcacgttacattcccttccagtggccttcttctcgcagcaagtggaggaatatgtggttttatcttgagatcaaggactcgaaccctgtgttcgtggttcccgaagatcaaccggacaagattccgtcttggaccgcaaagccccccttgaccccctctcttcagtcgtttatcgacatcatcgacgatctccaagaacggggtttgttgggatatgaagtcgttgcagacttcgttggtaggcggatccagccgcttcaggctcgggcccatccagcttataactattccgggctagaggacacgacctgggtttctcctcggggtatctttctcgcatttatcttgacatacttgtgttcgcattcctcttgacttatcaaaggttggttctcgattaacaggtctgagcggcgaaaccgtggagcgccgcatcggccaagtgatgatcaatggcccgaccacaacgagtgacatccctgtgcccctttgtgaaaagggggcggcggaacgtgatgaagccatcaacgtaagtatattcgatgaacatcccgcattctcctttcgaaatcactttatgacttgattgagcgtaggcccttcctttgactgatatcatcggatcgctcgcggaccatcaggtggcgtcatctctgaaagtgaaggtcgtcaaggaggcgtctgattctgccaccactagcggtggcaatgttccgacaaagccgaggaaattctcgtctgtaatcagacaacgtcgcaaggcgtcgaccccctcggtaatttattttgtcgttaaatcatgcagcaagaaggatttttccttactttgcgttgattgtcttccaggcctcggacgcgtctcccccacctccacgacgacaacgcattgtgacaatcggcgagaagtaagtagatgaattcttgaatccctgcgcttcttattcgattgttgtctaactcgtattcgtcctgtagggaggcgcgggcaaaggctgcgcgagccaagtccggaggagcttccagtgcgtcacccgtcgtggcctcgacggatgtcgtgcccgcagctgggagccgggaggcgacgcctagtggcccagtcagcaaccccgcggcaggtcgtgatctgccagctacagtcctcacctgggaggagctccaagtcgagatggggcgcctcctcgaagccggtgctcgcggcatcggccgcgagattgcggaggcgaggtcggaagcggcgacggcgaatgcgcgtgctgacagactagtgtgcgagttggctaaagcccgtgaagacctcacgaagatgagggagttggcggccggcaatgagcgacaacggaaggggctcgaggaccgaatgtcggaactcgggaacaacctatctgagatccggggctcgttgagggtcacctacactggccttcaccagctcaccggggaatgcggcgtcacgtccacaatcccagcgaatcccgatgagttttcgctgacctctctcgcggaactggcgacggcgatgggggaaatcccctccaagcatgcggccaggattgcggaggagacgtcaaacggaatctacaccggggcgtgtcatgtcctcgcgtgtgtaaggctgtcgcgtcctgaactcgatctgcgcgagatcttggaccagggggcggccagcgacacgcgtaaggaggtgatggaagaagtcggtgatctgggggagtctgttctcccccgttttgaagagtaggacttcttgtatttcctagataatgtgtaaaactcgaactttgaccgcctttgtgcatgcgattaccatcccggcttactttggtatgctgacctcgggaacttttgtcctctgtagagatactgatgacgaggatgtctagcagcgcgggcagcccgagtcactggcagtaattccggtactcgagttagaaccatacgtctcgcctgaccatgtggatcaaccccttgatatagagggaaggatggcgacgactgcctcaggttagtagtcccttcaccccttaatgcccacctgactaggttagccatgttcccgaaagagatgtatagcttgacttagtggttatcacgtttagcagatctcgagggtgcccttgctagccaagatcgtcgtatccaatactggaagacgaagtttgaagtggcggagctcgagagaaccatgctggccgtgaagaaagagcaggttgtggaaacgctccgaggccgtgaggtatggtttaactcgtacttgaagagttgttgcacatccatggccagggtatgcagggagcttcgagtagtccgcggagatcccgaggagtcggcggccgggtacatctcgtggcttaatggggcctgtgcccagctcgatggaatcagcaagcgtatcgacgaggccttgaagcaggagtgtcgtcgatcgagccgatatgccggggggcacgtgttggcttgcctacgagatcatcgcccgcacctagaccttgaatatcttcgtgagggttttgctcgttctcggaggactccggcagagatagaccatcttgcaaggtcaatgtcgccgttggccgagaagatcttccagtctatggactggtgttggccctcttggtagtactcgtaccctgtgacaaatatcttaggaaaagatgtaatgtagcgaaagatttgtgaaaaaactgtaaggagtatttgtgaataaagaaatctatctttgacaaatgtctcttactcttgatgtcatgtgtaagagtgcgttctcagttaacgactttagtcagccgtttgagtggtacactctccctatcccccaaccttgtcgtcagaggaattttctcggaggataaggctcttggacctttgacctggcttggttgaataagctctgatcctagcccccagccgtgaagttggaaagttgatttccgatttcacagcttggttaatacgcacggcgagaactcttacacgaccagatcttatatggtctttcgtctctacaggatctgacaaggccttatcggttctgggcatttccagccgaagatcccttaggttcctcggaggccttgtcgagacggcgtaaagggacataaggacaggtttcaacgctaggtgtcatcagagtgagggatcatcgggcgaaacacgttgattgtgatatgggcctagaaatagcctttattgatactgtaagggtgcttacaggtatggatgatattgactcatacatagaatttacgtaattggtcaatgttccaagaatttgctaattcgcgaccatcgccgtctgcgattttgaatgcgcctggccgcaagacttgtgtgatcgtgtaaggtccttcccatttaggtgagagtttgtttcgccctgcttggctttgaactcgtcggaggacatagtcgccgatcgaaagtatgcgtgcacggatgcgcttctcgtgataacggcggagggtctgttgatagctggctgctcggacggcaactcgttcccgatgctcctcgagaagatttacatcgatatcttgctgcccctcctggttctcgtcggagtacttctgtactcgtgtactctgatgttgtagctcgcctgggagcatggccttagagccgtgcacgaggaagaagggtgtttccttattagacgttgtcggtgtggtgcgtacagcccatagtactgatgggagttcttcaacccaccttttgtcgtgtgacatgagcctgtcgtagacgcgagttttcatcccttgtagtactatgccgtttgccctctcgacttgtccgttgctttgagggtgagagaccgaggcgaagcatattttgacccccagcccgatgcagtagtcctggaaatcggcgctgatgaactgggagccgttatcagttatgatgcggtatggtagtccgtatccgcaaaatatccctttgatgaatttgatggcgttgtcggccttgatttcccccgtgggtactgcttcgatccatttggtgaatttatcgatcgccacgaataggaatctgtagtcgccctgtcctcgtgggaatggcccaagtatatctagcccccagcacgagaatggccaagtcagagggatagtttggagcgcttgcgtgggtagctttgtgtgtttactgtggaattgacaggattcacatcgctggaccatgtcgcatgcatctttaagggcggttggccagaaaaagccttgtcgaaaagctttgccgaccaatgtccgaccggcggcgtgtgacccacatatgccttcatgtatgtcgaggaggaggtgtctgccgtcgtcggtcgagacgcatttgagaagtaccccgtttggcgctttcttgtatagatcgttgccgaccatacagtagatctttgctttacgggttattttctcggcctctgtgtcgtcctcgggcaactcctcgctgctgatgaatttgattagtgggatgcgccagtcgtctatggtttcgatgtcggcaacggcgcgttctgcctcggtgatgtccgagctaatgtcgggggtgttcgggctgacttcgctgctaacctctttcaccgatggcttcgtcacgatatcgagaaaagtgccgggctcgagcgattctcgtctggacgcacgtcgtgctaggtcgtctggctcgacgttgtccttgcggtaggcgtgtcggacctcgatcccatcaaactttttctctagcttcctgacttctgcgagatacttggataacttggggttagagcatttataatctttgtgtacctggttcgcgactagttcggagtcccctttgacgattagtcgcttggccccaagtgtagctgcagctcgtatcccggcaagtagtccttcgtattctgcagtgttattggtcgccctgaagttgaggtggattgcatgcttgaattgatctccggagggagatgtcaagataaatcctgcccctgctccttggctgttgagtgcgccatcgaacgccattgtccctgttgcattgtcgccttggttgtctgatttgttatctggcatagtccaatcggcaacgaagtcggtgagtacctgggacttgatggttgtttgtggcacaaagtggacatcaaactggcttagctcgactacccatttcgcaatgcgatcgacaacgtctttgtttctcacaacttcaccaaaagggaaagaggagacaactgtgagtctgtgggcttgaaaatagtggcgtagcttccttgatgtcatgatgactgcgtaaagcagcttttggatctgtgggtatcttgtctttgcgtcgtggagagcttcgctgatgtaataaactggtcgctgtactttctctctctcgacaacaatgacagtgctaacggagtgtggcgtggcagaaatatagaggaataattcttcattaggttggggagcaacaagtacaagggggtttgataggtagcgcttgagtgcaatgaatgcctcttcggctttctgtgtccatacaaatttgtcttgtttcttcaacagagcgaagaaaggttgtcctcgttctcccatcctagcgatgaatctgcttagtgctgccatgcatctggttagcttttgtacctccttgagtcttgtaggcgacttcatattctcgattgccttgatcttctcggggtttgcttctattcctctgccagagacaaggaatccgagcagcttgcccgatggtactccgaacgtgcacttctcaggattgagcatgaggcgatatcgtcggaggttgtcgaacgtttcccgcagatcgtcaatcaatgagtcgcctgtcttggttttgacaacgatgtcgtcgacataagcctcgacattgttgccaagctggttgctaagtgcaccctggaccgtgcgctggaaagtatccccagctgttatcagtccgaacggcatcttaacatagcaaaataccccgaacggcatgatgaatgctgtcttctcttcgtcctcttttgccatgctgatttggtgatagctagagtaagcgtcgaggaagctcaataactcgcaaccggctgttgaatccaccaattggtctattcgaggaagtggaaagtgatccttggggcacgccttgttgaggtcggtgaagtcgacacacattctccattttccgttggccttccgcaccatgactggattggctagccactctggatgaagtacttctctgatgaagccagctttgagaagtttgtcgagctcttctcgtatggcttgtttccggtctggtgcaaatctccgcagtctttactttactggcttggcatcgggtcgcaccatgagtttgtgctcaatcatctccctggggacccccggcatgtcggacggctgccaagcgaacacgtcggcattgtcgcggaggaaggtgatgagcgcaagttcctatttctcgtttagtgtcgccccgatcttgacggtcttgtcggggttggcactggagagtggaacaatcttgatggcgccgtctggtttcggcgtcttgtttgtcttggtcactttcttgggtggctcagtcgtggcgggtgggctgggcgtttgctcgactatgtcgaggcttcgcttgtcgcattgcaccgctagctttgcgttcccttgaatagtgattgttcccttcggtcccggcatcttaagcacttgatatgcgtagtgagatgcggccatgaactttgcaagtgcagttctcccgatgatggcgttgtaagctatatcgaattcagcaacatcaaaggtgatatgttctgtgtggaagttgttggcttggccgaaagtcacgggcaacgtaatcttgcccaaaggtctggacgatgattggggagtaattccatggaagagttgatcagttggtatcaactcgttttgcggaattcccatcgcgtccaaagtgttggcgaaaagaagattgattgagctaccaccgtcaatgagaactcgcgctaccttgatgttccgaatagtgggttcgaccacgatcagatatcgtcctgggataacgacggtcttggggtggtcttctttccgagaactctatcttctgctcagaccacttcatcttgggtgtagccccctgccatgtcgagcagacttcatgttccactttcttgtattctcgcttggaggagtacgttgtggaaccgccgaagatgtgtgagacgtggaggtcgaagtctggatacgctgagtccggttcgtgaggagctgtctcttcgttcgtctcgacaacgtgtactcacttgcctttttcaaatgccatgtgcttctcgagcgactttttgaaaacaaggcaatcttccagagaatgtctgtccgtcttgtgtatagggcaccatgatttctttgtgtcgctgctttgtgggtctatgcgtttgggagggttcgcgtattctgctgcgaggacttccgcttgagctttccttttcccgtttttgcgatttttcttcttgcttgactcagatgtgtccgtggctggtttcttctctcccccggtcttcggcctatcgttcttgcgtcttagcgcatcatcagcgtgggcgcatcgctcaacgatctcgaataatctccgagtggttgtgatgcgtcttgtcgccaactcctgggtagtgtagcgatctctgacaccggatttgaaggcgcgaattacagaagcgtcggtgatttcaggaattgtgtttctgcactcgttgaaatgtcgaacatattccctcaatgattcacccgaattctgtgtcaacgcgtgtaggtcgtcttcgatcgcgtggcgcttgtatgttccttggaaattgacgatgaattgttgccacaggtctgcccacgaagagattgagtagggaggaagatgcatcagccatgaacatgcagaacccttcaacgcggttggtaaatagttcgctaacgcgttgtcgtctgctccggcagcatagagtactgtggagtagacttgaaggaactcctctgggtcggtgctcccatcatacttttctattgctccgggtcggaatctttcaggccatcggacatcacgtagggaacgaccgaaagccctacacccagcgttgggggtggtgggttgccggtggtcgtgtgtccttgtggatgtctgtctgacgatgaggaggacgcggatgatgacgatgacgatgggtcgcttggttccggcatacgattacgaggatgatggcctggatctcaggaatcctgtcgtcgtcttccgctgttgtctcggcgccgatctccatcatcatcgtcgatacggcggcggccatgaccagtattgtctagcacccgtcgttcgcgattgttgtgattgtggtggttgttgtggtcccggtcctcgtttgagcggtctcctcgatttccgttatcatggcgccatgaagagacatgacgccgagagcgattcacgttgtctcgtgtgcgtcgtgcttcccagcggccgttgatttgatctcgaagatcgccagtgccgcgaggagaaggggtagcttgttgaggtgattccctccgttccggatcttcaccattggcctcgctagttggtggctgctcctggtgtgctgcggtagcggcttcttcaaacgcgttgctgaggttagtcaccgattcccgtagtcgttctgtccaacgctcgaggtcaacgttcagaacaggatcgtaaggagtttccctcagtatcgcttgaacggccctgatgtgctgggctggagtagtcgattgattccccgcttctgtgttggcgtgcgctgacgtgccgatgtcatcgatagccaatacctcccgcggcgcactcgttgtcgatgacccatagtcctcgaggagatgtaagaccgatggttcgtgaggatcgatatcgattaccccaacgaatcgatctgaagttggagtcgctccttgttccttgccgttatccctgatggggacgtatgacttaggacactgagctttcatggcactgagaaagactttgcagctcgagaggtcgtgattctttgtcttgtgaataggacaatagacatcccgagttggagaagtacgctgaattccacgttctttgcaggcgcgaatttcagcacggacgttgaggaaaacccatcaatcttgcagagtgtgtttcttggttttgtggataggacaccaagaccttgtggcttcggaagtcatctttgttggctcatggttcatgtcggaaggacaaggtttggccatatcagaatccttcttgagcttggatgccatcgatattccgttctccgtctcgatgggaggatttttcgacatggaatcgccttggtttgtagccactgcgttctcgtctccggtcattggaggaccggttgagatcggcgtcgtggtgtaaaccgggaagacgatttcgccgacttgagtccataccagcattgttgaagcagggagtacttggctgaggctggtgctaacgttgttgtcgacgaagctagatgacatagtagtagaaccttgagtaccaaagccccctacctggcgcgccactgtcgacggatgatacccgtagaccggatatagagggtattggggtacgttggtacaaggatctacgtagtacgacatcaagcaaacaaaagacaagaattatactggttcaggccccttgataggtaatagccctaatccagttgatgtgggattatatggtagaaaacacaggttacaaagagaataagggaacttgtcggatccggcgagattgtagtcgagttgattcgactagctctcgatgacttggctcctcataagctccggcttcgtaggctgtggaggttgtgttggctctgagattcgatgtctaaaccccccggggggcccttttatatcgcagatgaggaggtctcctcatagaactcggaggtatcagaccctatacgatacgccaacgacccagttctgcccgagtaggattcttcccatctatagattccatgaaaggtttccttagaatatacatgaaatatccgcctgcgcgtgggtatgccatatcgatatgtaatgtatatcgaagggcaaaggatatgcctaagccgtaaccctgacagtaagtgacataacatggcttcaaatttcaagtctcggagtatttgacagctctgcttctaaattctgcagataaaaaaaccactctgtattgaagcatacaaccagtggtattattattaaaatttatataaaaaagtagaaatgttgactattattttagaaagaaaaataacacgctacatctttttgttgatttgagaagttcagttcgagaggtttttatatcccgataaatatccattaccttattcgctacgatttgtattcgctctgtttttatattctataatatttgattccgtttttatatccggggcttccgattcgattatgatttcgagaaaaatatggaaacgaaaacgatagtgttggtttccgtctgaaacgacagtgaatcaagaataaaaatatagggtgagctcatagtatatgtcaatagaacaaaaataaaatacatatcgttgtgcaagttaaatttagtgcatacatgatcaaataggaaaggaaaaagtctatttactctcttgactatggccttagacgaaataacccctaacatttaatttgatttacttaacccctggttctcaaatcctgatactattcacgtttccaacataatgcaaaccactttgttgatgtggcacatgggctagtgaaaaatgacgtcatcttcttaacctagtgaaacatgatctccaaaatatcctctgatctctagcaactacagcttgtccctatgcaggtatgacatccagatttgagaacccagaggttaataagtgaaccaattaaacgttagggggttatttgttccaaggcccatacttagggggaataaaatgtatactttccgataggaaaggaaacacataaaaaacaacggagtgccttgacaaggcaatatggatggaaaaagaaaacagtaacagaggcactgctctttatgcaaactataacaacgactaattgtaactgatgagcgaagccacggctgaattgctcgaaaagtaattataagtaatatagcttacttgttcatcgcacatttaccaataaataaaaaacctacagcacataaggctcaatctacctgagtgaaaggttaatctcacaacattaggagaatgcgccacgtcatacaaacattattagccgtccgatactaacaatgaaactttgcaaatggtaaaaacaaagtgcttgcatcttcgtgagacctccaaactttcaggagaagcttggcaattcaccgtgagaaccccgatctgagaagcccaagaaagaaacgttcaagaggtgagggaaagaagaaaaataaagaatttttaaaaaataattaaaaatctactttaaattatctggactcaaataagtataatacattgaaaaaaatattcaacgattatgcaactgtttgttcttcatgattggtgtcttttatttctataattttatttgaactgcactcattccgagcgttaggctgtaataattggttgtaactcgttgaataaagtccaagatattatattacattatctaaaacaaattctaatgaacactctataatgttgataattttcgatggaatacaatgagaaaagggcgagtatgagattagcatttatgctagctcttaagtctagatcaataagagggtaatgcaatagagatgccaggaaaatgatggctcaagctgcagtgaacaagatggttatccatactccaattttaaagtcaagtatatatttttaacaagttattatagaatggttagagtcgagtgaatacgccacttcatgaactagctttttctcatggatgataaatcccctcgtcggtagacaaaagagtagaaactagaaaggaatagagtgactcattgtgtcattcaccacaggtccacagtgcataagaccagcaacaaagtatatcagcagacaacgacctcctgcgctgcatgttggctcgctcggcgccattaggggtgggcaatttccccgttggggcctgggatccggcggggacccgcccctacggggacgggggcgggggagaattctcttccgcgggtgagtggggacggggccccgcaaacttccgaggatgaggacggggatcggaattaacccgcgggtgactcggaggggccgccctggatgtgagttactacttctctaaaagtagctcattgcaataatgtagatctaacaaacccattcaaaattgacatatgaaagctcaacaccctagttcccctcaaccataatccctttctttcttcaaccaacccacacaattgggggctattgaaattttatcataatattatttagagtattgcaatatttttacaaagtattagctccatccgggtgatgcggggccctggtcacccaccgggtcccctgtgggggcgggaacgggtgatgtttttcacctgactttctttgcggggacggggccaggatacccgcatgagggcgggggcgggggcattccgacccaacccagccccgccccgttgccacccctaggcgccacggtggcctgccccctggcggcccatgccatcgcggtgttacatggcaggctgttgctgcaccgatgcaactgttccctcccagctcccgcagtcgcccatccccgtcgacggccgagcaagccgttcaaccctcccacccgtaaatcatatgggatcgctaggccggacctaatactataaacaagatggtgtgggcttactatattaaattgatgaattggaccatgtaatgtgtaccgcttcgcctttcttcccccaatcgcagtcactcgacacactcctgttcatcttcctcaagcagccaatgcatgtttatctatcctcggctgctgctatgagacatgcttaagtctaatgaagcctactttactcctatcataactggatggtatggttaggccgatcaatttggctactactaacaatctcatgaaatgtcgacgtataacgaggcttcaggtaacatcgcccgatgaactatggttagactcggctaaaaaaagataatgcaaataatgacatcaattttgcttaataataaagcatcatatttttaactggttgtgttcactttttttctcactatgcaatatatgatgtttacctcttatctgtatgcaagtatattggtatcttccctaattccatcttatttatttttttcctttttcttatgtgttaacttggattaatatttttgttataattaaatagataataagttgtttttcgatttttctcatatacaacaagtatggaacattgtatgattttcaaattatattatataagtgtatggaatataatgtgtaagattaaaaaacttagtataagatttgacgttttcttgaaaacgtggcaccataagtataggtagtctcataaatattggctatccatataagaggactaccataaaaataatatagtcaaaccatttctcaactaaacttgtcaacagaacttcgagagaaggtaagaaaatgaggaggttagttaccaatcccacacaagggaaaatattgctcacacgcattgtatgacatatactcccattaatcaataatttactaatattattaaatttcacaacgtttaatgaaaatttgttcttttgtgacaatgtggtgcgagactaaaacttgaacaccatattcttctgttgtttcttattctttattgttgataataatatagctggaaccagccactagcacttcacctgaatactagcagctagttcatgtctatgtgctctatattatttatggttttaaatgagttagtactaataattgtacttaatgatgatattgtatgcatagaagtagtattttagaacttgagatatattttttctaaacataatttagaatactccgaggaattataatgtagagcatattatatttaatgatacatatattcattttttatggataatttaaatattgacatttgttataaatccaatgatcgaagtatactataaatattgtataagtgactttcactatttactaattacatgttgttagtttttgtctatactagtttctttctataacagactttgacgatgggttgtgtttttagaattttttaaatgcgtttctttaaagggatggagctatattttaaagcgagtttgattgtttagaagtaaagaatacgaatgtgcgttttttttccattatggttgattttttagagaaattttccattattttagtttttcttaaaaaatggtacttactatgaaaattccttattatatttttagtatattgtctatataatattcttatgaaaaaagaaaataaaaaatcgaactatggaatcaaccgtgcatattatataatatcccattatagttacatcatcccataaaattattcaattaaggaaaagtaattagaagtattctctgcagatgcaataaaacttccatcatagcgaaattaatatcactaatactaaaattatgattttttttgaaattataaatataaattcataaatattaaaaattttattctcattaggatgttatattgcgaaaaaacattttaagaatgttaggagtgattacactgcacttatacctcataattggtattattaataagaccgataatacatatgtacccattattagcataagacaagagtaaaccatgtttgttctaataaaaactcttaatggtttgctaatattgaggatattagtataaaaaatttcagtttatggatgttttgtaaattggtttttatttatttaattaattataatatgaaatctaaactttgactgcttttaatctaaacattatcttgtgtgagaactcattataaaactaaggcagataaaacgacgtttgaattggtttatatatttttggaatttaggatgtaactaaaatggggtgttgttatctccggcccagtcttccggaagtgctcataggggtagggtgtgcgtgtgtgcgttcataagggtgagtgtgcgcacgttgtgagcgcctgtgtttgtactgtgtttctcaaaaaaaaatgtcgaagatagattttattaacataaaatttgctccacttagaattccagcactgtcaaactattgttttactcgtgttatagcccgagtataatatatactatgtcacattgcatggacatatataactgaaatgaaacgttattatctccttaaatgtccacaataaattttattaacctaaaacttgcttcacttagaattccaacactgctaaattattgttttactcttgtcatagcctaaggctaacatgtactcagccaaaatacatcgacatatataactgaaatgaaacgtttttatctcctcaaatttctaagatagattttattaacctgaagcttgctccacttagaattccagcactatgaaattattattttactcttgttatagcttgaggctaacatgtattctgtcaaattacatggacgcggactccacgagaaatatcatatcttgccgtggtcaacatcacacaaagaataagcttcaaatgtgtatgtccggtatctctattctcgcccctgttcgtttctgtgaagtaaatctggaggttaaattcccgtcaaaaaaatctggaggttaaaacacgacaagaggatatgacaaatgttaataatgcatcaaataatccaaatggcatgtagcctaaccccaagaatgtttttagaacacgatgctttacatatgtctagaacacgaatcattaaaataacgtctatccatgtcaaccatgaaacaaaacgaggcaacaatcacatgataggatccttatagccacacgccaccactaatttgcaagatcgtgatggaaaccggtgtaaatatgcagggagtggagagttcctaacggtttgacgaagtgaatcgaactatacatggtcaagttgaggaagctcaccagacagagaggtaggtggtggtggaaccatggaagaatttagtgttgggccttgttgggacgcaagtccctagatccatccgctagatcccaagcaccttacttcactagctctgtgatagtttggtatacatgtcattttggagaaataagataactagatagaagtactgctttgttcgcttggatgccttttaatctagtcttatttgctatgatatggcccaattgaaaatattttagctattgttatgggctgagacctcatgattggggaatggtgtgaaattaacgagtaagacaatgtggttttcattgttaattacttatcaacaaattcatatgaatgatctgatttttgtttgatggtcagtggtgcttgaaattaataaagatgaagattaagttgacacacgtaaaacaagaaagctattagcacatgatttattaatttttaattattacaaatttgacaaatagatatatttgatattttaaagcaacttctatataaaaagttttcgtacgaaatgcactgtttagtcgtttgaaaagcatgctaatgaaaaccggggtaaaatctaaatattaattagaaaagtgagtttatttcaaacatagcgatatatacttggttcacttatctatacatttagttcccacctttgacactttattttcattctagttttgtcactgggtggaacttggccttggcggctgacagcttcacccaaaacccactcgcctgactaacgggatgcctgccaaagccaataaaatgattaagaagaatgaataaaccaaaccagccaatggagaggagggttcatgcgaggcactcgctggaaggcctgtttggaaaaacgtgagacttaaggcttgtttggaaggcctgtaattggcccaatgctagtgtaaaacacaagaccgtaaaatcttttccgtgtaggctaaaaagcccgtttggacgggctgtaaatcataaaacattaggactaagttcaccagtagtccctcaactttacccgagtctgtctgaggtcccctaaccacgataccagaaatatgtacccctaaaccatgtaaaaccattcaaaaaaaaaaggtcccgaggtagtatagaagtctggtttcgctgacgtggcatcttactcagcaaaaaatataaaataaatatatgggggcctatatgtatgtgagagaaattggtatgggacccacatctctcctttctttttctttttctcttctcttctcttgttgattctctcgagcagtcgagcgggcgcagcgacggagggggggagaggcagccgacggtggagcgggggcagcggcggatggagagggggagagatgcggccgacacgatggtggctactgtcggtgactagaacggagggggctccaacgtcgatgaccgctgcttcgaggaggaggcgcggggagtttagatgaaggagatggggaggttggcgatcatggcggggatgccggcaagcatgagtggagagggaggcgacgaggaggttagcgagcgctcggagagggaggaggtgggcgccacgccgcacctctccctcgcg

SEQ ID NO: 10719 - DNA, 21973 bp, Oryza sativa
  unsure (1)..(21973): unsure at all n locations
cccccgctccgtcgccagcaacctctcccccatctgccatcacgcccgctcgactacttgagagaatcaacgacagaagagaagagaaaaaaaaagaaaagtgaaatgtggggcccacaccattttctctcacttacatgtgggccccacatatcaattttattattttcctgactaggatgtcacgtcaacgaaaccaggcatctatactgtcccgggaccttttttttttacgattttacatagtttagaagtatacatttctggtattgcagttaggggaccttatacagacttgacgtaaagttgagggatggccggtgaacttattccaaaactttacagccgttttagcatgtaaattaaccgcagatggggcacaaatttttatccgtccgatatcgaacctcgcagcctcgactgccgtcgagcccgctactccgtgacgctccgtgctctgccccgccgccaccgcacaccactctccgcttcgtttcgttgttgccgctgagtcgccacgtctgcgccgccccatcgccggcgccgccgcgatccgttccgcaaccatctctactactctgcgccacttatgcaaaccggcctcgatcctcaccaccatctgctgcaccagcgtcggttcacgccgggtccgttgtctacccaccttcgctatccataagggaaggaagagctgatacaagcggagagggaatctagggcgagaacgatctgcgccgtcgcctcatactcaccggtccatactctgcctccgaccctttatctctcgtcccagcttctcctttctctgtacattcagcccacatcattggctcattgcttcaacaccctgcgagagattcggcttgcctaggctccgtatcgatatggctttgtgattcagatttgggtctattcatctttttccccttcgccatgttcgttctgtttcagagttcgtttttgttgcaatgactagccagatagatgtcttacccttaccaaatacccaaacggcctgaaaatttttgactgtatgaatcctcggtgttcccaagaataaaagtgaaaatattttacaggtgaaaaaaaaactgtattcccaagaaaatcttccttcaagaactgttggtaaaaggaaatgtgcgaatgaaaattcatttgcagctggaaaatttctgttgtctcagcaatagtttcaagaaaaatctaggtcgctgctcggtgaacccgtcgatttgttcagcttaaggaaagaaaacgataagtgacagaacatggcttcaaatttcaagtcttgcaatatctgacagttctacttctaacttgtgcagataaaaaaagtactcctgtatcgaagcagccaacagtcatccgagcagcagatgccgttcttattttcttgggcttaggtgaggcgcagttgttctgcaaagaggaattaatggtttaattaacaccagctcaaaattccaagtggatcggcctgacttggtttaagctgaatttgagcccatgaggtaatcaaagtttgggccaaacatgaactttttggcccaaaaacttgtcgccgtttgggctattaccttttttagagtatgtgggctaatactccttaccatattccgttgcagtcgattccattccatacatcaacacaagtcgaaaacccttcaggagcatcggttggatacgcgccgcacgcagccctacagcctgctgtcgcctcccggagcactcctcctggtccctggtaaattaactaggtttaattcctccatgcctctgatctcgtatttcttattaatcgatttatcattatcattagctctaactaattcggatttcgttgcatcctcgtgatatattcatgctgtttttcgttttgcgttcgtttgagcaagatagattatagatggataaacgtctcctactctctcatgatcaggctatctggaggcaggattaggagcacaggccatggatgagaaagacggcaacaatggccgatgcaatttcagtacggaagatcctggggaggacaaagccttcgctgcctcgcttgtagatcaagatcaggatccggatcctactgatgctgccctactggataatgagtgttccagagttgtagatcaagatcctcctcctgatgctgctgccctcctgtatgatgagtgttctgcagcgtatggtgctcatgtagccaagaagaacaaatccgaggcaagtcatcttgctggccgaccaaaataaaacactacttttgaatgctactactactgtttcaggatgtgtcctgtatacaaaatagtggtctgattccatttagtgacgcttaattcttgtacatgaacttggtacttgcagtgcatgcgggtgtcggacttgctatgaaaatagatttgccgttggaacttcaaagttataatctagtataccatcatgcaagctccattagcttatgaatgatttcaaataagaccttgaccacataagatgttctcttgtcacttctgcttgaacacttagcatgtcatcttctttgtgacgactcgtactgttatgcgactctccttaccttctgtactacatatatattagagagcattctcacatttatattttttttccatgttaggtcaaaggagcaaacgtggaaaactgggcatgtgtaaatttttctttaatgggtactacagaaacacagaaatttgcatctgagctcaaaaaagcgtgtgtggccattgggatggtaaatccgtccactctttcctgggcaccattactttggcaacatgtgacacatctgacattgactttacataataggatttgaagtctgttcatgcagtgttcgtagacttgaactctcccaataaactagaaagtactttgcatgatgtgcaagaactgtttggcggacaaggagtggaagtaaaccagataaaccttctaattgtaattcttccagaattcagacgttctgatggtatggaagttatgatttgcatcaaccgcacctttatattcttttttttttgttgacagttgcatgcgatgttttgcagcgaaagtcaaagatatctgtaagaaccttggattcttatatcaatgttgtttgcctgagcatgctaggacacccagcaagctatacctgaacaatgttgctcacaatattcgttccaaggtttctctctcattctgtttgatgtgttattgttcttttttccttttgcacaactctcatgctagagtttcttaatcatgttgctgagggcaaaacacttttttgttcttgtgaggagaagagggtaaatggcgactctgagaaagtctatggttctgatgagatgagagaagatagtgagtcagatctaagtgatttggaagatatgggagatgctgactcagacatcatttacttggaagcattccctacatcagatgaagagatggatgatgatgatgattatggtgatgatgatgaatatgtaccagtatctcctgatgaagagatggatgatgatggttccgtgcagcagatgagagagaatgatgaattatgtaaacagctccagcggctggaagagaatggacatgaacaggccgccaatagcgcagaaggctgcctcaaaacctacaaggaaatagagactcatacagcgttagcaggaagtacttattctgagttaagtgaaccgccttcatttgaagccttcctgtgccctggtaaaactcagtttctggtctagtccaaagttaatcaatctaccctaggccagcagcttgttcttaactcttttgtatctcccagtctagtccattcacctttcttaataatttcgtgtggcattcgttgtgccctttttattttgcgttgattgtcctttcttgtttatgctttcttgcttcttcctctgtctccaggggaacgcgagcacattctcaagacaggatgggaaacacaacatccatacaagaagcctagcggcgtgtcttgggatgagtactctaaggtgtttgacaccaatggctactacaaactcagcaacatgcctgtggaggataaggacttggttgctgcagaatgtaacactcctgaagtgaggcgatgggaaaatcacatcagtcatgactatgatgagctgcaggtattgctagttatttagtacttccttcactcataaggttgttttagaaattaacactgtcaaaagatttctgttcttgtagatctattagacctaatggacctttcgataacaatttttactatagagatatgtgcataccattttcatgctatcaatctgaatattgaaaaggacattgacaactgaagtttggaaaatcttttttgatcaccacctcagcctagcaactgttgtaaatttgctactttacttgattgatgccatgatattgtggttgaatcagtgtgttcttctgtttcggaattgtatatatttggtttgtcgattcaccttctttcttcaatgttcaaataatgccgcgaggacaaatattttgctgatgatgttctaagtatcatcaaacaaaatgtcatgcatactcaaatcaaattatgcatcatatagtcctcggatgagatgtgcactataccagcttgtgtgttacaactcttgtatgatagttaatgttgcgtgcttgatgcgagtttgcaagtcttccaacacaaaacaatatgagaaccacataatcggaaagttgtgttcaaaaccagggatctgatagtctgaatataatatttaccttgaacagttgacaaacatgattggggcaacctaagaacatacttggctgatggattcttggtatagttttaacgtttggggtttttggtattttcactgctatgcaactctctttatctctcgtcatgattcataatatctttatagaatcattctcaaacaggcatttgttcccttttaggtcgaacgtggaattgtgagacgttgggcatgtgtaaatttttcacctaagcgtaaacatgcagcgcgggttgtcagtgacattataggaaagtgtatagacatgggaatggtaaagccctgcatactttccttgaacaaggcattctactaatcatgtaccacacatctgacttaatatctttgtatgataggaatttggtacattaccaaaaatggatgtcgatgtaccccttacttcccttcatatacgacgtactttgctggatgtgcccaaaaagatagacattctaattgtgattatggcagatgatagaagttatgatggtatggaagttagttgtgtcaggttcactgttgattttcttttttgacagttgcatatgatatattgcaggggaaattgaagagatgtgtgagagccttagaattgtttatgttttctgtttaccctgcctaagcaaacggaatctgaagagagttgcacgccaaatacaattgaaggtcatttctctttggtctcattttgtttgttatagtgttatcatgtttttggtttattaatcaggttgtaaagagttatgtacgtcgtcagcgactgcacttaccccttgtgtcagaagtcccaacgattttttggtgctcacacgatacactatgatcttggagaggattcagaggcaggagtggattcagagggcattgcatctgtatgtctcttctgtaactaccatctcctggatttgcgttttgttgttacacaatccaattggcatcatattttttgttggagtcatgtaggtggcggcttcattggactggccaaaattcagaaagtatcatacattaatttcacatcaacctcataatggcatcataaatctccattctagacgtggtggcatgatgacgtaattctgtgttctacataatctgtagctcaccgtcactttgatccatttggtgtactaacatttttcattttttttccagcaagttctttcggtccttctacaaaatgataaaagaaagacccaagaggataatcttctacaggtagtaatacttgtattccttgattagtgtgatactattagatatatgctaacagtgcaacatcttgcacagaggtggattaatggaaggtgagatggagcgcatttgcctgcaagaaatagatgctattaaacaggtaggaatacaatatgatttgccttcctgtatcttggtttgacttgctcattttgatggttttgtgcttcttcccttgaaaggcttgtgcctattcctacaaagaagatcaaccatcactgacatatgtggtcgtggtgcctactgcatcaattggttagtgtgtttgctgattctgcttgtagtatttcctttttaccgagtgaggtgaatacacatacatgctacttggctttggtgactgggtattgtttcataggaactgaggctgacaccgctaagtataagttcttttgccgccatactactcataaggtacattttagtttggtgaatctgcaaatatactcataaggagttgtctatccttgaaaaaaatatattgagctagtattggttgactgtagtcaacctcccgcgtggtccgctaccacgttgtccatgacgacaacaactttctagctggtgaacttcagtctctaaccttgaagcttttcaccttgtaagtttcacagctctacttttggattgctttgctgtgatcaactatcagtaggcacttctgaccatatttgcaaatgcatgttcatacccagccgtcatcgtcgggaatacccaaagatagatgcaggtgagtccttttatactacctatcaatcaattattcttctttcttgtgtctgtgttttctttaaaaaaaaaggtgtgggggttccgtgttgtcgaaagggtagggggtattctggattttggaaaggaaagaaatgctgctccaattggttgatgagcacaaggggcagggcatgtccttttttgtgatttattttttacgagtaaccgaacaatgagggcatgtccttttttgtgatttgtgtgggagcatacattttgcgctagtaaacactactatccaaagtataatattttttttgttgtttgaccaagtttatagaagaaacgataatatttgtgatatcaaatgagcatcatttgtagtttacttatttgacatggtcgatgtattctttctacaaatttgatcaaacttaggatacccctccttttccaattgatcatcgtacaattgttttaggttattctgaaatgatcatcatactagtattcattttttaagtctattcattatttgtgcatggaagtaatggacatgtgatgtcttgtttgttattgggtagaacatagtgaggatggctcatatgagtttgttacctcagtaaacgtagtttttcttggtcttgttgcactcatgtaatataatgataattgggaatggagggagtacttcctagaaatgcttatattgtatgttctgcttatgccttgcacatcggatcacttatgttttattactcactgcttattccattctatctagttgtaccggcctactacgcagagcgtgctgcattcaaagcttatcgcgcagagtgtgctgcatccaaagcttcttaagaagagcaaagcgagatgagaatgttgctactctagcaaaaattaatcagatgtttatctaacttattaagatgtctggtgtattttgaactcaaaaacgagtgtgcatatggtaacctgttaccgctgttgatcagacgtgttatggcgcttgtttttgttaatagttcaatgctgcgggttttgaaattgcatgtagtattggtcttttttaagacagaacaatccttgtacattttcaaatttaatatttatatatatcatgatttgaatggaagtactatctccattccaaaatatagcaatattttttctatgtatttggatataacattgtcctaatagcttgaagtagttatatttttttgtgctgaacatggacgcgttgcacgtgctccggttgtccggcacaaatccatcgtctccgcctgtggtgttcgataggcagcgctttcagtttggttaatatggctgctcaggttggatttgcaaggaaggagcgattgggtaagatgaaacctggaaacgatttgtgccgatttgagaatttggggtcttttcgccatttgcgcaaccaatctacactaaaaaaaagaatataaatccaccagaaagtgatgaattgaagccaaaatgataaaagtgatgaatagaggacaaaattaaagatatagaatgaattctaccgggaaaccactaccagaagaccgaacgatacataacacacctaatttcactgttctacgtctatttttcgaagtgtttgcaagtatgagcggcaacgggaatcatcggaacctacaaatgtacaggttatgtacattaaccaaacatgcacacagagattagtgcacagctcgtagagaaaggggatcagatgtaatctgacagaactgatgctgagacccgcttcaaggatgaggacactttggagatgtctgaatcggtgtggccggctgacatgaagaggcgtattccgacgggaagtttgcacctatccaaaggtgaccgctttgacgccacgataaaaactgaatcttccttcaatacctgttggaaataggatgctgtaaatatatgcaagtgaaagttcatttgcagctggaaaggttctgttgtgtcgacatggacttaccctctcagcaatagtttcaagaagatctatatcggtgtttgatgaacccgtcgatttcttcagtttgaggaaaacgataggtgacagaacatggctggaaatttcaagtcctggagtacctgacagttctgcagataaaaaacatcgaaggcatcaaggtgatcagcaggcaccagtaacgacatattatgcctgaacaaattcaactattgaatcccataatgtgtttcacaatttcaatgcagctgttttgaaactaccactaatgggaaaaatacatgataaaagtgatgccacaacattacatgctaggtattaaagcattaaaaactttacatctacattaatcacattaaaaagtaagtaaatgttggtcaaataagtatataaataacaagataatcttcttaacctttatgcaggaaagaaatgttgctcctcaggtctgcaagaactgacgggttcccctccaggtagctgacagcagaaaccgcagcgctggcaagataaggtggcagagaagccgagaaaacatagccagaactgcttagacgctgcaaaagcacaataacttaataggtcaagatatttaacaacattctattgcaattgattttccgtcaatctagagttgcattacctgatgatcaacaactctaacacttcctgtacaaaagccaccatcagtagctaatgcattccccattccagcagtgataatatcaattttgtcaatctgcacatgcaagaaaatgtaagaaataagatgtgccaatatatccaattaaaatggtcagtaacacaattttcataaattaacaggtgtctaccaggactccatggattatacctattctttttaatcttctactttggtgcgatgagagaacaaaaatgtcaggggtactcactggaactccataatgttcagcaaggcctcgtccagactggccaagcacaccaaaagaatggctttcctccagaataacacggaatcgatatttctccttcaatctgacaatctcatccaagggagcaatttgaccagaattctgcaatcgtcacagtaagagaggatatatccaaagtcatatgtttaaacgatttcatgattttctaggtcgtaaaaattcatgagaaaaatgagaaaaaaccatactcatgtccaatcagagttatcataaaaggcaccacacctggtagatagattctacaacaatgtatcgtctgatcttttctgctcgtttatttccacgtgtaagtttttccaaagtgtttgcaagtgaagccatatcattgtgtttaaaataaacaacagtgcttcttgacagatgaagaccattttgcactgcccagtgcacaccttcatcactgcaatgcatatagaaaacttgcttaggttcaaacatgaaaaatcaagaaaagaaaagtgctacctagtaaaagaactatccaggtatggagctaattgcatgaggaagaataacaactaaagaatagatacatgtaagaggtgacaactttgaagatcacaaggcagacatatacactactttctaaagggtttgtgcaggattttcattctttttttttggttggggggggagggggggggcaagaaagcagttttcatttgatttctttcttacaaaaggcaggtatataaaaaatgtgaataactaaaacatttatataagctgttgtactgaaaaaaaaagagaggacaaactctatatgtgccggtattgttcatattactatgtgggcaaaaggttaacttacgcaactatgatgtctcctttcttacaaaaggcaggtatcacactaaatattgtagaaatcccatatgaatacagaattgagtctggagttccaagaaacttcgctatttttgcctcacagtcaaggtggacatctgcaagtgttccacaatgaaaagataagtttctcttccatatttgcaacacagatcagtggtggcaaaaagagagtatacaaaccaattgttccataaaagccacgtggaccacaagaaccaacaccatatttctccagtgaaccaacacaagaatcctgcaattcacccatgtcaaatatcctggaagaagtgtcaaaataactcctaaataatagagttttggcttacaataatcttctcattgccaatcaaaccaagataatttgctgatgcaaagtttataacttctttcccatcaatggttgtatgtggagcagcagcactgtagcaagaaacgtaatagtgttaagacccccaaaactcaggagaaaaaacatgcaatgcccaagaattgcaggtattctgcaaacataaacattctcaattccagcattacacatccataaacaaggactcatcaaacagatgatatatcatgcattgcaatatctgagggaagggcaacaaaatgaatattctacgagtgagagttatttgagattggccacgctatgttagggatgctggaagttactcctaaatttgtattattcagaaagctgctgtccattattagtgcaacgcaagcacataaatggagtattgttgataactggataaagatacaagattataacagatggaggacaacttttataacaaaatactagcaagatgcatttggcagcatgtattaagtcatttgatgttcttattaacgtcgtaaaaagaagaggaaaaatgtttgagaagatactgcaagttacagaaagcagatggcgattgcgaatcaactataataacttcaagaaaagttagtctgcctaaagaatagaagattgtaagcatttggaaagcaagggatacatgatacttcaagtgattcatgatgccctgtattcgtctaaaatttgaccagatttgtggcatgcaaatcatctttttgcatgcagtatttgtcaagaataaaggttcaagtcaatattgccttcccacatgctgcactgcctagttaagttaaccaatgcttgagcttacaactgccccaatcctgtcatgctttctctcatagtttatctagtaactcactacttatgaaataatatagaggaatactgaaaacgaattatttcctgcaaggagctttaagaaactaccttcagaacagacactatcaaacataaaaacttccttaaagtaagaaaaaagaactcccatatggtgcatcaactaccgtttaaactttaattagaatgtaaccatcatacaaacctttccaacattggtgtgtcaattcgggccccatccttgatcggaggacacagaggttctggctcccattcatcacatagctcgtcaatctcctgcaaagatcaaaatgctaactttcaccaacaagttctggaaagcaatgaccaaaaccaatactctaacacaaagtaacagcgaggaacaggcagaagataactttaccttttcactgagtggcttcttgggcggtttgtagctcttcctagaaagctgaaacactatgaccgctataaggagcccttcaacaaccaggtgccctgaaaaatggaatgttaccgaatgtcgatcgcccttatcacatcacaagttcctcattgatgtggacgtaagaggcttaccatcgatatgaaccccaaagacaactgcgcgggcaaaaggggcattgaatgcagctgagacacgagcaagcaccgctgcggtggcattcactattggcaatgccatgtccatgtcctaatgcagcttttcgtaacacggaatggaaactttagcgcctcaaatctgccaaaaaaggcaatgggctgctcatcaatcaaccagatcggctgcagagcagaatcaatgttgaaattcatataagagtaaattttactttgggccaccttttactactggtgttttgctttggaccaccctttaactaatattttcactttgaaccggaaaatcttacctttgtgtcactttggagcacactcaaatcttttatctatctacatcaaacttgtcatctgtcaaataaattgccaggtataaagcggtgggaattcactgatgaatcggagccggcgtactcgaaatcgttcatatgcttgagaagagagttagggtagtccaaaatgcaacaaaggtaagattatctgatccaaagtgaatacgttgattaaagggtggtcgaaagcaaaacaccggtaataaaaagtggtccaaaatgaaatttatactccttaaggtcaaggattgaactatagacacggaatgtaatcctcaggtccaggggcgaacgatacgtgcgccacggcggttgatactactactctactagtaaaactaaggctactaagaagacaaggtgaaaacctagcttccagatctagaagagaagataaggttactgcaaaattcgagagaaggcgtgggtagaacgggatggatggggaaagagagaggatgtgaggtcggcacgggtgctcaccggagccggaagggaagcggggagcaggacgacagcacccggtcaccgctgctcgtggaacggatggagatcggcgcggcgcggcgggcgaaccagcgaggaggagacgttggggatcgacttgggcgcaaaacgagtcaaagaggggagaagagtatgcggcggccttgcgacggccagcgcaagccggatgtgacaagtcaagagagaagagacccaatccgttatgcttgcacgttgctttgttgtttggctttccaaatcacgttttcgatctgctaaagggccgtttggcacgaccttagactctagcttcatctctactcaagttaaaaccaaaccaaacgattaaacgattttagttccaccttaaaaaatgaaactggctaaaatgctctcacaatataaattagagatgtgaaactatgtttatgtttagtctatttcagacctaatttttaaagttaaatttaaaagttggtgttctattaaacgggtaagtctatggctttccaaatcatatttttatctattaagtctgggagtgaccgaaataaaccgaagtagcacaatttatatatgttatttggtggtcacttatgaaagacgatatatagcctaaaatagcgcaattaataaatcatttgtcaatttaatttaatccgagacgctttttaagtgaatatataagaagactgcgaagaacctatgttacttatttggttttcagtgatgtatgtagatattataaaatgatataaatagttctacaaatatctgtcacgacaattggaccaggtggtgcatgagtttttttttatccagagcataggtggcggtctaatctagccactaagatatatatttctatcaaacttttatacttgggagatatttctagtcgtttctttcatatatttttttggccttgtgcattatatgcagaggtcggggatcactcagttagattttattctcttgatgtaatgttattaactaagtttaaataaagcttacattatttaaaaatatatatgtttttataaaaattaaagtgtgataattattatcaatctgatggttataacacattataaatattgtttaagtactttttaccgtctacatttatatgtttgtttagacgatttaaaattgccgatgagttataataagtcaacttgtaatttatatataactagcaaattgtttgtgcgttactacggtttataaaagaacaatgatacgattgaagaccttttgctaaccttgtgcacagtgtaggaagaacattaggaattttcagagttgcaacaagtgccaaaccctaagttgacacccttgcttgtggaattcaagttgcatcaccggaagcttgggtttaaaagaaactgacatggatgggtttggaacattcaaagagtcacgaaccggtttcataattgcaaacctaggttaatgggcaataaaccgattgaaatcagagaggaatattttctcaataatagaaagccagctaaactgaattgtgttcattgtgttgaactgatccagcaatgggaccgacggcggttcaccggcatcgacgatggaggaggccatgacaggggcaggggcggaggtaggcctagggtagttatggcttgactccaaaatcatgttgaaatttcttaaactagctgggtggcccacgcaattgcgtagctagcacataacaatcatatattttttaagtatgattttacttaaaatttattaaatagatgtctcattgttaagactttaaaagaccaaatcttatcatcctcatgtttttaattatatagtttttaaaaattacaccaattgctaccccttatgtcatctccttctttatttgcttgctcgatctatcactatttctattcattcttcttggaacctttaaaaattggatttttacagtttttcgagtttattgtcacgttgggtttcgtttttataatttctagatgtctcgtcaaatgttgccattatactcctctatgtctcgtccactatctcttctctttattgtcattgagattttaaaaatcgaacgtaattatagtttaggttcatttttaatttctagaagtcccgccaaaccgtcagcggttttgccattgtactcctctacggctcgcccgctgtcttccttctttattgtcattgagattttaaaatcgaacatgattattattgtttttttttactttttagaagttctaacattggacttgtagtttcattttttattatttttagaagtcccatcaaacgatgtcactatatccctctgcagcccatccgccgcccactctttattgtcattgtgattctaaaattcgaacataactatcgttgcaattcattttttattttctagaagtcccgtcaaccgttggaggctctgcaactatactcttatacaccccgcccgctgcttctcctttttattattgtcattgagattttaaaaatcgaaaatgattatcaatatgttttttcttttttactttctagaagtcccggcaaccgctttacttgtttgcttcacggcctgcctgacgtccctccttttaatcgtcattaggattctatttggtgttttattaacaatttttataagtcgtatcaaccaccaccaactctactcttttataggcctgttacttaatttatctcgtcatgtgttttagatggtctttttttttcaatagtctttatttttgtcacaaaatttagttatttataaattttattcctaattgaaatcttttttttctatttcagaatttattttttcaaaaagatagttaatattgtattgtgttcttttaatgtttttattttttattttcaatttcatttgtttcaaaattgtatttctacttgagctctcttttagttttttctaattttggatattattatatttttttattcgaaattttaattaatctcgtattgggttcttatatggattcttcttttaacattgcttattttaattccgaatttcagctaattttaaattgtattcctacttgaactcttctttattttcttttgctaatttaggatttatttttatttttattccgaattttaattaatctcgtattgggttcttatatggactattcttttaatattccttatttttaattccgaaattcaggtatttttaaattatattcctacttggactctcgtttccttttctaattttggcttttattttatttttatttcgaattttgattaatctcgtattgggttcttatatggaaacttatttcaatattgctaatttttaatttcgaattttagctatttttaaattgtatttctacttggactctccattccttttctaattttggattttattttatttttattttaaattttgattaatctcgtattgggttcttatatggaaacttcttttaatattgcttatttttaattccgaatttcagctatttttagattgtacttctacttggactctccttttcttttttttttctttttcttcgattaatgtgggaatttctagcccctacagcgaacgtggtgtctcctttcaaggctattttaataatataatataatagatagatagatagatagattaccatataaattttacagaatatgaacaacttattagttaagccttagggttatccctattcttcgataatttctgacttcgccactaggccaaggagggttgagaggtactgcttctgggactgatgaggagtgccgagacaatggagaagtacataagcacctcgtggatgaaaacaccaagcagattgagtgattgatgtagcaattatgcaaaagaagagaaaaatctagacagttcatgtacgtacagatagggttcatgagaattttttattaagaaaactgcagatcgactcatgtacatatgaaaaacccgatcagacttcatacaacatatcaaaggttcaagctgggaggaagaactgttgtacatgctatgcattgcacgtagaatagttcttcgcgcagagtactatacaactatgcacagctcatgatcatgaaagtgacagcttgcagttaggttcgatcaagctattgtaatgtccacttgcagattaaagaagaacttgatgttattgaaaagcaaactattatatactaaaagttcattaaacttcctagaaatactttcaaagcgccacgtgatattctacaaatgcttctacgccaccacgtggcgctctaataaatagagaaaatcatataaattctaagaaaaaagcaaaacatccaaccatcaatttttatttaaattgatggacccgttattatcaaccattagattagatctatcgagtaattaacccctccctcctaatatctctctctgagtatgcacgcacataaaaaacaatcatacggcatgtacgtacgtataagcccacctataacagatttttacctttctttttctcaagtacttttattcactatataaaacacaatcgtggattagtttccttttgaagcacggcatactcatatgttacctcacctcacgcatatatattttaactcacctctttaaacgtattcctataagagaaaaaaataatacataaaccctgtgcccaaaataacctaatcctaagatttatccttaagattggattttattttactaagggagtattcacgagaaaaaaaaacataagtacgataaaaatcctaccaatccttcactcctaattctcaaattaataattaaaatatttttatgtttgtatgtaatacatacagttagaccagcccctcctccgtagctcctttcgctcatgtttatatgatagttaaacaggatttatgaattaaaaaaaatactacatcccatttaactatatttgaataaaatactatcacatggaacaatattataatccttttattatgtctttcgcatccaaataatctttttaactggcagcggtactatattcagttactgactttgatcgctaatctttttaaagaaatatataaatatgtgaactacatttttattaaaaaagttcacatggaacatattctatcccttttcatgtcattctcatttaaatagtcttaacaattagcataaataaatttaacaacacagattattctatcatatattatcccatgaacatgtataggtgaggaagatctataataatacaaggaaaataatatcaaggcccatgtaaaatcatatatttgcaaagaattattacttgcgcaaatatttttccacgtggttctcaccactaaagctattagattttctgaattagtgtcgaatgatcaactctgctaagttttaaaagagaaaattatatttgtaccactaaaatttagtagtactgattaataccataaaaacaccgtgcctactctataccacaaatcgattcaaaacttaaaagaactattttcattacctctattttctctatgttattccctaaagggcacaaagtatggaggacagggcatgctacgatattgtaaatactatgacaatattgctaaggtgatggtccagtgagaggtcactgttgttaatagagctcagttggcttagttactgatgcaatcatttattattgtaatgacaatgaatgttgaaattgtgccccacactgatcttaaggggtatggcaacgtcgatgcgaaacccatggtttaaggcataagagaagaaaaccatgacgggctatgttatgcttgatgcgttagaggaacatttatatataattttagtgattttatcatattaattgataaaagcgatattttttaatattcatacatagtttagtagatgacattagtgtcatggagcaggacgggctcagtaagtatgttgttcgcatgtatggaggttttttggtgaacagtatgtattttatggcgtacatatatggatattaggacagagaggtttctataaatacaagagatatttttaggagagattaggagagaggtttctatacatataggagattttgcagcatacgtgtacaggagatcaggattacatatctactccctccatcccagaatataagcatttttagagttggacacggttattaagaaagttgataggattaaatggggggggagggtgttgtgattggaggagaagtgaaggtaggtaggaaaattgaatggtggagggttgtgattagttgagaagagaatgttggtggagaagttgttatattttgggacaaattccataggctataagttgttatattttgggacggggggagtaataagtaagacatggacactgtgaagtgaagatggattctttattatattattgatatattaggtttatttttaagtataaatatggttctatctattaaaagagcacatacctttaagacaatggtaatatgtagtggtgatagataagtatatgtataaccgggataaagtaacttttgtttgaatatcatttgtctatttgacggtatacatattacttttatgattataattaaagtaatctatggtctttatagcgaatatggtgatatatgacttcttttaacattcttgccggcgcagttgtgcgggcttccttcctagttgtaataatgttgacaagtttctaccttttcagtagaaaaaaaatgtacgctgatgaattttgcatggaaaattaaagaaaaccacacagtaactgaactcgatgtagggctcacgatctgctagaaaaaagcagcattttgcctatgcttgataagaacatgtgaatccataagttcatacacattcagaccggcaatattcaacatcagaaaacccttatcccaattaacaaaaatccatatcctgatggcgcttggggaacagtggaaagccttgcagtcgatagcttattagggttgatcggcagcgaaggcgaatcaatcagtagaaagattgtaatgctttcaatttcgccctcatggaagctactgatctgtacatggcccatggatgcaaccgatctggacgtatcctcaattgtatcactttttgtagacttcttgaactattattagtgagatagaaaaaatgtaagaacaaaatcaaaatagagttgaaatatgttgtaagtataggggatatagatccaacccggtactagcatacctacctaggtttcatgctaacatcggcacataaactatacagcatcctcaacagtatcatgctttgtagacttctagaactattattggtgagagaaaaaattataagaccagaataaaaatagagttaaaatctattctaagtataggagatacagatccaagaatggtcaatgttaattagagttgaatggaagctatgagtcgtctaataattgatctcataagggttttaaagcatcattggcatgcttttatctttttaagaattatatccgtactcaaagttgagtttacaaattcaggtccgattcgagagttgaagaactagcttataagcatccagttggtgaaaatatatagaaactaggttttttggcttttaactagtagtttattctttagattctatagctatcgcttctcaaaacctgaatgagaatataggctatttggttgagctggatattctagaagtagttatagctgctgaaaacttctcaaatagggtattagctccaccactagggatgaaaacaataatgtttcaaggtatttgtggtgccagcttcccaatataagaaagaataaggaggatgggttgaccgaggaaaagttaccacatacccttcacacattggtgtctctcggcctattcacggccttcaccgtacatcgacagtccttcggatatacatgtcccgcagacacccacggtccatcagaccttcacacattgatgtccctcatccaattcacccccccccccaaccccaagcttggctacttgtgtttgatcctaaaatgaaaaccagggttgacgaaaacacaaggttgtcgttaggacctaggactatattccataaggagaagagcttcatggcaagagtaatgcaccgtgcccatagcccatagttccagcttccacctaagaaaaaggtgatgaagacacacataaaagtacaggccatccaatgcagagtatcttcgaaatggggaggattggtgaggagtagcaagcgtggttcttttttcgggtgtgaggaaaccgggactttaataggatgcacaaaacttgcaaagacacgggactcacctccttttctcctccacgtcaaggtttggcgtagctagaccgacgaggttactcgccacgcaagcgccctgtgaagggcctcatgctagcaatagttgcagtggtaaagcttcaaaccaagaaagagaccaagagaaacactacctctacaaatttgataaggtattttgacagttagtaaatcaaaaacacatatacttctttcatagtcagaaaccaaaccttgcattccattacattaattagttaatcaagaccaacaaaccacacgttacaaagtagagccagatacattttacatccctgacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10720 - DNA, 589 bp, Oryza sativa
atttcctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctggcattcgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggcctttcgcttgccctgctcctcaatcaaactgatgttgggcctatcccgggtgttcacgtgctccgtttcgatgttgtaagccagagatccatcggtgttcaagtagacccacgccaaaccgctgctcttggtcgaggattcggcactgtgcggcgccagcagggtctggaagatttcgcagctggctcgggtcacgatgtgt

SEQ ID NO: 10721 - DNA, 693 bp, Oryza sativa
accccaggatcactttccacttcctcgaatagaccaattggtggattcaacagccggttgcgagttattgagcttcctcgacgcttactctagctatcaccaaatcagcatggcaaaagaggacgaagagaagacagcattcatcatgccgttcggggtattttgctatgttaagatgccgttcggactgataacagctggggatactttccagcgcacggtccagggtgcacttagcaaccagcttggcaacaatgtcgaggcttatgtcgacgacatcgttgtcaaaaccaagacaggcgactcattgattgacgatctgcgggaaacgttcgacaacctccgacgatatcgcctcatgctcaatcctgagaagtgcacgttcggagtaccatcgggcaagctgctcggattccttgtctctggcagaggaatagaagcaaaccccgagaagatcaaggcaatcgagaatatgaagtcgcctacaagactcaaggaggtacaaaagctaaccagatgcatggcagcactaagcagattcatcgctaggatggcttaccacagtacatcttttaaattgctaactgtatgtttcgtgaaaaacttcttatatgctccttccgttttatattatttgtcggtctagcaaatctcactcaaaccaaggagaaatggcagattacatgggtaccc

SEQ ID NO: 10722 - DNA, 3017 bp, Oryza sativa
aatttagccaaaagcgcttcttgctacataacaattgatacgatttggccaaaaggcgcttcttgctacataacaattgagctacattgtttgttgagcgtgtgctttgagatatcagagctacataccagtgaactttgataaaggatcctcacgatttcttacggaatcgttggcgctttgtgcctcctgaattgttattcccatcccaagcacttccccagaaaaacagtgccatccagaacagaactgcaaagaatatgcgtatcctatcctgtaatcttgataacctctcttgccaacctgtcaaaaggaagaaaagactagtacatatggttaaatgcatgcatccattaagcatgaactacaatcctgagatacactagaaatatgttgcgcatgaaagtaataggtagaaccgtagaactagagaagaaaatacaaaaatgattgcactgctctactggctaaaagttaaaatgcatacaattattaagaactaggagtataaagataatgtccacaaagttcaccagagattgactgttcctagacacaattccttgatagcattgtgaaacaatctcgttttggttgttgcaagcaagtgatacacatgatgtacataattcataataaatttcacacaaatgttgatgaacatcactaaccaactaatgaagtctctatatttatgatttaactaaaagttgcactgacaaagtaaatcaaacaagtagatacaactctaactatgatgtctgaaattaaaatagcatcaagaaattaagcattcctaagtatacaagataacgattatagtttgttgacgatgctgcctcaagttcaacacaaaccccacaaaaaagaacagcacacagagtcagcccttcaaaagtttctagtgggatggcaaacctaggcagctagtgcttgccggtgttggctgggtgtgtgggtgtgtttttttggtgggagggctttggttctcctactttgttttttttttctttttcttcttcccttaatgaatgaaacacatttctcttgcatttcgaggaaaaaaatcactacggagtttttcccattgttgatgagttccctttgttgcgaagaatgctgaagaccaccaagaaaactaaaaaccaaagttttgtgagatttatgtgcaagatcaatgtacgtgaggaccaattatgataatattgcaatgattgaaaatttgtgtttgagaggtgaagtgccatgtgcttagtggtctgaccagtatggtaccgtagtctgactatggccctagtggtcaaactggggacgactcattttagtttgacttttggtcgcctcgggtttgcatggttggacaggtcacataacaacagtctgactaaggccagctaagattgggttgattaggacttatgtccaagttggttttgagttggatggctattgcaatattcttagtgatttacacacattacatatgatgtgtaaacgctaatttgaatcaagttcagaagaacttgtggtaaaaaaattgtttcttggtttggttatgacgttatgtacagttattacttgagggtgagcgtggtcgatgaccttagataggaacaagacagatgggggtgttgaggttcagtcattcagatagtcaatgagttcatgtgggacacacgggtagataacagtgcatgcgaaggtgagatttccatatggaattcatgggagatgtgcatcttatggaaaagtataataatttaaaaatagtccaagtttggcgaggacaaactcggttatgcgagtctttcctctacagctacgagccctagataaagaaagatttgtggcttgtgacagccatgttgcgggtatataaacactcggggagagcaaaattgttgaggatttttagagaagaattagggatttagacattttccattttcatctagggttttcccatgtggttaagggtgccaaggatacaccttgtaaacattttaaagcaacaaagataaaattcataaatccaaaggtgtaaaatccttttgcttttcctcactgttcttcatttttgtctatttttgtacaagttgatccatccaaaacttgctagggcagaaagaaatagttctgaaaattttcattgttcctttctgatgtttgaaaatgaccacattttcatgttttttatgatttcagggtcaatatgttcagatctataagtcgaagtgcgaaagttcttcttggaacagtttctaaatagataaagtttatattagtcgaaaagttccaggccaatagaagttagggggttagaagacaccaattttacatttggtttgacagattgcaaacagggctcgtggtctgaccatgactaagccactaaggacaatccgacctaactaacagggcctaagtgtgattgcagtggtttagtgatttcagtcctacaattgcagcattaagtagctgctgtttgcaaatcaggccatccacctgatattctaatttatgatttgtactgttttacttctactagggagggcaacatactagtaactatatattacatatgttgcagcagtttcaacttttaagatataacaaatatatttcatattttagtttcctaggcaccaaaagaaaacatggtatatggacagctaacattctcatgatattgaagcctggatgtctggcctgcatgaacaccataaaaaaatggccaacgatacattgttcccctacatctatgtgctctgctgcaaactaacacactacggatgaagaggacactttcttcagcaattcattttgtcccacaacccttttataaaatggaacatgtataaaaaagcatacatttgccgttagacaaaccgacaatcagcatttggtatctcaaatccccggcaaatgagtctggatcggacacaattagtacatagtaattctctagtacaacacatcccaacctcaatcgattaatcaattacttgggagcacgg

SEQ ID NO: 10723 - DNA, 5081 bp, Oryza sativa
gatctagcatgtatcagctaaactctgataccactctatcttaagatatcaaagcaaatagaatatttcaaccaaagcctaatattcctaaatgcagcaagatcttacattaaagggcaagatttaacatattaacgaagcatatagagtaaaaatagttaaatcaggtaagatcggctgaaaccccgatgctaccctaatcgtcaaccagaaggcaggctagagattgatattctaagcacgacttaatagatcaaactcaactgatgcagcattaaatatgaaaagaagaacaatatctagacaatcaagccactagatgcttcatagagtggtaaatatcctatataatctaagccaacgtcgctatttaacctaatcggctaccttctactaacagatgttagccgattgtaggttagataacgatattaccgaagattatataagatatatgataactcgacgaattacataaataagattagagtatcataaagatggaagcactaatcccgagaacgcaagctgctataacaagtttacctcttgttgaagatcgaaatcgatgcagctcaacccgaaagcaagaacttgtcgaaacaaaacgaaagcaacaattcttaaaccggctccaccagtaagatatttttaatcctttcactagttgatctcagccgattttgtctaacacttgtctcttttacagcctcctcctcctccttcttctcctgtacgaccatcatcgagtgaccatactccgtcggctgtagggagccatcatgttgaagaagaagaacaactagctgctcctaccattccagtaagtttccttttgacacaagaatttagatcggctatgtctacttagctctaacttcctttaaataattattgcaggtcctagccgatcttttctgctttgacattagagactatcttgatgagacagaagaggataccacaagcaaagctttagcccccttatccgatgatgtgaagaaaattcttgaagatatctcatcggctagaggcatcatcgttagacagcttagtggttgattgtggctcaattaggactcggctacatgaggttcaagctctgatcccagatgagctagccgatatccttactccggccgtatatctcgagcaacatcaattcaagctagagaaagccaagctgagactagctgaacgtcgggagcgcaaagatatcgaggctacaattcaagccaatcgacagcttgttcatgaagagaaggccaaacttgatcagctatctgagggcccgatcaaatctaatattgatcggctcgaaactcgtaagactgagctcttggcacaacttgaagaatgcaacgccgagctggacatggaacataaaaagctagccgatctcccaaattctgttgaagagcagaaggcaagactaaaatcggctatcaaaaatgttgctgatctgaccaagtttttaaaagtcatccctgtaaccgatgctcaaggtgcccatgccattgaagaagtagaaaaaatcaggcaaagagctatttcagctttccagcaatatttgtcttagtgatatcttatgtaataggtcttagaaatttttttgcaatcggctaagaaactctgactctttatgtaactcatctcaacaatctttaagccgatttaatatgaccccatatttggctcaaaaatatgcaatttttcatatatatatgtgccccccctaattttacaatgtcacaagcattgataaaattataaaagcggctaagggcgatacaacaatatcggccattatacatcggcaaaccataaccgattacaatatgaaaaacaactaagggcgatataacaaaggaggaactgattaaacggcttgctgattatcagtgatcaagggccgataattcgggaaagtacctccttgaagataaaccggtcccgtagtctgatagtcagctattgaaccatcaaccatcgacttcaccatgtttgacaaagtattgactaatatcccagattgattgatcaaagcatgatgtacggcatagtctacctgatcttggaagttattaaactgtagctgtgctgcgttactaacttggttaagattagcacctttaaatccctgagaaccatcaccttgaactccttgagagccaataccttgaactccttgagagccatcaccttggtctcattgaaaaccatctgcagcacctttatcagtcggttgagccgagccatctagagcttgtttcacttctccatccttagaagaaccggtcccaggaacatcagcaactacctttactttgtacttctgaactaatgttcccttgcgagtctccgtgaatgagctcaagaactgattccgtgcttactgcatcattgtatcaagatctttttgctgctcaagtgtcaatttatcaaaagtgatgggcacaatgttggcttcatcaatctcagatagacccagcttcaggatcttttctttaacagagccaggaccagccgaggacggcgatgctactagtttctcggccatgaggaaagctgctgttgtgattctgacttctgataggtcccaccaggcgtgccaaaagcgtgttgacgtaaaacacgaggcctgggagatctgcttaactctagtgcaggtccaaaactcgccttcgggtatgctagcgtaccagttgatttgatcctgcaatcaacaagaaacaaggacaaagaaaccgtggttaaatccataaacgatagccgatcggctaggtgccgatgacatattatttatctttgagccgatgtcatatatgcatcgatcggcaagtatcaataaataaaacagaactaaatctactcgatcggctatagatattaatgatatatgatccttatatcgatatatacttaaaaccaagtgattgggatagatcggtcgccatgccgagacagtataaatcacttagatcgaaatatatattaataatgagattatatatattcatagtatagccgatcagatagatctagcatgtatcagctaatactctgataccactctatactaagatatcaaagcaaatagaatatatcaaacaaaagcctaatattcctaaatgcagcaagatcttaacataaagggcagatttaacatattaacgaagcatatagagtaaaaatagttaaatcaggtaagatcggctgaaaccccgatgctaccctaatcgtcaaccagaaggcaggctagagattgatattctaagcacgacttaatagatcaaactcaactgatgcagcattaaatatgaaaaaaagaacaatatctagacaatcaagccactagatgcttcatagagtggtaaatatcctatataatctaagccaacgtcactatttaacctaatcggctgccttctaccaacagatgttagccgattgtaggttagataacaatattactgaagattatataagatatatgataactcgacaaattacataaataagattagagtatcataaagatggaagcactaatcccgagaacgcaagctgccataacaagtttacctcttgttgaagatcgaaatcgatgcagctcaacccgaaagtaagaacttgtcgaaacaaaacgaaagtaaaaagagtggcgatgcgccgagattgtattgaacgtgtgttaaattgattacatggggctcggggtctatttatacccgagaattacaaaacatgtccgtatcggacacgactcttatctctacaaactctaagataccataagtctttgcggcagacttttgcccgaatatatctctaaggaaattacataaaatatcctaattaatatatacaattgccttctcaagactctatccatgtgtggcaatcatcacgaagcacattaactcaacccgatgatgtataccgagtcgtattgtcggaatcggctgtatcagcttacccaatctgactcggactcagccgatcctgattgtagctgatttggattccacccgattcttactctgttcccgaatcgatcttcgtctttgattccgcttcgatctaatcttcatcttcgatactgacactggtggagaaaccctttgtagtcccggttcgtaacccccctttagtcccggtttccaaaccgggagtaccaatccgggactaaagatcgctatctttagtcccgggtgaaataaccgggagtaaaaatcgatctttagtcccggttggtaacaccaaccgggactaaagatcgagctaaccttttttttttgcatggccctgttgctgcatggtttatatatatatatatatatatatatatatatatatatatatatatatatatatatataaaccatgcatatatatgtttcaatacatatatatgcatacatatatatatatatgtatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaatcgccgcgataaattccttgtgtgtggtcaggttatccctcatgcgaataaactatatgaatgtatgaaattgattagtaattaaacaagaaatcgctacgtaatgaaattttgaatttatttgtacatacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgt

SEQ ID NO: 10724 - DNA, 5244 bp, Oryza sativa
aacgtttgaacacttggatgaagtattaaatataggcttaaaaaataactaattacacagattgcgattaatttgcgagacgaatcttttaagcctaattgctccatgatttgacaatgtggtgctacagtaaacatttgctaatgacggattagttaggcttaataaattcatcttgcagtttattgacggattctgtaattagtttttttattagtgcttgaacgctacatacgacaccctatataatattcgttgtgacacaccaaaattttacacgcatggatctaaacaacccccttagctacactggtggagaaaccctttgtagtcccggttcgtaacccccctttagtcccggtttccaaaccgggagtaccaatccgggacgaaagatcgttatctttagtcccgggtgaaataaccgggagtaaagatcgatctttagtcccggttggtaacaccaaccgggactaaagatagagctgacctttttttttttgcatgcccctgttgctgcatggtttatatatatatatatatatatatagaccatgcatatatatgtttcaatacatatatatgcatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacggtttcgacgtagtagtactcgctgctagctcagaagctaaggaccggtgaattgtgtttccgtcgtagtagaattcacccttgggatcaaggatttcttcgttgatgaatcccatgagttgtttttgaaccgccgcgataaattccttgtgtgtggtcaggttatccctcatgcgaataaactatatgaatgtatgaaattgattagtaattaaacaagaaatcactacgtaatgaaattttgaatttatttgtacgtacatcgagctctcttgtggtgatgatttggtctgcaaggcagtagcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtaacgaaaaccctccgccgtcgggccctttgaatctgcattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctaggggggcccttgactatgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgatgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccatttccctcgagttcgtcctggatgctctggagtctgcagggcgagtgtcagctcgtccctatctctgtctggtcggaacgtgccctgagaggaggcttccactgcatctgttagtcgtcgcgcagcctctcgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcatttcagtactggctgcttccctccgcgattgtatcgtacaatatctgttcctcatcgcggtcagccatctgttgatacaagaaacatctgctaagtcatgagacatttatgttttaacaatctaagtcatgtatgctaagtgtaaatgtcgtacattagaaccctacacaaccttacatgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttatagggctagctcttccactcaggcttgacggacgactccgacaacacgtcttttctgcaagatacaaaaaaatgtattaggataaatgcgaagtaacatatatatatatatat

SEQ ID NO: 10725 - DNA, 23518 bp, Oryza sativa
atgcatgaagggagatgcggcggctctcaccccagagatgcggcggcagcggaggaggcggaggcagcggcgaggacgacgagctcaagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccccggatctttactcccggttgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcatgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaagctcatcaggccctctgcccttctttcctttgctagacatgtccttcacgaaaaagacttgcgttacatcattgccaaggacaaaaggttcgtccgagtatccaaccttgttaaggtcaacagttgtcatcccactgtcatcaatcattacgcctccactagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatcaatgcatcggacttaccaatgttcctagcgcgaactagagccaagtgctccttgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcaaaaggtgacaaagcagatgcgtcattatattgaaaaatgaaggtggaaatatcaactcaaaactgacgagacattgcaccacttcattctgaagggcttctaatctatccggatcgaagaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagatggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatggagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactccttgtttgtcctcgtcccacatggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttctagtcctaacgggcagactatcttcttagcctcgtacgttgtctcgggcaatttgtttccccccggaagaatgttcttgacgagtttcaataaatcgccaaatgccttgtcactaaccccattttttgccttccattgcaccaactccagagtggtatccaactttttgtgcccccgctcgcaacctgggtacaacgaagttctgtggtcctccaacatcctgaccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaactggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtcccggttggtgctaccaaccggaactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgctacatggctatgcaaggtttttgaggctttgtgtggtgcacctgcatgtgtgatggatgctgaggtgggtgtcggatttttaagctaaatatcgtaccgatccaagcacttgtctaaatattactgagtgcatgttcaaatattcagctgatagcgtgagctcatatcacctataccataaagacaatgccaatacatatgcatcttcttatttattaatttcagattcaaaaattattatatttaaagcaaacaactatcaagggctacataaaccataaataaatatataattaatgttacttaatcttctcgatacaatacatcaactggacaatatatagtagtgtagttactacttctcgacactttgaactatatgcatatataggagatggatttttcattccacaaggaaactatacacacaactttagggtgaatctatcataagggcatccggatcttgagcctttactactttctccgtttcacaatgtaagtcattctagcacttttcatatttatattgatgttaatgaatctagatagtatctaaattcattaacattaatataaatgtgggtaatactaaaatgacttacgaaacggagggggtacgtactaatacgaggacaataggagccctatgaaacccatcaaatttttatttcttcttaaatccaccgctgcacaactcgtcgcacagacgatgcagcggccagacatgcatatatgcagtggtcgcgtgcgttttctgtccatggctagctccgtgctacttctagctagtgcttcaggtagaggtcgatctcgacgatgccaccggtggcgaggctgtagtcgtagttcttggtgaccatgtacccgcgcgcgagccggaaccgccccgtgccgccgatcaccaccgactcgcgctcgccggcgtccatgtcgatgcggcccttcgccgtcaccgagctgccgcggtgctcgccggcctccagcaccatgtgcaggctcaggtccgacaacacgccgccctccgacacccgcaccgcgaacccctgcgccgtgcccacgcgcgcgctgccggcggatggcccctccgtcagcgcgttgttcagcgccacgatgtcgccgaactgccgcggcggcgagccgtcgtcgccgttgccgttgccgttgccgttgtcgccgtcgagcagggagcggccggagacgacgcgcatggcggtgggagccgggccggtgtaggcgtcgtgcatgtaaaagtggaggtgggtggtggtggtggtggtgaaggcgccgttccggtgaagaaagacggcggctgcgaggagaaagcagccgacgaggacggaggagaggaacgccattgtcgagcttgatgtggggctatggcatgcagctgcttgcagtgtgttgttgcagctggcaatggcatgtacttatggacgtgacaagatagcgagtgctagcgcaagcgaaacgtttcttttttaaaaaaaaacgaactgggctcctcctcgtgtgaaagttttaaaaaaacatatctacacactatgcatactttaaggtgctgtcacatcggatgtttaaaccctaatttagagtattaaacatagactaataataaaactaattgtatgaatgagagctaattggcgagtcgaatccataattagcaaaacttttgctacagtcaacttttgctaattatggattaattaggcttaaaaaattcatctcgcgaattagctctcatttatacaattagttttattattagttaatgtttaatagaccaaattagcgtcaaacattcgatggagaggaactaaaaagttttagtcccatgtaaactgggccttatcaaaagttttagtcccatataaacttggccttatcaaaaatagtaaagtatcttatctggtcatactcatattttcaaaaagaatgtagcatgctattcacatgctatgagaaacagtaccattgatgtactctctccgtcgtaaaatataatcattttttagacttcgacacagtcttcaagatgatatataaaaataggatgttgtaaataaaaaaaatacatattatgatagtttgcttaatgataaatctagtaacatcaattttacatgatggatattttttattttttctattaatagtcaatgttaaaagtttgacttgacactatgctaaaaatgcttatattttaggacggagggagtagtatttttttaatcacttatatcttttcaacggtatatatatttgtcatggttataaataccacatacctaatagtagttaattaagcacggcgggacccaacacatatcaagtcttatacgtacctaatagtagttaattaagcacggcgggacccaccacatatcaagtcttatatggaattaggcctcacttatgaaaggtattttgaataaggaaggacaagtagagttctatatggaaactatagggactactcggattgtatccatattggtccctatagttctatttggtcaaggggacacctatgggtataaatagaccccctaggaggagagggggacaatcaagatagacacagaccaatacaagcaaacacacgccaagacaagctgccagatatcaacatcaaaaataagcctagacaaacccaatatagtgcctgtagaggctaacaagggatctagcgctatctctaatctcgccgagtgcggattcaaggaggaagactatcccgttgtcgactacatcatggtattctaggccgccaagtcgacaacggttgatagattatcccaaattttgtactggtgtgattatgatgaataaatagcaacaccggcttcggccaacaggagtagggatattacttgccaaataaggggcccgaacctgtataaaaatccttgtataaaaatccttgtctctatctcttttacctcaatcttgcataaaccttggtaccgacaatccccttaccatgtagttgtgacctaaaacatcgacaatattattttaaacatctacatatttgaacgatcgtacttcactcaaaatatataacaaaacaagtccaatattaaaaatttccaattattttaattttttattttttttcatagctcctgtaatagtatagttatttcaaataccacgaagagtttctttcccagagaatgtagttacttctacttctgaaaagagttacttctactaccttaaaagcgatggagcccacatgttagttctgtttttcttaccttttaatttctaacgatatatactccctctgttctataatataagggattttagagggatgtgacactttatagtactacgaatttagacaaaaaaaaaagcttgtccatagtcctagaaagtatcctattcctctaaaatcccttatattttgggacggatggagtatattttaatttcttcctctcgtacataaaaatcggtgcacaactgcacatgtcagaatatatattaagccaggcatcagccataccattggtataatgaagacattgcctgatgtgattgagatgagggtaactgattaattcatgttctaggaaagacaacatccgtcctataaaaaaccaacctaggatgagatatgacatttctttatacaattaatcttgataagggtatgtccgggttcattatactaaaaaaatgtcacacatcctgtctaggttggtttttgatggcacagacagagtactgttgtatattttacgcgctctctctctcactactactctccttttctcatccatagtgtatgtctacacatgcatatcatgtcatgtcattcgcgcatgtccacataagtttttgcttgctcatttgcacgttttctcccattttcaaatgtttttctttcaaaataattatccattctatcatttgattacactgttgtattacaattaaatctttataacaatatatcacacaattatattttgataaaaaatcaaatattgtttcaccctttaaagaaaattgttcactgcataaagagtttcagagaaatgcaaaaattaaaaataccgattgcaacaatagtaaccacctatatgaaacattaagtcccaaagaacgaaaaaaagtcatatttatatcacatattaatattaaattgtaaatattgaaacattataaaatacttcttgaaacattccagaaaaaccaggtgcaacatttgcaagttaactagtgcaacatcatatgtattctagttgaaacatttaaataaaatttgtgcatcatttaaaagaaatgtaaaaatgctaaatattttttcattaaaatataaccatatgtggtcttattataaagatttaattgcagcgaatttaatagtgccatggatcgtagattgaagaagtaaattaagagaaaaggtagtttatagattgctaaagaaaaactaataccacccaactaaccatggttttttattagatgcatgcatgaatatagacttagctacatggctacgcaagattttacaagctttgtgtggtgcgcctgcatgtgatggacgctgaggtgggcgtccgatttttaagctaaatacctgacgcccaaaccatagtggtgtcgtacagatccaaacacttgtctaaatattattaagcacatgttcaaatattcagctgatagcatcagctcatatcaccacatcacctgtacgataaagacaatgccaatacatatacatcttcttaattattaatttcagattcaaaaattattatacttagagcaaagaaactatcaagggctagctcgtgctaattattttttatcaaaacaaacaactatcaagggctacataaaccataaataaatatatgattaatgttactcaatcttctcgatacaatacatcaactggacaatatatagtagtgtagttacaacttctcgatactttgaggagtttctacgtatataggagatggattttcattccacacggataatatacacacaactttatggcagatctatcatgcaggcatcgggatcttgaacatgaggacaataggagcccgcacgaaaccccatcaaatttttttaacatatacagatagaaagaagtactaattttttcagtttgttcagatattacttcctgaatccaccgctgcacaactcctcgcacagatgatgcagccatgcatatatgcagcagtcgcgtgcgttttctgtccatggctagctagtgctgcaggcagacgtcgatctggacgacgccgccggtggcgaggctgtagtcgtagttcttggtgaccatgtacccgcgcgcgagccgaaaccgccccgtgccgccgatcaccaccgactcgcgctccccggcgtccatgtcgatgcggcccttcgccgtcaccgagctgccgcggtgctcgccggcctccagcaccatgtgcaggctcaggtccgacaccacgctgtcgaaaaaagatttcggcaataataaaatgggtggctatcaagctagaaaagtggatgggtttggagacgaagaattttataaaggttcgggccttcttattcaagaagtaataccctactcctgtccggggatgattccgccgagtgtgttattgattgtataaattgggaaaaagaatcgcgtcccaagaggcacacggaccctccttatataggggaaggagtccgctttacaaaatacaatccatatcctaacggaatatgggattatagataaaatacaaacgtaaccgactaagatcccgggtatttccttgacatacaagtttagaacctaacccgagtcttcatagagatattccatctatatttggtaccgtatatccgactaaattacaactgtcatgtagatatggggtatctataatctccacagtagcccccgagacgttcgcagttgacaaaatagccttctcgaaacaaaaaacagtagtccgagtgcttcaattcaacttgctccagcttgccgagtgctaaagatcaaaaactgtgaagggcgaaaataaaacatggtgcatcgagtagatgtacctaattaggtgtagcccccgactatgtgattagttgaaaaactaaacatatagtcaagaaccgagtggttttatagcgaagcacgcatggtacttagtaagatacccagccgactgcttctcaacttgaacataccaaggacaaaaaatacaagaagggccgagtgataaacactcaaaggtccaaaaatagacatgtttgataggaatccgagtaaaaatctcataaaatgacccaccaaacatgatagaaaatcatggtaattaataagtctaatagcctaggctgtgacccttaccataaccaaaataagcatataacatgctaaaagaatgattattaataaaccagtcatctcaaatcaacccaaacagcttttgcagcctaataaagcttacaaaaaatggtataacacctttctgtcgggcacctttttatatgcatcataataattccaaagaattattgaatcgcgttaaaaaggattttaacagcattgggccacaccattgtgaacacaaattgccaaagcaaaaattgactaagtccctagggatcacaacaggccacgctgattatagtattgggctgaagtactgtacaggcccaggcccattagtactcccgataccccaataataccgaagtgaaaaacgtctcttcgtcttccccgccgagactctcgccactttccccatttcctgctacagtgcaaaactgcgccgggcaaactagggttcatcaatccgctccaatccaccctcaaaaacttcacgaaatttctcctcgcatccaccgctccgattccccatccctttccagccgtatctcgaactaaatcagaccatccagttcacattcatggcggaagaaagagaaagcttcgagagtcagtgggcgccctccgatgtgacggaagacaatctgaaggagatggtggcgcacggcgttcttccagcaaaagagatcatcgggtggcgaccggcatttggtgaggcattcccgacccccgatacacacgaaatcgtggtatttgctcatttcttctatggcggattttctcttccaacctcaagatttttccggggaattctgaacttctacgggattagcttgcatcatctgaatccaaactctatagtgcatattgccaattttattcatgcctgcgaagcttttctgggcattaggcctcatttcgccttgttccgccgcatcttcttcctcaagccccagctaaataagagcaaaccatgcgtcgttgggggtgctggtttccaactcaggggaacactaagccaaaaatacttctccatgcccttcaagacctcaaataaaggctggcacgcaaattggttttatgttcaaaaccccgagcctgttcttcccgagtactcctgccttcctccagtttatcgggatacttggaactcactgccaatgggagatgaagctgcacaagcagtagaactgatggagagaatgataaagctgaaagaacagggccttcaaggagaacagatcacccggcactttatcaagtgtcagttagctccaatcaaagaaagatctcgcacagccttcgaatttgacggcaagcatgacccaaaccgtgaagatccagattctcttgacttcaaggtcatgaaggaaaggatgtataagatcttctcaaacgccatcgttgtcagctactcacacttgctgccagtcgtaccgttcaatgcattcaatcctcctccaccggtacgtattcatacacttcaacctttctcaaaatatgatcttattttcttgttgaattagttaacaatgaaggatattacacccaggaatttgctttgatgaagtcggatcccccaatcgctcaacgccgatctccccgccaccaaactgggcaagggagcggaggaccacgaattcggtctgaactcaaccaagtgcttctgatccaatcagccagccagattctcgaaagaggaagctggttttaagtgacgacgaagccgatgataccgccaggaggcctggagaccgagagacaaccaagaaactatcaaaacaggctacaccaaggaagaaaacatccagtcgccctgtgccaaagatcaggaagtcttctaggtgcaacttacataacgatctctcttgcattgatgcgcacccattgtggcaataatactgataatcaaatttgcaggaaaccatctgatatagatccgtctggaaaagactctgacccgactaacatggacacaagttcttccaaagaaaccgggccaactgctgaggatcatccgagtgacaatcagccggcaaccgataatgtagaatccggtgatcaacccccgactggaaaccagtcggccgaagccgaagccggagttaatcaggagcccccgactggaaaccagtcggacgcagggccaagccaagaggttccagaagtcgaaacccaagcagacaaccctcacggacaagacgccagcaatgaccagagatctggatcccctttaaaggcatccgaatccactcgtcctcgtccagaaatcattacgggtaaacactttgtctgaaaccatgttgacccaaataactctgatcgattgtctaacctttgtcaatggatacattaggaccaatgatcggtgatgaagaagaaattccccgtatacaagcagccgaagattcgtgccctcccattctggtcaagtggtgggatgacaacttgcaacctcaaggaattgtaataaaccggcaaaaagaagatgaagaggtatgcctactgaaaaaggcactcaaccaagcgactcgcattgtaaatgtaagtcccttgacgcctgacctcagccatcttgtttgccgtctggctcgagcgctgattaaactgctccgcagaggattcatcttaggaacgaggcgaaaaccgcaaccctagagagactagttcctcattttggaaccctcgaagccactaggagtcaattgcacgaggccagagaacttgccaagaagaatgaacatgatctgtgggatcggattgctgagctccaggagtccaatttcgaactgagtggctcatcaaaaggttcgcgcaaactctgcccaactgatttgtgctgttatctctgtaatcttgattaaccgaagttaatgtagtgcaagctgccaagatatctcaactagagaaacagatccaaactctggaaaatgacaaggcagagctggcaagatagagggattcggctttaaaggaggttgaaggtaccaataatcaatacctcaaaagccattatcttctatatgctgattcattaatgtgaatctgttgacgcaaaccgcaagatcaagtctcaagcacaatttgatgtcttagttgacaagatcaacaagtttgaaggagccagggataaagtcgctaatgccgctactccacttatctaggccatgttcttcaataacgccggttcgagtacacttgatgctgccgaaatcttcgacaagctgagagtcgcaccagatacttacttcaagaacatcaaagaagctggaagtatgggagcaagtctggcattggcgatgaccaaatccctttatccaagagttgacattgatgccattgatggctttgcagacgggacgagcgaagaagctgctcttgacctcatcaatgatgagcagaaagccgctgacaagattgctgctgatgtagttgagagattccaagatttcgaccttcggccaactgggtctgataagtctgatgatgaaaaaactgatactgattgatataacaatgattttgatgatcaatgacggtggaggctcaatttgtacaatactgatgaatttatgctatgcttggtgttccatacttagcttctgatttcttaaaagcctttgtcaaaccttattgagcctaaaacccacaaaagctattaaaaaccttcagtcctcattggctaagacgaaagaccaaacagggcaatgataaatcaagtaagcaaattgaattgataaaaatcacactccattattatcatagtagccccctgactgaaaacttcaaggaaaaccttgaagttagcagtcaaagaggaaagatacaaacgaaatgcctaagcataaaatcgacgaaggtgttcaatattccaagaattgttgatgagagtaccgtcttcgtgcttgagtcgataagaacctggccgagtgacttcagcaattatgaacggtccttcccataagggagatattttatgccgatcctgtgttgtttgaattttcctcagaaccaggtcgtcgactaaaaaggctcgcgatcgaatattccgattatgataacggcgcaacccttgcaaatatcgagtcgactgaatcaaagctgtttctcgggcttcttctagtcgattgatgtcgtctacttggccctcttcatagccctcctcgttgaatttccgaaatcgtagtgattcaaattccacttcactcggcaacattgcttctgcgccataaaccaaaaagaacggcgactggccggtagcccgattaggagtagtgcgtaaagaccaaagtatggacggcagctgatctacccacttgccagcatagggacatagtcggtcaaaaactcgtgctttgatcccttgaagtatcatgtcgttagcacgctcgacttgtccagtactcataggttgtgccacggaggcgtaacaaattttaatgccgaagtcttcacaaaagtctttaaatgctccgccagtgaattgagtgccattatcagtgatgatccgattaggtaccccaaaccgatgcacaatgttgatgaaaaaatctctagccttatctgctgtgatcatgatgacctgtttagcctcaatccacttggagaatttgtcgatagccataaagagatgcgtgtaaccgccgactgcccttttaaacgggctgaccatgtcaagcccccagaccacaaatggccaggataacgggatggtttgcaactcttgggctggcaaatgaatttgtctggcaagaaaattgacaaccttcacatgtccgcacaatcttgtcagcatcagacacagctgtaggccagaaaaaaccttgccggtaagctttgccgacaatggtccgtgcagcggcatgattaccacaaataccagaatgtatatccttcaacaactgtctcccttcttccaaagacacatagtgctgcagtattcctgatggacttttcttgtacagctcggtctcatgaataatgtaaagtctgctgcgcctggaaatccgctcggcttcatttttgtcttgagggagttcttgtttgctcaaaaattttataaaatgttctctccagtcggctttgatcatgcttacgccttgagtatccatggcttcgactgtctcttttctgggcacggtcggttcgtaaagatgttcgacgaacacatctgaaggagctgcttcccgttttgaaccaaaattggccagtttgtcggatgcctcattgttatgtcggaggacatgggtgagctcgagtccatcgaatttattttccaacttgcgtacctcttgtcgataagtggtcatattatcatctagacatgaccactctttcatgacttgattaacaaccaactgagagtctccacggacgattagtcggcgaatacctagagatattgcaatccttagtccatggagtagcgcctcgtattccgccacattatgggacgcagaaaaatgtatccacaatacgtagctcaatctttctctagtcggggagattaaaacaaccccagctctagtgcctgtaagcctcttcgacccatcagaatgcatagtccaatattccatcttttcctctggcatgtctttttggcactcggtccactcggtaaggaaatcagctaaagcttgtgacttgattgaagttcgtggcttgaacgatatgtccaaagacatcaattctaaggcccacttcgcaatccgtccgtttacttcgcggttatgaagtatatccccgagtggaaacgatgtgactaccgtgaccgagtgactttgaaagtagtgagataattttctgacggtaattaagacaccatatagtaacttttgaacctgagaatatcttgtcttggagtcagctaaaacctcgctaacgaaataaattggacgttggactttttgaatatggccttcctcttcacgctcgacaaccaggaccgtactcacaacctgggaggtcgccgacacatataacagtagcggctcttgcggatgtggcgaggccaaaactggtagagtggtgagaagtttcttgaaatcttcaaaggctttctgtgcttcgggtccccactggaaattgtcaatcttcttcagcagcttgaagaagggcatcccccgctcgccgagtcgtgagacgaactggctgagcgccgccatgcaaccagtcagcttttggacgtctttttgggagcttggcggtttcatgttgaggatggcgttgattttctccgggttggcctgtatgcctctttgagataccataaatccgagcaacttccctgacggtactccgaagatgcacttttccgggtttagtttcatcttgaaagcacgaatgcttgtaaaagtttcttctaaatccgcaatcaggtcatccttctgcttggtcttgacgactacatcatcaacataagcttcaatattgcgaccgatctgagttgaaaaacatctttgaatcatgcgttgattggttgctcctgcattcttcaatctaaagggcatggtgatgtagcagtaggccccaaagggcgtaataaacgaggtcttcaagcagtcggattcttttagccggatctgatgatatcccgagtaacagtccaagaagctgagtaactcacagccggccgttgagtcaaccacctggtcaatgcgaggtaacctgaaagggtctttgggacaagatttgttgaggttggtataatcgacacacatgcgccattgccccgtctttttccgaaccaggactgggttagccagccaatcgagatgaaggacttccttaatgaagcctgctgctaacagcttggttaattcctccttgatccatccttcctgtcctgtgcaaaacggcggagtcgttgcttgatgggtttggcgtcttccttaacatgtaaagagtgctcaatcacctctctggggataccaggcatattggatggtttccacgcaaaaatatctttattattctgaagaaaggtgatgagcgcactttcctatttacaatctaactcagcgcctattacagcagtcttatcaggatcggagggatctaagggaatctttttcgtcttggcatcactttcttcggtcttcgtcagcttggttgcaggcgcttctccctcgcttgccgtggtcgcagccagtcggatctcttcgcgggcgagagtagtctcgtgggtttgggccatctcacaactttctttgtcacatgtgacggcctgcttgatgacgctccgtagtgatatgactcctcgaggaccaggcatcttcatcatcatgtaggtgtagtgtgggacggccataaatttagctaaagccggtcgtccaagtatagcataatatgctgtctcgaaatcagcaatttcgaaacaaacattttctgtgcgaaaattctcccgagtgcctaaggtaactggaacagtgatctggccgagtggtgtagctgacaatcctgggataacaccgtggaagggtgcattactcggttttaattccgtgcaaggaatctgcatatcgtccagggtcttagcgaaaaggatgttgagtgcgctgccaccatcgatgagagtccgtcggagcttgacattgcgaaccactgggtctagtaccagggggtaccgccccgagtggaccactcggtcgggatgatccgagcggttgaacttaattgctatctctgaccaccgaagatattggggcgtgttaggctgaaccgcattgatctcccgttctgttagcttctgttttctcttagattcataagccaggggtccgccgaagatgtgattaagttctttgcgatgatcttgaaaaccagtcatggcatcgtcttcatcatctttcttctttgatgtgccttgatctccgtctgagggtttacatgcgttcttgacgtattgctccgcgaactgtttgtagacgaagcaatctttggccacgtggttggagttgggatgatgcggacattggaagttcattatcttgtcgaaggtgttaatgcgggaacgttgtcgggaagacggagaggtggtcgccacaagttcttcgggcttacgcttgcgatccttgtggttgttacttccactccctcccgcggtcggcatatccttctttggcttccaagtggtgcccgattgcttggacgccgtgatagcatcttcggctttggcatactcattggctttttcaaacatctgtttgaccgtcttgggaggtttgcgtccgaacttgccgactaggtcctcgtggcgaatgcctttagtaaaggcagcgatgatgacgtcgtcggtgatgtcggagatcttgttgcgttgctcgaagaagcgtcgaatgtaatctcgaagagattctccagacttctgaacaatgttgtaaagatcgaagtgtgttccgggccgttcaaaagtgccttggaagttggcgatgaagtggtcgagtagctctgcccatgatgcgatcgtgccgcagggtagcccgtgaagccatgaccgggcagaatccgctagggccacaggtagatagttcgccatggctttgctgtctcctcctgctgcgcggattgcgagaccatagacggtgagccaagactcagggttggtggtgccgtcatatttctcaattccagtcggcttaaagccggctggccaatccactcgacgcagatcgcttgtgaaggcagcaactccatccacgtcgtcgtcgtagcgatccggtgaatgatggcctcttgctgcgcgcgctggttgatggtgtcgcgaagatcgatggggcgccttcgatgtggggagtgtggtcgttcaactcggcgctccctatatcgctcgggaggcgaacgaacagaccgttcatcatgtcccctgctcctacgactagattcggcgccggcaatgctgaggctcggctggtgagggactcggctaccagtcggggtgcgggtgcttgcagagttggctggaaccgaggcagcgatcatggtcttcgtctggttcaagatgttgactacatgatcggcttggttgagtgcgtcttccttgaggagggtgtcgaggagagtgattgctgcaaccgcgttctgctgggggggtgcgaaagaccgctgtcccatcgacgtcttgttgcccaatgagctctctcgctcgccgcccagattccaaggcacgttgtcatcgatcttcagcctcctttgcaatccgttcgcgatcttgttgctcacgctgtagtcgttctcgctcttgtcgctgtcgctcttcctccagtcggcgacgttcagcttcttgccgtgcgcgatcttggtccgcttctcgggcttagcgttgttcctccgtttcgttgtcagccatgaatacgccgaagaagaggggcgtgtagttatcctcatagctgtcgtcgaagttgtcgaggtcgccgtggtcgtagtggtagccgaaatcgtcgtagtcgaggatctcggttggtcgagaactgacgctaggggagctgaggtagccatccaactcttccgtcgagactatcccgagaggttggactataacgccaacctccctggatctagatcggatcggggccgaagccggagctcgcctagatcttcgagtaggagatgtcttgactgtgaagacagcggcaaatcatcaggaagtttcatcaggattgaaggataggacccgtcgtcttgatctggtcgcggaagagtagattggatctcgtccgagtggtttgaagccgactcgggagagatgatcttggagtaggcctcggccgagttcggaataccaaacgggacggggacctggtctctccccgactggtttgaatccgagtcaagaagagagatcttgccgaagtcgttcgtgatgaagttgaggctgccgaaccggaacgcctgcccgggagggaaggcgaagtcgtcgatgccagaaacgaaacctatcgcacttagtcggtgagaacttgacgctacccctacctagcgcgccaactgtcgaaacaagatttcggcaataataaaagggggtggctatcaagctaggaaagtggatgggtttggagacgaagaattttatacaagttcgggccttcttattcaagaagtaataccctactcctgtccggggatgattccgccgagtgtgttattgattgtataaattgggaaaaagaatcgcgcccaagaggcacacggaccctctttatataggggaaggagtccgctttacaaaatacaatccatatcctaacggaatatgggattatagataaaatacaaacgtaaccgactaagatcccgggtatttccttgacatacaagtttagaacctaacccgagtcttcatagagatattccatctatatttggtaccgtatatccgactaaattacaactgtcatgtagatatgggtatccataatctccacacatgccgccctccgacacccgcaccgcgaacccctgcgccgtgcccacgcgcgtgctgccggcggatggcccctccgtcagcgcgttgttcagcgccacgatgtcgccgaactgacgcggcaccgcgtcaccgccatcgtcgagcaaggagcggccggagacgacgcgcatggcggtgggagccgggccggtgtaggcgtcgtgcatgtagaaatggaggtgggtggtagtggtggaggcgccgttgcggtggaggaagatggcggctgcgaggaggaagcagccgaggaggagggaggagagggacgccatggtcgagcttgctgtgggctatgcttggctgcctgctttgtgtgtggttccaggcagcctttaatgcttacagctgctgtacttatatagaatcctagtcgatacaccacactttgccgtggaatatatagatgaatgcatattatacatgatagatatatatgtttaaataatatataaatgatgtggagataatggttcgacattgattacatatatattaagttctaaaaatacaacaatattataaatgatatgtcatatttatatgatatttaaaataatctatataataattactagtagatgatgatgtagcacacttgcatatctatctatctattatatactccctccatactcataaaggaagtcgtttaagacaacgacacggtctccaaaacacaactttgacttcttgtttctataaaaatatttattgaaaagtgatatatgtatacttttatgaaagtatttttcaagacaaatatattcatataatttttacattttcaaactcaacaatttgaaagttattcatgatttatattcttagggtttgacttaaacattgtcctaaacgacttcctttatgagtacggagggagtactaaaagtccactaaacttcctacaaacgctcctggatcgtcacgtggcactctacaaacgctcctaacctaccacgtggcaaagaaacatctaactattgatttttatttaaattagtggacccattatttttgaccattagattagatgtaaaaaaaaatagtccacccatcctaatccacttgggctcactattcccgcggatgtacatacacgtacgtactccgtatgctcctactccaattattatcttttaattctattatctttttatctctcatattttccttcttttaataaaaagcaaaatttatgtaaaaacatttagagattggtgttataggt

SEQ ID NO: 10726 - DNA, 7409 bp, Oryza sativa
ggcacccataacaccaggcacctttaatagactatgagtgtcggttaattaaaaaactgatacctttaatctattatatactaaatgtctattaaactttctacaaatgttcgtaatctgctatgtggcactcctacaaaagatgtagagccgctatgtgatgctctaataaattgtagaaattatgagaaaaaacaaaatatctagcagtcgattttcatttaaaatagtggacccaataatttaaaacatcatatcaaaataaaatccctcttacgtatgtaagtacgcctatcctcccctcatttactctttcttttttcttctttttctaattaaggtagttattacgagatatgcaccataacttaatattggaaatgataacttaatattggaaatggttatatctttccatgcatggagcatcgagctggctgtgcaacatgcaagcactaactttttttatggacgatctatacattaattttatgatacgcttgaatgattatatgtttaattaaattaattaatgagcgaagtcctatattcactctttttactatgttttcgatataaaaatagacatccgattggttatctgttttcgatatagaaatagacatccgattggtcatctaataggtaaaaaaagataagccgttagagatatagttacaggatgtgagttcctctgttacggtggccgattgtcacatagtctaaatgattatatataaacaatagatagctaaatgattagtatattttttaaatatattcagtttttagtttgatccatgtaggcttttcttgatatatgataaatatattttcagacataaatccatatcctttccgtgacaactaaacatcaattaaacattatataaaaattgataatatatcacatatcatcatctattagatgtccattacaacacctctatgtcttcacatttcacatctaataaattatttttaaaaatcatatttttgagaaaaaaatacatatgaccatcgattttatttaaattgatagacccttccctctcagaaaaactcagggctctcctcttctctcccccttcctattatttagctaaagtctattaaatttcctacaaacacttatagcttgtcacatgatgctctaataaattagaaatcaaagaaactatgcgagaaaacaaaacaactagcccacaattttcacttaatacggttgacataatattatactccatcattagatctatctttagaaaaaatccaaaacccatctccactgccccttcctcccgggcctcctctcctcacgatacaaacatcccccctctttccttccttccttcttttaattttctagctaacagatttttataaaaatcataaaaattctaataaatgtttagccattatttttctaaaattgatggacccattaattttaaccgttagatcttcatctaaaaagaaaatctgatacctgcatcctcaccaccacctccatatatgcgcacttacgtacttacgttctccctctaccctcctaactctccccttctctcctatttcttaagctaattgctattttttagctgatactcaatctatcaaaaattaataatcggatttctaaatgatcataaaactcaagttacatattttctcaattttttttgaattattgtgttatttataattaaatacataagtcaaaatccatatacatagctcaaacttctaatataaatgtttaagatcaaatttttaagcatcatattaaatactaaatattaaatttagatcatgtaacgccgctaaatcgccatgtggcaataataccaatccccctaaaccgacatgtgaccatctaataaattataaaaattcatataaattatattaaaaaaactaaccattgatttttttcaatatcctcaatcattagatctattcttaatcttaacctacttaaaaacttcaagatgattctgtcctctattgcttgatgatgacatccatgagtcagccgcacatactccgcgtatatgttgatccgttcacgagagagtccgcacgagagagagagcacgattctgagtcaaattgaaaaaaaaaacaccacatcatttgactcggctcactgaaagaaaaagtcaaatgaaaaaacatcttactttttatttgaaattaatttgtcagaccgatttttaacaaacaaatacatatgcccgcgcatcgcgcggactacctttctagttgagatttaaaagttagtgagcagcaattttatagtaagatgggatatactccctccatcagatgcatccgaaaagaatgttaattgtagagttgaaaaggcaatttagtagagaaggaaaataacttaggtatccctagggtttacactttcgatttcagtacgactgaaatttatgaaattttaggattttcggcaattttcggatcgaaattttctaaaatattgaatgaatttgaataaactttgaccaacttcaacaaaaatttgagaaaacccaaaaatttcggtcgatatattgatttgccggtggggaccaaaattgcaatcactggtatccctcattgaatgtgaagtttttgagaatgacataaaaactctagctaattgaattagaggtagtgtaatacagtaccacaatctccggggagtaaacaatcgtttgcttccagcgccgcaccagcattgacgacgttctcctgcatcttcaccggggaagctaggccaaaactgaggtgtggccatggagaaagaaaaaacggtctcaatagttaacagaggcacaaagatattgcgtgaatattcgcgtcgaacgagatcccgtgaatcgcttatctggacttgcttcagcggccacgttgattttctttttgttacgttgcattcgctatgcgcgaacatctcgttgatgccccgcgtgtttagtgggatttcaaaattcttactgataaacattgctgattaatctttgtatgtttctttttttttactcatcagttgttgtttttttcgataacataatgtggagtacgtgtttctcaagtaggctgctaagaaataacaaaatattttcttccgttggttgctaggccaacagccaactgcatacatgagatattttgctttgaagtaattatggcttgctttgaagtaattatggcttagtgcaggggtggagctagagtattgagggggtgtctgagagcccggtcaagaaaaatttgttgctatatttgatctattttcaccatgtgttcacctccatcaatcataggctgttgttaaatctgatcacctagctttttggaagaaagcctgaaacttaagaccaaagtcttatacgaaagaaagaactaccaaaagtaaactatatcggtcagaccaaattgggtatgacccgatgtgttctgcagtgagcccaaagcaccttgtaagacctctgataccaaccgcaagtaccacacatatttgaatgagtaggatccatatgtacaatcatatatatatatagccactcactctgaatgtgtccatgtccacgattggcatctttcaatataataaccacaacaccaagtaataagcaaaggagaaacctttgatagaatagttagccagttattaacttcaacctaagcatgttaaaccactcgaaggcaatgaccaagcaggatacttgtcttggggactcgagctataacactaaatttcacagtcatctcaattgctcaaaacttatactcttgcttcactaatcctgtgaaagcaactagcagcttgcactttataagcaaaacataaaaatattagagcatttgtgtcatatgaaaaataattctatagagcccattgaagaaaggactaatttttaaccaatcccctttaaaattctaacgaaatagactattgtagatgaatttcggagggagaataagcatgaggccccacctcccgtctatttttctgttgttgatgtgtatttttctgctatgccaatctactgatggtttggaaactttcctgtatttgaaaattctccataggaagtgaaatgatcatgatatagccgccttgcgctccgtgggtattggtaattaaataagtgaatagttgtgatgaaatgattgcagtttgtcaaagaagcattaattagatcagtgtacatacaagaccttttttcgcggtccgggtatatagcgaggtaagcagaagacaattgacaatttgagagacaacgaaataatcaaatattccggccgttgctgtacatgcgctatagagataaaaaatgctatgtgaacgatttcttcttatagacttatacgacggtcctagtgcgattgggaacgtatggtgaacgccaccatgcatggttagctgggaaacggacggtaaatgtcatgttctttcttcgcttttgcgtcgtgattctaggagagagccgttacgtcacacgaacatcgtatataacaagttactaactttttcttcaaactttcaacttttccatcacatcaaaactttgtacacacataagcttttaacttttttcttcaaactttcaattttagtcaaacttccaattttagcgtggaactaaacacaccctaaaataaataaatataatatatatatatatatatatatatatatatatatatatatatatatatatatatatatcagctctcatataaaatgaattcaagtgactgtcaggacaaatatggtacgtatgattgtaccgtgttcgacgaattttcaatactcttgggagccgcatataaagaagggataagagtatgcccaacaacctcctataattaggagatgaggggaccatatgaattttcaacgttctaacgggcctatagaaacaagcgaataagtatgagacgagagagacagcctatagaaacaagcgaataagtatgagacgagagagacagagataataaggtactggatgatatagatactaggaaattccccgcgctttgcttcggaaattactaagggggtaatttttaatatgttttttcaataatcgagctaagtgtaaaaaaaaatattagatattaacaacagataaaacaggtttgctaaactatgtaaggagagaaataaactttatagactctgtagcagattctggatgaaatatgatatcccacgcttctattacatggatgaatatatatgttaagtattataaaaatgttggatatgtatgttgaaaatattatgaaaataatgtgaatggtgatggttggatatacttgcacttttatttgcataatttaatgaattgtagatgatgctgcaatgtttgttggagcttagtacgcaattattagtaatggacgatgagatgacatgtttacacgttaagctttagctttagtgggctgtaactatatagcaggtatagatgtgacgatggccatttgagtgaaatcttgagttaattaaactatccataattacactagttaaaagtttgcgatagagaatgtttgagatatgagatctattaaatctaattgatggataaaatatacattttgacttagaacagactgtatatgctccctcagtaaaaaaaagtcctagttatgaatctaaacataaaattgggttagtcaatcgattcataaccatctttcgagcactatattaaaacctctttacttgcccgatcatatcttagatctgtaaattatgttatggtctacgttccactcatagcgatgtgcttgagtccaagggacagggggtcgtcttggggccagagagaatgaatagatagggccccacgagttgttaattggccgctggggaattcacatgaaagggaaggacttattctgaaccaaaaaagtgctcactaaaccgaacatgaaagttgttttccatcgttttccatcataaagctgttcacataacttcacttttgacttggattatatatcccatatatccaggtaccatattaagatgtgattggcatccctcggcaagcactggtatgtacttaccgtataataattgctccacaagtactagtatgtactacttaccgtataataatggattgatatgcatgttttttcttccttgtacatagacacccgagcacatgtcttgtgatatcttagcccaataagaattagacatgtgtagcccatgagagttgtatgcgcatgtttagtaccaccgaagggaggaccattacaaatggtatcagagccgaccctcgcggttgcgcgtatgggtcagtgtgagggcacatggcacatggcgcatgtggactttgcgtgaggcacatggcatggcatatgatgccaacactggacgttcgggcatgtgctaacagggggtgtgtttctatacctttgcttatatgcctgtgtagctatgtgggtgatttggaccgacggggacgtcgggtcctttgaggggggtgtgtgtcagacatcccgacccaataaggattaggcctgtgtaacccatgataactgtgtgcgcatgtttagtaccactttctagtttagcaagggtgcgcccttataaggcctcttccctcaaactatatcactccgggttaaccttttagacgaagtatggacaaaagtataagtgggatggtatgtgtaagtgggcccgtccgtcggatgggctggctacgcggttctggagggatgtgtgattgaggtgaagatggaatattagttcatgtggtagcttgaactactccatctaaaccataaaaactaacttctgctacaaaccgtacatagcctacatttatatttatagctaaaagttgaatttcttttatgggacagagagtatatatacgaagatagctatacatccatctaagattatatgggcacttctaagtgtgttaaatagcagaaataaatattgaggtaaatctctttgatgtacttggaagtttatataattatgtactctacttgactggaaaaatcacgcccaatgatgcaactatcaataattacctaatgatgcaactatcaataagtacaaatttgttggatgaattgaaaagtagtacactacttcacaaacgatttttccatgcgactaaaatcgattttcccagataggggatgacccgcctacacccagatgtccaaaaagtcagtatttttacatggggaagagcaactgcatgtgaaaatacagtattttcgcatgcgggcgcttaagctgtcataatgcaaaaagttaaatcgaatgaaaatgaacaatccaaaaccatagtgtaacgccccacttttcgcgagacgttaaaagctaatttattaaaaatcctaattgtgaaaatttcgtt

SEQ ID NO: 10727 - DNA, 8317 bp, Oryza sativa
  unsure (1)..(8317): unsure at all n locations
aattcctttttatgaaacccaattcccgagtatttcccctctctttgaaaccccatccaagtaattctagaacaatccccgagtatagatctatcccaggataatatccgttccaaataatctcgcctgaacccttctattcagatttctcttctaaatcccttacccacatatctcgtcgagtagtccaactcaaactcccaagttacactctccttctctaaattatttgactcgtctccgaatattgttcccttccttgactccttcctattatcccgagaccaagtatcgacttcgaaattcgaatccagactccagccctaaaaccttccaattaaatctctctgtgaaagtctatttaacctccctcataggttggattccttcttcctttttcctggtccacttcttccttctattccagcccatctctctccctctccctaaagtttggacctatcaatctacctacaccaatccgagagttcgaatttccgtattcggattcctcttgtaaaaccctatccgcatttgtcgtcaatcctcaaaattcaaactcattgattggttcatttcgtccctctctctttcgatcgatctacctatctacctatccatcgacctatctgtctctcgatctaatcatcgatctctctacctgtcaacccatctaactatccgtctaccgatctctctgttgatctatctatctctacgatatccatcggtccgtccgtctacctatctatctttgaaatctatcccaaagaaataccgaattcccgcttggatgcattcccttgactcctccctgttttcctgagaccaagtttcaagttcgaaatccaaattcaatttccaaatctcgtttcctccccggcgccgaatcccgccgcccccactttgaccgtgccggcccgcgctccgcgttcaaattcgaccgcttgatccaccgacctcgccgcccaacgcatcctcgccgttgccgttttcgggtcgcccacgaaaccatcgccccaccgccagccgagcgccagctcgtctgtgatctcccccttgcctataaatcctacccaccgagccccaaatcctccctcaacctcggtcgccgtcgcgcggccaaccccggagcaccgccgcctccttcgtcgccacggccaagaacgccgcgccgtcaccaaaccgtcccaccccgcgtcccttccttccctggtgcgcccgcttcggcgtcacgttcgtccccgtgcgccgccaacggccttcctccccttcccatcctcaaatcgccgccgacaccattcctcaccgattggtgagctccccgtccccttccccttaccgtacgccgaaccagctcgctgtcgccctcccggaactcctcgcgccccctctctgtttccccggccatgccactctcgatgctatgaccaccccgccgtgctctgttcccgccgacgccgcgctcggctgagcgccaccgttggccaccctctcggcgactccccgcgccaccacccgccttgagctcccttgaaccaccccaaacagtcgctctgcccgattcgctgccgccacgcatgaccgcgcgccgccgtcggccatcccctcgccgtatcctctcgtctccaccctcctggagccccctcgactctccccgaaccgccggcctagccgccggccttcttttttgttcccacgtcgtgccgcccgattcaccaccgcggcacacgggcgcgctctggcgtcggttcccccctttttttcgaacccgctcggcaacaccttcctcgggcccctcttgacctcccccttgctggcccgtggacaccggctctcccttcaattttcgcgcggcgcgcgccttttggttgcccgcccgccccgcgcacgagcaacaccggagaccatcagccttcgcgcccaacgcgtgtgcgtngcaacaccacaccgattcgatcgaaccatagcccgcgcccccttttccctcccatcgcgtatccacgtcggcaatccggcgagcttcgccaccgtcgccggccgccgtcgcgccccttctctccggtccgatccgtggaaccgattccccgcttcctcctctcgcttccagtgcctgccgcccactccgattcgccgccgttcgctggagcgcaccgagcgccgttggccatccgatgagccgcccggcctcctctcccttccctgtccgacgtggcgtccacctggacgccacctcagccgctgaccccaccagaccaagtcaacccctgcctagtcagccacccccccccccttctctctccccgctcgtgggcctggcccatcgaccagctccccctcctcggcccattgaaacaaaggaagtccatttttactccctccgccaaacacaatgaccaaaagtctatatctgctccctcccaattcacctctctctcaccatatgttggccccacatgtcaatgagtgataaaaggatattcttgagaatattcatttccataaatgcaataaatcatatctcctgctccataaaacatttcctatattccaaattccataaaatccttcctcttaatctggggattccaataattcaacccattggtcctgcatgtcagtgactgtcaataatattcttgagaatattatttctataaattctataagccatttctcgtactccaaaaaatccaatagatcatttccttgtccagaaatccaattaagcttccaaaatccatatctcctcaaccgctcgaccgattgactccgttctacttccagtagttccgtaaaattgatatcaatttaatggcactattaattagtctaaataggatctttctttcagtcttttggttaggtttttgattgtttgcgtatagttgcggttaccggattttcgtcaagcggatttcttgaagattcgtgaagatcaagaccctgagcaaggcaagccacctttgaacatattgagcctatatttgaacttaattaatttgcttgaaaaatattatgcattgataggattgcacttaatctatttgccccgtctgcaaggcagaccggtgggcctacccaacttgttgcatctgatccttccattgttaattgttatatcatgttcccttgtaactatctagttgcgcctcgatattcgtgcactctgtgcgagtatcgacggtctccttcaaacttaaaatctgtgtaacttcttgggtaaaacttggtttacaaaagctttggaaaacccgacgcctgggtcggtgccttgtgaaagaaaatgagttttaaaaataaaatttgcgacacaaggccattcctgggcggaatacttgtgcggtcgcatctaaggaccgattcctttggaattacatccgagcatacaatagtgcgaccacacgggtggaatgggacgcccctggctgagtaaatagctaatcaagggagccttgatgccaagagacatgtggattcaacggggtggtgtcggggagaacccccgggcttcctggcacagtatggtctgggacctaacctgttgttggtctgggactcctctcattggcatatggtaaccctgtgtcggctttcgaaataccttgtcgtgaaagccccaaagtcaccagacgtggctgttctgcacgggctgggtgaccaaggctagtaacgtcgtgtgggtatagtgtaccccctctacagaggttattaaactgttcgaacagccgtgcccacggtcatgggcgaatgtgaggtgattccttagcgtagtttttgttttaccctgttttatgaaaaggtgttaaggtttgggaaacctaatgcttgggaagcaattagctgtccgggggacagtgggaccggaagtccctggaagtgattggtcgtttggggaccactattattgggaagtttggaaaaatggtttggtttgggaaaaccagctttgaggccaactctgggagttgtgaaaatcttgataaataaatttgttacttctcaccccgactgagctgagacttgtctcgctctggttgtggaaagcacacacttagattgttgaaaaccttgaaaacaaaactgattgaaaaataacaacctattctttgaaacttgcattaaccacctaagttcccctggcttgctgagtacgtaagtactcacccttgctctctatataaatatagttctgccagctctgaagatgaagttgaagtgaagtgaagattagggtttcgtcctagaccccagccgtcgcctgtggtgttgggggttagtccgttgtttccgttgctgctgccgctgttggtgttgcctcgtccgtgtcgtcggttgtaatctcgggctgtcctgagttgcaacctaagttaaggtaaataagtcctctatttattctaaggattgcaatgattcatatttgtcaccgtgggtaccagcgctatgtcctgggactagtactgagatcgcggtttcgtaggaagcggttcgcgccgtttttcctacgacacgctcctatcaggtgccgttgtacggcgatgccggattggggtgtgacacatagcaactcctatgccccgcagccgttgccgccgcccccgctcccacccccggggttcgtcctcgctgttgctgatgccctccctacctcccatcagcattgccatccctaccgccaaccgccggatgcaccatcgctgcccacccaaccaccggatccattgccgccaagctctccaccgtcctccccaccaccggatccgccgctccctgctcctgtatgccgccggatccctctggtgctggccactcccgctcgtccgcccacttgccaccatcgttgtcgtcgtagccatcgccactatcatcgtggccgcggtggaggaagggggaggggggaggggatggccgcttgaggagggggcgagaagatatgaggagaagataagggagtggagtggagtgtggagaagttaggaaatgagatattttaagaggagagaataaagagagggaggggacgggtaaacggcttggtgccaggcgggcctattaagaagcctgcctacgaaaattgttttttcgcatgtggtctttgaaccacgctctcggggcagcgatttttgcaggcgggagcagtttaatttgccagcaacctcaaggggtctcatccgaaaaaatcgtttctatagtagcggtaattaatttagaaatatcttaatgtaaaatgtagtttgtgcgctgctgcctttaattgtccatgagaagacgcgttccaggcacgaacgtgaccggaacacacgacgctcacgctgcaaacatgcagacgtgctcatgcaaaaaatcgaaaatagacgagctacagtacagtacaatacatcacaggacgctggttacaactttaagcaagaacacatgaaatgaaaaggcataggcatgcaggagaggcgcgcgcgttctagctgtacgtagtgtgtcaggctgctagctagtgctgcaggtagacgtggatctcgacgacgccgccggcggcgaggctgtagtcgtagctgctgctggccatgtacccgcgcgcgagccggaaccggccggtgccgccgacgaccaccgactcgcgcacgccgacgccgacgtcgatccggcccttgatcgccaccgagctgccgcggtgctcgccggcctccatcaccaggtgcatgctcaggtccgtcaccaacccgccctccgacacccgcaccccgaacccctgcgccgtgcccacgcgcgcgctgccggcgtccggcccctccgtcagcgcgttgttcagcaccacgatgtccccgaactgccgcggcggcgacgagccgtcgacgatgtcggtggtggactgcagcaaggagcggccggagacgacgcgcatggcggtgggagccgggccggtgtaggcgtcgtgcatgtagaagtggaggtgggtggtggtggtggtggtggcgacggcgctgtcatggcggcgaaggaggacggcggccgcgatgaggaaggagcagccgaggaggagggaaggagacagggaggatgacgccgccatgatcgacgttatcgagcttgctttgtgtgtggttgctactggcaggcagccctcatatatacacacactatgtacgtactggtttatgatttgttagaatctagttttaaacttaaccaaattgatatttttttctccttgttttaaacgtgggtttatttattaagatactgactagaccacctttcttttgtttcgctttgttccagttgctttcgatccagtactacctccgtttcatttcaggttataaaactttctagcattgcccatatttatatagatgttaatgaatctagacacatatatatgtatgtgtagattcattaacacacacacacacacatatatatatatatatatatatatatatatatatatatatatatatatatatatatatatatatatggataatagtagaatatcttataatattaaacagaggaagtattagctaagtgcaaggaaatatagggtctgtttggggagcttaagattctgcgaagtagctggtcggtagccagcttatgagaatctggaaaagctgggtttcccagcttatagcttctaggctgtgtttagttcacactaaaattgaaagtttggatgaaattgtaacaatgtgatggaaaagttggaagtttgtgtgtgtaagaaagttttgatgtgatggaaaagttgaaagtttgaagaaaaactttggaactaaacatggccctagtttattttctggtttatacaattacagcttctcaaaatctagaccaaaagctgaactgtttgggggagcttctgattctggaagaaactgcagcagctagaagctctctcaaacagggtcaatccttgcatataatttttttactcctttcttgtcattttcgaaaagaaaaacttcgctttagttagtactactctattggttcttttgacgccgtcaatttttatatgcgttttaaccatttatcgtatttaaaaatcttatacaattatgcaaaaatagaagtcttaaatgataaaattaatcacaataaaacaaataataaaataaatgatattatagcatttttaataaaataaatgttttacatatgttaagtcaatgatgctaaagagatactatacacaagcatgatgtgtgggagtggtaataatatttaacaatgaaacatagagaggcgtttttaagggtggcatttctggttgtgtgcgagtccctcccgtaggggtgaaaatggagcggattcggacggatagtggtcataccatatcctaaatcattgaagttaaactttatccaccttacattacccagtgcaacacacaggcattgtgcttgtttaaagaaaaaaggaattagcaacatctatattagataagtttcattaaatttaacattgaatatattttgatgcaatatttgttttatattgaaatgttaccatattttgctataaatttggtcaaaattttaaaagtttgactaaaaaaagtcaaacgacttctaatataaaacggagggagtatgatttttcacatgcaggtctatttttaagatgtggtgcttttaacataaccgcctacgaaaatcgcaacaaaatataaaataatgggccgggtgatgggagtggcaaaactctcgcttaattatcctctcccccgtcccctcttaccctccatctccagtacagcgtggtagcgtgggaagcgggcttcggatccagtggagctcgatgaggagtacctctgtgatggcctccatcgcttctctccccctcccttgtgttgggattgctcactcacagctacaagtgttaatcacaaacacttttgtctctctggtgggaaatcacttcctctctctctctctctctaccgtatttttgccacaaaggcttctcaggtagacacacacaagcagcacaagatgcaagtttctgttgattcaaccacccacggcctcatcatttttctcattatatatagactcaaattacatgcaaaggataacaaccagccaattctcttgaccgggactcacgccatgcactaacaaactaaccctctatgcaaggctgcatgtacacctacatgcaagctaacaaccagaacgtgcatctatccactattgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10728 - DNA, 673 bp, Oryza sativa
gttggtagaagttatgctatgattgccccatatgacgtagatggtaaccgtattacgtacccttctcttgggggacgaaactacaactctactacccctgttaaatttacaaaactagcaaaaccacttaaagtcggggatacagaggtttttgtagaagatgttagtctatggaacggacaggcaccgcaagactaccaacgtagtattatcatgtggggttataaaaactcgttcggctatacttatcccgatggaacgtatagtcagctaatgcagatgaggacatatgatattggtgcagttgacaccacagctaacaagattacgttaaacaagccatgggcagttgcaaacccaaatagttcagatgggattttcccagtagggcatacacttagcccaacttctgacggctccacatatttgtatttgaatggtcacgtaaatatacaagtacctactacgtacaccaagtacagccatttgattagtggctcttctgagtttgctaatacaacgattatcccagtagaaacaggttttattcaacttggattcttgttgaaccgtgatacaacaggtgaaaaatcttggctaaatggtttacgtctacgtgactatacagatacgtataaactaaacgatgacgttagagaaacacaagaaaacg

SEQ ID NO: 10729 - DNA, 4990 bp, Oryza sativa
  unsure (1)..(4990): unsure at all n locations
nnnnnnnnnnnnnnnnnnnnnnnnnnnnnnnnnntcaaatccaatttaaataaagcagtaaaaaaaactcaattaaaatgaacaaatgagagcagaattttgtcaattaaaactcaaatagatcatttttgcatgagagcgaataaataagacggacttacatagcgataaaataatgagaaattagatacatactaataataataataagagcataaatacctagcaacccatattcctgagttaggacctaatgcattcctcccatcaaatcccgactgactgtcgaataaatttcaaataattttactaaaaccctagactgacctaatttgacaaatctcacattaaatgagcgaccaagatttttcccttgaaccacaagaacagatcccaattttcccggaacaaatccaattgcaaagaacacatgcaatgaaaaggattgtcctacggtcaaggttggctctgataccaacttgtcacgcccagaaattcccgaatagaattccaagcagaatgtgcattaaaacccccgtctaggaccggccggggtacacaaacgataaagttgacatacagatcaacgtcttacaaacattataaaagtcttacataaatgcagcggaaaattaaaagataaatggagctaagccttaacttgaatttgcagcgggaacaccactccacaggcatcttagacgggacggacgaagcctactcttcggggaagccaccatctgacacgtactcaaactccgggttttggggaaaatagagttaggctgagtacaaccaccgtactcagcaagtcataccaaaatagggggtatgatgcagggtataatcaaggtatggctagaaaggttcatttgcataaagcgggcatttaaagacggtagttcaaagcagtaaaacagttgtagtaattaatcagtattaaccaatcactgtccaacgctacaccacgttgcaacaggcccaaccaaccacctgaactacaccagttcattagctaactaggggtgagactaatcacggtgaatctggttgaccgcccgtaaccgcgggcacggctattcgaatagttttactctgatcagaggtgtacaactgtacccacaagacacagccccacgacatgttaccgtgcgctgacatgccaccacgacataccgaaaagaggccgtgacaggacccttcgcataaccccctctagccaagcacaccacacctcaggtttcacccccgtccccagcgggcaacgggcagtcccctctcgtgcctaggtgaatccggaaggacagaggccgtcgcagggcccgtcccgctccatcacgcccacccttgcctggatgcgtcatctagaggaaagctacactacaagcccagccgttgcccacaatggcttgtggtaagtacgataagttcttccagggcatcccgcgaaccggtccttaattgctatgggcgcgaccatcaaaaccatgcacccacaacccaccatttaatatattttaattaaccaacaccggagcggtggcattaaccaacattattactagaatctgatatcaactcaataatgtattttccccattgtgtgttagttgaactaagcatggctaagtaatccctagtccaatatctagtcatgttatatccccaagctaacaaaggagcatggtacagaaatagcatggctgtaacagtaggtaaagatcccatagtaacattataaaacgatgcagtttttaaaggaaaacgatagagcatttgcaatataggatcaacatgttcaagtgacaagcatgacttgccttgctctgctgctggaggaacctcggcgactatttcaaagtacaccggagcgtcaggagagccggaatctaagcgacatacaaagcaaacaatgcaaacaggctataagactactgaaacagagaacaaaagcatttttaatggattttatgcatttttcttgatttactgcgacttgaataggcttaaacgaagctcggatgaattagatatgaattttagaagattcactgtgtttttactttaaacagaaaaatccttaattgatttattgcgcaatatatcccagggctgacgtcaacaagggagggacggcgccgacatgcgggccccacatggcagtgactcgggtggcggtccacggtggaccgggtccacggaccggggaaggaggcggcgcaccacgtggcgccgacgtggcgcacacgtggcagccatgtggcacgccacgcgggcggccgaaccgacggccccgatctacccgagggtagatcggatggcggcggggagcacgcggccggcgcgctcgggcggctcaagccggcccggcggccatggcgcacggcggcgctaacgcggggcggcggcggcagacggcggcgaccgatggcggcgtgatgagcggcggcggtgcgacggcgcggacggcgatagtggcggctaagcggctaggtggtggcgcggcggctaagtggcgcgggagagagagagaggaaggggagaggggaaaaggtgtctcaccgacggcgattgacgacggcaagcgacggagggcgatgacggcgacaggacaagctccggaaccacctagcgaacacggtgcaaggggttagagatgaagaggaaaatggaagagggcgaggacgccggccgaaggcggcggccatggcagtgctcaccggcgcacggcgcggagtgagttccggcggcggaatctgacaggagaggggtggacgaggtggcccgcacgacggcgaacgcgacgacgtctacggcgcggctcggcgcagcggcttgcgacggtagcgacgaccggagcggtgtcggcggcggcggaaaagaggacgacggcgctagggcgatgaagggcacgtgaacgcatggttgcaaacggaaatagagagaggagggaacggggaacctttatataggcccgcgggggtcgatcgtggccggggtgaccgcgattttgccggcgtagtgggaagaggtgggaaggacagagaggcgggattcaaaaattgaatcccggccgtctcgagcgcgggcgcgggcggtagagagagggagtgggcgcggggaaggcgggcatgagcggcgacgtgggcgacgtggcctagaatacgtgggagcgaggggtgacggcggttgcggtatgcggcggcgcggctgcaggtgggagacgggcccgacaggtgggccccacctgtcggtgaccccgggagagaggaggggctcgggcggccggctcagctgggtcgtggccttcggtcggcccagcggggagggggaggaggaagagaatgggccggcggcccattcgaaaaagaataaggggaaaaagaaaaagaaaaaggaggaaatgaattttcttgggattaaatattgcttgtgctcatttttgattggttaaaattatttctagagctatgaaaattccactaaaaatcttgttagcacatttcgacatgtagagctcaagaaaaattccacatgccaattccgattattatttgcattaatttatttagggtttcactcttgcttttacaccggtattttctcgagaccaattataaattcaattttggcttgggagaagaacttcagggtgtgacagttgcctcctgctcaaggacttaacaataagagccactatacagaggtaccacattgctaattaacataatgactaggtcagtccccattctagaaactgcggtcgcacccgttcgtttgacataagtacctggtgacaacttatatcgatcgagacagtactagccatccggaaatcatccaattcgtatgtcctgtcccaatctaagtataaaacattttaaccagattgtaagcaaaataagcaatactaaattatctgggtttctatggttgaattatgcatgtgaaagtagagtattgagtagaaaggttataaataaataacttgtaaaatataggcttaaacgatcaaaatgtgtatagtaacttgccttgctcgatgtcctgagattgactgatattatctaatgtgtcataagattcctcaagaccaagggttaaacatgtaaaattcaaattcaaaagggattcaaataaaatccaaaaataggtaaaaataaaataaaatataaaaatagcaaaagtggtctcaaaagatagagaatgattttagaagaattttggttcaagtttcactggaaatgaatctatattttaaaatatatgggcttctaaagtttgaaaatcaaattaaatgttaaatggtattgtgtgtgggtcccaccgatcagtctctccctctcttctcttcttcaacctccaactgttccccatttacggccggcggcgctagggttagggattatggcagtaataaagggggaaaggtgttgcggccgaggaggggaggtagatagggttccccggcgacggcgagcggcgccggaggggttaatttggtgtgtgagtaacctagcggctagggtggcggtgacatggatgagctgaaaaggtgatcggggtggtgagagttaggcatggctcagggaaggttcctagagcatctatgaggtgtctagaaggatttaagtagcttgccgacgttcggcaaggtatggaagatacttgctgacttgcgcctccattggcggtggtcgagctcacgtcggcagtcaagagggtgatgttagtgctaaccaattacgaaaatggaatctaaggagtatgtcgatggttaaaatggaagaactcaccgagataggttgaaacgacggattgcgaccggaaaaacctctcggcagcgaagaacagagcagagcaggggcggcagtgctcggctcggtgtgacgaggtgtcgacgcagagcttcggttaggctttagtatgctagaacatggttgaatataggtgttctatgggttggttagggtagagggtggatggagtg

SEQ ID NO: 10730 - DNA, 1171 bp, Oryza sativa
atcaattcagcgcgctgttttgcatcaaagttcactctctctgaagttgggaggggcaaaagatcaattggagtatggggcagaaggccataaacaatctcaaaagggcacttcttagtagtagaatgttgtgaacgattataagaaaactcaacatgaggcaaacattcttcccacattttaatattctttttcaaaacagccctaagcattgtagataatgttctagtcacaacctcggtttgtctatcagtttgggggcgacatgtagtagaaaataaaagtttagttcccaacttagcccacaaggttctccaaaaatgactaaggaattttgtatcgtgatcagaaactatggtgtttggcactccatgccagcgaacagtctcatgaaagaacaaatcagcaacatgtgtagcatcatcactcttatgacaaggtatgaaatgcgccatcttagaaaatctatctacaacaacaaagatactgtccctccccttctttgttctaggcagccctaaaacaaagtccatagaaatatcctcccaaggcacactaggaacatgcaaaggcatatacaaactatgagggttaaggcgtgacttagctttttggcatgttgtgcagtgagcaacgaacctctccacgtctctcctcatcttgggccaaaagaaatgatcagtaaggatatccttcgtcttcttcacaccaaagtttcccatcagccctccaccatgtgcttcctgcaataatagcatacgcacggagctagctggaatgcataacttattagctctaaacacaaacccattggtgagaacaaatttgttccaagtccttccctccttgcaatttaacaacacatctttaaaatcatcatcgtgcgcatattgctcttttattgtttacaagccaaaaattttgaagtcaagttgggatagcattgtgtaacgtctagacaaagcatcagcaatgacattttcttttcccttcttatgtttgatgacatatggaaaaaattcaataaattcaacccatttagcatgcctacggttaagttttgcttgacttcgaatgtgtttcaaagattcatgatcagagtgtataacaaattctttgggccataaataatgatgtcatgtttccaatgttcgcactagagcaaacaatt

SEQ ID NO: 10731 - DNA, 13080 bp, Oryza sativa
  unsure (1)..(13080): unsure at all n locations
acttctcaaggttaccaaataaacgtgcatctcgtagagcatcaaaaatagcaggcaaatgaccatgatgatcctctattgatctgttatatatgagaatgtcattaaaatataccaccacaaatctgccaatgaaagcacgtaaaacttcattcattaatctcatgaaagtactgggtgcattagtgataccaaagggcatgactaaccactcatataggccgaatttagttttaaaagctgttttccatttatctcctaacttcatgcgaatctagtggtaaccactacgcaaatcaattttagagaacacaagtgaaccactcaattcatcaagcatatcatctagcctagggataggatgaggatatctgattgtgatgttgttaattgctctacaattcacactcatgcgccatgagccatctttcttaggaactaaaagcacggggatagcacaaggactaggagactcacgcacataccccttgtcgagtaactcttgcacttgacgttgaatctcctttgtttcctccgagtgggtcctgtatggtacacggtttggcaaagaggccccaggaatgaggtcaatttggagctcaatccctcgaattggtggcagccccaatggaacttcctttgcgaaaacatcagcatactcctgcgaaatgttagtgaccggagaggcaaagaaatagagtatcctcaattggaaataaagtttgtttgcaaaccaaagcatagcaaacaacagtgtcagtgtcaacttcatccaaatctgattttgtttcaatgaaacaagatcccttcagcttaatctcatttttattattttgaatagagttggtggatttcttcttatgcttctcaagttcattagccacaatatgatgctagtatgctcctgtttttttgtttgctagctctagcaagttcattctttaaaataacttaaagagacataggatgtaacacaagtttttttccattatgcacaaaggagtattgattggatttgccaaagtgtaaggaatctttatcaaactgccatggcctacgtaataacatagaacaagcttgcatagacacaacatcatagttgattgaatcatgataagaaccaatggcaaaatgtactcttaccaatcgtgttacctttaccttgccgctgctattaagccattgaatatagtagggctgcggatgtggctgtgtgctcaatgcaagtttcttcaccatttcagcactaaattattgcagcttcatccatctatgatcatgcgacaagagcgttccttgatcacacacttggtttgaaacaaggtgtggcgctgattctgttcagccccttccatttatgcgcttagcactcgctgcaccacgaggctctcatagtcctctgcagcctcggccccaatgtgttcctcatcttggtggggcgcgtcgccttcccctgcattgttagttgcaagcaaagcataggtttcttcatctaaatcactagcggaggagtacccaccatcagctctcacgatcattacacgagtgcttggccagtccttgcgcacgtgaccaaagcccttgcagcgtaggcactgaatatctcttgtccttcctgataatgccactgatgatgagctcttggaagatgtagcagcaacccctcttgtgggttcactcgggcatggtgtagagtttgttgtagagggacgcaacttgttgcttgaggacgatggtgctgctgctcgagttgacggtgcagcagcgttggaaggggtccaagagctagcacgacctgcagaaatgttagtcctgaagccagctcttcgtccctgcacttccatttcagctttacaagcaagatgaaacaaacgatatattgaattatattctttgtaggctagaatgtcctgaatttctcggttcagcccacccatgaatctatccataccagcatcatcattttccaccaatccacagcaaagcattcctgtttgcaaagcttgataatactcttctacagatttgttttcttgtctaagttgttgcaatttatgcaacaaatcacgtgcatgatatgaaggaacaaatctagatcgcatgaatcttttcattgcatcccaggtttggggagtgttatttggattggaacaaacaaattcactccactaaatggatgcaaaatcagtgaactcactagtagcaaccctaacacgtttattctcaggaaaatcatggcaagcaaatttctgatcaatggctaactcccaagtaagatatgcatcagggtcatattttccatcaaagcaaggaatggtaaacttgatcttgcctaaagaatcatcattatcacgtgcctcccgccgtggtggagcgcccatgccatggcgctaccggcactgttgtcttcgttgacgaccaagtaccttctcatcatgctcggtgtcagcagcgtactctagttcttcccttgctgcgatgctgctattagcatcatggccattgtggttgcgcctagccgatccatcatgaccatctttgctcattctctccaatgtattcaagatacctgcaagagaagtgttcacagccacaagggacctctccaatgaggaggaaaacttggagttggtgtcaatttgagcagcctccaattgaccaaggcgatcattggcgaccctatttaggggtaggtatgacggttatacaatgcgaattgtcggaaatgccccgcaaccgccatcaggagatgatcaagaccgtccacgccaaaccccagcctggatggctgagattgtggttcggccgaacctcggctgaacctgggctagtgtcacgcccagaaatttagcccaaatttccagactattttgtgtattaaatccctgtccaggaccagccagggtacacaaaacaataagtaatatacagttccaaacgtaaataaagcgtaaaatacttacagaagatgcacttagtcctcacaccgaaacaaaagcagcagcagtggaaaaaggcgatcctagcggggcttcagcttcacttcacaggcaaaactcgactggggtctgagccttggtcttctaacctcgtcttcagctcagaagcactacacttctgnaaagggggaataatagcaagactgagtacaaccaccgtactcagcaaaccacaccaacgatgcagacgtgcaagggacaacaagacggttttgtgcatatttgcataaggcagttgtaaaacattttattgagcaaaatactaaaactgttgagtaattaaggtaatattaaatctccactgatcaacgctacaccacgatgaacaggcccaaccaacccacctgaactacagtgcattgagtcgattcattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggtcgtgacaggatccttcgcataaccctctctagccaagcacaccacacctcaggtttcacccccactcctcgcaaggcagcgggcaatcccctctcgtgcctaggtgaatccggaagcgacagaggccgtcgcagggcccgccccgctccatcacacccacccttgcctggatgcgtcggctagaggaaagctacactacaagcccagccgttgcccacgctggcttgtggtaagtacgagaaattcttccagggtttcccgtgaaccggtccttaattgccatgggtgcgactagcaaaaccatgcacccacagcccacccttcagtcgcattttagttggataattatgaccatgaagcatggccagatgtctcgagcacgcagctcattctgatactaaaaggtctaatattgtaattatcccatcaactgagctagtggtaattaagcatggctaagcatatagttctagctaggtcacataagtaacatgagctagtcgatttattacccaatgttgacaaaggacatatatcaagtaaatatggcacaagcgagcagataggtaaaccctgatcccatgtaattagcaaaacacgcatatttatttgcaaatagtaaaacatttgtaaattgggatcaacatgctaaaggggaatgtgtgacttgccttgcttcttcactttgatcttccgaactcttttcctcgtgaccgcggacttccgaaacgacgagaactacacgctggcacgcaaaacaaggaaaaactctaataaaaaccaagaaaacggtatataaaaagtaaacaaacatgtagagctcaattttagatgaattttgcaagttgaatggctcaattcggagttcgaatgaattagatatgaattttagaaggttttgagccattaaattaatatctataattattaccaaattattgcgcaattattaaatattttcacaaaggaaaaggactgccgctgacgttagcaagagagggggccggcgccgacaggcgggtcccaggcatcagtggctcaagggggctcggtccaccatggaccgggaccacaagggcggtccaccgcccgtccacgggatggacggcccagatcggcccaagccgatcgggcggctgaggagagcggtggccgggcacgggcacagccggggctggcccgaccgaccacagagggcggcggcgcgcagtcaccagcaacggcggggggcgggcggcacagggagcagcggcgcgcagcgcgggaagcggcgagaggaaacggaggcagtgagggagagggaggtggcggagctcaccgaggggcacggcgacggcgagagcagccggcggagggaggcggcggcgctccacaggtcgacaatgagaaggggctcccggcggcggaaggcggcgatcgggcggcggacggggaagagcgggacgcggcgaagccggcgatgcgttgcggcggcagccagggtgaagccgaacggcgaccggaggcggaaaaaggcggccggtagggtggtatggcaggaaggtggttctggtggtggaggggaaaaatggatggcggccgagcttgccctcgcggtggtaaagctaatgccggccgcggggtggctgagagcagtgaggtgtggccggaggcgacgaccggagtggcggaggaatggtacggcttgggtgggtggtggaggtgatgactcggccacggattggtggaacgaggcagtggccggtgctctgcttggagcggcgaagccgacactggcggtggtgcggcttggcggtggctagcgtggcgaggagaggcggccggagttcggcggcaagcggcggagagaggttacatggtggggaggtggttccgatggcggttgaaggaaaccgagtggaggccggcgtgcggcgcgggatggcgaagctgatggcacacgcgatgaggcgcggcgacggcgggagcagcggcggcgcgcggctggagatcgccggcgagcggcggcgatggggatcgacgtggagagctcggtagagggcgtgggggactcgggaaaacggggaaaaaggaagaggaggccacgaggattgattttacagctcaagggggcgaggagagggccggggagcggcggatttcgagggggagtggggcggcgtcttgggggtggtggcggcggtttttcgcgggacggagtgggggaggggagcggggtcgtgggtgacgaggtcccacggtcgggcaggagtggtgcagggtggaagaagttggcgggaaaagcggtgacgtggggcggctcgggcggccatggcggttgcagccggctagccagaggaaggaggaggaggggccgtgggtcccacctgtcggccaaagcaagagggggccggttaggggaggaaaagaggacttgagggagagggaggggaggagctgggccggcggcccaaaggagggaggagggcggccgggccggaggtgaagggggaaagaatttgggccgagcccaaaagggaggaaggggaagattattttattttctttttatttaaattgattaaatgaactttgtattattataattacttcttgagctccgaaaattcacggcaaaatttcagagaatatttagggcacaaagaatattacaaaatattctcgcccaatgatttttaaaggaaatttttaattccctcaatatttcacttgattaaattgctttaacttttatttaatttctggaaaatacattatttaatgatttttaatcccaacgaaaatcggggcgttacagctaggcccatctggcctggctctttgcgcatcttcccccctgaccttctctacctatttctcaggattttgggttgactctcgggtattttgatgaagttcataacccatccttgtatggatacataattctcctcactttagtctagatttcctcccaacatcgaggtttatcacctgctgacggagcatgggggtcctcaccgggagaccgcgcaggcccccctttgccggttcggccgggggcgctaagtgaggttcttcgccctcgatctgaggaacgtccgcgagagaggaagtgcacaagacacgggcgacgtagacaggttcgggccgctgggaagcgtaacaccctactcctgtgttctggtggatctgtgcgtgaaggaatacagagagctggagagcgagccagagttcagggtctagcacccattccccttttttctcctccctccagagtcccctttctttttttcttttctcttttctctccagagtccccccctcttaggcctgggcaccctttttatctggtcaggggtcaccacaagggcctccagctgcctaagaaaggaaacatgctttttacaatgagggctagtctacagccggaagtgacctctgacaagcagagcacacgcctcctgcccgctcgcccgcttttccggtggacgcccatttcaaccttcatttaatggccagcgacttccttgccatacttgcgctgaagcctggaatggttctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgactggtcacagaccggataagcgtgcgctgcgccgcattaaatgcggcgtggcgcgctcgtccaacctgttataaatgcggttaggtgagccccgcagtgctcacctaactcacacacgtggcgccaaaaccacagggggtcggggcgtcgcagccctcggggccgaaacgggggcgccccagccctcagggccgaaacgggagcggcccgacccctcggggagacagagggaggggtggccacgtcaccctcgggcccgaccccccccccccccgagggggtcaggccacgtgggtgaccgcggctacccaagcctctagtcacgatacccctggccccatgtcaccgacagtagcccccggcgttacgccagggcgatcgcccccctcgagggaagcgctcgggcgtgacgccactccttaggcccggtgacaggtggggccggtccctacaggcgggcagaaacccagcggtcgcaaatcgcgcgcatcagcaagggaaaaccgaccgacaataatgagcggcttctttaagactgctacattactcgagcagcgcgcgaatcgggacgagccggttcgtttcgcctggagacatgatgatggcgcttttcacggttggcgagcgtagttaatgcgcgcacgatctgccccatctcaaccgccacggccgcacatctgccgcgtgcgccgcaaacgagcgagtgggttagtggaggcgtgggcgcgagaagccgggtatagcattggcaagggtgtaaagacgtcgaggaagggattcgttcctttcctctcgccactctcccccttgccttcgccacttgtgctctaactcttcgtttcctgtgccctacccttgccgcactcgctcgctctcaagctcctcctccgccggcgtcatggcacggagctccgcaccgctcgacggtagcgtgctgccgccttcccgcatcgtgagcgagaggcaggccgggctgccgcgccgattcatgccagaatccgccaccggccgggaggtggtcgcgctgggcgagggacgcccgacaccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttattggggtgcgcccatctctccggctgttccggtggttcttcaccgtacagccggtgtcgccgccgacggtagtcggtggctgctacttccagccgcgggggcaggtgctgaaccgctacattctctgcgtcctccgcaaaaagtgggatgactggaagagcgattggttctacacccccctcgccgacgaagcgcgcctccgacttccgagccagcccccggcgcaggcctccagctggcgggcgacggtagatctgggagacggctacgacgccgttcttgaccgcctggcgggtctgcgatcccaggggctcacgggggccatggtgttcggtgactaccttcatcgccggatcgcgctgctccagcggcgcgcccggggcgcctgggtgtacaccgggcccgaggactacgtgaggacccaccaggggcgcaaatgggacttggaccctgaggacttcaggatggtggtccaacgggtgctgaatctcagctccgtggaggcatccctcatcccccaaggggtcctccccatctgctgcgatccagagcgcgccaagatcctggccatcatgtaggtggtcggggcgtcgggggagcgggccccccgaggccacgatggcgcgggcgggagccgcaggagggaacaatctaccccgggagggggtcgtgcttctgggccccgcgacgggggcccgggggtatccgccctaccgacgcccgggggaagaggaagcaggagggtacccctcccccatctcctccccgagggggcggggcggtgcgtgccagcagcaggcgcccggagggtgctgtgtcgacgccgcagcccgagggggagcgaaagaagaaacggctccgcaagatggggggaccgagccatgccgggagagcctcatctcgcccccgaggtggtcgtttagccgacatccccgcaggttcgtccccgcgcccaccgcgagttttcaaggcgagttttcactcacccgtttctttttgtcttctggtttttcttctgcctaagcgagatcccgtcgcgccctccccgccattccaagtccagccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggctagactccgccgggccggggagtccgtccgggaggcagaggcggcgcgcgcacgccaggcggcctgccaaacccccgacccgactccgcccgaggcgacgccgacttccgaggccacccacgacgaggccgcgggcgcgccgctcgggcccgacccctcgggcgacgcttgggacgagccaggttcgggggacgcccccgagtccggcacgtcgatcggcgggccgagccgcgcggcacccacactgaggcggctctcccctctgccttccgctgccccactgagcgcggagcccctcctgcaggccttggccgccgcgaacagcacggtgctggacgggttaagtgcccagatggaggccctgcatgcggagcgggcggagctcgacgcggcgtgggcgcacgtcgaggaggggcggcgctcggtggaggccatggtggaggcgggccgcaaggcacaccgccggcacgcctcacagctcgaggcccgtcgtagggacctggcggagatcgccagggaggtggaggaggagcgggagactgccctcatcgccaccgccgtgctcgacgaggcgcgggacgacctccgcctccaatacgggagccgggcggcggagctagaggagaagctcgacgctgcccggggagtccttgacgccgccgctgcccgggaacggcgggcggcggagaacaaggcggcgtcccggcagcgcgaagaggcccttgaggctcgcgccacagcgctggaggagcgcgcccgcgccctggacgcgaaggagagaaacctggcggaccgcgaggccgcctgcgctaaagaggagtccgcactccgcctccgcgaggacgcgctcaccgagcgggggcgaactctcgaagaggccgagcccgcggcgcagcgactggcgaacagcctgttcctccgcgaggcagcgcgggaggagcaggcgcgccgcaatctggaaggcgcccgcgccgagagggccgcactggatcagcgggccgctgagctcgaggcgcgggcgaaggagctggacgcgagagcgcacagcggcggggcggccgcgggccacggcgacctagccgcccgcctcgcagccgccgaacacaccatcgccgagctgcaggcgcgctggactcgtccgccggggaggtcgaggccctccgcttggcgagcgaggtagggcccggcatgcttcgggcagcaggcgggcctctggggcgggcggtacgcgaagtacaccgccaaccaggggggcctcgcccagcgcctctcagagatggccggggccctcgagcggctccccgaggagctcgaggagacgatcaagtcatcctcgagggacctcgcccgggggccggtggagctcgtactggcaagctaccaggccagggaccctgacttctccccgtgggcagcactggaagatttccctcccggaaccgaggacggcgcgcgcgcgcaggtccgggattccgccgaccacatcgtccacagctttgagggtacggcccctcggctcgcgttcgccctcgacttcgacgaggagggcggtgacgacagtgcggacgacagcgacgacgaggccggcgacccgggcgcgtcggagtgagcccccaaggccccgccaatcttaataacttttccttcttcttccgaggccttcgggccccctttttgtatagactgatttaatctgcaatcaagtaaagaggaaatttctgcgtcagttctgtttgttgtgtgtataagacgaggatggtctgtgccgcggtccttctgtgtcttggcttgaacaagggctagtgcccaggtcccagcctcaaacggcgcgggtcggggctagtgcctggggagatccacgtgtcgagactggccaggccgggagagcggtgaccgagggttatggatgacccgattgtgggcctttgccgattcccccccggagttcaccacgccccgggaaacggctcggttctgggccccatttggcgattttagccggcccgggccaccgagggcagggtcgagcacgagcgtgctaattcaagccaagattcttcaaaaggaaacgatggcacagacacagtcctcaggaaatcgaaaatgcttttattgaaatacggaagagaaaaaagataagtatatgcatgtggtagcccccggccaaccctgcacgcccgggggggtgcggggttggcccgagcccgagacatgacacccgacccccactaggggtagaagcgacgaaggtgttcgatgtttcacgggttaggcagctctgtgccgtcgcccgtggccagccgaatggagcccggccgggggacgccgatcactcgatacggaccctcccacattggtgagagcttgctcagtccggcacgcgtttggacgcggcgtaggacgaggtcgtcgacgcagagtgatcgggcccggacgtggcactgatggtagcgccgcaggctctgctggtagcgcgcgccgcgcgccgccttcgctcttccaaatagtcgaggtcgtctcggtgaagctgatcttgatcagcctcgcaatacatggtgacccgaggggacctcagggtgagctcagatgggaggaccacctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcattggcgcgctccacttggccattgcttctagggtgggcggggtaggcgaagcagagcttgatgcccatgtcttcgcagtagtcaccgaagagctcactagtgaactgggtgccattatccgtaatgatacggttgggcaccccaaaccgaacagtgatgcccctgatgaatttaagcgcggagtgcttatcgatcttgatgaccggataagcctcgggccacttagtgaacttgtcgacagcgacatacaaatactcgaacccgcccggggcccgcctgaacggacccaggatatcgagcccccagacagcaaacggccacgaaagaggtatggtctgcagggcctgggccggccgatgggtttgcctggcgtggaactggcacgccctgcaccgccggatcaggtcgaccgcatcgttgagagccgtcggccaatagaaaccctggcgaaaggccttgccaaccaaggtgcgtgaggcggagtgggctccacactcgccttcatggacatcggcgagaagctcgacgccttgttcccgaggaatgcacttcaggaggactccgttagccgcgcgccgatagagggtcccttccaccagcacgtagcgcttgaagatgcgccggacgcgttcactccctt

SEQ ID NO: 10732 - DNA, 4597 bp, Oryza sativa
tgggcacgtgccgaagctctatcccgtcgaaatggcgctccatatgccgcacctggcgcacgtaagcgtccatctgcgggtcagagcactggtactccttacagacctggttaacgactaactgggagtcgcctaacaccaggaggcggcggatccccagtccagctgccactctgagccccgcaaggagtccctcgtactctgccatattgttggtcgcccgaaaatcgaggcggaccaggtatctgaggacgtctccgctcggcgaggtcaacgtgacccccgcaccggcgccctgaagagacagggaaccgtcgaactgtatcacccagtaggcggtgtgaggcagctgcgaggggcccgagctggcctcgggggcggagacgggctcgggagctggggtccactccgccacaaagtcggcgagggcctagctcttgatcgcgtggcgtggttcaaagcgcaaatcgaattcagagagttcgattgcccatctcaccacccgtccagtaccttctcggttatgcaagatttggccgaggaggtaagacgtaaccaccgtgacccgatgggcctggaaataatggcgcaacttcctcgaagccatcagaatagcgtaaagcatcttctgggcctgagggtatcgggtcttggcgtcccggagggcctcgctaacgaagtatacggcccgctgcacctttcggcggggccaatcctcttcgccaggggccgcatctccagggcgctcttcgtccgagaggccacgcggggcgcactcggcttctgtgccgatgacctcggggtcagagggcgacaggcgcagccttcccgcagtggccccggggccatcctgggggtcgggggcgcctggcaccgtcggacaagcaggcggagggccagctccgaccgtcgggggccttggccgccgttcggctcgggggcctctcctccctgctctctcccgggtcgagtcgacacagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgaaggcctgctcagcctcctccgtccaggtaaacggcccggagcgtttgaggagcttaaataggggtagcgccttctctcccagcctcgatatgaaccgacttagggcggccatgcagccggtgacgcactgcacatccctaagcttgctgggggggcgcatccgctctatagctcgtatcttctcggggttggcctcgatgcctcgggcagagaccaagaacccgagaagcttgcccgcaggcacgccgaacacgcacttatcggggttcagctttatgcgggtggagcggagacttccgaaagtttccgctagatccgagagtaaggtctcttggttgcgcgtcttcacaaccaagtcatcaacataggcctcaacattgcttcctatctggctacccaaagaaattcgagtagtacgctgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttggccttgggaacaacgaccgggttcgccagccactccagatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggacccctggcatgtctgccggtcttcaggcgaagacgtcggcgtttgcccgcaggaaggagacgagcgcgtcttcctatttgtcgtccagaagaccaccgattcgtgtggtcttggacgagccgtcgcccagggcaacctccttgaccgggacctcgtcgcacgtgaccatccgctgccttggggcggccgggacggaggtgctgagcctctcgtcgccacccgcgggcttggacgccgcggcgaggtggtccgcgcgctgctccatacaagcaagcgcgactttgaggtcgccatggacggtgatggggccaccggggcccggcatcttcatctggagataggcgtagtggaccgccgccatgaacttcaccaacgcgggcctccctaggaccgcgttgtagggtagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatgtccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcgccggttgccggtgggagccgccggggttttgccctcacagcgctcctgcttcttctcctcctcccacttcctcgtccgctcagccaaacttttgaccgcgcggcagtccgcgaggtcgtggaggaaggtgttgtgcacggtacaccacttgccggtcgggcgctccctgctgggagcgccggcctccttctttttgtcgctcacaggcctcccctttcggggggcccgcgaagcgccctcgacggcgaggacgtgaccctcgtcgtcggaacgggccgaccccttcttcctcttcctgtcccgccgccctgaccgagcggcggacccgggggcggccgaagctgccacaccagaatcggaggagttccaggtccaggcctcctccttttgagccacacggtccgcgagctcaaaaagctgcgcggtggtctggggctccttggaggcgatcttctcgagcatgcggttgcgccgtacgccccccctgaacgcgtagatcaccccgtgtgcggggatgcacggtatggtgttgcggacttgacagaaccgctgaatgtacgagtgaagagactcatcgtcccttcgctgtaccgcatgcaagtccgcttcttcgcctgggcgcggatatatgccctggaagttcatggtgaactgctggcacaaatccttccaagagtggaccgacgcgggtggcaagttcattagccaaccccacgcctgacccttcagggccatggggaagaaattcgccatgaccctgtcgtcacccccggcggcctcgatcccggtcgtgtagatctggagaaactcggcggggttgacgcttccgtcgtatttttcggtgatggtggggccggaaccttggggccaacggacgttccgaaggctcgccacaaaggctcgacagccggcaccgccaaccggggacacggggggccggcccccgtgcccggaccgaagtggcgctccggacgaggaagcgccctccgttgcgtgggcggcgcgcgtcgcgccgccgctcgatatcgaggcgggcatccggccccccacgcacatcttcttgggtcggaggcgttgacgagggaatggcggacgaacggcgggtaacggccgccgctcgccgcgccctccgcctcgacgacatggagccggcggcggcagcgccagaggcctcggtggcggaggaccgcccgccggcgcctaggcgctgctgcgccgccatgaccaagtcggccacgtcatccagccaacgtcgggctggagtctctggatcggggacgacgggcgggtgacgcaggagcgcgcccgcagcctggagcgcgccctggggcgtgccgccatcgccgtagacgaggcggcgacacgccccgtctcgccgtcctcccccgtcgcccgcgggcggtgaagtcgcggttccttcgaacctccccgagcgcctccccccgcccaagatttcagtgagagggggacggtggggtgcgagcccgacggcgcgggttctgctccccgtcgtcaccgctagcgttcggagagaggctgtgcgccactgcccgttcggccattaggctgagcgggagaagcttggtgcacacgaaagaggacgagggcttaaaaagacacgcgcgccccctacctggcgcgccagatg

SEQ ID NO: 10733 - DNA, 5606 bp, Oryza sativa
  unsure (1)..(5606): unsure at all n locations
cccccccccccccccgagggggtcaggccacgtgggtgaccgcggctacccaagcctctagtcacgatacccccggccccatgtcaccgacacctgcatatacatatacacgaacacttgtggaatatgtgagattaagcacctatcactatattggatgttttattatctgaactttatgcagatgttgtcggtatagaatctgcatttaacatccgccaacattcactaaggtttagggtaaaggaaataattagggtaggttaaaagagttctaaagaaataatacttgaaccaaaattaagaataaaaagagttcaaataacaatgattttaattttgctaatatagtcaaaagccagcatgatgcagtcaaattttagtttaaaatttgaggatgttacaaacctacccaccttaaataaatctcatcccgagatttgcttaggagtcttcaaaaagatacgggaattccaattgtaaataatcttcccgtttccaggttgcttggtcctctgtatggtgattccattggactttaaacaactttattaccttagtgcgagttgttctttgtgcttcatccaaaatagtagcatacaacataaagagtctcatgaaagaatcacatattcattaaccaataatgagttatctatttcaaggaacaatatcggataaatatgtaaatatagtatgtgatacaatcatctctatgattgcctctagggcttatcaccaacaggtatgatggttatggaacgcgaaaagacacttctgccctccaaccgtcatttaggagctcatctagaccatccacgcgaagccccagttcgaacggctgtggtagtggttggccgaaccatgggttcgaccaaacccaggtctggctcgacagagcccatcttcggcctgttgctccttctctgcgtcctctatccatttctgtgagtggaaagcccatttgaagatgttttctggtagtttttggcccactcttggtatggataggaattattcttcactcaagtctatttttggtccaactttggtggtttattacctgcatacaaatatacaccaacactcgtggaatatgtcagaatttaaccctatcactatgttggatgttttatttccttgatttatgcaggtattggtggcataaagtctgtcattaacaacagccaacagcctcatagttaaaatcctccattctcgcattagcaagttgcttttggtgcaaagttaactggcgggtatattgtcttgtgctaacccctgctcgagttcgctttgtattcttgcctttgtgcagtcatgaggagacggctctcccacttgctcaagggatccggctcccgatccaaccagtcgagcgatcgggcatctgccgacgtgtcaatggagaacactgacgctgtaccacagctcctgaccgacaacgacctcgatatcgttgacagacgagagaaacaagcctaccagatgctgaaggaccgatcattcgctcacaaccgagcgtacgatccaaagctactccggaaaacaagtatggatgtagattttagtgtcatttggagaaccatgggttggcacgcctttgcaacggtagacgagcttggctcttgtctactaactatacagtttctgtgcacacttaggctcttgtctactaactatacagtttctctgcacacttagagaagcagagggtggtgttactttttgacttttccgtaaagagtttaatcttttatgtagtggattgagcacacttctcggtttccccgaatcctgtagagtcgatttttggaaggcaacttccggttttgagaaaaacatattctgtgaagatatttctggtgcaccgatttataagaaacccagaaccaatgacatccataatctaactcttaggcttatgtacaaatggattgccatgtctctgataatgaattgattattctatatgccatggttcattagaaactattaagtgtggcggaaggggcggacgctgggcgtgtccacgtcggattttgctacagtagctacagtgcgaggttggatttttgcgaaaaagccctccggttcttcgtaatcaggtataggcccctcgcgtcctgtgtttgaagagaaaaaatcgcggacaggggcttcgttgtgatatgtggaagacgaggggctttttcgaaaaaatactcccactagcgcagacccctcaaaccctagccgcttgctctccctctctcgcgccgctaccaagcactggcgcttcgccttcccctcacgccgttcccgtcgcctcgcgccggcgacttcacccccgtcgncgactgcccatcgagctggcaccttcgactcccgcgtccccatcgccggccgagctgccgccgtccgtctcccctccgccctctcttcccccactctctccttctccctttccctctccctccgccgtctcctcccccaccctcgcctccgccttcccctcgcgccattgcctccgcctacgcagccgctgtcgtcgcgtcaccgtctccaagcgcctctgcttccgcatccccctcgcgtcgtcgccatcatcgtccccgtcgccctgcgccgctggcgccattgcgtcgccgtctccgaccgccgtcaccgagtgcagccgtctccgcctccggcatccgtcaacgacgaggtcggagcgccgacggctgcatcacaggcggcgcgaaaagctgagggcccaatcctggcggcgggactgccgcgaggttccggacgcatcaactcgagggggagacggcggagggagtgggggttgaggcgggcgcggtcttcgtcctcccggcgccagatctgcttctcatctccacaaggacaccccagcccaccactcatcggcgtcgccatggtcgtcggcgtcgccctcactgtcgccgtcgccaacagactgcgttaagaagccacttcaccaccagcagcagcaggggcatccaccgtacgccgcaccaatgccttccccttccctcccatctgtgccctctgggtcacaggtagtcgcttcatcggcagccgcgttgccgtcaatgtacaaggccaatgaccagcagcgagcaactcatggcaccagagacggcggtggcgacggtgactactaaactcttggcacaggagcttacaaaggatgtgcaggtttgtgtgagttgttcttttaaggttgccatgaggaatagttaatctcgttttttcccctatacaccatgaattgttgcacatcaacattgacagtgattttcatttttttattaatgcaatggagcaacctaactattataccaatttaccaggtgctctaatgccactgttggtgatgaaattttgagagaccctaatcttgccatgtttatgatgttctacagaacctgcatccattccatctaaaagaactcatcagctgggattgaagtactgatcagatctttttttctaggtgaactctagaagaaagttcgaaaaatgggacattgcaatcacaacattggaacctaatatcaacactatgctcattgccataggttctcccatttgtatagcatttagagatttctttttttataaaaaaattgtgaacaatttccataaactcacatcaaggtgtctcatgcagtgccaagtaaagaaagggactacaatgcttattcaaaggattatatgtcttccatagtgaagcagtcttgcactaatactagaagctgctttagagatggagacatcccatcaaaaatctgcaattacccaatgagtgagccattttttccccatgataacttactatttcagatatgtatttctatacatgtggcaccttttcattctagtgtttttttgactgggcttttcattccagtgttgtgcctgaggatcatataaatgactctgatcaatcctccacctaagctggttgctctgcttgctgtgaccatgccacgacatccgaaaacacagaggaccaggttggttagcatatttcatactcggtgccctctggaacnatcgatagagaatcacttctagcnatctgttatgattcatttccagatgcattaatctattctctttcttagtacttacttgggtattttaggttttcttggggcttagttatagaatagggttttggagtgggtttgtgaggggtgattgaaaagttgaaactcttttgccgcgaataaatctgcagtaacatgcctatcatttcacttcagagccaatgcatttgggtaatgtctcaaaatttgttttgtatttggtggtttcggcttttttggttgaaggaatctgcaatatatcatgcttccccaatgagtgagccattttttccccatggttacttaatatttcagatttgtatttctatacatgtggcaccttttcattccagtgttgtgcttgaggatcatataaacgactctgatcaatcctccaccatagctggttgttctgcttgctgtgaccatgccatgacatctgaaaacacagaggaccaggttggttagctatatttcatactcgttgccctctgaacaatcaatagcgaatcacttctagcaatctgttatgattcatttctagatgcattaatctattctctttcttagtatttttcttggtattttaggttttcttgggacttagttatagaataggattttggagtgtgtttgtggaaaaatttagaagcttcacatactggatgaatttttttagtagttagcgtattggttattggcagtcaaatttttttagtacaactggtaggaggatgagcttatatttggcactattattcaaaagatgttaatctcaatctcccattttactgtacttaatgtttcttaaatgttaaatacttaaaatgggactgcagttggtcactgatggttgcttgatagccataaggaaaagagagacaaaaataattaattcatgcagaggtttcagtcaattgcaaataatatgagattggttgacttaaaattgaggatggtgtggtatgatgagcctctgttgatctgatcattttcctttttcatgtcaggtttgacacctttggattgcataccagaattttccatgttcttcagctctcaataattcatcttcaggtaatatgatggtagtccaggtttttagatgatttgcatcaaggggtgaaaataaattgatcagcactgcaacattgatctttcttatgggttgtcgctttagctaccacaatgcttatttgcaagctcgtgatgtgttgcaaggtctagagtagtctagtgaaacctatgtcataagcgccacaattccaaaccgaacctcccccagtgtactgttcgatgtggctgctatagttcttttactaaaagtatgtaaatttatttgttctatggcttgtgtagaggagaaagggaagtgaggaaaatttgtaagtgaagaatttgacagattgcgacgggcaccagttatgctggtaattttcttgaacctgacactaatttcagggtacgtacattcttaatccaagccacaacaatgtctgagtggttttatatgtcgaccatctg

SEQ ID NO: 10734 - DNA, 719 bp, Oryza sativa
tgcaaacatgcatcatgctaatgtcgtcctgagcttccagattaggccctgctgtattgatcaatatattcaggtcagttgaggctctaaattaattctgatgataatttttattctgctgtatttgacgggcctcatgcatctgaagatctggattactgtggccgaattcgtgttctgattttggggtgtaaaatactgaaatcaataccgctgtccttgctttcatggggggtatttggtgatttggttacttcgattacatcgagttggaatgtcaatgctctctgaacctcgaatttattactgggttaccgcattagattattggcttcgcaagctgggccttgtgcaaatgatcctgcgtgaaatatgcacataatttgcttccccagacgagtttctgctaactattctatagatcatttgcataacccagcagccagctgtttctctcttcttccttttttcccctctgaacatgtttacttaggtcaatttccagacattgaaatgtcttgcaagattaaaattcaaggttactccgctcattctgttttgagagagttcaaggctagaagagtaaagttagtaagcaaataaaaatgatgcaaagaatatacttgatcagagctaagaatgctctcataagtcataagtctgaactcccagaaataaaacgtcaagctcttcgaaacatgatatatgccatttaaacc

SEQ ID NO: 10735 - DNA, 7186 bp, Oryza sativa
tgaaatgctacctcacagtgttacatgattatgatgttctttcttctttcttttccttttggcatgataaaatgaaaacaggatagaagttggtttaattatgaaaaggccatggattttctacagcattatctgtggtgacttatttgctactcttcatgcactcaatgctaaccaaatgcatgaatagaatgagaaaatagtcccaggtatcgggaaactgtatcagacacatgcccattcattctaacaacatttcagtttgattctcaaaattcttcatgccatcaaagtaaatactatctgcactgtctcaaatcaactacaaagctgtcaataaaaaaacgacaaagaaagggaagaaatggtgaagatagagcttactacttattttaagcacatgtcttgattctcttgagggctcaatcacggacccctttggtaatttgtattcatccttgaaaagtgaaatgaaactgtggagaccaaggtgtcaaagacagaagaaacttgtgtagttatcattttaactcgacaaaggtatgctaagattggaacttacgcattaacaaaaaaaagtggaacaacattatttactaaatagagtgacaaacctgaaactataatatgatttatttttctcagctgatgattagttctgaatcagtattgctcttcttcacaaatgacctctctctctctctcagcatgatgacagcattatttctatacatgaggatattgtgtatccggataagaatagcattatttgtaggtaagacatataagaagtaaatatatttctaatttataaactgagaatgtattattaagtgctttaacatgtcatatgcagaagttgctggaatgctagataatcttgtcctcttttaaacatagcatgggaattatagtagaatcaagatgctttcctttgcttggtaaaaatgttttggactgcatttcagaactcagaccatcatctatttcagtgtaattacattattctgcagaaagacacacaaaactgtcatggaaatatggaatagatagttctatatttataaggcatatagttcttaattcatttaatcaagccgagtgctattttgtgtggttcatgaatctttgcattacctgtaaagctgtggtttatatatttctttgggagctaggttcgcttggtaatataattgactggtagtaatatacattggttgcactttgaatgtgctgagaatggggtcaccttgcatgcttttttatattcttaaataatgatgaattttcatgtgaatgtatgtatagcatccacattgttcatgtcactgattaggaaaaatgtattatttgttcatgtatatatcatttgttctgtgttactataggctggaggctatagaaaaatatttcagccttgaaacagtcaaggacattgtggaagccatggtgagtgatgcttcagttgttttatacttccaaatctctgggcatggtatgtgctccttttcatttgaacatgagtaaacagaatgctgttgattggtacaatagctttcaaggctacattttatttccatctcattatttactcaaatgaatctcgtggatatttttttttggaattatcaagtattttttcaaatatagtagttatcgttaccgttttggcatagattttgttccttagactaccttttagtttgatcttgaaggttttggttccatatagcatatacataaattttgcttatggttcaaaacttttaaggagatgttgtaaacttgtaatcaggaaagtgaagcatctaagttagatgaggattgttgtaccttggccatgaaatgattgagagagccctatccagttctgttgagagcctcacagtgtttggtaagtaaagaaaatagaaatgctcacactgccattgccgatggctgacagattttattatatgcctgtcctacagatgaattgcaagctacaaatgctttgctgtagatatgaattgcaagcttacagaaaaggttgtgcactgtgggctaaaaagtcccattaaccaggaaggtgagtgttgtttttctcctttaatataagaatttgctacctcaattttttttactcatgtcagcactgagatataatactgatacatggattgatgctgaattatatacatactccctccgttttttaatagatgacgccattgacttttcctcacatgtttaatcattcatcttattcaaaaattttatgcaaatgtataagatataaatcgcacttaaagtactatgagtgataaaacaactcataacaaaataaattataatttcgtaaattttttgaataagacaaatggtcaaacatgtgagaaaaagtcaacagcgtcatctattaaaaaacggaggtagtatttctctagcttttactcatacgattaagatttcttttaaatgtcaatatatcttctttttatgtatttaagcgtccctttgtgcttttatttttggtttgcaagttgtttatgtatttcatttaagaaaggtgtatggattacatgtatataatcctcgcaaaaaatgcatgtatatattgtggatttagccatctattttccctgctctttcatgctttcaaaagggccagcggtcacttggtattgtgtgggtgctctgcacatgactatttttataaatatgtaaatcatgtttgcgtatccctgcatcttatgctagacgttgattagttttcagcaaaaaattgggaagttatacttggttgaaatcagtattttgtcgatggttgtcataaatatatcaaaagttctaaactagaaaaaaaatggtatccccaaatctaaaatatttccttatgagttcacgttaaatgaaatggcctcatgcatatacagatgagtatctaatggaatgattcactcatttaccaaaaagatagtacaatattattcatcatagaatgctaccatcaccgccactatgtttttttatattagtaaaagatggatgagcctttggagacttattagttattaagttacttatgcttttctcactttcagcttgaaggatactaatattagtaattccacaaatgacacaatagatatgctacaattttggctccacttacactatcctgtatatggctacaaaactgcagctgtgagaagatagaatggcattacttcaagggtaaaatcctttttttttttggtttataacttgatgaatgtgattttgcaaaatactcctatatattgctgctacctcataaaaatacatccatggatcaatgttcctctagcactgataggcctagaaacaaggttgtccttttttcccttagtgtgtgcgcactatgataagatgttactattagggtattagtatgtacctgcaggtctgcaggttcttttgaatgtgatttaattagctaatgtttgctttcatttcaacctgtttacatttttcaggatgtgatgcgatgctgaatctaatattggaaagtcgagccctttgttcttcaattgtcctatttgcaaagattatgacctttaaatttgtcatcaattatttatgacaccaatgcattctcttggtgtatgtaccaaagcaatttgtacgcggaattacttatattttttatataatgaaagcattgtgttcatgtttgaactaatagtgtaacaaactgaggttttagtaggggatgctttgcattgataataaagtgcccattactttgtagttacatgggatatttgttacatagaatggattactgactcaagtctggtgtcattgatatacacaggagagttaatatagaatatatgatgttactaatatatttatcaattgattgatttagtacatggacgtattttagtgtatgcaggcagcgcgcaatggcgcgccctagcatctagtaaaattaaagtttctcctgtgcaacctatgagtaggcaatggttacaaagtataaagttccctgctccagttgatctgttctgtctctcaattgcctaaggtggtgagaagcgggtgttctacaatttttaggcgtaagggtaagcctccgtgcacatttacttaacatgagagagagagtactcaaactatgcacttgtacattttaaatataacaatggtagcaactcctgatcaacaaccaagtttattttcctttcgtcctttacttgggacgagcaaaggtttaagcttgggggtttcgttgacggttgttacagacaatatttgactgccaatagaactaaaataatgaagaattagctatgcttacaatgcatgtttgttttcaaataatatatttccacttgtacttggagaataacatgttgcaggaatttatcaaataaaataaagagaaattggagaaaacctcactcctaaacaagcaaatggatacggagggcccacatgtcaagtgtaaccgccggaaacagccttaactgccaaaatcgccatgaggtcccacctgtcagccaccctgccgaagctggaggcctgttgggccagcccaggttcggccgaaccctggcggcgtccaatcagcctagccttacacgtggatatccaagattgcttgctgatgatggttacaggggtaaaatcgacatttcgcatatcagtaaccgtcataccgaccctataaaaggaggagttcacttcacttctcaacacactcaagcaagctcaattcctcttcatacattagtattagtggtataatgctaagtgtagtagtatagaatagtgttcggagtcctcggagtcttcggaagagttttcggtatggctctagcagctcttgtaatctcttctgtaatactttccgtattaatgaaatactcttctttatatatcttcggtgctttgcttagtcttagtactggtcttactttatatctgcattatatgaattgtgtgggtagcctaccagagaggtgtaatggtgcgagtttaatgtctaatttatcagttgctctatgtcgggtgcacggctatagagtagtatttagtaatgttagcatggtgcttagattattaaatatcattaattgggcatatatgttgcaggacattagaggtgggccgctgatggtgatagctcagtatgggtatttctccacgttagtatatattcctaagacaaattcgaagggagggtactcctctatatgtagccccggttggacggccatgacaggttgtcgtaagtatctcgccaacccagggtggtctctcgaagtaccaggaggacactgttagggggtattggccacatgattgtatattagcagatgtaaactaagatttgagtgtatattagaagaatagtaatagagtgctttatgtttcttccacttagttaaacttattttactagtaatatgtccgtgctaacgctacgacattatttataatgtaaagcaaacaaccaaaagtaacaatatatgtttcaaaagttttctgacattatgttcaaacaagatcacaagtattaagcacaaaaacgtaaaagaaagaaaaaaatctaaataaataaattatgttctggagccttagcatcgacatcatcgttaagaactaaattagatacaatactattgcatcgtgcttatggagcattaatgtcttccatcttagagaaaacctacccatcaaaaccatcatcactaccaggcaaccatatgcctatcttagtaaataaaaaacaagctaacttattcgttaggaacctttggattctcccagttctctcctcaagcaacgatcttattgaatatgccaccatcgtaattctgatagacaattgtaatatataccattaggaataatacactgtagtgtagcaaaactgatgtctagactggagagataaaccttacctgaattcaaaagaaaaccaacttacagaggctacatataaattgtttataaattatatatgtttaaatctacaaatagtactactccatttctttttcacaatctttgccatgtactttcggcataaattcaatggttaattaatcggggtccaattacatagaagcatgaaaacaaacaatttgcttgaaaagttcaaaagtgaaaaattgaagctattagtgcagattaaatcagagcacaatgaaaaatccaaatacactccactaacccaatttaattgctaggctacctgtatggtagccaaacccctcagccattaaatgcttagacagatccctcgagagtagtagaaatccctaagaaaacatgcagttgtcggttgctaaattatgcttagcatcctaattacatacttacggcaacatgatgatggtgtttaaccacctcttgctattttccattttgcaccctttcattccttcgcatgcctccccagaaattggtgcagcaaacacgatcccatctacacctccatacagtcagattggttctttgacttcttctggaccatggctacattggtttctaaatttgttaaattcagaaatggtctctctgtatcatgtacatttgcttgttgaaattataagcacataatgatttaatttattccataaataaatcatgatattgcagatgtaaactagcatgaacgcatcattagatctacacatgtaaactaagcagtaaaacatgaacagatcaaatatgcgcaacatatcgaacacgtaccgaggtggtggaaagactggttgctcagcaggaactactcgcggttgcgggagtcgacgaaggcgcgcagcacgcgagcggagaggaaggcgagccgtagcgaacgaacagggagcagtcgcacgaagcgcttcccaaaaactttattgccgccttctcccggtgcaggacgtcgaaggcagaggttccggagacctgctctcccgatcgctggtgcacgccggcgagcgggatggagtagtctacgagcgacggcgcagcacagagtaggaggcaaatcctagattgatttcgcgtatgttacgtgaaggcggcggctcggtttatatagagataggtcgcttgatcagggcgcccgcacgatctctactccgtgtaaccgaaccggataagtcgcgcgtaacttatccggacttcacgccgttttcacgcaccgattttttggaatgtttcc

SEQ ID NO: 10736 - DNA, 10339 bp, Oryza sativa
aaaactgcaaaaggaggctgcatctgcgcaaggatgaggagcacgacgcgcctgcccttccctgccaggcgaggcgaggctagcgcgtgtgttccccctcttcctccaccacacatgcttcaagtggctaggagggcatcctcccttttaaggaggtcctcctctcctagaataagcaaggtggtcctaaactccacatgcatgccatcccatgaggtgggcttttgtgattttccaaataattaatcttcgaatgggtcttagcccatctattaattccaacaatcccccaccaaatctcaaaatcccactgagatttgccttttcaaatgtactgtttatataccagcggttcgatggagaccgattaaggttgaacatccacctagaactccaaactacacttactcacaacttgaacaatggactacgccttgaattgcaagtctcgtgcaagcaagtttcactcagagtcttatctagtactataccgtctgtagactacccctcgggtggagcgtataagtcatactcctaggtctttagtaagcttcctagaagattcacccaaaatctccatagactgcgatcaatagtcaagcttacaaaggtgagttctttcaagaatgctctgcaggataacatcttcgctaattaaagccaacagaactcattaagccataaccaacctaccttgcagctcacgagagtacatgcatcttcacttagagagggtatagattggtactctcctctagtttactaatggtttgttcttcccaggttctaattcacgggatctccgatcacatagactgggttaccaccattgtataactcacatgggtctcaaacccatctccttcgatgcattgtctatcacatttcgtgatagtcccttcgtgaagggatctgccaggtttctagcagtttggatgtaatctaacattataaccccggagtttctcaatttcctaacagacttcaatcgtcttttcacatgtctagacgatttcatattatcattagaactattcacttttacaattaccgtttgattgtcatagttcataaggatagccggcaccggtttttcaacaataggcagatccattagtagatcacgcagccattctgcctcaacagtagcagtatccagtgccgtcagttctgctttcatggttgacctcgtcaaaatgatctgtttgcaagacctccacgaaacagcaccaccacccagtgtgaagacatatccactagtggctttgatctcatccacatcagagatccagttagaatcactataaccctccagtaccgcaggatacccagtatagtgaagccccaattctatagtacctttcagatagcacattactcgctcaagcgcacgctagtgatcatctcccggattagaggtaaaccggctcaacttgctcacagcaaaggagatatcaggcctagttgcactagccaggtacatcagcgagccaatgatttgggagtattccagttaattcctagcaattcttttgttcttgcgaagcaacaagctaggatcataaggtgttggagaaggcttactatcaatgtagccaaagcgattcaagatcttctccacataatgggactacaagagtgtaatcccattctcacctctaattagcttaatgtttaagataacatcagctacttccaaatccttcatatcaaaattttgagacaagaatgatttaacctcatttatcacctcaaggtttgtcccaaatatcagtatgtaatcaacatacaagcacagaataactccctcacccccaccatggtgatggtacacacatttatctgcctcattgactgcaaagcctgcagatgtcaatgttttgtcaaatttctcatgccattgctttggagcttgtttcagaccatacaaagacttcaataatttgtacactttgccttcttgaccttcaactacaaacccatcaggttgatccatatagatctcctcatccagctctccattaagaaaatctgtcttaacgtccatttgatgaacgagaagaccatgtgaggctgctagggaaggtagcacacgaattgtggtcaatctagcaacagatgagtaagtgtcaaagaaatcttcgccttctttctgagtatagcccttagcaacaagccgagccttatacttttcaatagtaccgtcaggcctgagcttctttttgaacacccacttgcaccctacaggtttacacccatagggccactctgtcacctcccaagtcccgttagcgataatggaatccatttcactacggacagcctccttccagtagtctacatcaggagatgcatatgcttctgaaattgacttaggagtgtcatccacgtggtacacagtgaaatcatcaccaaaggacttagccgtcctttgtctcttactccttcgaggagcttcactgacatcctccttagtgacatgttcgtgtgtatgtttagtttgttctggtggtgtgatcgaactgggaattatttcagagggttggctcgaactactatgtgtatccttcattgggaaaaagctctcaaagaaggtagcatcacgagactacataattgtaccaacatgcatgtcaggtacatcagatttaactattaaaaatctataggcaatgctgtgatgagcatatcccagaaagacacagtccataatctcaggtcccagtttgcgcttcttcgttattggtacattgactttcgccaagcacccccatgtgcgcaaataagaaagtgatggttttctcccaatccatatctcatatggtgttttgtccttatttctattaggaactctgtttaacacatgattcgaggtcaacaatgcctccccccaccatgccttaggtagctccgcgatgtccaacatggcattcaccaagtcagtcagtgtgcggttcttcctttcagcaatcccattagactcgggagaatatggaggcgtcctctcatgtataatgccatgttcctcatagaataagtcaaactcgtttgagaaatactctccaccatgatcagacctaagtgtttttatctttctatcaagttaattttcaacttctgccttataaattttaaaatagtctagagccttgtctttcgttttcaacaagtacacatagcaaaatctagtagcatcatcaatcaacgtcatgaaatatcgttttccacccttcgtcaacaccccattcatttcacaaagatctgaatgtaggagttctagtggtgccaagtttctctcctcggcagccttatgaggcttgcgaggttgcttcaattgcacacaactatggcacttagaacctttgacaatggaaaacttaggaattaaacacatgctggaaagccgagacatcaagccaaaattaatatgacataaacgtgagtgccaaacattagcctcatcatccacactgccacaaatatggtttacagacttattgcagaaatcagaaagggaaaagcggaacaggcctccgcactcataacctttaccaataaaatatccatgtttagacacgactactttattagactcaaaaaccaacttaaatccgtctctagttagacgggagccactaacaagattcctatctatagaagagacatgctgcatgttcttcagctagacgatctttcctgaagtaaacttcagatctaccgtgccaataccatgaacagaagcatatgacccattccccattaggacggtggaacctcgtgcgacctgataagaagaaaacaatgagatgtcagcacaaacatgtacattggccccagtataaacccaccaattagtagactaattaactgaaaaaatagtaggtaaattaccatacccgcttccatctccagtgttgccaatggtcacattagcagacttagaagtctgccctacaggtgccttcatccccttgcgttgtggacacttcctagccagatgaccaggttggccacacacaaagcaagtcctctcatcctgattaggattgttattgttcttcttctgcttcttgaagttggtggtctattgagctttgtatttccccttgctcttgttctgggccttgtgcacaacattggcactggactgcccaccatcgcccttagacgcagcatctttttcccgagctttctcctcaacatcaagagacgctatcaacccctcaacggagtattcctgtctcttgtgattgagtgcagtaccgaaacttctccaagatggaggtagtttcgcaataatgcacctggccacaaatttgtcgggtaagacacacttaaggagttcgagttccttagccatggtttgtatctcatgagcctgttcgactacagaacggttgtcagccatcttgtagtcttgaaactgctccatgatatacagatcattgccagcatcagtagcaccgaatttagtattcagtgcatcccacaactccttagcgtcagtcaaatgcatatacacctcgaccagacgatcgccaagaacgctaagaatgcatcccacaaagagagtagtggcttcctcgaattgcttctgctgatcagcagtaagaactccttcaggtttgccagtactcacccagaagcatttcatagctgtcaaccacagagtgaccctgatctgccatctcttaaagtgcacaccggtgaatttatccggcctcagtgcatcggcaaaaccagccatagtaaaatcacagcgcctataataaggtttttggattgtagaaattataagcacataatgatttaatttattccataaataaatcatgacattgcagatgtaaactagcatgaacacatcattagatctacacatgtaaactaagcagtaaaacatgaacggatcaaatatgcacaacatgtcgaacacgtaccgaggtggcggaaaaaccggttgctcggcaggtactactcgcggttgcgggcgttgacgaaggcgcgcagcacgcgagcagagaggaaggcgagccgtagcgaacgaacagggagcagtcgcgcgaagcgcttcccaaaaaccttattgccgccttctccccgtgcaggacatcgaaggtagaggttccggagacctgctctcctgatcgccggtgcacgccggcgagcgggatggagttgtctacgagcgacggcgtagcacagagtaggaggcaaaccctagattgattttgcgtatgttgcgtgaaggcgacggctcggtttatatagagataggtcgcttgatcagggcgcccgcacgatctctactccgtgtaaccgaaccggataagtcgcgcgtaacttatccggactccacgctgttttcacgcaccggatttttcggaatgtttctaaaacaaaaacaaatccaaatttcccgcagcaaaacaaaactgcaaaaggaggctacatctgcgcaagagtgaggagctaattttgcggaccattcgacgcgtaacaacgtgcacgcgcgccgcctgcttggccaggtgagcgtgcgcgtgtgttccccctcttctctccaccacacatgcttcaagtggctaggagggcatcctcccttttaagaaggtccccctctcctagaataagcaaggtggtactaaactccacatgcatgccatcccatgaggtgggcttttgtgatttttcaaagaattaatcttcgaatgggccttagcccatctattaattccaacattgctttggtccgataagtatgtgccctaaaattttgagttatcaatatacaaaatgcattaccgatgatgtagacagggtttaggtgctgcagctatcaagacagaatctgtaccatttagcattctagcaatctagcacaggtaagaactcactaaatgagcatcactgatcaaaatgcgacagatcaaaggcactggttgatatcgcaccgtactaactcaacatagccacgcgtagctgaacacctgaaccgcgctgccaccggaggccacaagcgtacgagcaaatggaaccagctcccagaaacaccacaacaggtaaaatttcattaattttttcagggttagtctgatcataattttcagtataacgctctcagctggaagaaccttaggttgagtattgcatataagtatttatcatgggattagagtagtaccaaatcttaattcagatgataagagtgaacaggtgtcgatctgtgcaacattactattcccacacaatgatatcttcagaagcttctgaaacttgaaaatggtttgcaaagttcctgccaaggaaaaaataaaataaaataaaattttgccatcagtaacattggaaacaagagctctgtttgatcaaagtcacagacatctagcgccaacagtctatgaaggccaatatctgtagcacgatttgacaatgctcaaaattttagatctactaaaaattgtggtagcatgttctttccaataaaaagtacaattaaagcacaacacagagatcaattgaagtacaattaaagtacaacttatgctacaggacctaacaagaaacatggtttattcaaaggacctaatgcaaaccatccaattttcatttttacatatatagttgtatgtgacaagatgatatcaagggattgttgggaaataatctctcggctaaggaaaccgagagaaaatcacgcgatcctgttttccacccgttgaccagcgtgattagctcacgattaaatttccttaaatgcacgcgcaatagtcggtagcgcaaccaacgtttccttttggagcagcccccgattccctcagtgcaaaataaaaggggaggccggcccgtgagaaggtgacaatctcactcacggttccaatctccccgacatcccaaaaccctaatttcccgattctcagttgcgcaggaagggattcgtagtgctgttccgggacaatgtaagtggtgaccggaaggccgccgccaccccgcaggtgatcaccggtgacctcttcgggatcaagccggtgtactcactactacgaccacttctcctacaccgacaattcgcgaggtggttcgaggttctgcatctctacatccactccagactaagcgagaacaattgcaatggcttcaaacaacggtcagtaatcctaaattctgcattagggtgatcatgttaggccgaccggaaggccgccgccaccccgcaggtgatcaccggcgacctcttcgggattaagccggtgtactcactgctacgaccacttctcctacaccgacaattcgcgaggtggttcgaggttctgcatcctctacatccactccggaccaagcgagaacaattgcaatggcttcaaacaacggtcagtaatcctaaattccgcattagggtgatcatgttaggcttagcacttatgtcttagtagatcgcaatatctacagggattaccttgctttcaggcagatgttccagatgattagccgagggcgtggagctgcgttggttcagagacggtcgtggaagtggagcagctatcagcggagtaggcagtgatgcacaacctgatggaatacgcgtaggctacgatagcataaatcaaaattttctaccgcgtaaaccagaaaccatgcaagtattagatcataaatcgttaccactcgacacgctgcgtagcggaagaaagcgctaagaagtcgaaggaactttcgcgaagtagcgcgcgttgatgtagaggaagtagtcgatcgcaccggcttgaccttctcctcctcgtgcgttctcctcgccgtactcccacgtcgaccagcaccgaaaccaacggcgcctctaccggtatccacacgtacagggacggaacgccacgcgcagatgtgctagcacccgctcgcggctagggttttgctcggggaggggagtggcggctagagtttctcacatgatgcaatacctccgccgatcacacccctcacgaatatataggatccatgattcgggcctccaaggcccataggactcctatttgaatccctatccgaattaaactcatattggatctccatccaatccccttattccggcccattaagcgtgcgaccctgtagattcatgtacactcggctgtaacccgaaaactcctttcggtccacgtgacaatagcggtccctagcagaacgtattgacctaccgggcatacataaagatcatattggctgaacctctagtgtatacttgtatgatccactttgcctcacgatatcgattaagctcaaggctagatatgtgctatcctctaatcgctcaatcattcactcgaacctgtgatagattatataacttgtgattgactcatcaatcacctttggcatggccatgcatttccataatctacaacatcgaggggcccagagatatctctccataggaggggcaaatcccatcttgattattcatatcacactacatgtttcacagcatacccggaaactacttttataactacccaattacggagtagcgtttatcagtctctaagtaagctactacacatgttgggaaccatgataatctcaggtctaaggattcaacaccaacactaaatgagatcactgatgacacaacacatatggctcttgcggtgtctcatgttgggtctatccaacaacatgttccccaacatgtgttcacattattaatttggtatctctactagttgggtgcccgtgcattgcaacgggaaaaaaataaacagacatattaaattacattgcgtaaaatgcgtaaaatgctgttaaataatcattgagcctaaatttgttgtaacaaaaaccttaatataacatgaaccataaaaaccaatctagtcgcagtaaaggcttgtcatctacttcctccgtttcacaatgtaagtcattctagcatttctcacatttatattaatgttaatgctagaatgacttacattgtggaacggaaggagtagaataaatagccgaaaatgatctaactttaactcatgccacctattatttgacctcctaatccagcggtatgcaagaccaccattcctccaggacgcatcaacgcgtactttcatttgtatatgcagttccttcgaacacgtgagtaccacgctcctttcatattattgaggagatcaaactcataagaaaccatgagggcggatccaacattgtagagatggtgccacatgacatcaattaatttttactacacataaatgtaggtcagaacttgtacaatgtatggtttaaaaatatatattgccaatttctacagaacttatggataaacagaaacaaaataaggcttatgaatgaaaaaaaagaaaataattggctggtagaacattttagtatattcatagctagaaaatgtgtaacatagttctgatgttctatagatggcacatctcagttttgataatgaaaggttgctagcacgggtgcaaaacaaaagagtaaatcaagacacctcacagatactctagtctggcctaccaagtccaatagaattcataagcgaaaaatatatgctacaactacgtatgaatatacaagagaacacagttcgtaagtacattctatcagcttgcaattgagttccctctgtagatcagaatcttacctttttccatagggtgttttcaaagtttcaacttcatgtcaaaaaagagaggaaccattcaaaacaaatgatcatatgatatgttactgaagatccatttgaaaagaagttgaataaaaaaggaactaaatgaagcttactggcatcttcttccccgccagggtagggatgcaagcgggccgacccgcgagttcacttataggtcaaataaatcatattttatgggttttcgcgtcggtccagtttaccgcatcatagatatgaaaactcatttatagatcaaattgataggtaacccgttggtcaaacctgcaggttacgtactaattttgcctataagcgggttcgtggacaatgtcacgcctagaaattcactagtaatttccgaactaatttgtgtatagaatcctcgtccaggaatcagccgaggtacacaaactgacaatttaatatagaaatccatcataataataacgttacatacttacaaaacaaaagaaaatcagcagcggaataacggtctagcgatggcttcagctccactcccacaggcagctcaactggggtataagccaaacgtcttcttctggatccttttcttcaactgaggttgattgattattgcaaggtgagcatatgacatactctgcaagccacacagcaaatatgcaagtgcacaaggatacc

SEQ ID NO: 10737 - DNA, 15231 bp, Oryza sativa
  unsure (1)..(15231): unsure at all n locations
ccaggagctaagcaaattattaccagttatagcatcaataattactgtgagaggtgtgagactaatcacgaaaaacattgttcaacctgcccatgatcgcgggcacggctattcgaatagttttactctggccagaggtgtatcaccactgtacccacaagacacagctccacgacatgtcaccatgcgcctcaataccaccacggtaccttggaaaggaactgtgacagtacccctcgcacaacacaactcaccacagtgcaccattcctggatcataatcaccccctctacaaccagaggcatggactccccagcgaccctcatggacttctcgccgcttctcagtctggtgccccgcaatgaaccatgctatacgaaaggtaaatccgttgcccacgctggcttgtgcttggcacggtaaatatttcacaacaatagctcgtgaaccgttccttaattgtcatgagcacgaccttcaaaaccatgtgctcacaacccaccattatcaagttttaattatcaattaattatcataacacaattaaccatcgtgagctaccattaaatatagccataagtaacaatgtagtgtgattcatctcatttatggctaagcaattatatatatagcatttagctgaaccaatccaatatataaagtccaagctaatcaatttattacccataggaaaataaagtcatcttcggccataattaattgggaatggctcaccacccgatgacattcgaaaataatgcataagttgaaataaaacaatagctttagataggttcaacatgctcaaagggttgtttgagatctgtgtgacttgccttgcaataatcggtcttcaattaatcttcttgaacacttccgacgcactcacgaaccttcgcaacgacggaaacaacatgctaacacgaaaaacgaagaaaaagactaataaaaaccaaataaacagtacataaaaagtagacaaacatgtagatcatgattttagatgaatttagagacttgaaccacttaattccgacttcatatgaattagttatcaattttacaagataaatatgattttagccttatacagaacaggattaacaatgtcatgacgacatcattgccggcgatggagggtttaggcggccaagccgaggcaccagaagaaagagcacgacgaggggaactcactgaggggcggcacgacgatgaaaaacggctggcgatgagatcgggagtgacgacggggtaccgatcgatggtggcggcggagtttcagcgacgggagacgacaaccgaggggtggacggggttctcctcgcagctgcgatgccgagggaggctgcggcgaggtccggcgaccttggggtcgatgaggaggcttcgccggagatcaaaacaaggcggcaacccactggttcacggtgacggcaatctcccggcgggatttggcgcaaaagaaccggtggccggggtagagctgacccttgcgaagccgagggaggcgacggctcaaggcggcgttgaccagagaggcggcgcggcgctgctggagatggtggcggcgctggagagagagggactcgcagggagagacggctagggcacgggagctcgagctaggggttggaaacgaaagaggagagcttgggggttctatttatagccacgggagagagatatcgggcttggaacgcaaggaatcgcgtcgggaaaacctagggtttggtggagagataaactcgaaaacgaatccaaattcgcgtcgaattcaaagggataaaaccggatttttggggaaagagatagaggaggataaggaaacaagtcccctcaactaattttcggaaaacacgagagataaggccggattcggaggagaaaaaccgagccaactcggtctcagttcggctgtcctgaggttgaagatgaacagtagcgagggacgtaaagcagactttctccgagagcatcctctactaggccggattgaaggagggacctgaaatggacttcggaggagggataaggccagccgaaagggagggagaatgggccgagaactaaaggtgaacctttccagtttcggcccgaaaaggaaaaggggattttaattacttttccaattaaattaatcactgaaatgatccttgaattgttaaaaatacttctattgctcaaataatttcaaaaaaaatcctgaaagtacttgaacactataagtatttaacaaaattaaaatcagaccatttaatgattaatttaatatgtgaataattacttaaatgttgtttgtattattaaaattaagaattgagctccgaaaaaatcaaagaaaattccagagagtataatgcgaacttaataaaaattaaatccagccatactttatatttaggaaattttatttcccacatttaactttacttgtaaattaatgaacatttaatataaattctaaaaataatttattaaataatttatgaatcntagagtgaaatcaagtatgtggcagacaggcccacttgcacccctagcgaagggagaggcgaccacactggtgctgccacctcccccgccatctgcgtcgccgccttcccccaccatccgtgtcgcttctttcttcctcaacttcgccggcgccgcccaccacctactccgccaccttcctgaccgcgccacctgcccccgctattcgcgccgcctttctcgccatccgtggtgtcgccttaacccaccatccatgccgcttcttcttccccaacctcgccggggccgcccaccacctgctccgccgccttcccggttgcgccgcctccccacaccgagccgcgccatcgcaactgctgctgcctgctcctcattctaaccgccctcaatgtcgtggatggtaggggaaggcggcggcgccagcatggttgcccctccctttgcccttttatcctctcactcggctcggtctcagttgtgagtgcgtggtttagagagagagatggcagtgaggggcaaaaagggccaagaaataattatttagatgaaaaatagtattttgcaaatgcaacagacagcgaaaatggcattgtagcgaatgcccacaacttgagagtagcattcgagcgaatcctgtaaacaatacattattaattacatgctaaaaatgtaaatttagttgctactgactataggcagatttcatttcgttcttgaataaattctgtcatgaaaaggatatacatttagcatgaagagatgtataccgtttattagttgactatagatacgtgtacctacggtcagccaagtcagccactgaacagcaactgcccccctccagttgccaattctgggttagccaacatgccatgcaagttaagcgagcagagcagatcaaaaagaaggaaatggagtacacagtggagagtgattatctgtgggaagtgaatgggggtggtactgcttgagatactaacagttaccaaaatgaccaaatatatatttagtttctttcacatagaaacataattgctatgtaaatcaaaatgtatcttaatagcatgtgaggtggtatacaacagaaaattctattttaataaccaaatggacataacaatcatttagttgagccagcctgatgcaaaaattcactgctttcccatttgctcatgtactgtcatgttaagtcctaagggctgagtgcacgctacagaaccctataaagattaaataatcaaataccctcaacctagctccacaactcgagaattgaagtttcctaaatgacggtggtgttggaaatttagtcataatttggcatattttaatccaaaatattaagacaataaatataacatttgcaatattagtagatatagtgacagtgctacatgtatacaacttgagtatgcttaatatagaataagcatcagcatagacaagagaacacaataatattgcgaccgacagttgtaggaaacaaagaacgaacggtaagagtgaaacgttataccctgagaatggccctccgctggagtttgagacagtattgcctccgttggtgttgacgggaagctccttctccttgtctctagtgttgttgttgtcgccggttgtcaacatgttagtgaagatgatgcagagcagtcgcgcttgaagcgctacccaaaaacttgatcgcccacttacccgtgcaggttctcaagcggacggagtttcggaggcacctgctcattccgatcacccgtgcgcacgggatgaacagaaccggggaaacaaagagacagcgcaggaacagaacgagagtatcgctaaggaacaatacaggaggaagacacacactttgagagcctctgccttgcgttatatatagagagagatctccattaccgcaaaaataaatctaatttgttgtggatgttacaacacaatcaatctctcatttgttgtggagggtacaacacaatgaatctctcatttgttgtgaatttcattttttaatggtgacttcattctcgtttgttacaaaaccgaaaccgaagagcaccagcaagctctgcttggtcagccaccttccctcgctacgtccatggccgaggccgactcagcgcgtgcgcatgcgtgtggcagtccaaccatcacctcaaccggtcaacagggaatctccaatatcaccctatttaagttgaggttcttccacctaatttttcaaggtagtattattctctctaacattacttgtgggctcttgagattttaattaaattaaattaggcctagcccatttatttcaacaatccccaccaaatttcatggctcacaagaaatgttctcaaaactgaacctgttagttataccagtgttttgatggagactgttaggttgaacttccacctaggaaaagagttacaccagatcataactgaacaatggattatgccttgtaattgtcagttttgtgcgattcaggtttcactcaaacccttaactggtattgggctgtcgtttgcatcccctctgtttggagcgtataagtcatactcctggccttttcatgagtatctagagatcacccagatctcatagactgtgactagcagtcggagtcatataggcgtgttccttctaagatgttctgtaggccaacatctctgctttatgaaaagccactcggatcacattaaggtgtataccatcctaccatacagattagaagagaagtgcatcatgaagataagctcatttttgggtctcttctctcagttacccaatagtttgtttcgccatccaaattcacgggatctccaatcacaatggacaggtttccaccattgtgcaactctaagtgggtcttaagcctatctccctcgatgcacagtctatcacattacgtggtagcccctttgtaaactgatctggcaaatttttagccatctggacatagtccaatgctatcactccggagtttttctgctttctgacagacttcagtcttcttttaacatgcctggatgacttcatgttgtcctttgaactgttcactttaataatcactgtttgattatcacagttcatcaggattgctggtactagtttttcaaccaccggcaagtccatcaggagctcacgaagccatttggcctcaactgtggcagtatctaaagatgcgagttctgcttccattgttgacctcgttaagatggtctgcttgcaagacttccaggaaacggcgccccttccaagtgtgaacacatacccacttgtggcctttatctaatcagcatcagatatccagtttgaattactatagccctccagtacttttgggtacccagcgtagtgaactccaaagctcattgtcccttttagatagcacattactctttcaagagcatgccaatgatcatctcccggatttgaaacaaaccggctcaacttgctcacagcaaatgagatgcaggcctcgttgcactagctaagtacatcaatgaaccaataatctgggagtatctcaattgatcccttgctattcttcggtttttccttaatagcacactaggatcaaaaggagtaggagctgccttgcagtcactataaccaaagcgactcaggaccttgtccacatagtgagattgcacaagtgtaatcccaccctcatctcctctcagtagtttaatgtgaagaataacatcagccactcccaaatccttcatttcaaagcttttggatagaaagtccttgacctcctcaatcacattaaggctggacccaaagatcaatatgtcatcgacatataaacacaagatcactccctctcccccaccatagcgatagtacacacatttgtcagcttcgttcacaacaaagccaacatatgtaagtgtattgtcaaacttctcatgccattgcttaggcgcttgtttgagaccatacaaggacttcaacagcttgcacaccattccctcctgaccttctagtacatacccatctggttgatccatatagatctcctcctccaactctccattgaggaaagctgtcttaacattcatctgatggacaagtagaccatgagaggctgccagagcaagtagtactcgaatcgtggtcaagcgagcaaccggtgaataagtgtcgaaaaagtcctcgccttctttttgggtacaactgtcacgcccagaaattcacgaaccagaatttctaagctgaatgtgtattaaacccctatccaggaccagccagggtacacaaacgacaattgttgacatacagatccacgtcttacaaaaacataaaggattacaaatgcagcggaaaaggtaaaagcgagctaagcctgaagacttgactcctgcagcgggcgattccattccacaggcaacccttgacggcagcgacgaaaccaacctctctgagacggctccaattgagaagaacttctactctggtgtgggggaaaagagagcaagactgagtactacccactgtactcagcaagtcataccggaagaggaggtatgatgcaggatataaccaaaggaggctagaggttcttttgcataaagctagcatttaaaagtagtagttgaaggcagtaaaacagttgtagtaattaatcaatattaaccaatcactgtccaacgctacaccacgttgcaacaggccgaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacttttccacacatgtcgccatgccccgaagtatcaccatgatactgcaaagggggaaatcgtgacaagaccctccgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagtaaaaccatgcacccacagcccaccattcagtgtattttaattaactaacaccattgcggtggcaacaatctaaagctatgccaaaagacaaagtctatgtaataatgtgatccccatttgtgtactagttgaactaagcatggctaagcatttcctaagccaacatctagtcattttgatacccaagttattaatggcatagggtaaccaatatgtggctgaggaataggacccatcccacattacattgtaaaagaatgcaacattacatagaaatgcgggatatttgtaaattgggtacaatatgatcaaacgtattgcatgacttgccttgctctcgaactgatgagacctcagcaacgtcttcgagagaccgcggatcgacgaaaaggccgaaatctacgcgacaaacaaagcacgcaagcaaaacatgctataagactacagaaacaggaaacaaaaccatttttaatggattctttgcatttttcttgatttactgagacttgaatggacttaaacggagctcggatgaattacttatgaattttagaagataaactatgtttttactaataaagaaaaagtccttaattaattattgcgcaataaagcccagggctgacgtcagcgaagggggggcggcgccgacaggtggggcccacgggtcagcggcttaaaggggagaggaagggggcgccggcaagcggggcccgcatgtcagcggctcaaggcggccggtccacgggaccaagggtccggatcggcccaagccgatcggacggtgaagggagcagccaccgggctcggcctcggcttcaagccggccggcaagcatggcgaacggcggcggcatgcggtcgccggtgacggcaaccagcggcgtgggaggcggcggcgggcggcgcacagaccggcggcggcggacgaaggcgatggcgagcgcagggagcggcagcgcgtgcgggacagatggaaggatggaggagaggagctcctcactgtgagcacggcggccggcgcgaaggatgaagacggcggcgatgaccggcgacgcggaggcacggacgggcagcggcgacaccctaggagaagatggagaggcgttaggagaggagacgacgaccacggcggcttgaattgccggccggagatggaggggagggaaaaactcaccggctcgcgaggggagaggcgctccggtgggattccggcgacgcgaggcggcggccgggaaagctcttgcggcggcgaagctaacggcggcggcgatttggcgcggcggcgactctagcggcggcggctcatggccgaaggcggcggcaagcggcggagctcgggtgtgacggcgcgggcgcggtagggggcgtgggagaggacggcaaatgggggaaacgagggaggggactcgggggagggtttttatgggcgagagaggggcggacgtggccggggagatggccgaaaccgccggcgacatggggaggagagagagagacggtgaggtgggattcaaaatgaatcccgcccacttcgtgcatgcgcgcgggcgggaagggcggaggagtggggcggcgacgtgggcgcgcggcacgggcggagtggggcgtggagaacggcgggaaacggcggcggcggcatgggcggtttcgacggcagcagttagagctccagctccaacggctggaggtgggagacgaccgacaggtggggcccacctgtcggcatcccagagagaggagggaggggcgcatgggccggcccaacaagaggaaggccgagcgggagagggatgggccgacggcccaagaaaggaaaaggagggaaaagaaaaaaaagaaaaagaagaaaggatttttcctgggatttaaaattgcactttagtgatttttaattggttaaaattatttccaaggctctgaaaatttcactaaaaatcctgttaatgcattggagcatggggaactcaagaaaaattccaccacactatttctgattattaagtgcatttattaactagggatttagctctaggttaattaagataatttcttcgggcaatttatttaaccaatttttaaagcaagcaaaagggggaaaacttcagggtgtgacaaacctaccccccttaaacggaatctcaaccccgagattcggaagagctggcgaagaggtgcgggtgggtggccttcaactcatcttctctttcccaagtggcctcttcttctgagtgatggctccactgaaccttgcagaatctgattgctttgtttctggtccttctctcgctggtttcaaggatacgagtcggcttctccacatacgtcaagtcttcctggatttcgatttgatccggacttgcctgttcctcaggaactctcaaacatttcttcaactgggagacgtggaacacattatggatgccaagcatgttggagggaagctcaagctggtaagcaacttcacccctgcgttccaaaattcgatatggtcccacaaagcgtggtgccaactttcctttggtttggaagcggtgtactcccctgagcggagtgacacggagatacacataatcccctgcttggaaaacgagctcccttcggcggttgtctgcatagcttttctgccgagattgcgcgattctcaatctttccctaacagctctgactttctcttctgcctcatttaaaacttctgtaccaaacaactggcgttcccctgtctgatcccagaagagcggagtacgacaccttcgtccatacagtgcttcaaatggtgccatctgcaaactagcttggtaactgttgttgtacgagaactcagcatacggtaagcttttgtcccatgctccaccaaagtcaagcgcacaggctctcaacatatcctctaggatttgattgactcgctcggtctggccgtctgtttgtggatggtaagcagtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattcggatttctttccacttccattctggaatttaaagtgtctgtagcaaacctgctggcctttggtgttctgcctttactcggtgacagacgtcacagagtgctacgaattcagctatttcccttctcatgctgacccaccagaacttttctttgaggtcttggtacattttggtactgccgggatgaatggaatattgagtttgatgagcctcggttagtatcaggtcttttaattccttgttttcgggtacacacaatctttatcccatccagattgttccttgttcgtcctcaacaaaacctcgggcttttccaaccctcatgttctttttgagctctgctatttcaggatcacttgcttgagctatgcgaacctgctccaccagtgtgggctgtgcctctagggcagccacgaatccgtgctcaactataccaaggttcagatgttccaaatcacgttgaacctcacaacatagttgctctacccatgcaacattgcactagctcttcctgctcaaggcatctgcaaccacattagccttgccgggatgataatgtatttcccatatcataatccttgatcagctccagccatcttcgctgtctgagattcagatcaggttgggtgaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcatgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaatagcccgcaagtcctaagaaactccgaacttgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcctcgcggatcctcaactggtgatagtctgatcgcaggtctatcttagagaacacagtagctcctttcaactgatcaaacagatcatcaatccttggcaaaggatatttgttcttgatggtgacctcattgagtgcgcggtagtcaacgcacatcctcttggttttgtctttcttctccacaaagataaccggagcaccccaaggcgatgtgctcgggcggatgtatcccttctgtaactgttcatcgacttgcttcttgacttccgccaactcgttggctcccattctgtaaggcctcttgtggatcggtgcagttccaggtaccaagtcaatccggaactcgatatccctttttggtggcattgttgtcagatcgtccggaaaaacctctggatactctctgactatgggaatatcctccagcttcttagtggttttctccactgctacctcttgttcttcaccagcagcctggtttaaactgatccctgacttctgcggcactggagactggaaggttaccacctctccttttgcattggtcaacttgatggtgcggctggcgcaatcaatcactcctctgtgtcttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgagcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcacggttgttgtgactgccactatggtggttcttgttgaagctacccgggtggtagggacggtactgccggataatcatggtggaaggtccaccgtgatgtcccatcgtggaacgaggcttctgactcttcccctggggagtcctgaactgagctgccttcctcttacggtttactttgttacagtgctcctcctgacggatagccttatccaccagcttctcaaagtcctcataatctctagagatcaactggttaatcaattcatcatcaagaccagacagaaacttctcctgcctcttggcatcggtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacaaaactctgtccaagtaacttctgccccagttggacgggtcaccatgtagttgtcccaccaaatagaagcgggaccttgtagctggtgtgtagcaaaagcaaccttctcctgctcattgcattgcaaaagattcagcttcttctcaatggcatgaagccagtcatgggcctcgattgggttggtggtgcttgagaaagtgggcggcttgacacgaagaaattctaatagtttggactgaggaggtggaggaccaaactgcaggttctgttgctgctgctgtgcttgctgctgcacctgttgcaacacctgatggtactgttgctgcatctgttgcatcatcattgtcatcatctgagtctgattgtccaacacctgagcaattgttgggttcttaggcggtggggacggattgttgtcagatgcaccgttggcacgtgctccatcgatcggctcttcgctgccactggcattgttggagtcgcgtgaaccattccttgtctccatctgaaggggataggtagaaatatgagaaaaggaagaaaacaggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacagaaaactagcaagcaaacagactaagaaggcaataaagctaagggcggcgactctgaagctcggagcggcgcttgcgatcgaggaataggactgacatctaaagtagacaagggataggaaccaattcatgctcaaatccaaattaaacaaagcaacaaatgactcaaataaatactcgagcatgatgatttttatgcatagaacatttttcatgaactcaaatgaggatactgatgcactggctaatcaataaattaatgcataaaataaatgcatagctataatgatacgcatgaaattgcccccatcaacctagacacgacttagtgcatatcacctgacaaattcccgactgaccgtcgaataaaccccaaatagatttttttttctaaaaccctacactgagctaaaaaaaaccgatccgaatgaacgaccaagatttttcccacaagccaaagaggcaaaaccccaaattttcctgaaacaaatccaagcgcaaaagggcatatgcatatgaaaaaaaaaggggttcagagggctcttaggtttccagttggcttgtgctacgggcaaggtcggctctgataccaacttgtcacgcccagaaattcgcgaaccagaatttttaagctgaatgtgtattaaacccctgtccaggacca

SEQ ID NO: 10738 - DNA, 9564 bp, Oryza sativa
tttttcctgggatttaaaattgcccttaagtgatttttaattggttaaaattatttccaaggctctaaaatttccactaaaaatcctgttaatgcattggagcatggggaactcaagaaaaattccaccacactatttccgattattaagtgcatttattaactagggatttagctctaggttaattaagataatttcttcaagcaatttatttaaccaatttttaaagcaagcaaaagggggaaaacttcagggtgtgacaacaacccttgtccacaagccttgccttgtacttttcaattgtaccatcaggcataagctttttcttgaaaactcatttgcatcctacaggcttgcaccgatatgaatgctcgatgacttcccaagtaccattagacataattgagtccatctcacttcataccgcttccttccaatagtcagtgtcaggagatgaatatgcctcttcaatggttcttggagtatcatccacaagatatacaacgtagtcatctccaaaagactttgcagtcctttgtctcttactcttttgagttgctacaatgttatcctcctcagaattttcctcaagcatttgatcaatgtgttctatcggcacaaagtgctcaggggataaaataggttcttgactagaagtgctaggtgcatttttcataggaaattcattctcaaaaaatgtggcatctctggactcagtaattataccaacacgcatgtcgggtactccagaatttactgttaagaacctatatcccacactatggatagcataaccaaggaacacacaatctacggtctttggtccaagtttacgctttttggctatagatacatttaccttggccaaacagccccatgtgcgcaggtgagggagatttaatttcttcctttcccattcctcgaatggtgttagttctttatgcatagtaggaattctattcaggacatgacacgcagtcaatattgcctcaccccaccattccttggaaagtcttgcagtgtctaacatggcattcaccattcagttagagtgcggttcttcttttcggctaccccgtttgactggggtgaatagggaggcgtcctctcatgaataattccatactcttcgcataaagaagtaaactcattggaaaaatactctccacccctaccagacctcaaccgtttgattttcctttctagttggttttctacctcagccttatagatcttaaagtaatgtaatgcttcgtcctttgttttcaataggtacacatagcagaatctagtgcaatcatatatcagtgtcatgaaatatttctttcccccttagtcaacacgttgttcatttcgcacagatcggaatgaacaagttctagtggtaccaaattcctcacctcagatgccttgtgaggcttgcgaggttgtttcgattgaacacaagtatggcacttagagcctttgactaaagtgaattttggaattaaactcatgttggctaagcgtgtcatacaaccaaagttcacatgacaaagtcgcgaatgccacacattggactcatcatcatcatcgcttacatggttcacaactttattacacatatcatccaagataaagcggaacaagcctccgctgtcataaccttttccaataaacgtgccatatttagatacgacacatttattggattcaaacacaagtctaaaaccatctctacacagtagagagccgctaactagattcttctttattgaagggacatgctgcacgttcttcagctgcacgatctttcccgaagtaaacttcagatcgatcgtacctacaccatgaacaaccgcaaacgatccgtttcccatcaacaaggaggaacctctcccgacctgataagaagaaaacagggaaatgtcagcacacacatgaatattagcaccagtatcaacccaccaatcaggggagtgacagacagagagaactgtagataaaatttaccataccccgatgttcctccgccctcactaataaccatgtttgcagacttcttgtccatgcactcaggacagtccttggcccaatgcctaggcttgccacacacaaagcaatctccttttgcctttcccttgtctttattcttaaaattgattgtagccttgggtttgacgtcaggtttgactttcttgttcttgttgtgggatgcgtgagggttcttcttctgtaccaaattagcgctagaacctccctcgatctttttgtcccggttgtcctttgccctcgtcttctcctcaacacccaaagagccaatgagatcagtaacgctgaactcttgcctcttgtgttttagagaagtaccaaagtctgaccaagaaggtggcaatttggcaataatgccacccgccacaaacttgtccggcaactcgcagttgttgttctcaagttcctttgccagcatctgaatttcatgagcatgttccactacagaacggtcatcgaccatgttgtagtcatagaactgctccatgacatacagctcgctgtcggcgtcggaaaccccgaacttggcctcaagagaatcccacatgtccttccctgaaggcatgtgcatataaacgtccacaatactgtcggcgtgcacactgatcaatgctccacggaacaagcaatccgcagcctcgaacttagcctcctcctcagggagagaggcggttcactcggtttgcctcgtgaagcaaagaaacattgcatcgccgtcaaccacaaaagtgcacgtgctttccatcttttataatttgaaccatcgaaagcatgtggttttagtgatgcagcaaagccaactaccgaaaaagacctatcaagtttttggattgttggaaatttggtcataattcgacatattttaatccaaaatattaagacaataaacatgacatttgcaatatgagtagatctagtgacagtgctagatgtatacaacttgagtgtgcttaatatagaataagcatcaacatagacaagagaacgcaataatattgcgaccgacagttgtaggaaacgaagaacgaacggtaagagtgaaacgttataccccgaaaatggccctccgctggagtttgagacagtattgcctccgttggtgttgacgggaggctcctccttgtctctagtgttgttgttgtcgccggttgtcgacatgttggtgaagatgatgcagagtagtcgcgcttgaagcgctactcaaaaacttgatcgcccgcctacccgtgcaggttctcaagcggacggagtttcggaggcacctgctcgttccaatcacccatgtgcgcgggatgaacagaaccggggaaacagagagacagcgcaggaacagaaggagagtatcgccaaggaacaatgcaggaggaagacacacactttgagagcctctgccttgcgttatatatacgtaaaatctaaactgagaggcttctcgctttagtcgtatcacgcgacgcatctcatagccgatcgatcgcgcctatcgtccatccacgtggccgcgctgtaatggcacaatgagaaggattgacacagtgtgtgccttgtttctcaatagacatgtatatctttttcctattcaaataaagttttctcttaaattacttatccgatctataatccgattacaccattgtgttcgttacaattaaatcttcacaacaagatcttacatgattatattacgatgaaaaaatatttatatttataaattacttttattatatatgtaagttacttttatcatatatatataagttacttttagatatgactaaattatttcttagtcatataaaagtaaattcaataaggtctaaaagtaatttacatatattataaaagtaacttaaaacaaaatggaagtaactttgtcacgacattagaagtaatatgtgatctaaaagatataagcttttttttgaaatgaatactaccagacatttgcccacagtgtaccttttttaaaagatataagttattaaagagattaaaaaaggatacatactattgcatttttcaagttcaaaggagagactagatggagtacaaaccagctaccactagctgtgtagtcacgtccaatgaaaaaagacatacattaaagttacactcttttttgttataagttacttctataatatatgcaaattaattttaggttttattgaatttatttttatatgtctaagaagtaatttagtgaaatttaaaagtaatttagatatactataaaagtaatttatgttttttcatcaaaatataatcatgtgagatcttgttataaagatttaattgttacgaacacaacggtgtaatcggatcgtagatcggataagtagtttaagataaatttttatttgaagcataggtggatagggtctcagctggtttagacaatacagctaccactagctgtgtagtcacatccttatatatatagagagagagatctccattaccacacaaataaatctcatttgttgtggatgttacaacacaatgaatctctcatttgttgtggaggttacaacacaatgaatctctcatttgttgtggaggctacaacacaatgaatttcatttgttaatggtgactttattctcatctgttacaaaaccgaaaagcagcaggcaggctcggctcggtcggccgcctcgcctcgctacgcctacggccgaggccgactcggcgcgcgcgcatgtgtgtggcagtccaaccatcacctcaaccggtcaacagggaatctccaatatcaccatatttaagttgaggttctttcacctaatttttcaaggtagtattattctctctaacattacttgtgggttcttgagattttaattgaattaaattgggcttagcccatttattccaacaggtggtataccaaaatgaactatcattttagacaaagagaccaacaggcacatgaatcatgcatgtagattacctcgtagtgtggaatcctatgtactcctcactcctaccagccatgagcaacggattcggccaagactccccttgatactctcacattagctggttccataaaagcatgagatattcccctgtagttgttcgtctacaagcagtcgaagacaatatggaaaatgtaaagttttaatggaaaaagagccatagtttaagaatgttcgaagaatccaaattccatccaaccaaatctaaaactgcatggataagcctccaacttctagaattttagcatctaaaatggctagttcaaccatacttaacaacgataaggtaagctacacagaaactatgtaaataaagtagtaacaaaagcaaaattggaaatttcagaatcaagacctcctaataccatggtgaatcatgatgatttgtgttttcaccaaagacagggattaaatcgtcttcgaagttcaaaccccactgttgccttgggcttggcctgtgatgccggtttcatcaacatatgtttggatccttgaacagcaaagcgagaaaaaagaatggtcaattccgtcaatagcacaatagcagccaagcacccaaatgcttgattggggcataagttttttttgtgtatgtatcctgagttagcagcagctcgatcttctacagacaatccaacaaatcaaataaaaatagaatcaattacctggaggatgacagggatgatggaagtcgacagcatgcctgctgaggttgccgttgccaccgcctatgcgctcttctcttccctccccttccgatcttaggttctcttccctcccttcggatcttagggtttgagcagtgacagcggtagggagagatgaagtaggaataggatatggggatggaagaggcggtgcaccggacggaggagaaagccgtagggttggaggaggagaggggctatgaggcaatggagtaggcgccggggttcacgacggaggtggcagcagcgcggcggatgaggcgccggggttcacgaccgaggtggcggcagtgcggcggaggagctgccggggtcgcgactgatgtggcggcagcgcggcggaggagccgccgagggcgcgacggcggcgctgggaaagcggcgaaggcggtacgaaggaggagtgacgggggcgtgcgatggagggggcagtgtgaggacagtgcgatacgaaggtgggggtggtgcgggacagcaggaggttatttgatcccttcgatctgtgggaggatcctgcgaggaatatcggcccttggattatacaggactcaccaacaccaccacgtattttttaagtagtaaagatactatgatctatgagacatgatcatcaattaatatatgtgctgatcatttaaccatatttgttccatatatgatgtttgatcagggatcttttagaaatagtaacaaacaacataaagagtctcatgaaagaatcacatattcattaactaataatgagttatctatttcaaggaacaaagttggataaatatgtaaacatagtatgtaatacaatcatctctatgattgcccctagggcatatcactaacacaacccttgcgcctgattgcatgcagtgaattttggtgaaggcgttctggaaatgatgtagtgttgcaagcgcctgagaaaaaaaaacaaaccacctcagagttcagagcgagctgacggctgcaccaccaccagtccatgcacccatcaatacaaagttcttgcttaacccaaaaagagattaaattgacctattaggacgtttgtgcccataaatcgagcctctctatgtatatataattgtagaaaatattttaattttgctcttagtatataaaccaataattcctgtgcataaaacaggacaagcttgtccacatcggcataacaagcaaatatggcaacccctcattctaaaaataaaatgacacatttttcagagaaacaacaggttcagggtcaaaaccagcccagcagaagggagtcaggcagctccatctcatgaaccaactgaagtttctcatgtcactggtactgcaaaagaatcccctccataattttctgttaaagtgtcagtggcaaatcaccataattttctcttaatcacaagagactaatcacaaaatgtgtacatcttcaaacttaatagctgatttgcaagcaacataatagaagagcctgacagccgcaccaccaccagtccatgcacccattaatacaaagcaagacaaatcatctggtaggggaggaggatttttgtaccttctatcggtggcggaggggatcggcttggtgaggacgagcccggcgactccggccgacggtgatatgggggcgtggaggcgggcgccctggcgtacatcgggggcggcgagggcaaactggcctggcagcgcggatcggtgcgatgggcggaggggcggtgcggacgagatcgtcatcggtggcggcacggataggtgcaatgggtggagggacggcggggatcgatgcgatgggcagaggctcgggggtggcgactgcgactccggtgcggatcagtgtgatgggcggaggggcacgagcagcaggatggcgaggcaaagggaatgctattggaaaggaaggggtggcgacggcggcgtgatttgtggggcgatgcgttggggggatgcggcagttgtagaagggagagggaggtgcgcgagagagggagggatctgggagggagggcgcgatctgggagacgttggatgtaactcagatgattttaggctgttggatgtgtgacatgatgaatgtgtaatgagtaaaaccatttgttcaactatagggtagatgttaaactatagcttagcttcgtgtcactgtgcccgtatattaaacttaacccctgcttagactttgataaatacaagtaatatatgtataaagagtattagcatagtctactcatattatcttcccttgggatcaaaaatacgataccttggaatatttttgggtgaaatactacaatggtatatcggtgcgcttgtggataacatctgtaaccagaaaatataccaggaccatttctgcgtcattgctaggaatgaatatttctagtaatgtcgttaagaaataccaataataccaaagggcaaaatgaactttatgataggaatttaatggtcaactaacaaaaggggtatagaagggattcaaactgaaatttaggggtatgaaagagaatgagcaaatctcagaggcatagaagggattgggcgaactttcaggggtacacagggaattttctgtgcaaaataagttaacacacctacattaacttattttagcatggagggagtacacggataaatcttatgtgacagtatcccttcttcacccctaacccgtcggccttcattaggtctccaacactatcctcatttaattagctagtaacagaaaaagtgttaaaacaacaagaaacaaaaaccgagctgattgccaaacactgatctacaccttccatcctataaaaaaaaacttaatcctaactaccgacctagatacgcatgcattcggattgatagataggattaatatttttcttggacggagaaagtaatacccaaaagataacccgagcttactgcgtgcaggcgaacaccgaaaagaatcactactagagaactgattgttgacggtcgttatcgaccaatttcgaccatcaatattactcaattaataaagactagctatgcttgcaatgcataatttgcaaataaaatatcaacttccactatatactatactactaacatagatgtaggagaagcacatataaatggagaagaatcgacagaaagtaaatggtcaatcaatcatacgctgtcgagatccagacttatggatgaatgcgcaaagaacacagaattcacacgatccactaggccttctggactgacgagacaacagggagacggcctgccgaaaattgggctgtttgggccagcctccccatctccgccgttgatcccaggttttggggtgtggatgtccaggatgcctccctcaacgacagttggagggcagaatgaacattttgcatcacctaaccgtcataactgccctatgtaaggacctcacatcctcactctctgcacacactcaagaagaagagctctctccctctctcaagtttagtagtatcctagtgctagtggagtagaaattataaaagtattcttagtcctcgggtcttcaggagaattttggtatgtctctagtagctttcctctcttcttttgtaagacttatggaattaatagaatattcttctttatacatcttcggtattttattccatttatattatctgagtgccggcttcattttatacttgtatcaatatagttgtgtagctagcctaccagagaggtgcaatggtgtgggtttagtgtccgattactcagttgatctatgtcatctcgggggatatatagtagtatttaataatgtagatgtggtgtctaaattattaagtatcactatctgggcatatatgctgcgggacagtagaggtgggccgctgatggtgaca

SEQ ID NO: 10739 - DNA, 4476 bp, Oryza sativa
tcccttgggattaaacaaatatgatacttggaatactccggggtgaaatgctaaaatggtatatccgtgcgcttacggatcatatttgtgaccataaatataccatgaatatttcttcgtcattgctgggaattatatttctagtaatgccgtttaagaaatatcaacactaatctttgcttggacggcaaaaatcacagttgcccaagttcgaataggatccgagactaaagaatatctttagccacgacaaaaatcacagttatcccggttcgaacactaactgggatttaagatcatttttagccacggttcaataattgtcaggccgtgtcaggcccccaacaaggactaaagatcatcactttagtcccagttgctgttaccaacccagactaaaataggaggatctttcatcctggctggtaacaccaatccggactaaacattgatcattagtcccggttcataaaccaacccagactaaagatatttttagctccacttggtgttaccaacccggagtaaagatgcctccagggttagtttaaaaataaagcatctctatccaagtcagatgtgtatactagagatgaaaacggtcggaaacggtatcattattttattatttttcgaaaacgaacggaaacggtcgaaaaatttccatatttatgaattcatctatttagaccctgtttgattcagcttaggattattataatctagattattaggagtaagctgaaacaaacaagtagattattatgctagattattataatctataagccggattactataatccattaatctcctctagagaagcttttttcagattattgagtggctaaagacctactacccttagatgcctctaataatccagagaaataaacaactcgtagcttattttatgtcattattataattcagcttagagtaatctaatttaataatctagattacaataatctttaagctgaaacaaacaaggccttagtgtcaacttcaatgccatgctgacagaaattaaaaaaaactaaattttgaaaacggtaaccatcggtaaaaatagtattattatattagttttgtggaaacggtatcaataccgtcgggaaattttcataccgttttcgtaacacgcgtgagggttgaggtgagagatcttgagtttgaatcccacatccgacgcgtttttttgacgtggtatgcatctttagtcccgcttatttcaactaggactacgaagggttggcaaccgggagtaaagctcccttccccaggagtgaatgcttgtttggttctatggctgatttttggggaaatttgtgcccaacccctactcgtcacgtgtgaaggaatcaggccgcatgtatggtgtggggccactctcttttggattgagacgacggttatgcaactttttaccaaccatggatggaggtttaaaaatagacttgaataattgtgtattccttatcttggtctggtcacttttataatgtttaggtgtgtttaattctatttgaactacactcttgttcgagtgttagattgtaataattggctgcagctctgtttagcaaaggccgggatgttatctattccattatctaaaaaataagtgaaggaatcatgccgcgtgcatggtctggggccactctcttttggattgagatcctcttccttaagtcagatgacattaaattctttgacatgtggacccatagaactagaaaaaaaacgggtaatttagaaccatgccattataattttgcaaagtttgagatatgccatcggtatctcaataacatgtaggacccacatgagtcaatgacatgtgggtcaggatggcatatctcaaattttgcaaaattataatggcatagttccaattttcccaaaaaaaaaaggatcccatagtaggcagaggctttggccatagccttgtgggctgtggtgcaaattctgtggaggcggccggtcaaaggcgaccttgtctacctgcgtgtggagtcgtggagctagacgacgtcacctcgcctcgtggtttggagtcaaacatcgaccggggtggatggtgcgcgccgcaaatagaagaggtggtgtggagtttacaaactctggaggaggctactccgccgcagcgcagctaacaagcaaccaagacgacatcaagcttcgccgctacaacaggcaatcgcggctacaccgctgcaacaattgaggaaaagaaagcagagcagcgctggtatccttttgtcgagaaacctagaaaccttttaagttgggcgggagcttatcgggcagcatttgcctggtggacgccgttttgctacgtctatacccagacgctgctcgtaacagtgaccacacctggacgatcttccaaatagcgtccttactattttgctaaataatgccaatgaattactaatgatttaatttcatggttattaattattatatataggaaacaatttcatggttatctatatacctaattaaaaaatacggaaggcttcctccctccgctttagtccgtccccccaccccccctgcccccacgccgccagccctcccatgcatctccgcttccgcctctctcccttccttccgacgcccccatctcttcgttgctgcacgctcccccaccctcgcggccctcttctcccttgcgcctctcctctcccgcctccctctctccctcatggcactgatgaaccctgagttccactcgacactcaagactgttgttggcccaatctttcgatgagtttagataactacgatttagaagaaacgttgatgacccgactacaaccgtacaagacgttacgttgtaccttagcgaccaatacacatctccatctttcattctttccgcgagttcaaggaaaacagaatcctctcgttcaggaatgtgttttgacgcacttatccggtcgtgttcgccaccagagctcgtcattatcgtttctccctctaccaagaccatgacattgcttgcccaattcctgctgttttggttttcttcattgccgaccaccaccatctatggacgagtcacatcgtgagacacatcctaccatcttcctcgccactgtttggtcataggagcaccgacacccatttcccctcctcttttgtttctcgtcttcagctagggaaggcaatgaacaatgtttttttttgacacaattccttcttggtctagcccaaagatgctcatggaacactcacagaccataggactatgaatagaacaataaaattctaatttatgtcaatgaaacatgcaccgttttagaattaatgtattggatttttcatttgtgggctaaaataagttttttcaatttctaactaatttaagttgttttttcacagtattagttttagcactatttgatccattaaaaattatcataatttatatttttctttgtattgaattctttataggtaaatgaaaaaatagggattaagttatgtaattttcatgatattgaattatcgttccggacaaaagttatttgtatgtttgtatttccttcgtcgtttatcccaactataatatatgattttggattttaatttatgtcaataaatattatttagaaaccgttgcaacccacaggcattatgctagttaattactcctcgtcccaaaatataacaatttttagcacttagagcaattttaatagtatagcccaccgttagctcaaaatcatctatagccaatgtaacagccaattcatacaatagttgcttactatactattaatacctggtcccacctgtcatacacacattatgtcttgtagtccgtgctgcagctggctacagatctgtagcccgctacttttctctctcttcctttatctctttaaaatatgtttatagttgacttatagcctgctattgtacatgctcttaggatttgtcccaaaatataacttcttcatcagcatttccttcctaaccaatcacaacccttcacttttcccacctacctccactgctcaaccaatcacaatctctttctatttaatgctatctatttttttaataaccgtgtccaactctaaaactgtctatattctgtgacggagggactattatatataaaaaaattcagcaacccctctcgggtcatttggttgggggagtttttaggagagattgagagtttagagggatgatgctattaattattctgtttggttgtgttaacaaccaaatttggtaatatcacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatcggttcgaatgctgtcaggacctgtcaggcccccccgggatctttagt

SEQ ID NO: 10740 - DNA, 700 bp, Oryza sativa
gtccttggcccaatccttaggcttgccacaacatagcattctcctttaccttttacgttgtctttattcttaaaattgatttgaagctttgggtttgacgtcaggtttgactttctgttctggttgtggaatgcgtaagggtttttcttctgtaacaaattagcgctagaccctccctcgttcttttggtcccggttgtcctttcccctggttttctcctcatcacccaaagagccaatgagatcagtaacgctgacctcttgcgtcttgtgttttagagaagtaccaaagtctgcccaagaaggtggcagtttggcaataatgccacccgccccaatcttgtccggcaactcgcagttgttgttctcaagttcctttgccagcatctgaatttcatgagcatgttcctctacagaacggtcatcgcccatgttgtagtcatagaactgctccatgacatacagctccctgtcggcgtggaaaaccccgaacttgtcctcaagagaatcccacatgtccttccctgaaggcatgtgcatatcatcgtccacaatactgtcggggtgcactctgatcaatgctccacggaacaagcaatccgcagcctcgagtttagcctcctcttcagccacaccccccggttcactcggtttgcctcgtaaagcaaagaaacgttgcttcgcggtcaaccacaaaagtg

SEQ ID NO: 10741 - DNA, 572 bp, Oryza sativa
cgcagtgaatttaagccatgatttatgaatgactacttcaaaagaacattgccatggcagcaagttcacatttacaatgttgtgctactgaaaaaccattttcatatattcaactatgattgtatgatgcagtgaaatgaaattcttatgcagtgccattcacgaggtaatgaacaaaccttgctctttgcatccgcagcaaacttatcagctactacaatatcagttggaagcaatagggagactccctttgacttggctttttcaataagcgaggtagccaattcgagcttgtcttcctccacaagagattttccaacagcgtatccctgagccttgtaaaatgtatagatcataccaccacccagtatgaggatgtcaacctttgccaaaagactctcaatcaccccaatctttgttgacaccttggatccaccaacaatggcagcaaatggttttttggggttggcaacagctccaacaagatagtcaagttcctagattggtgaggacagttactacaaaattttaaaaggattacatatttcaaaaaatctcaaggaaaaacagct

SEQ ID NO: 10742 - DNA, 867 bp, Oryza sativa
tttaaaacattttaaaaacaaaatgagggaaatcaaataacatttgagaatggtgagctcattttacctctttttcgctgcccgagtggatcgcaagttgtattgcgtgggttgcgtcccctgagacgcgtcgggaagctgcgacatgtctatctcctcagcgtctggggcgacgtagtcctcatcctcctcctcctcgtcgtcatcgtcgtcgctaggtggagtcggcgccttcccctttcccctcccttgcggaatgcgtgacgacgacgagccaccaacttcttcacgctcttctatcctgatggagtgtcgagcggtacttggacgcacggagtgaggtagtggtggtggtagtctccgcggttggtacacgtcgtccaattcaaccgacttgcaacctaatcttgctgcaagtttccggcacctttgacgaactttctgcagttcaaaaaaaaaagaagtttgttaggcataactcaagtaatgcaaagtgctaaataaattttacctccaaaacattgcggagtgtgttctccgtgtcctcaccacccctcggagcttggagggcatgccccatttcattcacactcctgaggagctctctcgactgaaagcgtgagaagatatatgttagggtctagggtgcaaatggaaataactttgacaaatgcaagaaaacttacgactctgtctctaagtggggcgtgctccatttgatatccaactctagtccggacatcatagggattccgtccctcatcggagtcgcggtcatcctctatgtcggcttccgtccaagtagggcggaggaacagtctatatgtcctatgcagccaacgaagatactctgagaaaagatgattt

SEQ ID NO: 10743 - DNA, 4703 bp, Oryza sativa
ctcatttgtgtggtatggtaaccattcaatctgcaaaagttgaagagatgtcgttggttagtatctcaattaaagaagtaaatgtctaactagaagtgatattggaagtacttacatgttgagactgtaagcagtccatctcattgacataatgcttgtatgccacatcccggtgagcatgtgcagtggcagtactctcaaaaaggtaggccactgtcttctccatgtctggctcattgtagggccaaggagtgaagctttgcctccacttaggccttccaaccggtagtcttaaccacatccacagctgaatcaatagcacacaaccactcatgttggatgatggtgcctgacgacaacaggcctcacagagctgtctatatgtccacgccaacactgctgagccccaactgaaacggcctagatcaccaaggttggcgaccaaaggaatccatatcgccgaagcaatgtcatccccagcatcaggaaacagaacccctcccaacaagtgcaagatgtatgcacgggcataacactcaacacgccatggctcagcgtcgtcgtcaagatgtgagaagttctgactcagccaagacaggggtattccattctgcttcttcttccccccttgcccctgctcaatgttcagtggaatgccaaacagctgctccacttgtgcacgccatccaggagtctctgtcctgcccgtcacggcatgcccccgtaatgggagggccaagatcatagccacatcctgtagagtgatggtcatctcaccattagggaggtggaagctgtgtgtctcaggcctccatctgtccacaagtgctgtcaacgcaggagcgttgaacactggcattcctctgctcacgaccaaggccaccccgagcaacccggccgcccttaggtacgggatgtacctatcgtcgaacagtgggggggcatgagctctgactcggagcggttgaagtacctgcattagcaattgtaaatcaattagttaatataatgtcaaatacacgctacagatacttatgcacaagtgaatcaatgccgattcataccctccccgcctcgatcgcagccccgcgatgatgggcctcgtagtacgcctccaaggctgggtaagtcggcggttgtctctcctcggccatactacatgaaaaagtaataaattcaccgttagttaccaatgtgacatatattaacagaaaatgaatgcgagaacatgagtaggaaaacaaattatttacctccctaacacatatattttttttggacttcttcttttttggacgcttaagacacttagttttcttgtgactctcctggtgacacaacgagcatctattttgcaccggcgcagcatcaagttgaacgcatgaaggtggtttccttccaaaaccacccagacccgaggtcatttcgttcttgaatcgtttcgatctcctcttccctcttgtttaaatcttcaactttcggtcagcaacaaattcttcaccatcgtacggtggccactgtgtggggtcgaggtatggctcaaagcgacttgcccatgtgttcacaacggctcttgaagagaattgatacggcattcggttggaagatttctcatcaattgcatgaatcagataaacgtgtataagatgtgagcaaggcatatggtagagcaatggcctttggcaagaacatgagttcccctcaccttcaactttgaaggctcttgcgccgaatctaacaccaccacgcgttatactacccctctctgtgacctcgtatgtctttttctgcttatcgaaacaccttgcagtgtgtttgttcgccttacttttttgcaccttcatcttactatcaaccttggtggaccaacgctgccctaactggactcgcttcaaagcttcatcacgtctgttcacaaagtagtcattgcacttcatgaacgtaaatgatactatggccgtcactgaaagcttacgaacaccaactagcacgctattgaactgttcggccatgttggttgtcatgtaaccccaccggcggccatttctatcgtatgcacgagaccacttatctttatccaacaactcatcttcaagccatttacgaggaccttcgggaatacgctgccttagtgcctcaacatccctctcaaatatccacttctcgtcaatctgacatatccttaggagctcttttgtctggtgcttgtccgcaccgcccttgtggaaattagcattgaagtgcctcatgcaccatcggtggtgaaccggtggcaatcctggaacaggagtcgtcatggcattcattataccagcatgtcgatctaagataatacaaacctccctatgcggcccaaccacaacccgtcagacaagatcgataaccagcaccagtctcgtgaattctctttctccaccaaggcaaaagctaaaggtacaagttggtcctccgcatcagctgataatgcagtcatcaaggcaccaccgtatttctcagttagaaaggttgcatctatagctagtactggcctacaatgcttaaaagcctcaatggaaggaccaaagcaccagaatgcacgcataaaaattttcttggtcactccatcaacgttgacaaccctatcagaatgagtatcgatgtggtagaccatactgggattcctctgcttaatggcttgcagcaaagtgggcaaacggacatacgcttcaccccattcaccgtaaatgagcttcatagcctcctctcgtgccctccaagccttgccatacttcaccctatactggaaaacctcaaatatatacaaagctaacgcagaagcagagagtgtacgttgcagttttatggcattgcataaactatttactatgaactttgatgtcagctgccggtggctccctgaaccttcggtagtagcacaactatgttccttacctacccgtgatatcctccacgttccactagactttttagttgcatggaccttccatttgcaccgtgggttttcacatttaacagtgtacctcctatttgcggcagaattgacaactcggtatggacgatggtgcacgatgacgtaatcctgaacccatagcttcaatgcgaccatgtatggaacttttaaaccctttttaagaccatccacttaaaatggttctgacaactgatctaggttgatgcggccatctagtagtgccccatgggcatgtgttaggtccctaaactcagaaatgtccggcttcctcacaaacaccttctcaaacgcacgacattcctctaatgctaacttgtcattattagtaagtggagggaatggacggtcatcatcagagtcttcagcaaattcaacatcatattgctcaacacttgcctcctcgtcaacatcatctctattgacttctactgagacagaatcgtgaccactactcaattcgacatcaaagtaatcatctggattcacatattggcctgctacttctgtcgggtattcagggttgactccgtacgatgaccaatgaacactcgccgacaaatgttcacttagatcaagcccctcttgtactaactcccttttcatctccctcgctgcatccacatcatgactaccacaatgtctctttgatggtcctgcctcccataaatcatttccaagcaaaggtctcttcttctctccttccccctccaagtcttctcgtaccaactcagtcttacttgcaccccctccacgacgagaataatatgtcacaaaattcttctcaacgcaatgataagaaggagatttgtttagatccaaattttctacggtacgaactaactttgatgcaaacacctctagagatctaaactgagactcttttaccaaatcaaagtaaacttcccattccaactgacctatcacatttaatatatacttatgcccttgaccaacatcgtatctcccataaaaacgaatctccacattatcctcggtccatccaagaacttctttcactcgtgaccttagttcatctagagttgggtgggtgggaaacaaaatggtcttcaataacatatcctcaaactcaacatgtgtaccaacataaggttccaccactctaccaccgtagtaaacacgaacaagtcaatccatctacaccaaaaaatcaaatgtaactttgcaacaaaaattaaatcttcattcctaaacgtagtccaaaccgacatattataaccaatgcataacttaaattatcccaaagctactactccaaaaaaatatttaattcacctacaactatcaacaagtttactagtgcattacacatcgaaatattaaaaatactccgtcatacaacccaacctagttctagttaactataatcaatttatataatgcaaccaaaattttctcaccttcatataattaatggttaaaagtttaacctatagactatagcatcaagtccatcaaattaaaattactttcatgcctcaaccataatttttatatccatccatccaatcaaaccatttaaaaattaacattaccacatatatggttaaaaaaatcgtgacaccaatgagttcattgcaaacatatagcactacaacaagccaatcctaagaacaaatgctaaaaatcacacatttgggtaaaaaaggggttctagggttgcccaccgatctacaaattcaccactaaaaacgaaaaaaaagaggggtgaatg

SEQ ID NO: 10744 - DNA, 602 bp, Oryza sativa
tcacagtacagacagggaaacaaagaaagcaactagcacgttaaaagagtcatgctatgaattcagaaagtcgaacattgactcttaaaactctttgggccatcagataggccttttagatagatctatttggtctatatttttcctttactaaaaaggccacctgattttcattccgcgagctttgctgaaaaattcttcgattgcgctcaagccgaacgttccactaacttgatggttcccgaggatcttcttcttcatggtccctgacgaaatgtggcaatcccaatagggaacttagttgatggccttctgggtgatgacgaacctaagaagcctaggagatgaaataactcaattttatagatgtttcgtaattaaaaaaatcaacgtaaaatggtgagggaagaacctacacgaggtgaccatcgtacaaagatccaatgttgacggtgaccagttacatgtactctctcccaaaaatctcatatatcattctttggtttttccaaaaatctaagtcctatttgtagtcactttgtgctaaataaaattgttaatcggaaaccaagaagtcattctaatacttattggttgcatgt

SEQ ID NO: 10745 - DNA, 510 bp, Oryza sativa
ttgatggaactgatggtttgggtgttgctgatttgggagttggtgacattgaaacaaccactgattgcacaaacacatcaaatatatgtataagttttatgagtctattagtatatgttctttaggttatttttttttgtactagtcttgtatctgacattctgaattgctgacaaatacatgtatgaaattttaagttttttgctgtgccaaaggaataagatgaagtttctgaaatttgatatccactgacaccctgctgaaatcaaacatggcactattattatagcagcaaccgctgactgctcactcaaacacatcaaatcctcaaacctcagctgcgatgctagctcatggagcttgagaccgtgtgttctgcatgcagagtactcgagcatattgtaattttggtgcagtactacagtggcatggaaacaatgtgccggcgtcccttagtcatggctctgcccagccaacccgacgaagtggtcatatgcttagtgtgtaaaa

SEQ ID NO: 10746 - DNA, 734 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgcta

SEQ ID NO: 10747 - DNA, 207 bp, Oryza sativa
ctactctcgaggtttcacgggcgcgtgtgtcgcagttgcgcagacatgatgcgcatggctggtgttagggatggcaatggggccccgttcaccatttccccgtggtgaattcacctattaggtgacggagatggttaatatctgtccaccatggtgaataaaatggtaccatagttatcaccatcggggataacgggggtggggacg

SEQ ID NO: 10748 - DNA, 8826 bp, Oryza sativa
  unsure (1)..(8826): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagatcaaggtccgagcactcaatcgtgatggcagagcacttgttgtagttattcctcagacctgatgcttctctaaagagaaataagatttcattcatcacccgcgcgtcatgttctctcggccggagaaagggaacaacatcatcagggtagagctaacagccccgcttctttagcacctgaaacatcaaacttaagatgtgcatgacaatgatgaagagaatcagcgacaaagggtcaccttgccgcacaccacggtgcagccacacagccagcggtgggcggcgactggcgagtggcgcggggcgatggggcaggggatggtcggatgtgggcggtgactggcgaatggcacgggaggcgtacgacgcaggtgctggtgagcggcactggcgcctggtggctaggcttagagacacaagtgtgacgccgccgccgtgttaggagactggggagggaggagagtgcggttgatcccctttatccttttcacttttctgctagggttcactgtatttcgattttgggccttatattctatgccacaggcccacggcccaagcaataacaacccatgtgtgacttgctcagaaactgaggattatctactctagcttgttaaggctcacgagcagctcacgagttagctcgagctagctcgttatctctaacgagcttaaaagtcagctcggctcgttacgaaatttaaatgagacgagctgagctgagcttgtcacgagccgagcgagctaacgagtcaagagtttcctgtccacccctacatgtggcgccaacatgacatcatctttcctttcttcttcctcctacctctctctctccccctcatctctttctccccatttctcttcacgggagcagggcccagatcatcggtggtggcgacggacgagggccggagcggcggcagccgacgcctcctccaatcccatcccggccagcgttcacccagtaccgcagggacggatcttgcccggcaagcgcttaggcggcacggtggcagtggcagcagcggtggcgggagggtccgccctctgcggcgttagcatgtactctcgactgtgccaccgagagtcaccctcgccgcctctctttctcttccctcaacggacgacggcgtttgcgcatcaccgacgcccctacccatggattgtcaacaatcttcccccatccccgctgctccgttgccgccacgcctcatcgctctagatgccacagcctcccccgcccgtccccgtggcatcgttgccggtgccagcgccggcggccaggagggcggtagcaaccccttctctctccctctctttccttcttgacgcggtgcagtgatgaggagtgctcgcggagcacgattccggtgcaaagacagcattggcgtgatggagaccggtccacagccgctgccgccgtactgtcgcgctgccactctgcgacgtgctttgtggcagtgacgacggtggtggccaccgccgtcggctccatcgccgccctcccgactgcagtcatcgctccggcccgctgcccactccctcgagctccgccatcgagctgttgttgcggctgccaccaccgctgctatgcgacgtgcttcgcggccgacaatctggcccctgctctcgtgaagagaaacaggggagagagagggaggaggatgtaacgccctgatttttgttcagaaataaaaatcattaaataatgcatttttagaaattatgttaaaagttaaatcaatttaatcaagtgaaatagtgagggaattaaaattttcctttaaaaatcatggccggaaatattttgtaatattctctgtgccctaatatactctccagatttgtccgtgaattttcggagctcaacatctaattctaatatcacaaagttcattgaatcaaataaaataaaaggaaaaccaattaaaatcctgccctttgcaattgggcctctttcggcccaagccttccttctcacccgcggcagccctcctcccctcctttctcggaccgctcggcccagctcgcacccccttccccgcaaggtcgtttcatctccccttggctccctcctctctcccaaaccaccgacagtcagggcccacatgtcagttcctcccctaacctccagctccccagccgaaacctccattgccgccattgccgcccacgtcgccgccgattccggctcctccttctcacgccctcgcgcccaaaccatgtggaattggttcccctccacctcttccaccaattcccccccactctcccgcgaaatcggcgccaaaccgcctcatccgcccacgtcgcaggagccccacttcgccggccgttgccgcccctctcggccacggttctccctcccagagcactataaaacgatccccgcgcctccctctcccttttccctcttttcccgtgctccccgcgtcctccctcgctctccccacgccgagcccatgcgccaccggtttccggcgagctccggccgtcgctcctcgccgccttagacgccgccgcgctgcgccaccaccaccatcggcatcagcgtgccgtgccacaccccggcccctactccctttcccctctccgcctccgaaacattgccgcaccgcgcgcccgagctccaccgcccgtcggcatcctccagccgcgctccaccgccgctagggtcaccgccgcgctgcaccgccaccaccactacctctgctgcccctcgccgcacactggcctttgctcggtttccccaacccctcaccgaaacaccacctccactgtcaacccgagccgccaccacctctaccgcctccagccgtccatcgccgccgccctgagtgaccttcgacctcgcgctctccttcgccggcttcgcagcaacgatagggagcccgacaatcccctcatccaagcccctcgtcgccggaatccattcccctcgtcgcaacgatagttttcccccacattgccagcggcgcccgcgttttcccgtcgccttgcgcctcctcctttttccctgatccctccatccccgtggacaggtcgaggagctgctcagccatccctccgcgctcgccggtcatcgctggagtgccgtcctcgcttcccaacccgaggaacgtcgtcgccaatcctcgccgccggcagccttcccgttttcgcctcgccgtcttgtcttcttggtgagcatcccccttccctcccagcctccctccgctgcgtcccacgcgtgccgtcgcgctagtggtcgccaccggcgaccatcaagccgtgcgccgccgctccctggccggccggccggcttgaagccgtgccgagcccggcagccacaccgcgctgtgcctggcagccacaccgcgccgttggattgggtgaatccaggcctccacgtggccgtcgtggtgccgtcccacgcaggtgccacctcggcgacacgtccttgccaccttgcccgccggtccaccgtggccaccacgtggtgcacccgcggatggcgcgcgtgtggactcggtccaccgtgcacccgtccctttgagccaccgacaggtggggcccgcttgtcggcgccacctattcccctcggtgacgtcataaaccattaataattgtgtcataaatcggtaataattatagaaattgatttaaatggctgaaaacttttaaaattcatatctaattcatactaagtccaaattgggccattcaacttgcagaattcatctaaaattgagctctacatgtttgtttactttttatgtactgttttcttggtttttattagagtttttttttctcattttgcatgccagtgtgtagtttccgccgtttcgaaagatcgcggtcgcgaggaaaagtgttcggaagattctttcaaagaagcaaggcaagtcacacatttccccttgagcatgttgatcccaatttataaatgttttaccgtttgcaaataaatatgcatgttttgctaattacatgggattatgggtttaccaatctactcgcttgtgccatgtttacttgttaccgtcctttgtcaaccaatggatgatagtttatctagctcatgatacttatgttgatctagctagaattatatatgcttagccatgcttaattaccactagctcacaaaatgggataattacactatttgacatctagtatcatgatgagctgcgtgctcgagacatccgaccatgtttcattggtcataattatccaactaaaatgtgactgaatggtgagcagtggatgcatggttttgctagtcgcacccatggcagttaaggaccggttcacgggaaaccctagaagacttgcagtgcttaccacaagcgggaatgggtaattgcatgatctgtagtatagctcgaccctttcctaggcaccggtggcgagggtgggcgttatggagttggatcggccggggtgtccggttgtccagctgccggattcaccgtggcgcacgaggggactgcccacctccggggtagggggtgggggtgaaaccttagcatggtgtggttggttagggaagagttatatgaagggtcttatcacaatcactcgacatggtaacgtgtctgcgtaggcacggtgacatgccggtggattgtgttttgtgggtacagttgtgcacctctggccagagtaaaactattcgaatagccgcacccacggttatgggcgatcgaccagattcaccgtgattagtctcacccttaataaatcgactcaatgcactgtagttcaggtgggttggttgggcctgtccaacgtggtgtagcattgttcagtagagatttaatattaccttaattactaaactgttttactgttttgctcaataaaatgttttacaaccacctttatgcaaatagccacaaaccgtccttgtgttccccttgcacgtctgcatcattggtgtggcttgctgagtacggtggttatactcagccttgctattgtttccccttttcaaaactgtagtgcttctgagccgaagacaaagttagagaaccaaggctcagaccccagttgagttttgcttatggagtggagctgaagcctcgctaggatcgcctttttccgctactgctgctttcgtttcggtgtgaggactatgcgcctcttctgtaagtatttacgtttggatctgtctattacttattgttttgtgtaccctggctgattctggacagggatttaatgcacaaaatagtctggaaatttgggctaaatttctgggcgtgacaaaggaagagttctcaaaaaaaaagaggaagaaggaaagaggatgccatgcgggccccatattatttttgtgtgaatgacaaatgggttctgcagatatttttttaactctaatacacgtgagcgccacgtcaactccacgtggaatgaagaccgagtcaacatcatcacgatggtgccatgtcagtgaaaccaccctccaaaaccaccaagggagttaaattgtactggttttaagagttggagggttgatatatccggtattgtcattcagggatacgaattagattcggacactagttaagggagtcaaagtgaacttattcccttattatgttacatattggattgggttttatatggacgtgtcgtatgattctgggtttatttgggcctcttcttgggcttaacaaatatattgggccattaaaatagtcagatccaaatttctttttattttttattgttttatgtcagataatttcagctgttagattttgatccaatgacttcaaaatctgcataattgaggcctcaaaaatcattcgaatcctatatagacagccccttagcttccacgccagggaacatgtcgggaaatagatagcatgagtccaaaacactctatctaacttcttgattgaaagataaatgattgcaaacaatagaaatctcaaatgcagataatttacaatttgttttacttttaatagacatcagttgcaaaggaagggcacccggcaagtttcattgaaaacccaagtctgtggtcctagtcttgcaaaaccccagatttaacatgaccacaaaacttgactggaaacacccaaaataccaggttgaaatgaaacgaacagtgatattagaagtaatgaaagggagcataaacttgtataaatagtgtctacttataagtgaacatatgtgcttgtataaatgaaataaagcaacaataatcaattgtctcaatctaacacaattctcgcaacaatctctgtaggctacgacgaagcacttgcatttttacgtttttgttcagcatagggaaaaatacagatcaatgaacaattaaatttatttctcaaaagtggtggaccgaatataaggtgggttacttcaaagtgtcactttatctagcttttgtccctctagagcatttttattgttttagctctgagacagacatacagatccactttttgattccttcattgggcaagcaaactaggggtgttcatccttggttccatctgaaccagccaaaaccaggcagagcaaacaaactttagccaaaaattagcccatagtgaatatggctcgctttttttaacccatagatgaacagccctaaagcaaaagcagagctataaagaaaaccagttatatgcaattctaattaccttacaaagtagaaatatttgtctgtattaaggtctatctagtgactgcacatgccatagaaggctagagtgccatgaattttgatcaccaatgtacctacaccaaggaggcaagaacccaagatttttgaccgcctaccaaccgccatccaagaatcctaacatagatatatcatatatgtattgcagcagaacagcagcaatgttaatccagcagtacgaaaaattatcacaaaatccagaatctcctgcttgttctgatcagttagcgatagatttgagtgaacaagtagtctctgactgaactagatgtatgaactaatttaagcgatgcggtaaagtcctagaaaataattgtccaaattaaggggcttactcataaggatattacgcctgccaggcagggtgaagaaagtctccggagtggatcatagatgctgtaaacctgtttccattggttggagatcactagggcacgagtggactcgaggtaatccacatttgagtatgctctaatggtgacaagctcccccacgtgttgaggaaaatcgaaggatatgtgagggtcattgttgacccaattaagtgaacataagccagggttgccagcagggtaatcaaaggaaattaatttgcaaccggtaacaatctcctcctcgtcctccaagtaggtcagcatttggatctcgacaattgacaaagagtacatgtgccctgctgtgatggtgcttgggcttgcaacggaggagacagagacatcgatcttgtaagcagtgatttcgtcgctagtgttcgatgagccaaggaagagtagtgttccctgaagagggatggcacgtccgatgaaaggcaggtctttgtcatctagtttggcccattgctgcgtctcggtgtcgaacatgtgagtgcccttctggccgtgcccggttatggacagcagaatgtaggagccaactgctacatgggacttgacggtatccaccggtggaaagatgtagtcagttggggtgagatcccaagggaaaaagggcgggcgaggcaggggtttccactcgcaatccagcagacagcagcccgaggcattgtcgatcactcgagccatggagagatcgagcacctcgaaccagggcacgaaattgatgtcccccgtcacgcagggcatgcctgccagggcgtatatcctctcgcccatcggtaccaggatagggcagagcttcgtcgacaggagcttgggtcccgataccaccttgcacgcgttggtgtcgaagacgatggtctccgggccatagtccctgatgcctgtgttgccgccgacgccgacgatccacggggcatgcctcctcgaccgcacgggaacgaaagacatgcagtgcttggagggcaagcgggcgaggtgttgcggtagaggtacaggggtgtcgccgtcgtcgtcgccgccgccgccgacgacagctggtgggttcaccttgaacacggactaggcagggcaagtgactccatggccgaccaccaagtacacggccgacacagactccgtactgcttgtacgagcgatctgacgagggattgaatctccatccttttcctccatcttgtgcttcttgctcaggcaggttagggttggggattgtttttgggacagattccaaataaacatatttttaactcgagcaaatttgtaatagcgtgatctagtttattacaaatgttgcacgaatacgaatcgaaaccttaaactattcgaccaccaaatcggacttattatatagtgagagagagtaggttcccccgagggaaagagagtaggttaccctgccagcgatcgggcgcccgatcagcgacagaaaaatcgagcgcggctgcttcccgcgctttcacgccatcccaccacggggcccaccacacgcgccgtt

SEQ ID NO: 10749 - DNA, 23209 bp, Oryza sativa
  unsure (1)..(23209): unsure at all n locations
caaataaacatatttttaactcgagcaaatttgtaatagcgtgatctagtttattacaaatgttgcacggatacgaatcgaaaccctaaactattcgaccaccaaatcggacctactagagagtgagagagaggaggttcccccgagggaaagagagtaggttaccctgccagcgatcgggcgcccgatcagcgacagaaaaatcgagcgcggctgcttcccgcgccttcacgccatcccaccacgcggcccaccacacgcgccgttgcaacaaatcacccacatattacgaaaaccctctattaagggaatccgtttcattttttgtttcatcaagtttcagtaagtgtacatgtgatgtttcactatgtacggatcaaatgttacagtgaattgaaacatcctttcgctatttgatgaaacattgtttttatatagggtgaaatagtgcccgattttttttggaaaccgttgtttcatacgttgcaaaatattccacgaggtgatttggttgtgtttcaacttttcaaaagactgaaacattttcgaactacttagtgaaacatttccggtctaaaaaaatcgagcgttcttttaccaagtagatggaaatgtttcactaaatagttcaaaaatgtttcagtctttttaaaaatctgaaacacaactaaatcacctcatttaacattttgctacattgtatgaaacaaacggtttccaaaaaatcagacgttgtttcactctatataaaaacaatatttcagcaaatagcaaaatgatgtttcaattcactacaacatttgatctatacagtgacacatcacgagtacactagctaaacattgttggtggaacaaaaaatgaaacggatacccttaatagagcgttaccgtaatatgcgagtgatttgttgcaacggcgtctgtggtggggcgcttggtggggatggcgcgcaagcgtggaaggcgcgggaggtgcggcgggagcatgggaggcgcgggcgcccgatgcatgcgcgcccgcatcgggcgcccaatttagacaatttttgctttatttaaacttgctcttgtgttcggtttcaagggatgggaactactcccccccccccacacggaaaacggaacgatccattagcatgtaactaattaagtattagctatttgtcgaggagtgatcctctctagcgggaggtcgtgagacccccctttgtgagttcagctgggggataaggcgcgaactactaggtcgctgcaaatctgagtgagagaccagtgattatacaggttcgggctgctatgaagcgtaacaccctactcatgtgtttgggattatggtgagttgttacaagagatcttgagctcctcgggaatccaagccgtgcttcctttagagctcaagctttcgagagtcgtcccctttctcggtgggtgaggtcctccttttatagttcaaggggataccacatgcactgttcatacctaccccccatgggagggggggccacatagcctaagtcagataactgtccgtgccttcaaccagaagcaaagtggtcgtccgcctttaggtggggcccaacgccgtcctccgcctgacacgggggacatccctgtcattccctattaattgtataaagactttggtgaattcatcatatacaggcggcacactcggtagtgtgctgatggcatacctgcccccactccacctgacacagggcgggacgtggggccactgccacccgtcccatccgtctgtgaccggtcacatgccggtcaaggccgattgacatgcgtcaatcgggcggcaccacgcgcctgcccatgccgcattaaacgcggtgtggggcggttgggacgccgctcaattaagacgctgggcagggtctcctgctcctgctccgctttctcggccgccacgtggtggccgagtgagggcctcagggcggtacgtgccaagggcacgaggggtgtgacgtggcaccccaaggccccctggccacctcagtgctacccgatctccccccgaggggacggggaaatagtcgtctcctttagtctccgtcgccgtcgttggattcgcaaagaggagaagaagcccgggcaccggttccttttagccgtaacctgctggaagcccgtcatcgacgtgaatccgatctactccgcctccggcagagccttgccatcgacttcgtggttcctggacgtcgtagtcgccttcttcggcatcgcagcgccaaggtgaagcccgtccgctggttttcctctgccaaagatcgccggaacgccgttgtcgtcgtcgaccagtacctcgttgcccttcggagctcgtcgccggtcgtcttccgtcatcgtttgtcgtcgccgtcaccaccagtgagttcctctcatcgtcctctctgcgttggtgctctcggatagtccggccgagcttcctagctcctgtggccgtgtggtctagtgccttgttctggcgatgatgtcatgctgacgtcataaatccccttttccttctcgaaaataattaaatattgcgtcataaatcgtaaatccttttatgttcaaggctaaaatcagtttaatattgtaaaattcataactgattcatatggaatcggaattaagtggtatcagagcctactctcgaggtttcacgggcgcgtgtgtcgcagttgcgcagacatgatgcgcatggctggtgttagggatggcaatggggccccgttcaccatttccccgtggtgaattcacctattaggtgacggagatggttaatatctgtccaccatggtgaataaaatggtaccatagttatcaccatcggggataacgggggtggggncggtnaaccattnaccgtcctcgccccccgcggtgacccgacctttctatatagagaactaattttagactttatagacattttggcccataatactaaagcccaattaacaggtatatataaaaagctaaccctagcctctcctccagctctccaccacagccacgcccgcacaggcgcgcggcgcgggcgccgcttcctccactcgcgcgcgccgctgccttctctcgcgatctcccccgcaccgccctgcagacgcgcgcgcgccgccggcgcctcctctcgcgcgcgccgcctcctcctctcgcccgcgccgccctgcagatgcgcgcgccgccgccgccgcctcctctcgcgcgcgctgccgcttccagacgcgggcgccgcctcctcctctcgcctacgccgccctctgcagacgctcgtgccgcctcctctcgcgcgcgccgccgctctcctgctccctccgttgacgcgccaccgggagccgccggctttgtgctgcccggcgcctgcaggcgtcgatgtgggcgtgggagatgtagttgcgtggccgggagcggggtaaccacggggaaaaattcaccgcgcggtgatcggggttggtgaaaatatagccccgtcgtgattgacgggggcggggacggtgaaattttatcaccgtggtgacggggacgcgggtgtgacccccgacggtgaattcaccgttgccatctctagctggtgtggaccagcatggcacatgcgttggcactggacacacggacatggccaagaggggacgttcctagcatggggttgatcgacgggggcgtcgatctctcttaagggggtgaggatatgacatctcggcctaataggatactcatatcaacaagttacaacttcttttccagaagccgatctctaaagaactctaagattaagcgtgcttggcctggagcaatttagggatgggtgaccgattgggaaattcttcccgagtgcgcacgagtgaggacaaagtgtgcagaaaagacatgtgttggtctgtgagggcagtctatgacctatgaaagctgccagatgtaagtggacccggcctgggaaaggctggtcgttacaaaaggccagttcacacggccacgtggctagataggaaggttacttccctctactgtgcgtacccccgggcccatatcaccaacagtagccctcggcactacgtctgaccgcgacccctccagggcggtctagcgtggtgcctcataacttccgtcttgtgataatgggtcccgtggggagttcgaggagctatcattggcgcgctcgactcaagcgcccactatgaagattatccgactgccaataaatgcgccacgcgtgggggcgcgtagggcagaaagactggggggggggtctgtcaaaccgcgcccggtatcattactggccgttgcatcaactgcctgattgtgaggcgtgtgcgaaaaatgggattatcggtgggcccgaccggccatgaccgtaatcattgcacgtcccgcgtcaattatgctgctgacagatgcgttcaacacggggcgtggatttagtggggcgagtggttcgagagggtgcgaaagacgaggaggcggctgcggttgcggggaacgaggaggcgggcgctagcgaggcgagaataaaaagggaggagggaggagagttcgtctccttcctctcgccattcttactctcgcacacacgctcctcagcccccaacgttcctctttcggattactgcacctcgcgcacccaatcttcccgctcgcactcacccaccgccatgactcaagacgccggcgacgccgttctcctggcctcgcgcatcacgatggatagacacttgagtctcgtccacaagttcatgccggagggcgccgtcgtgagggcgggggagtcgcggccaaggccgcggtacccggatcggtccgtgcacctcctgtccttcgccatggcggggttgattccacccttctccagcttcttccatgaggtcctggatttctacaggatccacgccttgcatctcgcctccaacgctatgatgacactggccccactaaaacctcctcgcctccgccctcctgccaccttttctttttcaagaaattctcatgttgtagcttaagataggccaaaatttctcagttggacatgcttgctaacatagatgcaaaaagaattttgacaaaaacccccaaagagtactgataacttctatatcagtataaacccaacaactggcagtaccgtcaaggaaagccccaatttgttgtttcagaaataaaaccttatttcgttttttcttgattgcaacaagtgaggctgttgcgttaggtctgatgtcccaatcttaataactaaataaactaacttatcaatcatatagatttcaacatatgtcatactcatacacctgagccaggttggatacagaataaaatacattgcaccatactgtatgcggcaaatgcgatgcaactgacgacgataacaacaaccaacatgaacatctggcaccaaccagtcattacactatcaatcatattttttcataagagtgtgctactatttaactggcagttctttatcatgtaaaacctaatcgccaaacaatattatccattgtccattataccaaaaagcatggaggatggaatcggaaaaacacataattggtaaaacagacagaacatgtgaacaagggagagacgcatataactctgccaggttggcaaccaaccacatttatacatggatacaaagagagggaaaattattgtgccatttgttccttgatgatactgtaaaggtgataagaaacatgaacttcaatgcatccttagtaggtgacatacataatcaatcttcacacacacaagagctcatgccaacaagaaattactctgttgccaagctcagatgtatgtatttttcttaacaaatcccaataatagtaacaatttgttcctacaaggtccctgagtcatcaccaaattgcagacaaattggaaccaattttaccttctacagaatcacaaattggaagcatttacttgcacaactcaagtggaacatcaggtagaaatccagcaaattactacacaccagagaataagcctctgagataatcccaaacaacatcaacaaaaatgcatcaatcaaacacatctatggacggagcggcggccgagcgagcagctcaggccacctctccggccgccgcggaggccgggggcgcgcctgcggcggaggagcgggacctgacgaacgcgaggaggcggttgctcacctccctggagtagagctgcagcgtctcgatgccgtcctccacggaggacgaggaggatgacgaggcggaggcggcgtcgaaggcctgggcctcgacggcgcgcgcggcgcgctcggcgtcggcggcggggacggcgccgtagcggtagcgcttgcggagggcggtggtggtgtcgccggagaggacggcgacgaggcggcgcaccacggcgtcgcgcgtgcggcgcgtgggaggccagacggcgaaggagaagggaggtggcggcgaggccgagccggcgcgggggagctcgtggccatgtgttggtgtcggggagcagagtagtaaagcagtttgatgcgctgcgtcggctgcaaggagtcttttacacacgttttggagagaaacggtcatacggataaaatgatgggctacactacacatgagtagatccttttgtcatgtgactagttgacttgactaatgccacaaagcccacaagagcgtggctacccatcaagacgccttcttcctcgagctgagttcaaaggcgagtatacgtagggctgtacacacggatggttggttgtcattggcgacagtggcacgtacaccttgacctaaggtgacttgggaggtggggatgtcgaaagatggaggcggagcgtcttatgactcttcatccttgctgcaccaccaccagtcaatggcaaataagagacatccgagagaagattggtcgatgactaggaagagccctctcctctttctctctctcctagtttcaacaccagccaacagcgatgatggggtcagtcagagcagatcagcgataaggaagaacccatagatcctgtaacgatgagattggaattggtcgattgatagtagatgtagtggcaacagcttgtggagatggatgtccatcgacaaaagatgcttgaggtcatgctgacagtggccactccgcttgaggttgccctctctccctcacccaactcttcccatcggctatttggttggatctattgtcaggaaagggcctccttttgcaccctccattgagcacccaccggcttccctccctcccttcacttggctagaggaggaacatgacctgacggatgagcctcacaaaggatgccatgccgacacgcctatgtgccatgccacgtaagaaaaaaatgtttgtaaatattttaagaagctgtcctttcttgacaaatttataaaacccaagataaaagtggcatttgaagttttatgtgaagaataattttttctactatatttgtattatgaagtttgctatctcattatcatgtcacccaagttggcagcgagaaaaattggaaaaatcaacagtattgaaaatgttttaaaaagtatttgaacctcaaatatattattaaaatatgccactatgttttaaaaaagtatttgctcaagagtatgaatttataagatattttaagaaaatatacatatattttaatagaattataataaaaccagacatttaaaacaaatatattacaaaaactacatatttaacactaaatgtaggtcccgtttggcataactcctgatctcatatttacactagatttagactttataagttaaattaaagattttgattttttttcttaagtaagaacaaaatgattcatttaaatattatcaatattatcacatatctagatttgtggatttattaagctagagatacctagctccaagaaatcctggatttagagctgtgccaaacagcggtatattacaagcctacatatttcacaaactaatgcaaacctctttgatttggagaaaaattttctacgaagacttctaaataaaggattgaatcctatggaatggactggattttggaggaaagttaaccgaaactccaactaatttcattagactatctctcacctgattccttctttttttttttccttcagtctactcaaacaatagttcatgtattttatgtgtatttatttttatagaaaaatcctatgtttttctattcctccaatttttaaacttgtgtttcaaaggagctagggatatgtttgtgataacttccttaccaaattcataatttgtgatactctcacttatctttattttttacaataaatttgatgccagttctatttaataataccatcagattattgaaatggactatttgcttcatgttttttaaaaatatattttctcaaaaatattattttactgctacttataccacttgctttaatctatttgtaaagtttatttattaaatatttaatttgcctcataatgtttcatagtaataatctgttcaataatctaagcaaacaaagttttaggttgcgtttgtttcaagaaacaaacacaataaagagaaaagttattcgttttccacgcgcacgcttactaaacagcaaatggcactttttttaaaaaaaatctataaacgattactttaaaacatattaatctattttttaaatttaaaataattacaacttaattaattataagttaatgtctcatctctaatttacgtacctcaatatctcacacccaaaatctctaatttactcaaatcttttcgttgcaagaaaaaaaagggcactctcaagtctctagcctttcaaggacctttgtgtaaaagtggactcaccagatcggcgcccgtttaagccgaagagagcaaacccagagatatacagtcaagggccaacaaggatcggatccctcgccgccgcggcggacgacggcgaggcctccgaatctgactaggtactccacctgcctcttctctccctgttcgtgtgtgctgcccgtgtctgcgtgtggcggggtctccatttcacactaggggttgcggctccgcgaatcttgggggtgagtttcttttcttgtgtgcaagaacttttgggatttatatgcttttgaatccacactgagatgtgtagaccactcgatatagtcgctgctggattctgattgaggtaagtttgtgcaatggggggcaagagcgtttttttttttttttggatatgattggagcgtccttttccagttaggttttggattagtgctctggtgtgttgttggtgaaacgaactctgtagaatcctacaaccttggacactgtaaatcagctcgcctgtaatcctgttagaatgcacgcacgagtaggtatgtgtgatgtgtcggtattgtgtttgatattcttagctggcatttgctaattagaaacaccagtatgtgctgattagaagcaccagtatgccaatttaagagagattgttgtgagagcatggcagcatgagttatacaacattagcacatatttttgtaccgcatgtttaattaccttcaatctgatttagaattacaaaattgtacagagtttgcgtccctatataatttccagttcttagagtttttctttttttggtgttgcttgttgatatcaaagttcctcactaggctgcattgagttctaatgcaataggtgcatcagaaaccggagggttttacattaacttctgcccttttacatgttattaatgaatattgagttgaactggacttttttttcttctaaaacactaaaacaatgctaaccggtagtccggtatttctaatgcatttgtaatggtttattgctcttccgatttttgtttgaactattagatttggtttgctggtttgcatctaatgcaggtgatgttctgtatttcaggcttttcatatcttcctaacagaagttgtccttgtcagcaagatggtttcctttaagatgaatgaccttcaaagtatgaacatcatctatccctgtttccatcatctgaaatttccattgaacactaaaatagcaatatattgttctatgcatcattttcctttcattgaggttgaacctttcaatggttgcagaaattatatttctctaattatggtagtaaccttgaccatgtttaaagatgtttgaacttttgaagttcacagtaattttgtaaaagttgtcctttcttgcatatgctttgtgtttatttggcttttgacgatcccagaattgacaaccttctcttgcatactgtacaatatgctctgcttgccatttaagttgttactctgcttcttgttatgttagaatttaggaatacgttataccgcagcagagaagcaaatcctttgctgttgtggctatctaagtataaaggcacacttttgccgttccttcatcacagccagtaattttctttcgacggttgagattcctagtctttcaatgccctaccaggcccattcctagcctttgcacggttgtgacaaaaccttgcatgctcacacttgctgtgtttgtgttttcctgctagattttctactaatgcagtcaaacactactgttggtaacttgatcatgctgcttgtcaccgctcttgcttgctgtgtagccagagctgtgcacaacaaatgtctgtactattatgaacaataaaaaagtatatgtgagctgtagttatatttaggacctgttcgaatgtgctattggataaagattgtcactggcacgcaaaatgagacgagccattatattaactattacgaacttgaaaatggatttatttggtttttaaaagaaacttgtacttagaaactttttgcacgaaacacaacatttaacagacaatttgggaaacgtgctaacggaaaacaagggaaaagctccatccagatgctacatcgaccgcagccttagttgacatgatctagttgaagagttgcatacttgcaatcattagatacagaaccttgttctatattgttctgtattagtcgtggcttgtaaggaccttgggtagtgtaatgggattaatctcatagaggttgtagccagtgtccaaatgtggcaccactacaagattaagcagaatggggaagaaactttaagagaaaattccctgtgtacccctgaaactttctctaatcctgtccatgccccaaaattttgctcattcccttgtatacctctaaattttagtttggatcccttccataccctttttgttagttgaccgtgagttgatcgttaaattcctatcaagtagtccattttgccctttggtatgaacaaacatataaaattatggagtatattgttcaagggtagaaatttgctatatgagactattatctcaatgagtttgttatgcgagatattattaatcataaaatttatttatagatatgaaacaaaaaattaatattaatttattatttattaaaaaatatttatgtataaatagatttgtcttatacaacaaatatgttgtacaatactatctacaaaataagctacacatacaatgtttaattattaaaaaataaatattaatttttatgtcatatctaaaaataaactgtcataaataatatcttgcattagaaactcataaatataaaagtctcatacaacaattttctaatactccattaatatatatgtttttcataccatagggcaaaatggactttttcataagaatttaacggttaactaactgtcaactaacagaaagggtatggaagggatccaaactaaaattcgggggtatacaaggaaatgagaaaaattcaggggcatggaagggattgggcaaagttttaggagtacactaggaattttctcaacgtttaagcagtgtgttatatgcaattatgcatcatataccactccaatagagttaggcatagagcagattttggaagctaggatgctagtatgttacaatgtattacttgtggcaatcaatttttcatgaaggaatacattttttctgtcaaatattttcgtcagtattttttttccctgaaaatctatactttcctggcacgatcttgagttgaatttaattgattgcctacctcatgccattggcaattggcacttcgttgctcatccccctgtagctattctggagcatttttctatttttgcgataacaaatgcattatgcaccctgctacattttttcaatttttttcatctcatgcttggaactatgctcttcagggcatagagcactgtttatcctggatgggatcacatttcccatccccacaaggtattattccattggttggattttcttttatgctttcttgctatgccacatcatcgttatacccatacccacttcaattggtaatttgtgaatctcatcttgcagagattgggatagggctgacaggctttggagtattcttctcatttctggggatcattttcttctttgacaaggggctacttgcaatgggcaatgtaagcttgcttgaaacttttgctgaattttttgaagatctaagccaatgaaatgtgtatgcatgtggaacatttcagattctcttcctgtcaggcttaggtttgactattggattgaaatcgactctgcaattcttcactaagcccaagaactataaggtttgtaaatttactgtagcttatcagagcttttgcccatggactatatgttatttaatcaactaactgtaactggcagggtactatctcatttggtgctggccttttgcttgttctaattggatggcccttttttggcatgctattagaggcatatggttttattgtacttttcaggtttgtttctcattgcttgtccattgaccaatccttcttttccactatttaatgctgagataataaagaatgtcttatatttgaaaagatttctgcacagtgcatgcttgacaattgtcaggtttaacatttgtcttgtatgtgacactgaaattgcagtggattctggccaactcttgtggttttcttgcaaaagattcctttcattggttggatatttcagcagccatttgttgcatcggtacagattttcccaacagaaaaatattctctatatggacactgattactgcatgtgctaactgaaaaaaatattttatttgcagtaccttggaagctatcgaggaaaaagagttccagtgtaggtcttaccccaagtagtgacacagcaattcgaggtttacatggcaacctcaattggttttgtaacgcgccttccacatttctgcccttctctaccttttcaatcaccaaatctttacaaatgcacatgaatcagggtctttttttttttgtaaattgattttgcctccccttggcttttaatgacacaatactctctttagtaagccagattctaggaaaattcatgtttagaaccgccttgttgaagcagaaactgcatgctcgttgtgcttctgtaatatagttccagcaaatggcctctgatatagaaaatcttgctatgggcacacatttttgtgccagaaattgctggaaccggaacttgctgaaatgactattgtgaactactgtgatccatgaactagctaacccatctgctcaagatgtctatgaaaccttttttcctgacattcaaaatgtctttaatccactggactaaccttttatgactagcttgtttgcattcataggaacggagaatgaaattcacaacagttgttaaagtgaattaacgattgattagttcaaataatgggaaacagttattaaagtgaattaataacggatataattcaaatcagtacaaatgtacaataccaaacgatgagattaatattctgttctatcaggcttgtagtttcctcgttgtgattacctgagttttctcctctcccggcttaatttatgaaaatgaaaagcttataaaattcaacttagatacgggtaaaagatctatagcatatgggtgtctaaattttgcatatgaaaaaggggctctagcaaaacaaactgttgaaagaatgccatccgtcaaatgtatcccatggtcaaccatgcaggttgagcacggagagtacaaaactgagtgcaagagagcaaattagagcagtacagcagctaaacccaatatgaggcaattgtcttggctggaacagatattggtcacaattgcaacaacactactacttctaaccagtaacaggtcagtaaatcctacagcccattcacaactagcagcacagcaaatgactagctagctaaacctggtgtttgtaagaaatctttcagatgttggcaagttcagatcggctgccatttctcgcctaccggaattgaggatggcattggcccaattggacgaccggtgcacgatctttgacgggatgcgatcactttcctcgcctcccgaggcctcgtacccaccactcgtcgaccttgaaagtgcaatgctttttggagcagtggattctgatgctgcgagtgacatgaaactgcggagttcgtctgctcctgacattgaaacacggaatgggtgaagatcaggtgagtccaggctgctctgaggtgatgaggtgaggtttctgatcgacgatgcgatgcttggttggaaaacgctcctcgcttcatgttgcaatggggctaaactgccacatgtttccatgtccatgtcgctgcagttgctgtcggtgcagctatcagatgtcctcgtagtgtgatcgacggaaagttcaggtagaaactgccctctcttgtcgggtcgcctcttgtcatgtttaggatcttcatgtctcgcgattggctgaagaactttggacttctttttcgcctctgcagctgccttcgaaacttcctccgcgttaaggcgagctagtgtccagggactgattttcacaggtcctgatggttttcgtttggttacatcagcatgctttgccttcttgcttgaggagttctgtggcatttctgggggaatgacatgctgcagaaacagcataacaataagtgccaaaaataacccagaaaaaaaaatctatgaaacatggtcatcctgacacctgaattcagacttcagagcatgctagccactacaaatgagtacaatcaagtgtagaacagtagctacacaagaaaagttctaaaagataatacaaaccaaactctagaagtgagctatttctaactattctacaactaaatttcagacatccattttttttaagtagtagctgacaaatatctcaaacacaaactttcttctttttcccacaacaatcagaaaatgtgcatgatctgatattctgtatacctgatcttcaaggaataaacgtggcggagtacaccatgacccacgttgaagaggagcaaatgagctagttgtgctaaaccctgtcacagagctaataatagacatctgcgggctttgatgctcagtaacctcttgctgctcttcttgttctctcaaagctacaatataatcatacgtacttatgccctgcatacacgtggatagaaagtagaatacgtaaatcaactttaccataagagatagcttgaaaagctaagcatattatctcttccagaaaaagactataaacataattcggtaataacataagactaagcatgttcaacacgttatataatattatttccaagaattaacttcaagaaagagagagctattgtccttcctttccaacatataacttgttgtatcaaggtttagtataaatattatcttaatttcataagagttctattgacagtgaaggattgctttgctgtacaggccatattcctgcatttgtcatctacttagctctagaataagtaaacgactctttgcaaattccctgcactgtagttagcgatcatcaaaagttttgcgccagtgtttccttcttccagcaagggttttccacattaaattatgtgtttgtcgttcctaagaatctctgtacttgccttgatgtttttaacaattcacattttacaatttgatgtcagtctgtaggggccaatgtgtaactatgagtctgactgatatctgaacagacttgtcaaaatagtgaactgttattacttaacaggaggaagaaactcacttaagtttattaaaactattgcacactgcagagtagacagaaaaatgagtgtcactttaatttgttacagttatgatcttttcagataagagcgaaaagaggaaaattgagtgtcgttgcaaccaatatgaattagtatgttaagaaaacagggcaacaatcattaataacacttctatctatgctgtgttaaaactgatcttggtacatatcatctgcaggtaaagctattgcttactttcttaataagcagaacatggaagcagaaaagttgggcaaggggtattgttgcaagcattgctagtaaagtacatgtcatctgcaaaagtaatttgtgttagaaagaaataggatggattctcaatagtgctttataagcaacagtaattctacgctaaatatagcttcccattcacactttaatgttgtaaactagtaaagcaaaattcaaatttccaaaccagcaactatgccagactgtccattatatagcacacggttaatatgacattagacaacatcttttccatcatctcacataaccaattatccttttaattttttaccgagagtttaagttctagttcgaaacatccaatcaaaacagtgttgaccaaaatgtatccgttaggttctcacaccaaaataaaatgcacatttacagggttcatactgttcaagtcttaatacttatggtctttttcataaattctgagtattttgatactgcaactcaggaaacaaaagctatttaaaacattatatgagaatttttttttctcaaatagctgcaaattccagagaactaaccacaacaattacaaaagcagctgttgagaagctacttcctaactttgagatgatctgtccggagaactcccctcgcttcagtaaacagagtatcagcacaagaatgcccactaaccactgcattataagctgaatgtgcacaatcatggagagctgtcaatggtcaaccagaaaaagtggatatggaatagcagcactttctagatgtaaagcctacaggattgcagtttttatttattgattcttgagtgataaatttaaaggcacgaggaataatacaaaaataacagagtttctttttaggatactgtaaattgaataattcttaaattttagatgctcatcaaaggttgtagtggaggtttttacttaccaagagaacagctgaagccattagaatgaagaatcttttgtagtttctttttcctatgcaattattgagccactgtggacaaatcaaagcagaaggtatgctaagaataatatttcttaaagaaaaacataatttccaaaaaaaaacattaagagaaaaagagagaaaattaccctgcagtggtgatcaaaaccatcaacacacttgtcgcaaactctacaatgcttactatgctgcaacacctacacagtagtcatacatttttaaacagataaagtaaaactgtccagataagaacattttgatgcattagaaggtatcatccttttgttgaggcatgtgatttttgaacatattcacataattttttctgcagtattacagcacttttagattttattaagaagaaaatgtgttttccctgaatatatgtataataagccagattgcaagtgtttgtaaattatagctcctgtgtttctgatgttaacaacttaacatactagacaatggtctcatatctaaaattacatggcaggtcactgcataactgagtattttaagaggagaattttaatcctcatttttaactcaatgggttatagtttaaagagattctccagttttttcaaaaagtagatgtaaagttcagcataagcagacatcagcttgtaacatacctctacttcacataagctgcaaaagaacatgccttcttcgctcatgtgctgttccgaagattggtcatctgagtgaaagaatcttttccataagcagaagaatgggttgcatatcaagcaaagaactccatgtaacccaggccgagaagatgaatcattcccttcaaacatattgcttaatctctcactgttattaacaatgctacagccatcgctgaacgactttcctccctggcatgattcgtgctctgaaatttcttgtatttgctttccatccttgcctaattttggatgtttctttgctttaaaaatgcctggatcaccaggattagttgctgcacaccatatgtataatgtgacaacacaagtaatctgcaagaaaaacttatctgtcattcatcattttgttgacaatacaagagcacatcgatgtgctgttatatcaatgtgcagttactcttaagtatacagttacgaattgcaatgaaaatcatgttggttgaagatataaaatttatgttttgatgcatagtcatttgatcaaagtgaaagctacatcgttgatgatttcatggaatttttatatatcaagagcaaggcaaatggactgtatcgtaatttttaattaagctatttacccctgttacgattcagtggatttatccaatccttccagtgttgaatgtcttctctctattagttctacccatccgattacatcatataaaggattcgaatccttggtcctcatcacatcgtaaggattgaatgcttcagagaagaaaaaaaggtaattactctgtcttctaaaatagctttggcagaagcataggcatattagtggcatcaaagattttcaccatggcatgtcgtcagtcttgatttataaaaaactgacctatattagcctaaactactccgaagcacaaactactctgcagtttatccctgtctctatgtcatggaccttacataatgtagtatttctcctaaacattctccacatattataccgaccaaaacacagaagggagtagtgcaaaagaagtcaccccaaactgaaaggagatgcagatctatctgccatgaagaattaacacaacaggttagaaacacattaaagagggcaaagttgtttcagctactcaccagtggagtgtagagacccatgagcacatactggagctcactcctccccacaaatggcacaaagaacacatagaacgcaaaacccagtgccagaaaaaccgctatcgccaccacctgcatatgcacataccaatcagcaacaaaaacaagtatacaccagaaaaagataccaaacgaaaacaccaaaagaaataaacaagaactggacctgaagagggtggtaaggtagctgccacccatgcctcctcatcgccaagaacccctcccaaatcggggcccaagaaacggaaccaagaatcaatcaccaaagcagaaatgaatcaagaaaccataaggttttgttttgcccccttctccggctccgtggatcacaatgcgaacttggagcagccaagaactctggtgctcaggttgtttctttttttttctttttctattgaactgcctgcatttgatccctccctcccttgcagtaataactcaggtattaaatgcccataagaaaaggctgcatcagtgctcagcagcagcaagcacaccaaccatcgttcagagagagagagagagagagagagatgttgaatgaggcttgcgacttgcgagtagaatactagtatagccgtacagtctgtcgttggatttattattgggaggaatatataggggctaggtggagacgaggcaaaagtgaattgtgacaactttggctcgagggatttgtttttgttttttacacttcaatcttggaactttttacacttcaatcgatcgggtattttataatttgtgggttctgggtaaatgtcacccgaaataactaaaatggcattcataccacttcaagggtctgaaatgcagaaatttcgtgttaattgttgacaaaaacaattacatgtcagatacatcgagggtagaagcaatttcgttgttaaaaagaaaaaaaacacgctttaaaagaggcctaaaatatcccagtttattttttttttaagtttgtgagtattttttttcttttgaaactacacaggcacctaccgggtccttgtagaatcgtgacgtcaatggttagtaaggccatgtttagttcccacgtaaaacttgtacaccctattatatcgaacgtttaaagacttgcacgaagtattaaatataggctaaaaataactaattgcacatattgtgactaatttatgagacgaattttttaagcctaattgctgcatgatttgacaatgtggtattacagtaaacatttgctaatgacgaattaattaggcttaataaattcgtctcgcggtttactaacggattttgtaattagttgaacacccgatgtgacacgccaaaactttacacccctagatctaaacaccccctaacttttcattgataatttagtgaggctagagtagtgtattcaatgggtatacttgatatatgtatgtatgttcacctttcatataattcgaagttttaaacataccaaatatttctactattataaaaatttaaaatgttttcaccggaattttggtgcatcatgcgtgttttgagttgatttttagttggttatatatcgtttgtatccaatttgacgtgagtttaatataactattatacaacctatcccagcccaacccctctcccttctagcacaatccaaccgccccacgccatcctgcaaacttaccctgatcgatgtattttttttctctcttattttttttcctttttttatccaatatttatgataatctctctctccttccaatctcatatatttcctcctttttccctatttcctttttttatctttcaaatttctttcttgataaatatttttctcattgtttaagatgtttatgtgacaagtttattattttgcaaatgtttttcatataaaatatttttttactaattgaataattaaaatttcaatctttgatcgatgaggtataaccaaatgcgcatgcgccaacttatgaaatagtcacccgatcaatttgtgaggctatggaaaggtgtagataagagattcttcgtgtgatgagacatgaagcaagcacaaccgggatcaatgctatatatgatttctaacttttttttgctattattttgtttgtcttgttccggtttgtcatttaaattgatagagtttttatcgatcttgaaagttatcttcacctgttgtaaaacaccagtatttttttctagtataactaaaatatatttgaaagtcacttttcagtttattaggaataaggaaaaagatgtgctccttagccaaacataacattagtaaaagaaagtgtaattttcatattttccaaaaatattgaaagatacacactcgtttctttttttttagaactcacactcgtttcttcaaccgtgtaaccacgtcatatgggcacaaccacaagcagatacaacgattgatatgcacagccattacagatataaataatactaactggtccttttaagacatcactggtgatgacatgttagaagatgcgaggattttttaagtcgtcatctacgttacaaattaaatatcacaaaattacaaatttgtataaattgtagtactccctcctttccaaaatataataatttttggttggatacgacatttgttagtactgtctaaattcgtaatactaggatatatatgtcccatccaactaaaaattactatatattttaggacaaaggaagtagcagtcttactataaagacatttaagcactcctactaggacgttgccgcataaaccggtcgtgccacgaattacccacaaccatcgagccccacgaaaacgctatggccatcactgatcatcatccggagactgccacaagcccacaacaccgccagccgggagactcgaacgcctcgtgtaaactaatttggcgcacaaacataattcttttagcatttatagttacaaccaatcaaacctaaaacttgatatataaacatacaacatcattatccacaagtaacattatttatcaaaactcatacaaatatttgtaacatcatctacattttattaaaccctacaaatctatatattataagcatatccaatcatcatctctcataccattttcacaatatttgaacatatgtatctattactcttataatacataacattttattcacatattctacaacaaagcatgaggtgaggttcatttagtttgtctccgaattagtacaaacaaaaacctgatttgtcatcaattcttttccacttttcactttttgcgatacaaatcttcaccaacaatctaatatttcatctataatatcctatacggtctactaaatttatctctagttttatttgatgttaataactaatatatacatttcttactactatctagattgttataaaataaattaaaattactaatttcatatttaaaatgcgcgtagtatttatatttactcgtacatacgacgactgtaccggcgaccggattttgtaacgcagggatgtaaaaaaatatataaaagtactctctctctctctctcattgccatttgccactatgcctgccatagttgattcttttctgcccaccggcctcaaaagatgcaaggctctctccctgatctcttctctctctctggtgcatgatcgatcacatgagcggtcaaagaatgtgacattgactctccctcccccactttcctctctctctatataatctatctatcattcactgcaactacgtgttgtacgtagttagtttaataatcaaggttttgtcccctgttaaaattaatagatgagagagagggggatggatgaagagaggtttcctgtctaggtatcacgtcacatgctaccaatgctgcctttgacaattatctttagagaaccaaagcatttggtttctgcaccaaaaacagacactcacggggctagccggccgataagttacttgacttaaaacaagttaattggtagaaaatccaggataaattaataggtatcaaacaatgctagaaaaatgattttagtagacgatatgccctctactttgtaggtgagtcactttttcttttgcacca

SEQ ID NO: 10750 - DNA, 12350 bp, Oryza sativa
caaatattgtattatcctaggcggatgtcttaaagctacacctgtgaagttatattttcgtagacggcaccttatgctgtctgctctatataattcacacaaagttggtctctccaataacaagcaaaatatagggggaggttttgaactcaaaattttcggtggatttttcttcagtggttagatccatacatttcctctcttatgattttcttttatttttgtaggtattaattgtgatggatctatgcatgaaaaatagtgaaagcaccatgtgcaattttttttcttttatgcttttctatgctatgattgtgatggatctatgtatacaccttgatgccatgttgttctatcattcccttgtggttaaatgtgatgctttcattattaaaattatatgtataatattgcccacttcccaatcacctagatctagataggagagagagagagaatatgtattttccccactcaccacatagtagaaaaactatatctatgttatatttatagatcaccatcccctaattatttatatttttcattcccatagtaagcaaagttaagtttgtttataaatatgtaattttttcagaaaatttagtttttttaatataattgtaaacacaatatttttagagatatggacagaaaatggccatgaaatataattgatacatggatttttgaagggctacatgaaatggatccatcatggcgagcgacaagtggatcctgatgacaaagaagatcggctggatgtcaatcacacatggaggatgctgatggtgatagttgtggtgataatatcattgagttagaggaaatgctacattgtgtagaacctgaggtgctaatggggtcagctaggggtttagacaattttgaagctttacagaaggcaacgaaggatcttgtgtacgatgagccaaagagttgtgacagggagttctcaacattatgatcagtgcttgaacttataaggttgaaggccatatatggttggtctgatagtagtttcaataacttactacattgaaaatgatgctaccaaagcctaactcattaccttccaacacatgtcaagcgaaaaaattcatctatcccttttctcttggtctagaaaagattcatgcgtgtgtgaatcactacatcctatacatgaaagagtacacttcgttggataaatgcccattatgcagtgctagccggtagaaatcaactaacaacactaccctagatgttgattttttttaataaaagaagaggctgactcattcgaggaaaacaaggaaaaaccccctagctggtgatgtggtacctttctatgaaagatcacattaagcgtttgtactcaaacacccgagatgcagaactaatgagttggtattaagaagggcacaagaaagataggatgctccgacacccaatggatgctcgtcattggaaaaacataggtgcactgaacctataatttgctaaaaacccacgaaatattagatttgcactgagtattgatggagtgaacccttaaagagacatgagcagctcacatagcactttgccagttcttctgaccatatacatcttcatacctgctttgttataagtgaaagtacgttctactatgtgtcctaatacaaggcccccggtagcctggtattgatattgatgtattttttgaaccattgatggaagatatagaacatcaggtgatttgtctccatgaaagtttatttgatatccggttataattcacacgaatggcatgtcatgctcatcgtgtttctcgctattcctataacactactacaaaatatcaaataggtgtcaccactataggtgccagaagtgctaaaaccggcacctataagccttttcccacctccacgggttgaaattgcaaaaaaccggcacctttaagcagttataggtgtcggttctaaataaaaaccggcacctattctatatgtgtcggtttttaataaaaaccagcacctacgaattgagccgagccagtgggagccaaggcggtgggccccaccacgacgcggggaggagataagtccgctgctgagtcgcgcgaggagataaggctcgctcggctctcgttctgtctgctctctcttgttctttctcgtctcctctcgatctttctcgttctctcgccagtcgccactctatctctttcgccggcccggcggagcaacggaggcaacggccctgtggcgcgccctcccctccgccagatctggccggaggggaggcagtggcgagtgggggcggcgtcagcgggcggtggcggggagcggggccatggggaggcggaggttgcgtcggaggcggaggcggaggcggccgcgccctcccctctgccagatccggccggaggggaactctggtgtgggggaaaagagagcaagactgagtactacccactgtattcagcaaatcatgccagaagaggaggtatgatgcaggatatatccaagggaggctaaaggttcttttgcataaagctagcatttaaaagcaatagttgaaagcagtaaaacagcggtagtaattaatccatattaaccaatcactgctcaacgcttcaccacgttgagacaggcccaaaccaccacctgaactaaccagttccattagctaactaggggtgagactaatcacggtgaatctggtcgaccgcccataaccgcgggtacggctattcgaatagttttactctgatcagaggtgtacaactgtacccacaagacacagccccacaacacatttccgtgcgccgacatgccaccacgacataccggaaagaggccgtgacaggacccttcgcataaccccctctaaccgatcgcaccacacctcagggttcacccccgtccccagcaggcaacgggcagcccccctctcgtgccgcagtgaatccggaagccgatcaaccgaacaccccggccgacccaactccatcacgcctaccctcacctgggtacgtcggctagaggaaagctacactacaagcccagccgttgcccacactggcttgtggtaagcacgataaattcttccagggtttcccgcgaatcggtccttaatcgccatgggcacaactagcaaaactatgcacccacagcccaccatgtagtgtattttaattaactaacaccattacggtggctctattccaaagctatgccagtaatcaaagtctatgccttaaggtaattccccctctgtgtactagctgaactaagcatggctaagcattccctaaaccaacatctaatcattttaatacccaagttatcaatggcataaggtaaacaagatatggctgagtagtaggacccatcccacatgatattgtaaaacaatgcaacatttaatagaaatgtgggacatttgtaaattgggtacaatatgatcaatcgtaatgcatgacttgccttgctctcgcactaatgagaccacagcaacgtcttcgagaaaccgcggatcgacgaaacggccaaaatctacgcgacaaacaaagcacacaagcaaaacatgctgtaagtctactgaaacagagaacaaaactatttttaatggattctatgcatttttatgaatttactgagacttgaatggacttaaacagagctcggatgaattagatatgaattttagaagattaaatgtgtttttactataaaagaaaatgccttaatggattttattgcgcaataaaggtccctgctgacatcatcaaggggggttggcgccgacagatgggccccacttgtcatagactcaagggcgccggtctactgtggaccgagtccacgggaccgcggagaggagcaccacgtggcgcacacgtggtgccgacgtggcggccacgtggacggccacgcgggcggcagccgaacggccccgatctaccgagcggtagatcagacggctgtagcggctcgcggctgggcagtgcacgggtggctcaagccggcccgggcatggcgtgcggcggcacggcacggacaccggcggctcgcggcggcgcaagacggtgagcggcgaggagtggcggtatgcggcgacgcggcggcgcgacaaagagagagagagggagaggaagggagggagaccgatcctcaccgaggggctcggccggcgcgggggaggagcgacggtgaacggcgacgacgagcgacgggagaacgatggcgacgggcggacgagctccgggaccacctagggaacaaaatgggagggattagagggagaagggtggtccacggcgagcggatttgccagccgaagatggcggcaatggtggtgctcaccggagcgcgaggagaacggagctacggcgacgatttgtgtcaaccgagtgttggacggggtagccctcgcaacggcgaagctagtggcggtggttgcgcggcgtggcgacgacactagcagtggcggcaggcggccggagagtggcggcgacggcggcgctaggggagagcggcgcggcggtgatagagggctcaagagagtgcggcgacgaaaggaaaaagagagagggaggtgcggcggtgcttaaataggagtgagggaggcgagtcgtggccgggagggggccctattgcgccggcgaaatggggaaggtggaggagaagagagagtggggttggggatttcaaatcccccgccatttgcgggcgtgcgggcttgcggaaggcgtgggaaaggtgggcggcgctgtgggtgcggagcacgggcggagtggggcacggaaaggcgggaaggccacggcgtggtcggcggttgcctgcttggcccggccgcgtgggcggctgggggtggaagaaggggctgacaggtgggccccacctgtcggtgaccttgagaggggaggaaggcggctcggactgggccatggccacgggccggcccaagaagaaggggggggggggcgcgcgcgcgggaggagagttgggccgacggcccaacaaaggaaaaaggaagaaaaagagagaaaaggaaaaggggaattttccagggatccaaatatttggttaaaattatttctaaggctctgaaaattccactaaaaaatcctgttagcatattttgacatgtagaatctaagaaaaattccacatgtcgattccgattattatttgcatttattaattaaggaattagctctaggttaaattaaactaatttcttcggacgatttatttaacaaattttaaagcaaggaggggaacttcagagcgtgacatgctgtatctttttattgttaaccaaatacttgttgacacattgttcccatattttttttaaagtttaaaatgtcacgtagatgtcatgtcagttgaaactaccgttcaaaccattttaaaatcttatcttcattgatttttaggagttgagggcggttcaggatgaatttcaacgataaattgagggaagcgagtacgcagcaacggcctcgcccaaggcctctgagcggcttggactgggctgtgtctaggccggcccggcacgaacagcccaaatgtgccattccgccgtgctcggcccgcacccctcactccgagtctctgacaagatagctcgatgggccttgggacagcccgttttgtcaagatgcacgatgggccttggtacggcacgaagtacagatcaatgcaaaggggaaaaagtacaccgaaggtccctcaacttgtcatcgagttacaaaatcgtcccctaaccgcaaaaccacatgccggacgtccctcaactaacaaaaccgttcactttaatcctccagtggttttggccctagttttatcttacgtgacggctgagtcagcgtgggacccacgtgggctccacatgtcagcattgccacatcagtcttctctctcttttcctctcttctctcccatcctcatctctctccgttctctccgattgcgacaggcgacacggcgcgtcggtgaccggctgccggcgaccagccacgcggcgaaacggcggcgggggaaggggcggtgcgcgaccggccggtgaaggcgcggcgcgcgggcggtcgggggcggagcggcgacgcggcggcggggaaaggggcggtcggtgtactttttccatgcaaaggaatcgccatttcatttgcttcacgttgcatacgcatcagaaatttcttctaacttcaaagtaagaaatagcgtgacattcttcatctagctaatgacgatttcgcgagattgtactgaactactgatcgcctgatctggaggctggagcttaacttccaatactaaaaggctatgttcagaacaattatctactcctacagtcctacgtgacagcttgctaacggtatgtgacaccggcaaaaatgctcatgtacttctggttggatgagatattgtaagaaattcttatatttgaatgagaaaggtaatcgatctataatctcttctacaccccatggaaacctttgctgttggatgcatgcatgctcaatgcgtctttcctttcttgctgccatgtaatgtacagtgatgccgtgttaatcataccacacatttctgactttaaacattaaatagttaatgttcaaacatttcatacgattgatttaaaatatcgtctaccattcacttatacaaataacgtaccaagtcttgtattaccgccacttacactgaacaaagataaaattcctcgaatttagattcgcatacctcctttatgccactcaattctttcactacctcattcattctcattctctgacttgcagagtccctgcaacacgctaaaccaattcttgaaataggagcaataaaccaatctacaatatcttgagaatttccgtcctgtggtattgcgttgtccataatttccaacaaattatcaggataggccatctcaacatactttggaagactcatatcatcatgaaacattgtgtcagttggtcttctaccagtaagcatttccagcagtagaacaccgtagctgtatatgtcaccttctctagaaatttctgtccccatgccatattcttcagaccaaaaaaaaaaaaaagggagaggattaaatcagttttgtaatggaccgaatgctacaaatcaattattggtgcactttcagactaaacgaaagataactatctatgaactgagtttaccagttcagaactgtagaggtaaaaatacctaaaataactggtgcaaacaaaacggagcaggaacagaaattaagacagtagaattcgaattacatcctgtagttacatacctggtgctaagtacccaatagtgcctttaattccaactgagctactctcacccaagcattggccttctgcttctgcactcattattcttgctaaactgaagtcaccaatatgtgcagtcatatccttatcaagaagaacattacttggtttaatatcgcagtgagcaatggaaggactaatgtgatggtgaagatactccagtgcctctgcaacatcaagagcaatgtttaatctttgcatcaagcttagcttcccaggtatgtaggaagtattttctgtgcttggatgtagccatgtgtcaaggtttccattggagataaactctaatacaagtgccttaaattcatcaccattgttgtccaagctatcacaaacagtgataatcctgactaggttccgatgtcgaatccgttttagggcattgcactcggacatgaagctcctggctgctctggtctgatggagatcaagaaccttcactgctacagtgattacatttgaaccacaagttaagtttcctctatatacactaccaaagcttccacggccgatcaaattttccgcagagaatgaacccgttgcgacatttaactcattatacgatatcctctgatacatctcatcgataaatttgctaccttgatcttgattaactttggatgacttttcccttagcctcttgatgcagtagcatgtagcaatgcaaacaataacaaagacgaatgctcccacaatcagaaagatcaagatatgcaccaccgaacgatgcgcaggcttatcggaagattgaaatgggcatggcgggaaatgaaagaacatagggcctccacatagcatatcattacttacaagtgatacagcacttgcattagagaatatccccttatctggcaccataccagataggttattgaatgaaaggttcagattcttcagaagctggaagctctcaaggaattcagggatgggtcctgaaaatttgttgttagagagatccaacacttctaagcccctaagtttattgagctcttttgggattagtccgtggaggagatttgcttgcaagtataaaaattgcaatgcaaggcaattaccaagggtgcttgggatctgaccagacaatttatttgatgagagatcaattatgccaacattgaccaagttcccaatatacggagaaatggggccacttaatgcattgttcgagagattaagtgcttcagtcagggaagaaattctgataatctcttctgggatttgcccactcaaaagattacttgaaaggtccatagaagttaacttgcttaggttgccaatagttgctggaattctaccctcaagatagttaccagacagaagaagctgatttagttgtgtcatgttgcctatggatgatggaatctctccctggaatccatttgaaaacagaagcaactcatggagattagtgagctttccaatatctgaaggtatagtgccattgaaaaggttatctgcaaactcaaggcttgtgagtttggcatacctccctattcctttaggtaaaatcccagaaatttgatttcctcccaatctaatgctctggagctctagtgagagattagcaattgtatttggcaaaatgcctgacaggttattcagttgaagattgatgtagattagattgctgcagttagccaaggatgttaaaaattcccaatccctcggctctgtagcttgaagctcattgttacccacttcaaatactgttaattggccattgataccactatttggtggaattcggcctcggaatctatttctgtggaggatgaatttttcaaggacagagatgtttgaaaaggaggctggaatttgtccttcaagtctattgtagaaggcaataaaataccttagattgggaagtgtaaggccaatatctgtaggcagagaacctgatatgatgttggacccaagattaaacaccttaagggaggacaaattaaacaatgatgcaggaatctcaccttctaatccgtttccagatatagtcaaagcttcaaggtttgtaagctgagatatagcctcaggaacactgcccctcatcatattacccgcaatgttaaaactttctagcgcggtcaaattgcccagccatgatgggatttgtccatgaacatagttatcagcaatactgaacatggtgagggcagtaagatttgcaaatgtagatggtacataacccgagatattgttatggcgaatattcagaacctcaagctttgacagctgaccaatggatggagggatcacaccagacaagaaattgacactcaagttgagcctctgcagtgccaagcatcttgcaaggctaggagggatctcaccttcaagcttgttgtctgacagatcgagctctcggagtccggtgaggttgccaacaagaggtgagatggtgccaacgaggccaagaccctgcacgcgcaaagagacgacacgacgatggcgcgcaccactggagcacgtcacgcctctccatgagcagaagccattggtgccatcagaggtgccattgctgacaacactccaggaagacagtgcatccgaatgatcctttgctatgtgggatctgaatgataggagagcgtggaggtcatcaccggcgtcgatggagcgggaagccggggcgagaaagaggaagatgacagtggagggaagagcaagcagctggaggagcaaacgtgtgatcgccatggatgtgatgggcaaagagaactaaaaaaggacgtggagattttgttgtggtggaggccatgcagtcttgaacgatcagttacttctagtttaacttttgcaatggaattttcatctcatcgatgactagtcagtggtcagcaattgctgctagtaccctctatatgcaacgccacgttgcaaactacttcctataatatactgatagcatagaaagatcgttgctgtgcatccatttttctttgacatctctgcaatgcaaccaacacatggatacctggtagcgtaaagaagtcgctgctgtgctgacaacctcgagaaacatctgagaataaaaaatattatcccaatctgatgcccatgctgaccaaatgtcacaaatttcttcccctgtttataccgggttgactctgcatctgagaagccttcctccatattcccattatcccaccaagaagcaaattagtatcagtaagtaggtgggtaaaaggcattgatgaaataaatttttttatttgcgaaccaagagcagataagaaagtagaagataatttatttttgggacaaagtttgaatttcagaaaatgatttattttgggatagagggagtacgcatcaaggacccaatagcatctctagccgatgctccatctgatcctccatctaagaaatagcggacggaagtaaaaaaataacctcgggtggatacgccatcggctacgcaaaaaatagcgcattcactaaataggtgaaaggaatgccaaatgacaagcaccttccagcaaaaatataataaaatataggatgatataatatggacgatataaaatagatgatttattggagtgaaaagaagtacagaagagaatattttttagacgaccatccaaatgggaatatggaggatgaaatttggatgagctcatgggatgctctaaggtcccagatatttgtactgagaaagtgaggattaaggccaagtttggatagtttatcataaattactaaaacccttctactctgaatcgattccgtgtgggaagagataagtagtagttttccattttacaagattgcatttcaaaattcaaaatattttgctcccagaaatttaagggaaagagctcaggctgaaatttgtttgaattttaaagggttcaaacctaattgtataaattcaggaaaaaactatattaattcaagataaacaatctagtttttgaataaattaaaacatctctaaactttatttttgtgcacatttaacacttttcgcaacaaaccgattaaagtgtggttttggttcgatttgatgcagcatgtatactcgaagtatagaaaaaaaatcatacactctaccttgagaaaaaaaacacactagggcggacagcttctccgcttctatgtcgtcgtccggcaatttatcggtgctgagaaaatctgtaagtggtgaacaccaatcttgcgcaatttcaatgtccgccacgatactgtttgacttgcactgtagcccccgaggcccgagcctacatcggtgatgttgtcagtgttgtgttttggagtacccttgacggaaggtttgattaatccttcaaagaacgtgaccagttccaccggttcttgtctggaagtgcgtcgggcaaggttgttggcatcaacattgtgcttgcgatggacatggcgcacttcgaaaccgtcaaacctttgctccaactttctgacttctacaaggtatttggatgactcggggttgaaacatatgtagtccttatgcacatggttgccaactaattctgaatcccctttcagaatgagtcgtttgctgccaagtgatacgactactcttaacccgacaagtagtccttcgtactcggtagtgttgtttgtggcccgaaaatcaagttatattgcatgtcaaaactgatctccttttagagatgtaaggataaatccaacgcctgctccttggatgctgaatgctccattgaaggccattgttgatcgctcgttgttcgtatgcccaactttgccgtcctcggcaacagtccagttggcaacgaaatcggagagtacttgagacttgatggttgttcgtggtatgaagtggacatcaaattgcccaagcttggtgacccatttaggatgtgtcctgcgacctgaaagaaatggcacacctttcgggatgtcatgaccatggcatagagcagcttatgatcgtagataatccgtaaacatatggaataccgttgtaggacgacggcgcgacgacgacggacgagctcgaaggtgaccccgacaggtggggtccacctgtcggtggctggggaggggaggg

SEQ ID NO: 10751 - DNA, 25469 bp, Oryza sativa
ccctcaagaatcggagcaaatggttgagtatcttgcccgaatcgaactcgttttcgagtttatctctaaaaccgagtttttgattttccgagtcgatttcttgcgggaggagtccgatctcttcaatccaaggctttaaataggaccccctagtcctcccctttcgtttgccccctctcccgtcctctcccgtgacccgtagagccgtcgccgcgtgaaaccatccgccgccgccgccggccgaactccggttgcgccgccacgccgcctccgccgtcgccgtcgcttgccgtcgccgccattggttttgccaagaggtggagaagctcggccgccacctctccttcgccgccggccgccgtagcccgtccccaccggccaacccgagccgccgccgtcgtctcctcgtcgccggccgtcgtcggtcgtcgtttggcacgagggtgagtatcgttgggttcgtctcgtcgtcctctacgtgtagatgtcctccaaaatcccggccgaccaccctagctccggcgaggtcgccatccgagccggccgcctttgatgacgtcatcatgacatcatcggtttttctttttcccgtttttctaatagattaaatcttctgaaaatcataactaaataaccgtagatccgtttcaggtggttcaagttgctaaatttttctaaaatcaagatctacatgttaaaaatatccacatgtactgtttatgcttgtttttgtactgttttgttaatttttgtttaattgctttagtttccgacgttccggaggagagcgtttccgttgaggaaggttctgaagcgtttgcggaagcccaaggcaagtcacacagatcccaaacaaccctttgagcatgttgaacccgtttaaagctattattttatttcaactatgcattatttttgaatgtcatcgggtggtgaacctttccccgttaattaatggccgaagatgatcttattttcctatgggttataatttgattagcatgaaccttatatattggattggttcagctaaatgctatatgtaagtttgcttagctatgcttagaaacattagctaactaaaggggttaattataaactatattatattatattattattatggttatatttaatggtcgctcacgatggttaatcgtgtgatgttaattaattgataattaaaatctagttaaggtgggttgtgagcatatggttttgatggttgtgctcatgacaattaaggaccggttcgcgagctactgttgtgaaacatttaccgtgccaaccacaagccagcatgggcaacggctttaccttttgtatagcagggttcattatagtgtgccagactgtgaagcggcgagaagtccgtgggggtcgctggggagtccatgccttgtttataagggggtgactatgatccgggaacggtgcactgttttgagttgtgttgtgcaaagagtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttaattcctggtttggaggtttgatctgtacgaccggggttggttgttcaggtttggttgggcctgagcagcatgggtgtgctgttcagtgttgattaaaattgatgattaattactctactgttttacttatcttaaatctttgctaaatgctgcttttgcaaatgagcctatattatgccatcctttggaatccttgtgcacttgcatatttgctgtgtggcttgttgagtatgtcatatgctcattcttgcaataatcatcacacctcagttgaagataaaggatccagaaggagaagacgtttggcttataccccagttgagctgcctgtgggagtggagctgaagccatcgctagaccgttaattccgctgctgtttttcttttcttttgtaagtatgtaacgttattattatgatggatttgtatattaaattgtcagtttgtgtacctcggctgattcctggacgaggattttatgcacaaataagttcggaaattactagtgaatttccgggcgtgacaactaaggacttgtgtttcctggctctaggctggggattaggaatgtccacccgagaattaacagaagctgaaaaggggagagccctagccactgtctaaccatacctggtgactttctgagcaaaagattatctaacctacactctctgctttctaactgcaatgagatcctgttgctactcgacaaattggtagagcaaagacctcttgccttgtaggaatggaacttcagactgattttaaaggagcacattctaagcctgttcaaatacaaaaatgaattctggaaaaaagtttgtacgattagatgggcaaatttggagatgagaacaccaaattttttcaggcctctactccagacagtcacagaaggaataaaatctcacatttaaaacttgaggataaaagacagaaagaggggtgtcctcccatgaggaaaaggctcatgctttatacacaacttataaaaatagaatggggattgatggtcactcagacatggttctcactctagcaaacctatttcaaccagtagatatcttacattttcaaagttcaatgccatcaaaagaggaaatggacaatatcataaaaaatatgcccacagatagaggccctgggccgcatggttttaatgggatgtttcttactaaatgttggcccatcatctgtaatgacttctatgagattgcttctcaattcttcaccaagatcatggccaatagaattcaatcaattatacatgagctcatccatgaaaatcgcttcatcagaaacagaactatacaagactgtcttgtttggagctttgaatatgttcatcagtgccacctaagcaaaaatgaattagccattctaaaagttgacttttaaaaagcttttgatctagtagaacatgaggcaatccttcagattcttcaggccaatggttttgatcaagcttggatcgcctagactaaaaatgtcctgtcatctgcaaccacttttgtgttgttaaatggagttctaggtaaagatttcaaatgcaagagaggcgttcggcaaggtgatcctttatcaccacttcttttgttctagcagcggatcttctccaatctattatcaacaggccttatgagatggggctattatcatttccaatccctcaagacagagggaagtttccaattattcaatatgtagatgacacccttcttatcatgaaggctgattagagagagttattttgccacagaactctgatgaacacctataccctgtgcactgggttgaaaattaattatcacaaatcttgcatgattcccattagtactaatgtagaaaatgatacaagttctggttggtacatttggttgcatggtgggaactatgccttttacctacttaggtttgccaatgggaaccactgaacctaaaatcattaatttttgcccctttgattgaatgagttgaaagaagattgctctccatcacaactttcctaaatcatggacaaaggttaacaatggtcaactttgtgttatcttctctacccacatattacatgtctgctcttaaactaccgaaaaaggtcacacaacacattaattgtgcaagaggggggggggggggggcttggagtcatcaatctgtaattgcctgggacctagtttgtaaaccaaacaaagggtggggggcttggagttatcaatttgtaattccaaaacattccttgcttctcaaacacttaagttttttttaacaagaaggaccttcctttggtacatttaatttggaacaaatattattagcactctgatctccctccacatgcacacagagaaaaaaaggttcattccggtggagagatattttcaagctaattcccttgttcagagcattcactaaagtgacaattggcataggggactctactatgttgtggaaagataattggaatgacaatctcttggaattagaatatccaatagttttctccaatacaaggttagaagatatttctgtccaagcctttttgtcccttactgaatttgaatagtacttccacacacccttatctgttcaagctatgcaacaattgaaagcccttcagaatgtgttactcaccataggtacaaccagtgaacatgacaaatggatatatcactggaattcagaacaataccagtcaaataggttatatgaaatgttttttgagcactttcaagtggatatcccaatctccatgatatggaaaagcaaatgcacaatgaagttaaaagtatttctctagctactgccgatggatagactcaatacaaaagatacgcttcaaagaaaaaatttcaacacataaggaggaaccagatgtgttatgtgtaattaagtagtatctgaagacatgcttcatctcttctaagacatgcttcatctcttctattcgtgcacttttgcacaacaatactggcagtacattggaatacagtggaatgtgagaatggtgttcataaatatgataaccacagccaacaacctttttggacaaccttttttcattgaagttctagcgttgggatgttggaccatttggagtagaagaaacaatctcatcttgaagagggattttggaaagtggaaggatgatttcaagagggattttgttctgtatatgcacagggcgaaagaaattgacaaacccaagtggtaatcatggattaacaactttgtatagccttttctttgtatttttcctctgctttgtaattatctgtaaatattctctatttatatgaatatgatttaatatagatatagtgcagttggagcctctccttctgtttcttattaaaaaaaggtgactttgctagatcttgaagttatgcgatataaaggtgtctgtatataactctctctgcaaacatagaggataattttcatttacccctttctcattaagcttttcaagagctgaactctttgtcaactttgaatgatgtgaccctgtctcaagagaatgatatctgggctatttggggaattctgaagtattcctcttagaaattttatgctctcaattttagagctttacagccaccatcacattttctttggttatggaagagtaaagcaacttcaaaagttaaagtcttggggtggttgttactgatgaacagattgaatacaaagtaaatgttggaccatagatattgtgctccacctgattgtgacttaagttgtgtgctttgttcagttaactctatggaggatctgtttcatctcttctttcaatgctcttttgcacagagttgttggaatgctcttggtttttcttgggatacttcactgagcatggatagtatgatgattcaggcaaaatctctctatcagggacaatgctttatggaaaattttttgtatggtgcatggaatatctagaagcagaggaaaggcttcatttttgaaaaaaaaaactccttcctgtctttctggagacaactcttaaagggtgacctcctccttttgttgtttagaataagtgatagagataaggatgtaatcttaaattggattagtttgttgtaatttttctctttcttcctttcattaataaagttctttaacagcgggggcctcccctgatgtgtttcttttaaaaaaatgctagtagttaaattgtgtacgtatatatactaacttggcgcctcacttgcagtaaaaaaaattaccaacattccgccacataacttcgaagaaattagagaggaactagctgccttcatacttgtggaaatcgtatctccaaaaggaagctttagattaaagtagctcgtccaaaattcgttgaacatttttcagtgcttgcaaaaaaaatgtgactatgcaatatttatgtatatattatatgcaataaaatctctgatgtaaatgtatacatttgcaatatgctaattacacactttgtttccaaatataactcggttttgcaggttttattgcttaactcttgaagatgcatatcggtgatttggtgattgtgaatatggatggatgtgtgaatggggtctctaggaatgagaacgtatgtgtgtgtgtgtgtgtatatatatatatatatatatatatatatatatatatatatatatatatatgtatgtatatatatatatatgtatgtatgtatgtatgtatgtatgtatgtatgtatgtatgtatgtatgtatgtttctgttattttgcagcgggcatggctagcaaaggcctgaggctgtaaataatatttttttttgtgtaaattactcatcggtgatgggtaagaaaaaatcaccgatgccgatgcgtatcaaagacgtcgggtctaacatagaggctgccactgataagtcatttgtgacggtctccaaaacataccgacaaaggtgagctagtcatctttgttggtttatattaggggccggtcacggatgattcatcggtgatagggtctagtttgactcctctgttggatcaaacctattggtgacggggtttaatattttcctgacaaagataaaagtcatcggtgatggcaaccggcccaacaaagatgacttttcacatcactaaccattagttcatgacggagcatctcgccaacacagatgacggtttctgtctgacatggatgacctgctccaattgtattttcttcaaaaacttaatatatgtgaaacaaactataataactttctttgtggatggagggagtatacgcttctgatgaatcaaactcattttacatatattatgcatttgcaccgtactttaatatacgaggactaaaattgtctttagtttcgagcactaaaacatatacaaattatacatttgtttatattatttgggcggcacacacaacatatatagcaaagtgaagaaattacatcaaagcatcgagcattcactttatgcatctgaaacatatatgctcatgaacattatttattttgtaggggctaaaagtaactgaaccaagtacatcagtcctttgggaaaagttggatatgaaaaccttcgagaaatcgtaggccgggagaaagcaccattcttcctcctttgatcgctttccaactgacaagtgtagacagaaggtcatttttttttttgcagggtacttcagcatccatgtatatatagagaataacttatcttcttaagtatactcattacatgcagaacaaaatgtgtgagaaatcagtgtatacatgttttaatacagatgaaaataatctcgaagctcctagatggattctgaactaggtatacctttgcaacagtaggcttcaatacacttaagtagggtgtgtttagttcacaccaaaattagaaatttggttgaaattggaatgatgtgacggaaaagttggaagtttatgtgtagaaaagttttgatgtgatagaaaagttagaagtttaaagaaaaagttgggaactaaaccaggcctagatagaaacaaatgggagtgcagatttaagcagtggacgaagactgccatctgcagcttggcaaaatgtgcaccaacacacaaacgcagtccccctccaaagggcatgaaatccttggaggcaccaccagcaggttcagcaatatcctgtacagagcaacatggatgcaacaaatcagaactttggagacacaattctacatagctctcgcacttcagaattgctcaatagtggcttttagtaggacctagaagaaacgtaccctatacacaaggctaggtgtgcacacaccttacaccactaacatattttataaaaaaatgaaaaaattgtacatgttatttttagtagtattaaattaataatgtgtcccatctttgaaatttatcatacacagggggcaataaataaaaagacaaaattctaacagatatatacccttaaaactgttatagcttttaactttttgttagggctaaaatacaacgaatttaagattatgactttacacataggtgtaatacaactgaaagtatatgtacatattttctatatttttttggtaatatttattagtcatatgtatggtatgtgcacgtgaagcttatgtgcaaaatatgttcacaaaccttccatctcaagggattgaatgtattgggtcctcatagaccacggggtttaggtgaacagtagaaggacaaatcataatttttgattcttttggaatagcaaaacctgcacaaattatacaaatatatttaagaagaaacattgtaaaatattcttttacaaattttctactattccctatatgtccatattataatatgatattcggattttttcctagctaagtcaaatttcttcaagttaaccaacttcataaaaaaatgtggcagcatttccaagacaaaacaaatatattataaatatattttcagtgctttatttaataaataaatccaatgtgttatgtttttcaataaacctgtcaaacttcttataatataatgtggaacagacaggatatatacatcttttacatcgcgttgtactacatgtgaaaagcaacggctacaacaaaaataccttgtagagacatttctctaatactataaagatgttctagtgaattatctctatataaatgaagaggcactttacaaaatgtttgtatgctcttggacacttttacagaggcattttttttttgtctataagagagtataggcattttcggaaggcattaactctgccacaaccatagtaaaccaatgtaaaaatttaaaaaaaaatataacttcccttgcaattgtccatccttgaactctagacctcttgaatatttcattttctacttgaatgttttaaccatatcaacctcatgttattacttgtacatatgtgcttcgtgtttcttttattgagttaattagctgagattaaaattccagtaagtgccccaatggagattgaaatgtcttaaaaaaatgcctttatatatcaagcaaattttaaagtgcggtaaaagtgcctctacaaggtaaatttaacaaattgtgctaaaagtgtctctagattaaaagtttttaggcaatatttaacgtgcctctaacactgtctctacactttataactcttgattttaaagccattttaaaaattacctctacaagaatgcaactacatgagatttttgttgtagcgtgtttttaccttttatatgaacatcctctatggcttctctaaacatcatcggagtaatgctagcaagcctcaaagcttcgtgtataacctacaaataattaagtagatgagtgagcgtatatattgtgagaggatttgacattaaccatatacatatacatgtgtaaattgttaattttttatatgtagaaagttaaagaaattgaaggaatatacgtgagatgtaaatttcatagacttgtattcctcccatgtgatttcggagttcagatcggcccttcttctccgtatgttattgtgctcctcctaaaaagaccagatatcatttacagcaaaatgtatcctggattatttggaaatatatagcatttccacagtaacttttacggggaagtatgcattcatataaaaaaaaaatcaaactttacattgctagtatagttcttatgtacgttgctgttctaattaaataggttttatgtattagttgtcacatatatgagggcgcaatcctaagcatgtagtagtgaagaaatttaaacattcctattattgtattacttgtatgaatttgtgaaaggaattcatatgacttgtactagcacttactgtcagttctcgcaaggcctcaggattatctgtcaaaaatttgagcatcccagttattccggatgatgtggtgtcgaagctgccaaacagaagcgaaaagagcaagttcaatgctgtattctcggtcattgaaggattatcctccttaacttcctctatcaggacatcaaggaagtcaatgctttcatggcgtccttctatcttcttcctctcattgagtatttctttcaacatcttcatgacattctttcgcccctgcatgataaatccagtccatgatgaacggggccatttttatttattttaatttacatgatgacggttagttataataaaaaagtagtaatacaatgttgctgactactgaatcacaaacttgttatatatataggttaatttctttgtatcaaactacataactaattattttaaaaaaacattgtaaagtacatccatgacagattataatgacgcctggaggtattcatcataaaaatctttcacggtgaaaaatatgtcaatcacaaacattagggatttttttcattataagatgcagctatcacactatgacaaagtatttcatcatagaacttggtaggcagggtaattatagaaccacagtaaattggtcccgtttgtaagtatcagtttgcattaaaaggttcatcctaaacgaggcataattcatcataaagagtcaggttggcatacagtaatgaagtattttcgtcatggtactaacaatagttgccaggaggtcataatataagtgtgagaaaatgtaaaggagatagtttatcctgtgcaaacatgtattgtgtgcattgttgaacgattgttttccaaatcagtgtgcgtacgtttggtagagctccaactcctaaatttaactccaagatcggagttgggtctggagtgcagttgtggagctgcccaaacccagctccacctctctagtttattttgtgagagagctccacccagctccactcacatttttggtggagctgaaattgtttgacggggctttagctctagaaaagatggagctggagttgaagctgtgtcaaacagacccgtatatcttgattttggacagtccacatgcaatactcggactggtgaccgcatcctatattgtggtgtagccatgttatgtcaacacgtatcaacaaactgtctatctccctatcctggtcaatggtggaagtcgatgagaatgcaggaggctacattgatcacgattggttgtctgaaatcatgttgcaagaaaaggcggcagatcattggaataggccgcatgatgggcctccacattatggatatcccatatctacacggcgatggtatttggactgaatacaggataccaaatatagatagaatatcttatttgtgtctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcacatgttgattttctccaaatcatacaattaagaagacactcggcggattcatccccggacaggagtagggtattacttcttgaataagaaggcctgaacctgtataaatcttttgtctccaaacccatacacttttccagcttgatagccaccccttttattattgccgaaatctagtttcgacagttggcgcgccaggtaggggttgcgtcaagcttttcgctgatcagtgcaatgggttccgtctccggcatcgacgacctcgtcttcccacccgggcagacgtttcggttcggcagcctcgacttcgtcaccaacaacttcggcaagatctctctccttgactcggagtcagaccagtcgggagagaaccggatctcagtcccgtttggactcccaaacgcggctgaaagttacttcaagaccatctcaatcgagttggcttcaaaccactcgggtgagatcgcatcttctccaacgtcaccaggtcaagatgatggggcttacccaccgatcctgatgaagctccccgacgatttggcggccgtctccatcacgacagcgtctccatcccgtaggcctaggcggaagtcggcttcaacaccgatttcgcctagcttcagggaagtcggcgtcatcctccaaccactcggcatggtttcgacggatcagctggatggctactacagctctcccaccgtcgactcgcgccccaccgacatcgtggagtacgacgagtttagctctcgctacaacgacccggatctcgacgacttcgacgggagcctagatgacaactacacccctctctacttcggcgtcttcatggccgataacgagacggaggagcaacgccaagcccgggagaccgaagcacgtcgcgagactgagcgtcgccgactggaggaggagcgtcaagcacaagaacaagaacggctacggcgtgagcagcaggagcgtgagcggaccgcgaaggaggctgaggatcgacggcagcgagctttggaagcagggcgccgagcgcgtgatctcatcggccaacaagatgttgaagggacaccggttttccgcacccctcaacagaatgtggttgccgcgatcaccctcctcgacaccctcctcaaggaaaacgagctcaatcaatctgatcacgtcatcaacatcttgaaccagacgaagaccatgattgcggcttcggtcccagttaactccgaaagcgtccacacgccgactggcagccgagtcccccacttccgatctcatgactaccgtcatccaagcctcagcatcaccggcgcaggatccaatcgcaggagcaggggtcacgacgagcggtccgttcactcacctcccgatcatcatagggagcgccgagtggaacggcctcgctcaccacctcgtcgccgccccgtcgatcttcgcgacacaatcatacagtgccgagcagctcgaggccatcatcattcaccggaccgccacgacgacgaccttgacggagtagcagccttcaccgacgacctgcgtcgagtggattggccagccggcttcaagccgactggaatagagaagtacgacggtaccactaacccagaatcgtggcttaccgtctacggtctcgcaatccgcgcagcaggaggagacagcaaggccatggcgaactatttaccagtggctttagcggattccgcccgatcttggctccatgggttgccccgtggtacaattgaatcttgggccgaattacgcgaccacttcatcgccaacttccaaggcaccttcgagcgtcccggcacacaatacgacctctacaacgttattcagaagtccggagaatcccttcgagattacatccggcgattttctgaacaacgtaacaagatctccgacatcaccgacgacgttatcatcgccgcattcaccaaagggattcgccacgaagaattggtcggcaagttcgggcgtaagcctcccaggacagtcaagcttatgtttgaaaaagccaacgagtacgccaaagctgaagacgccgtcaccgcatcaaagcagtcgggtcccagttggaagccaaacaagggtacgccggctacgggaggaggtggaagtaacaatcataaggaccgcaagcgtaagcctgaggaacttgttgcaaccgccactcactcttctcgacagcgttcgcgcgtcaacacgttcgacaagatcatgaactcccaatgcccacaccatcctaactccaaccatgtggccaaagattgtttcgtctacaagcagttcgcggagcaatacaccaagactacacggaagaactccgacgaagaacaaagcacgtcgaggaagaaggacgacggtgacaccccggcaggatttcaagaccaccgcaaggagctcaaccatatcttcggcggccccctggcttatgagtccaaaaggaagcagaagttgaccgaacgggagatcaatgctgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgatatgcagattcctcgctccgagctaaaaccaagcaatgcgccttttcacggagtaattccaggattgtccgcaactccactcggccagatcaccctcccggtcacttttggcactcgggaaaacttccgcacagagaatatcagctttgaagtcgccgatttcgagacagcataccatgccatactcggacgcccggcgttagccaagtttatggccgtcccgcactacacttacatgatgatgaagctgcctggtccccgaggagtcctatccctacggagcgacatcaagcaagccgtcacatgcgacaaggagagttgcgacatggcccaaacccgcgagatggcgtctgcccgagaggatatccgactggctgcagccacggcgagcgaaggagaagtgcccgctaccaagatttcaaaaagtggagaaagcgaagccaagactaaaaagattcccctagatccttctgattctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaagcctatcaaacaacgactccgccgattcgcacaagacaggaaagatgcgatcaaggaggaattaaccaagctgttagcggcaggcttcattaaagaagtccttcatcccgactggctggcaaacccggttctagttcggaagaaaacggggcaatggcgcatgtgtgttgattatacggacctcaacaaatgttgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccctttggagcatattgctacgtcaccatgccgttcggactaaaaaacgcaggagcaacttatcaacgtatgatccagagatgcttctcaacgcagatcggccgcaacgttgaagcctatgtggatgatgtagtcgtcaagaccaagcaaaaggatgatttgatctcggatctagaagaaaccttcgcaagcatccgcgctttcaggatgaaattaaaccctgaaaagtgcaccttcggagtaccgtcagggaagctgcttggttttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactgaagaaaacagatgatttccattggggacccgaagcacagaaggccttcgaagatttcaagaaactcctcaccgagccaccagtcttagcctcaccacacccgcaggagccgttgttgctgtatgtatcagccacctcccaggttgtgagcacagtcttggtcgttgagcgcgaggaagatggccatgtccagaaagtccagcgaccgatttactttgtcagcgaggtcctagccgactccaaaacgaggtaccctcaggttcagaagctgttatatggtattctaattactaccaggaagctatctcactactttcaaggtcacttggtaacggtggtcacatcatttccactcggtgatatactgcacaaccgcgaagcaaacggacgaattgctaagtgggctttggagttgatgtctttggacatatcattcaagccccgaatttcaatcaagtcccaagcgttagctgattttgtcgccgaatggaccgagtgccaggaggatacccctgcggagaaggtggagcactggaccatgcatttcgacggatcgaagcgactttcgggcactggagcaggagtggttttaatttccccaactggagaaagattaagctatgtgctttggatacatttttcggcgtcccacaacgtcgccgagtatgaggcgctccttcatggactgcggattgcaatttccctagggataaagcgtctaatagttcgaggcgattcacagctggtcgtcaaccaagttatgaaagagtggtcctgccttgacgacaacatgatggcatatcgacaagaggtacgcaaattggaagacaagttcgatggactcgagctcagtcacgttcttcggcacaataataaagccgccgacagacttgccaactttggatccaagcgcgaggtggcgccctccgatgtcttcgtcgaacacctttatgcgccgacagtacctcacaaagatactactcaagttgcgggcactcatgacgtagctatggttgaagccgactggcgagagcccctcatacgatttttgacttctcaagaactcccccaagacaaagatgaagccgagcggatttcaagacgaagcagactttatgttatgcatgaagctgagttgtacaagaaaagcccttcagggatcctgcaacgctgcgtatctttagaggaagggagacaattgctgaaagacatacattctgggatatgcggaaaccatgctgccgcacgcaccattgtcggcaaagcttaccggcagggtttcttttggcctactgcagtgtccgatgccgacaagattgtgcgcacgtgtgaaggttgccaatttttcgccagacaaattcatctaccagcccaagagttgcagaccatcccactgtcttggccgtttgcggtttgggggcttgacatggttggcccgtttaaaaaggcattcggcggttacacgcacctctttgtggccattgacaaattctccaagtggattgaggctaaaccggttgtcacaatcacagcagataacgctcgagacttcttcatcaacattgtgcatagatttggagtgcccaatcggatcatcactgataatggcagacaattcactggcggagtttttaaagacttttgtgaagactttggaattaagatttgctatgcatcagtggcgcatcccatgagcaatggacaggtggagcgagccaatggcatgatacttcaagggattaaagcgcgtgtttttgaccggctaaaaccttatgccggcaaatgggtggaacagctgccatcagtactttggtctttgcgtactacacccagtcgggccacaggccagtcaccttttttccttgtctatggggcagaagcaatgttgccgagtgaagtcgaattcgagtctttgcgctttcgtaatttccgcgaagaacgctacgaagaggaccgagtggatgatttgcaccgattggaagaagtccgcgaagcagctttgattcagtcggctcgatacttacaagggttgcgacgttatcataatcgcaatgttcgatcccgtgcctttctagtcggcgacctagttttaaggaaaattcaaactacacgagatcggcacaagttatctcctctatgggaagggccatttatcatctctgaagtcacccggccaggttcctatcgactcaagcgcgaagacggtacactcatcgacaattcttggaacatcgaacatcttcgtcgtttctacgcttaggcttatcattgtacttccctatcttgactgtcaacatcaagttttcttcttgaagttgtcagtcgggggctatcatcataataatggagtgtgattttttatcaattcaatttgcttacttggtctatcattgccttgcttgatttttctacttagtctgcgaggactgaaagtttttaatagcttctttgggttttaggctcaacagagcttgataaaagcttttaagaaatcaaagacttggctagaattatcaaacacagcataaatacaccagtattgtacaagttgagcctccatttgttacattcatactcagtcagaatcagttttttcatcatcagagttgttactactcggctgtaggtcggtattgcggaattgatctacaacgtcacttgcaattttgtcagccgcgttttgagcattgctgataagatcaagagcagcttcttcgcttgtcccgtctgcaaagccatcaatggcgtcaatttcaatccttgggtacaaggatttggtcatcgccaatgccatgctagctcccatacttccagctttcttgatattcttgaaatatacatccggagcaactctcagcttgtcgaagatttcggttgcgtcgagtgcactcggaccactgttattgaggaacatagcttggacgagtggtgtagcgacactagcgacttcatctcttgctccttcaagcctcttgatcttgccaaccaggacgtcaaattgagcttgagatttgattttgcaatctacaaaacacatttatgataagaatctgctgcatttaaaagagagaagttcagattgttagctggcagtaccttcaatctccttcaaggccgagtccctttgcgcagccagttctaccttgtctcttttcagggcttcaatttgtttctccatttgagccatcctggtggcttgcgctgtttgaaatccaaatggttgaggatacagttatgacagcgtaaattaatgggacagatctagaagattaccttttgatgaacctctcagctcgaagtttgaatcctggagctgagcaatttggtccctcaattccttctctgtctttttggcaagctccttggcctcgtgtagctggtccctaactgcttcaagagttcccaaatgaggaaccagcttttctaaagttgcggtcttggcctcattgcgaagatggattctctgcatgatggttcatggtttagttctgctaaagagaaaacaaagtcatcaaaggcagtcacccggaagatttacattcacaatgcgagtggcttctccaagtgccttcttcagctggcacacttcctcatcttctttttgacgatttatgacgatgccagcagcttgtgagttctcgtcccaccatttgagtaagataggaggacgagagtcatcagccgcctttatgcggagaatttcttcttcgtcgtcgcctggtggttctgatgtatttccaagacattagacgaataagctggagttattcaaatcggcatcacttgaggagatgagttacctgaggatgttcctagctgagcgtgaggtgatccttgttctttatttggagacccaatcatcgagtcgttaccagcctctggtccttgagaagttatcgtccgtgcttcaacttcgggaatttcttgatctggacctacatccgactggtttccagccgggggctcttgggtcgttgtagtttcagttgctgccgactggtttccagtcggaggctggtcactcggataggccttgtcacctgaagtatgggcgccagccggctggctttcggcagtcggctcagaatccttggatgaacttggctctgtcacggccggatcaggatcttttccagctggatctatgtcggatggtttcctgcaaagtgttctttcaatattcagtattattttcatgagagaagcatgccgaaatgaaatggtaccaaaaggtttatacctggaagatgttctaatctttggcattggacggctagccagttttttcctgggtgtggtatgctttgggagtttattgggcaagcctttgttcccatatttgttgccatcgtcgccttcgtcgtcgctaagcaccagctttctcttgcgagaacctgtctgcccagtcggattggaagtttgaggttgcgggtctgatctgattgttggccctccacctccctgaacggtgtgctggcgaggagatcggcgctgagtgattggggggtcagacttcatcaatgcatattcctgaatgagatgcctccacggttagttaactcaacatgaagacaagattatgttttggtcatgggttgaaggtttcagatacatacctgcggaggtggattgaatgcgttatatggcacaactggcagctgatgtgagtagttgacgacaatagcatttgagaagattttatacattctctccttcatgattttaaaatccagagaatctggttcttcacgattaggatcatgcttgccgtacgggatctttctttaattggtgccaatcggcatttgatgaagtgccgagtaatctgctctccttgtaaaccttgttctttgagttttagcatgcgatccatcaatgccaaggcttgggctgcttcatccccaatcggaagagagttccaggtatcttggtacactggaggaagacaagagtactcaggaagagcaggctcaggattctgaatataaaaccagtttgcgtgccaccctttgtttgaggtcttgaagggcatagagaagtacttttggctcagagtccccctcagctgaaatccggcccctccgactacacatggcttactcttgttcggttggggcttgagaaagaagattcggcgaaacagagtgaagtggggcttaatccccaagaaggcttcacaaacatggacgaaattggcgatgtggactatggaatttaggtttaggtgatgcaagctgattccatagaagcttaatatcccgcggaaaaattttgaggtcggaagagcgaagccgccatagaagaaatgggagaagaccacaacctcgtgtgtatcgggggtcggaaaagcctcaccgcacgctggccgccacccgatgatctccttggcggggagaacgccgtgcgccaccatctccttcaggttctcctccgtcacgtcggatggcgcccattggccttcaaagctttccttctcttccgccattgattttacccgaatgcgctgatttgattcgagggatggcttgggagaagtgagggattgaggcggtggatcacgggaaggattttgatgaacttttcgaaggtagattcgagtggaatggtgaaccctagtttgccggcgcagctctgtactgtagcagggagtggagaaaatggcgagagttccggcggggaagacgaagcgtcgcttggatcttgggatttcttgttaagggtatcggaggtgcaaatgggcttaggcctgaacagtacctcagcccagtacttttgacagcgtggcccattgtgctccttagggacttaggcattttttgctttggcaatttatgcgcacaatagtgttgcccaatgctgataaaatcctttttacgcggtcatataattctttggaattattgcaatgcaaattaaaaggtgcccgacagaaaggtgttatgctgtttttgtaagcttttttaggctacaaaagctgtctgggttaacttagaatgacttgtttttaccatagtcatttccttggtatgttatatgcctgttttcattatggtaaatagtcatagcctaggctattagacttattcattaccataatttttataatatttggtgggtaatctttagagttttctattcggatgcctgtcaagtgtgttcattcgtgaaccttttagggtgctaaccactcggattccttttattatggctaaaaagcagtcggctagaatgcctctttaggcgccgcgtatgcttttgtcatacgatgcacgattgtgctgttattttgttctcaactatatgtttagtttgttaactaatcacatagttgggggctacacctaattaggtgcatctattcgatgcaccatattctttatcttttcgccctttacagtctttgtcttcgctactcggcagatcttggcatgaaaggtttgaagcactcggattattatctttgagaaggctatgatggttgactgcaaaggtctcgggggctactgtggagattatggatatcccatatctacacggcgatggtatttggactgaatacaggataccaaatatagatagaatatcttatttgtgtctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcacatgttgattttctccaaatcatacaattaagaagacactcggcggattcatccccggacaggagtagggtattacttcttgaataagaaggcctgaacctgtataaatcttttgtctccaaacccatacaattttccagcttgatagccacccccttttattattgccgaaatctagtttcgacatccctatcctggtcaatggtggaagtcgatgagaatgcaggaggctacattgatcacgattggttgtctgaaatcatgttgcaagaaaaggcggcagatcattggaataggccgcatgatgggcctccacattagcacttgccaagtcacaatgtcacgaggcaaatcatcaaaattggccccaagtcgtcaaaatgggctggaaaattggcctccatatcagcacattcctgatcataacgttattccatggaggtgattggttcgaaggaaacatgaagccatatagacatataaagagaagactgaaatctactaaaaagctaaaaaactccggagtgatagcattgcactatgtccatactactaaatttggtagatcagttcactaagagactatcacatattgtgatagatagtgcatcgagtgagatgggcctgaggcctacttgagttacacaatagtgataaccagtcccgtgtgatcggagatcccgtgaattagaacggcgaaacaagctattggatgactatgatgagagacctttaaaaatgctcatttctttgatgtacttctctcattgtttgtatgacaagttgatgcacactttaatgtgatccgagtggctttctaaagtagagttgtcggcctatagaatatcttagaaggaacacacctatatgagtctaactactaatcatggtatatgagatttgggttatctctagatactcatggaaaggcatggaatatgacttatacgctttaaacaaagggtattttgacggcaacctagtatatgttaaggaattgagtaaatcctgactccacaagactaataatttaaggcatagtccattgttcaattgtggtcccgtgtagctccatttctagatggaagttgaacataatagccttcaccgaaacactagtataacaaacagaaacggaactgaaaacatatcttggaggccttgaaatttggtgggtattgttagaattaaatgggctaggtctaatttaatccttgtaattccaaagactcataattaatgttaagagattaatactccctccgtccgattttaagtgcagccatgagtttctgtgtccaattttgatgttacatattactaaattatgttattactgtttttttaagtgctattagtatgttcatgtttagtagtattacatagatcatccttttattcttttgtcatgtttaatattatgattttctgaattaaaatatgtcgaattatgactatatttttaacattgtagtctattgcaggaggcacctaaataataagattttggcgaacaactactgctaagtggcaaaggaagatttcatattatgattccagtcaatacgccaaattccacatttagattgagaattatgtgatcatgttttaggctacgtattgctagctaggtcataagaattttaggcccccacggaaattcaacatgcatatccatttgttcttgtcaaattaaagctagaatagagcagagaattacattggaggttaaattcattcaattatatatgaatgcaagcagatctattagcactaattatgcaggtctatattcttgtttcctttttggttaggatttaactgaactttttatcaaatctagctaaacacccttgcgtgtcaacggagttctaaaagagaacttcatcttttaaaattactgtgtcattcccgatgtacgagactatactcgcatcaattaaattttgttgtttagctcaagtcatgtacaaaataattgctaaccatgatcataatttaaatttgatactgattttccttgtggatttttcatgactttcatagcctggttaatgctgacctaaaattttcttaagaactaaaccagataagtgtagaccttttaccagttaatggacaaagatcagtttagaccttttaccagttaatacaaataaatgcccgtctgtttaaagttattcactgtacgtggcccccacataatagcatagcaggtataggtggtgatgttggcccgggccacataacaatggatatgtagtgagaccaccatcacaattgctgtcttttaattagagtatacatactatacatctactacctcaaggtgcatcaaatttatatgcatttacctgcatacatttgtagaacgcagtgccaggaatgcatagtggaagtgttataaggccctgagcgaaagcatcgtagtgtttccacatctttccgtcggaggtggaagaatcatagctgattaacttcttggctgtaacgctgaatatcatctgcaacaaattgtagtgatacgaagattcaattgtcttatgtaaagttacaacccactaaaaatctaagctcaacatacaagtatagcaattattagttgacatgcaggcacgctacatcaacccactcaacatgcagtcatcgcaagtattagttttttaggtaatagaacttatagagtattagttaatatgcaagcatgctgcatcaacccactaaacatcaaaagccaataacatgcaatcatgcaattatgccaattatattcgtatatacttcctccgtcgcattttaattgtagtcgtagttttctgcgtccaacatttgaccgtctgtcttatttaaaatattttatgattaatatttttattgttattagacgataaaacatgaacaatactttatgtgtggcttatttttttaatttttgcataaaattttcaaataagatagatgatcaaacgttggaaaaaaacccacaactacgtttaaaatgggatggagggagtactaaaactgaaaatataactatactacatcatctaaaattataaaatacaagcatgc

SEQ ID NO: 10752 - DNA, 13597 bp, Oryza sativa
caaaagtacatacaaagcgtagggatatataaatgaatatatgttaaatgttacataaatagggatatttttttattgaaattttgtggaaatgatataaggaatgatgatctggcatgcttgtattttataattttagatgatgtagtatagttatattttcagttttagtactccctccgtcccattttaaatatagttgtgggttttttgtctaacgtttgaccatccatcttatttaaaaattttataaaaaaattaaaaaaattagtcacgcataatgtattgttcatgttttatcatctaataacaataaaaataccaatccatctgccctctcgctctccatttctccttcgccttcactctcaccctctcactctccgcctctccatactgacgactgccgctatgacgatgcaccaccagcggcctcccctcgccccaccccttcttcttagagctctccgctattatgcgccaccaacgttgttgtgccatttctcctcatatctaggccaccggatccggctacccagaggctggggtcgctggatccagccgctttgaggacaggggccaccagatccacggcgaaactgtggcggcggtgatggcctcagcctccagcgagtagtgacggcagtggttccacgacaagcggcggcggcagcaacaacctcatcctctgacgagaagcggcgggctcccctggtccttgatggccggatggcatgtgccattcgagggtgatgacgggtgcgagggagatcgaggatggcgtcggcagtgagtgcgttttgtttctattgctattctgttgaatgtctaatatggcagaaggttttttatctgtgatgtggttgtgcgattgttgatgatgttgatgaataattgaattaatgtaaaatagccatgttattggtttctgatatggttgttctcatctttgacctgtggatgtggagttcttgttcctaatctataaatgcggaaggggatttagtggtaaatgtggaagggatttggtggcatggatgtgaatattaggggcagccccaagcatcggctcatcgagctgattcgtcgagctagcctcttctttttttttttggcttggggaacacatcaataccggttcctcacccgcactgatgagcccccctcatcagtgccccaatcatattgccggttggagaaccggcattgatgagactttccaaccaaaactaatgataaattatgtagaggagcaccccttgggcctatgccaggtgtgtttgctcccacgtggcacacttggcaacccaattagcaaattcataaaaaacatgtcgttgtgttcatcttcttccccacttcccctctcaactttcatcccctctttcttgttgtcagctcagaggaggcctgcagatctgaccagttggtcagacggtggtgatggaccggaggcactaaggtcttcctgggaggcggcaggtgccacctgtggggataaactagcatcctagacgagggccactgatcagtgcggtaagaaaggaggcctatcgatgccgtgtgcgggtcgaagtgtccagcagcctagcaggggcatcgtgggggacccatgtgggggttggggaagtgttggacggcctcggccacaatggagatggtaggcagatatacctgtaggttggcggttggaggagaagcccgacgaatctacaacggccacagcccaagcgacaacgaccaacaggtggatgcaggaatttggggagggagtcgatcaaatggccgccgccaccatggtcctcttctcggatccaaggacacaaccacagggaatgccccttggagctgcagatctacgctgccacaagccccttccgtggcgccacccagtacatgcctcgaggaccctccgaaacgatcccaggtgcaagagagaaagagaggagagggagggtatggagtatgaagaaagaagaagatgggtactacatgtggggcccactaatttgttgctatgttggatgacacctaggatgaaaaccaccatgtatttgatagggtgtaatttgtccagcttaaaattaaaattgcctgatactaaaattgatggagtaatttacacttttatgatagttgaggaaggtaaatcagacaaccatattttcaaacatggaagtgtagtattttaggattaaaagattgaacatacacttgagattgcttccttgagttcgatgcttgggtgattaagccatgatgacaggctggcctctgctgttttgtgcatttcctggatgatttcttgcctgagatttccagggccgaaaattcggaggaccaagttcctgatatgcctgtgtaacaacgcatgtgtcgtgattatactctcggcgccggtgatacgcatgaatgaacccgggcaccatatctggaaaagcttctcctcttgttgtaacacgaaattgctcacctccggatctagggaaacaatcaggtcttccataatcatgtttgttttgaaaattggaccatacctgaaataggcgcaaatgaatgttaatatgcattttgtattatcccctctgtttctgtttacttgctgctgtctaacgaattacattcctacccttgtaaatcacacatattgctattatcattaaaattcacacatactaatcatctttccccaaaacaagcattaaaattcattatgagaagtactagtgctagtatgattacatttttaagaagattaggaggataaagacatgtcaaaaacaagtctacaaatccttttatgtctttgtaactcactataattatgctggattggggagaaacgcttctaacaagtgctctggagatgtaggctacaagtgaacctgtgagaggtctatggatggaagcgcgatgaggtgcgcaaggtggaggtttagggtttagggtccagggatagacatgtgtgcaaggtggagcatgacgacgataaacataatttgatcgatggattgaacactttaggcggtggtttaagccattcgatggctactttcaatagggagatgaccagacatggtgcttcgattgatggtggcagaagcgattggcaattgatggagtcagacacttcgggtggatggttcaaactttttggtgaggcactttcatcaaggagtcaatgaggcttgaccctggggttgattgatgctagaggcgatcagtgtacccgatcagtggagttgaacactccaggcagggtggcacgggtctttcagtaagctgcgttttgacaaggagtcgactagatatagcgctcgggtcattccatggctaggaagatggcatggcgatttgtcggcactcactcacgactagattgatggcattcaataggaagttgtagcgggtggaccctatatgatggtttgagaattgagaggtttcttcgacaaagtgtggtatgacaggactgcgccggtggcggcatatatgcagcagacagctaaattagggcaatgacggtgaggccgttatattgagtcaggccaatcgtgcaaggacctggatgaactatggatgtcgctggagatacattgacactcatgaggtctcatctcatggaggtgtgcacgttctgcatcgaggctgagccggtggtgactagggttgtgccgagccatggctaggctttgttcgagccattctcgcatgagagtcaaatctggacaagatcatgccgtttgtgatggaaactgacacaaatttgtgaggattctagaagagaaatgacacacactcgggagcaatcaaatatgtttcttgacgggtggacgtgatttgcagcgtcgagtagatcaggttgagtctacactgcttcggcgagtggtggtgcaagtggaggaagctcggtggcggctccccaccaatgggaccgatgtaggcaggggtggggcatggggaggatgtgtgtggacgggcctcctggcagtggtggcggcccttacaggagggtcccaggagacgatgttgtggaaggtcaattctcgtgcgtcgcggcgctccaagatgagcagtgttgacggtcgttagcgatcggtttcgaccgtcaatactaccaaaataaaggagaactagttatgcttgcaatgcatatttgtgttagaataataatattccactagtattgggattactgacctcttgcagagaataaacataaaatggaggagaatcgacatcaaaccagatgatcaatcaatcggacgatgtcgagaattagacttatgcatgaatgggccaagaactcagaattgacacgacaaattaggccaaaattcacaagtctgcggagaggagcaatagaggaggccacctgtcgaatttgggctaggctggccaagcccatggttcggccgatcccaccgtggctccgttcgatgcagggtttggatggacggcgtggatcactccccaatgacgttaggagggcaatgccgaccatttcaactaccacaaccgtcattggcagcctatttaaggagctcgtcttctcactttctccatacacttcaagcaaagttctctcatattctctcaagcttagtttactattctcaagctagcggaataggaatagaatagaaatcggagtccggaagtcttcggaagagttcgggtatggctctagtagctctcctttcttcttttgtaagacttgtactttttttagaatattcttctttatataattctggtattgaaatattttccgagtatatgaatgccaactttacttcatatttaagttatattgattatactgctagcttatctgggagatgcataggtacgggtataatgtttgcttatacaattactctatgtcatgacgatgatattagaatagtaactggtagtttaggcatggtgtctagattactgggtatcattatttggggttatatgctatggaagagaggtgggccgctgatggtgacagctcagtacgggtattcctccgcgcgtgtatatagtcctaagttaatttcctggggagggtactcctccatatttagccccggttgtatagtcatgacgagctgtcgtaaggaactcgacagtcaggggtgacttctcgaagtaccaggagggcatcggaaagagggtattagctaattaatcttataactaggatgtatgtataatatgtatactagaagtataggaatagattcttttctattttctttccatttagcttagatagtttaatatgagaatgagtagtcttatgcttgtgtgtcatgctaccctatggattatattaacccctgcttacactatgattattacaagtaacatataaattattagtacggtactctctactataatcttcccacaagattaaacaaatacgatacctttgaaatactctcgggtgaaatgttacaatggtatattcgtaagcttatataaactctgtaaccataatataccaggagtatttctgcgccattgcttggaattatatctctagtaatgtcgttaagaaataccaacaagcagcagtgttgggaaccaaagcgcatgctcgatggcaagacaacccttgctcggagtctgtggaggagagctggggacttctgttcatgatggtttgctcgaaactgagaaggagtatgcgtggaaggagaaagggaatcggccaacccttgatttcctgttgaatgggatttgaccagaagaaaccaagttgtggctttgaccagaagaaaccaagttgttttttttttgggaaaaataaaccggttttgttccagctggttagttggtgggctaaacaccaaggcagatcaatttaattagggtggcagctgtttttgttatcatccatttctaccgtgatagctcctatgtttgattcggtgaaattcgatagcaccataaatcttttctctggcagacagaggtgaaggatatgttggcttaactggggatatccaatgctcttgatgagatgaagccggccaagacggatgatgacaactgcgatgtaatcaagacacatgcagctgcgacgatatgattgcttggatttggtcatgtaccacatcatggaggaaaatttaccaaataaaatgttggacaagttgacaaggctatatatgtctaagtcggtgactagtcagttgtatctcaaacaacaattgtatggtttacagattcaagaggagtcagaccttagaaaacatgtggacatcttcaatcggttggtcatggatctaaggattagatgtgaaattggatgatcaagataaggccataatagttctgagctcacttccaccgtctttggagcatgtgactagcgtgacgtatggtgagcatactatcaagactgacgagataatttcatcattgtttgcatgggatttgataggataaaataaaaacaaggcaacataggcttctcatgctgaaagtttgctggtcaaggcaaagcatgacaatgaggtggagacatcgaaaggcaaggagaagcgggtacgttgctataattgtcatgattttgggcatataaggaggaattttccattaccaaagaaaaggaaaagtgcaactgcatgtttacaagctcatggtgatgacttagatagtagtagtcatgagatctcacggtgtctaacgagaagtctggtcaagcatagatattggacttggctagttcctatcacgtgacatcaaagcatgagtggttctcttgatacaaatctggtgagtgtggtcttgttaacttgggcaatgagccacatgctaggagtatggatgagtctgattttccctaggagcttacatgagactgtatcaagtggattataataggaagacaatgaatatcatgaaagacgggaaagctgtaatgatcggtgagaggatgataatgtttgcacaagctataagctacatggaagatggatatgttagtgtcgctgtacacgatcctgaaggaggtgagcctagcgtaggctcatcgggtggctcggcgtgagtagtgaaaggaaagtaactcaaagttcaggaacacggcggtacgcacaagtactaaattcagattggcatggcattttcagtaaggtgaagtttgttaaagtttatgtcgaatatttgtacaaagtcggttacaatttcagacttgaagttgtaccgggtattaagacagttgtagagtcggactctattttaagatctcttaaaaagagagaaacacctgttgtaactgcatggcaacatagcacatgcaagagggaaaggttgtcggcagcgtccagtctatggttgttgcaactttgatacactgtaattatgctagttcggggaggagcatctgtaatcagtgtcatggggttgtacgcttcggctgaaccttgttaataaatatctactataaatttggactttggataagcgaagtcttaatatttctacatgactttggatgaacacataaatatttatggaagtcgtatatttcaacgaggttaacttcacaaaattttcatttgagctcatcaatgatatgattacaagttgcaaacgagagtactcaaaagaacaacatcagtaacttaattagatatgaagtgcttggtaaatccgatgatagaagggttaattagattcatgccgtattgaaaaaatatcattactatttacaacatctgctgcatatgctactaaaagtttagaaaattcgaaccatgccacaccgtaactatttctgtcatcctccgttcatcgacgttctacttccctctctagctgcctgcttgaagtgagcggcgaaggcgtgcccagagaaggtcgtcgacgtgctcctcatggacacaagtggactcgcggtgggagcctgtgacatcccgacccaataaggattaggcctgtgtggcccatgtgagctgtgtgcgtatgtttagtaccaccttactagtttagcacgagtggaaccgacttataaggcctcttccctccaaccacatcactcccgggttaacccttttacacgaagcgaggacgaaagtgtaagtggggtggtgtgagtaagtgggcccgctcgtcgtttgggctgggctacgcggttctagaggaagggctattacagagccgtcgggaaggggaggggagactcgtaatgagatcgatcgggaagagaaaggaagaagtggtaggcggcctgggtccgtcgcgttgaaatcctccaatgcggcaatagactcgtaatgagatcgaccgggaagagaaagggagaagtggtaggcgaaggggaggggagactcgtaatgagatcgaccgggaagagaaaggaagaagtggtaggcggcctgggtccatcgcgttgaaatcctccaatgcggcagtagactcgtaatgagatcgaccgggaagagaaagggagaagtggtaggcggcctgggtctgtcaccttgaactcctccaatacggcaatgagccccctctttaggcccgttaatgtccatgtgcaaaataggcgatcgaacatggcctctcttttttggggcccatataaacatgacggcccacttctaattgcttagctatagcaatgcaagcctaatagatagatcgaccaacaagaccaagccaaggtgtggcactgccgggttgtgtgatcacataatttgatcctgctgctactgtgcgacaatcctaattccatgccgcgtgaccgccgagaccgagacgtcgatcccaattccacgcaagcgacgtgggaggcagcgatatagcttgctgcttgcaacaatagcacttgaaaaatgatatcttagacaagattgttagatggatctccctccccttgagcccaacggctcaagggggccttgacccgtgccctgatcgggggcgcccagcccaatggctggtgggcccccgtcacactgtgccatataaagaggggtggaggacgggacgggacaactacacaaggaacgaggttcgtcgccgccgccgccactccaccccataaaccctaaccgatcgagggggcgcagccagtgacgggaagactccaccgccgcgccacgacctcgccaggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaaccctaacaatggtatcagagctgtcctagcgtttagtttggttcggggatagacatccacagagaagaaagaaatccaaagcaaagaaaagcaaacgatccaacggatcgaaaagatcgaaaccctaaccctaatcttacctcgtcgccggccgtcgttgacgccggccacggagagggagaggggcaaagaggcaccgccgaggagccactcgacagccgcgcgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcagcgtgagggcgtcggccatggcgccgcggcgcgaaggctgccggtgtcggcgacgccgctcggcacggcgcacgcccgcaagagaaagaaggagggggcgccgcggcacaaccgctcgacggcagcgcactcaccctcgagtgagtgcgcgcaccggcgatggggagtgcgacggcgccgccgtgtcgccgtgccgccgccggcgctgtgctagggtttcggcgacggcgacgccgctccgtgcaaccgcaagagaaagaagagaagaggagctagggtttcggcgccggcggtcgggggcggttttgtttgcccgatccgcccgcgcgaccgtccgatcgaaaccctagcgatcggacggccgacggcggccgggccgaaagcggcccaagtggggagcgcgcggcggcggctttcccggcccaggcccaggttgcggcctgggtgaggggagggggcgctcgcccgcgcgcaaggtggccatgggccaaccggcaaaggccggaaaagttcactttaggtccctccgaaggaagcattttcaatatgtttaatgattgtgtttatttctaagcaatttgaactaacgtgaaaattgtttagagaatagataaatgtgagaaatgcttctgaacatgtattttgtatattttcatgcaaattacaatagagttttgaattgtttttacatgttttacctctgtttaaatttgaaccaacgggagaatttttacagagagtaaacaatagagttttgttattgtttatatgaattgtatatagatcttccgctgcaaatagatgaaattgatgaaaattagtgtttctaaaattaaatttcgaaccaacgggagattttaattttaggagcattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatacgaaatggtccttagccaacaagaattgtttggctgcggtaaagaacacgattgagccaaccatattgggctcaatcccagagtatgacactgtctctaagtacctcgaaagtataaagagccagtttagtggttcttcaaagttttatgcgacacagctgataaagcagcttgttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacattgcaagaagacaagacattccaagaaagatcatcctgtcttcctgacagtgatcatggcaaagaaaggtgagaacattattacatttgtaaagaatctcattatgattggttattctagatccacatggtggatttattctggagcaactattcatgtgtgtaattgtttaaagggattccgttcaatgaggactacgcaaagaagtgaaagatccattagagttgccaatggagttgaagcaaaagttgaagctgttggagatcttcgcctagaactcgcgaatggcttcacacttttacttccagatgtttttatgtccattctttgcaaagaaacttgataataagtgtatccaaattggattctgatagatttgaaatggcaaatgtgaactatggtataataatgaatgtattggtcttgtgttgcaagatcagttttatttgttatctctttctgagaatgtgaatgttgtgtcctcgttgacaaaagaaaagaaagcgaactcctgatgtctcatcgaaattatggcactgttgtttaggccatatttcgagggggagaattgagagactgttaagaatgtagttcttcctccattggagttctcagttttagaacgatgcatacaatgtatagaatgcatcggtgcccaaaacaccgtatgagctatggatcctccgtgtgtgggggagtcctgcaaaggataaagtatttaacccaaaacagtaagctgccattttattggctattctgaaagatcaaagggtcatcgtttctactgtccaaacagttatacaaagtttgtagaaacgagacacgccgtcttcttggaagacgaaatgattagggggagctcggtaattcgagaaattgatcttgaggagaggcaggtgtctgtacccgctccgtcgactcaggaacctttcttctctctacctgctaatgttgtgccagcaatgtatgccgttgcggtaccaacacctgttgttatctctcctgtggcaacaatgaatgaaagtgaggaacctgttctacaggattcaacagaaattattgccacatcagaggaggagctgcaacagcctcaaacagataatgtgccagaataggaggcccctagaaggcctgaaagagtcgcatatggaggatgatcccatctcatatgaagaggccatgagaagccatggaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgactcgtggcaaaaggcttcacgcaacgagaagggattgattacaatgagactttttctccagtctcttgtaaagtttccttcaggattataatggcactagtggcacattatgatttggaattacatcagatggatgtaaaaacggcatttctaaatggagatttggaggaaaaagtatacatggcgcaaccgaaaggttttgtcatgaaaggaaacgaaaatatgggatgccgtataaagagatccatttatgggttaaagcaaagcttcgagacaatgctacttgaagtttgatggaacaataaagaaatttgggttttcaaaagaatgtagaggacaactgtattgattcaaagttaagaatgggagactcatttttctaattctgtatgtagatgacgttctactggctagtagtgatgtcaatctactgcaggaaatagagaaattcttgtcctcaaactttgacatgaaagacctcggtgaggcttcatatgttttgggcatagagattcaccgaaatagaacaaaagtatgcattgggattttctcaaaaggcatatatatagaaaaggtgttgaagaaattcaatatgtacagatgctgtgctacacctgctcctatagtcaaaggcgaaaagtatggggcatcgcaatgtcccagaaattcagtatgagctcaataaaatgaaaacaaagccatatgcgtcagctgtag

SEQ ID NO: 10753 - DNA, 25838 bp, Oryza sativa
  unsure (1)..(25838): unsure at all n locations
nnnnnnnnnnnnnnnnnnnnnnnnnnnnnnnnnnnnnnnaggcacgtaaattcaactactatggtagccagtggtgactagcttgtcctcatcggcttggtactaacaaaagataggagttgatgaggatgagggactctctgactagatcacattcgatgtactcctacagttgatgcaaattttggatttttccctatcaatcttctgacttgctaagttgtgattaatgtgaatgctctattgctatctactttctagaatgaaaggagtgcctttcgttcaattcaaagtcacggagacagaaaattcgaaggtcaacaaatcagtcgagtgccaccatcatgtagcagaacacccgttcgatcaggacctcccgtcgtctctcccatttgggtcattggcattcatttcaacccctgctcaagttggtccttcaaactaatctgattaatccttcctcacacccaatgttaaagcatcccatcacatgattccacgtctcctcttcttgtcttacacttccaagatggcactctcaacttccctcctacgtaggcctccgcccactccctcagtcttaaaagtatgccacagtttcgtccctacaatcttctcaccaagggcacattgtaatgcatttgacatgatctgccccgtctaccatgtttcatgtatcaggtatgtgctacatgcaagcacataaataataagtatacttatttgcaataagctacatagcctcattttatacaaaatgagctaatatgattagtatagatgaaattgtctaagttttttttttctattcactggtggctttttcttcactttggcacttgaaccacaatatcaactatttcctgtgggactgtgaggctgtgactacgttatatccaccaaaatgatgcagaccacgttcaacatcacatattccaccatccagaacacggtatgttgttgaacaaagttaaaaaaggggcacttagtagtaacttgtaatgcatgaattgacaaaattataaggatgcaagaatcaaagcaaccaactgggtagatataaaaaaaatgcatcaacacagtaaaatggaagatacgtagggaggtgtacagaccttcaaaagaggtgtatggcgtttcctaacctgcaggaaatagacattatgtgagtaaagagttctaatttcttaagaaatttaggaggtggattccaacaaatataaaggctcgtggtatgccaatgaatactgcaccatagccccccaaaagcattcctactgtcgagaacatattttatacgcaaataatatacgagttacaaattgtttgaaaaagctctagtttgccacagaaataaaatcaaagttccatgtgtcctaactaaaattacaagtacaacaaaaatcgggaacaacagatttactccttgagttatacgaaggatttttagagattttatttttcaaaattgaaacatcgacaagtgattctgaagacaaagatttaaggcaaataacattaaatcatatggcacattggatgcaaggcaatctgaaaataaaagaccatgcacccataaatggaccaaatttccttcagaaacctgaccatcagaattcagaacactataaaagaacattccttactttaacctctaaattgtaaagaattaagaatcaaatgatcctatacattcaagagagaatatgcaattaaatcctgctccaatatatcctaatatttcagaaataagtatagccttattttttaaacctgatgttaagtatcaggaatggatagacagatagtaagaactcaccacataatcccatccatgcttttcagcaaatgcctttgctgaatctgcactgtcaaacgtaagccctgcttcaccaacattagcatatggatctccagtagatgtccatcccattaatgggttctcccacctattattcacacaaatgttagaaggggaaaaagcggcagcaactgaaatagtaatatctaattgtatgctagaatgctatataataaggaggtgatacataaagctaaatgaagtaaatgcatgagacataaaagaaatgaaatagactaagtacacactgtttgaccaaaccaaggtgaccacctcaatgagaggtcaaatgcatcagttgcaaggctttcattgtacaaaaaaaagggggggtaatctcacgttaaaggaaaaaaagaaacagacttcaatcgtcaatgaattcttctgttatgaatgtaaatcaagttttaatatgagactatttgttttcatttgatatattattgaggcagttcaccaaacagcaacacagggtttgaggtaaataattcatgaaaatgaatcaacaataaccaataaaacaaaactggaaacatacttttgggttgacacaaagttgattttccacctcccgactttgcctgaaccctgctgagatgcagtcctagcgggtgaatatattacaacctgcaaatacacaaggataagttgatcatgtcttcccagctaggtagttgaaaagcatacagtgagtcttaaaagaacaaaagtggcagcaacaaaaatcatattttctttacagtataaatatttaaacctatctgaataacacaatcctgtcgtaggccatttagaaggccgtttactgtataaacactaaaaggtgggggagaccacttgttaacagtctaatgatctacaagaacatagatcacaatcaaaatattttctagggctcactctgtataataaatctgcaaaaacataagatctattgatgtgtaggcatcctctctctgcagacaaacataaggttgataataccatgaaaaatgtgactgaagtggtgctatcagcattgggccatatcataagatgcttctaagctctttgaagttaagacggatctttgaaacaacagaagaattgatcatcaaacaatattcgtattaacgagattatgttgtagagaaaactatttcatggaagctctgttcctcagaagtcagaacaagaaactaccactctacaagtaggcctctacatggattttgaggtaattacaagaactatgaaatggtatgaaacagacattagttcatagtccaacaagttatctaaattcaatagctaagcattgctagcaatttcatctttctttgtatgcagttagttctatcaaatgtatttttaagtttgatgtacaccaagaaaatggataaataataagcatcctagcatcatctaaactctggtatgtacagttctctaacaccaatactgtcaactctaatcacaaacaatttgaaaggtaagaacatacacctatatacattcagtcattcacagtacataaaccaaatcaggataatttgatcaaactctgttgcctccagccctccactaacataatctaaagtgggagaacccaacctggagagcagcacattcctcccaagttctaaacgcagttcaaaccacacaagcgtaaaacatcatcaccaaattcgcatttctatccactccacgattcgaacgtctactagcgatagcactgtagtccgtacgacgagttcacgacccgacgcctccaggctctatgcctctatccctaaacacgagtaacgaccaaaacaacccaccaaacctggacatctcgagcgattcccacacggatccgcgagggctagccaatctatcgccactacataaatcagaggtaaggtcagcgaagcaccgcaccttgcggcggaggtgctcctcggggatgccggagaccatgccgatctcgcctggcttgatctcgacgagggcgtcggacgccgccgcggagagcatccgcgcgggcgcgggggacggcgagaggagcgtgcgccccagggaggggaggctccgccggagcggggcggccatctcgtcggagccgtacgccggtgaggcggatggtggaggagagaaggggcggacgagaaggccgaaggggaaacaccgagagagagagagagagagcacttcagaacttgggagaagagacggctggaccgaggatatgttggaagcagctcatgttgggccaatcttctcggcccagtgttgtgggatccgattggtttatgggccgggccttgcggcccagactggtgcgaattcgatttgtttctgtgtgctgggcccagttatggtccagtgggtgatctgcagccttggagttgaaggcccataccgaggttagactagctcgttgggttttggtccagatgaaccactgacttatctgggccggcaatgttatattgggctgcctctggaataattcttgatggcccttttgataatttatagaattcatttttcagttccgttatttcaactacaccgtgatgaagttcatcaagagcataatcacccataataagtgtattcagataatttaatacaccatttggtcgtgaatatttgatggttaggccggacaatatttggatggcaaattttactacaaaacatctaaatttcgtgtaatttgctgatagacatcgaaaaaacattcacaaatgaaagacatctaaaaatactagtaatttgttagagaacaatatcgactcaattaaaaagataaattcttgagaaagacaagaatgcccctagaatcacatgcttcaaacataacgttaaagtacgaatttagaaattatgcaactccaaatttagcatcaccccaagtacatcactagtatacgtgatattttatcttcaccctagtctcagttcaaaatcttttgaccgtgggggcatccttgtcttttttaagaacttttcttttcaattgagccgaaagtgtcatttagcaaattatcagttttttaagagtgtctttcagccgtgacacgtttttatgatttctatcaacaaacacaaattttgagtgtcctatagttaactttacctatttggatcttacttttgaaactttaactatcaatagtctttgaaatgcttagtttaaaaacaaaagacttggtagtatcaatgttttatgcccataatatagactaattaaattttataaacttaatactaattggccgaaacttgttttaaacgttaactatctagaaaacgagggagtaagtcttttgtatttcgcctaagaatgaaaagtgattaacattgtgtaggaggacaaatacgtatgatctatgatcacatgaagttctgaaaaaaaaaagatcacatgaaaatgcaagattacatctctaaatcattttcaatatcgatgccaaagaaatccacaaataagtccacctgaatatagtataaatacaaacgatattcctatcttggatctttttcctagttctagaacagtacattttatttaacaagcaatagctgacgtgtaacactcttataaggtcacgttaatccactattttttcccacgatcatagaggaaatcatgcacaaccctaaaactctcaatccctgtcctcattcatatacagtaagatttttttttccagagagtacaaaatgcaggggagagagggatgcgggcacgggtgatgatgccgaactggccgaggccgccgatcaaggacggcgaagaagaggtcggggtcggcggagggaagaagagggagaaccgagagaggagagagaatgacatgtgaggcccacgtgggccccactattttaaaaatatttttgtgtgtagctcacatgtgggaaacgatttttattattttccgagatataattgccaggtaagcgctacgtcaatgtcatgtgggatggagacctagtcaaaccagccacgttaggcccacgtcagccaaaaccgccttccaaaccactgagagacctcatttgcaccggttttgacagtttaaggactggttgtatctggttttagggttcaagaacgaaaaacggaatcggtgtaaaattaagagacctcagataaacttattccttcgataaattatagacttcatttttcagttccgttatatcaactaccctgtgatgaagttcatcaagagcataaccacccataataagtgtattcagataatttaatacaccatttggtattgaatatttgatgtttaggaaaatatttggatcttattttgaaactttaactatcaatagtttcgcatgcttagtttaaaaacaaaagaattagaagtataagtgtattctgcttataatatagactaattaaattttataaacttatactagttgatcgaaacttgttttaaacgttaaatatctacaaaacgagggagtaaatctctagtatttcgcctaaaaatgaaaggtgattaacattgtgtaggacaaatacgtatgactatgatcacatgaaaatgcaatatgacatctctaaatcactttcaacattgatgccaacgaaatccacaaataagtccacctgaatacagtaataaatacaaacggtattcctatcttggatctttttcctagttctagaacagtgcattttatttaacaagcaacagctgacgtgtaacactcttctaaggtcacgttaatccactatttatttttccacgatcatcgaggaaatcatgcacaaccctaaaatctcaatccctgtcctcattcatatccagtaagattttttccagaaagtacaaaatgtggattttaatgtacgtgctcacgtagaaaaatacataaaagtcttctttgtttgcgttctattagaaaaacattacgataacgacttttttttattggatagttgcggtgcattatgacattctgctatgaaagcatggtcgtaatgatagtcatggatgagcaagtgacagcaacatcctgcgttaattttctgcacgcatggttagacacaatccatccagaaggtttgaaattaatcgagagcttaattagattcacatgttaatttaactggcgtggcagcttatccttgtcaggcgccggccggcggctaactcagtaatactgatgattaatcaattttcaagtcgtacataaatttcttttttaaaaaaaaaaacagagttcaagccgtatatagctgacgcaactgtctgttgattcgtcagtgaattggttaataaaataatatagtacttagctgatctttggctgattttttttacaataaattttgaagagatttatcatactccgtaaactgtgtgaattgtggtgatgttgaatgataatcaattgttttcagccaggtaacgatgatcaattgtgacattgctagtgaagtactatactatataataactgtctcgctgatgtcagtgatgaacttgataagaattagcaggagtaactaactaactagtaggaattggcgatgaattaacttgattgtactgtacgtgaggtacgtgatgcacgtcgtcatatctatctgccgtgttcttgaccacttccgtcgaacattcttcttcagataaagcagatagagatactagaatgccacaggtctttagcccgttgagtcaagcaaattaaatgattacgaactaacgtagtaattaactgcacccaaaaacaagatcagctcccctgccattaactaaaactggttaaactaattacagtaggctaccggattgatttcaaatattatggctgttcttcttcaggttaaaatttacatagttagtttttcaaaaaagaaataatagacatttataatttaagtttgacttatacctgcactcgaaactttgactcgttttcagatgaattaatcacgcagccttttgagttttgatccattcaactgttcaaggttatctgcgcggcgcgagcgataagggctttcagaattcagagtccacgccttgcccagcaatcaaatattaccgcgggccagaagctctcacgctcgcgagaaatcaacgctgcaaaacgcgatgacatcatgatctggcagaaaaatgcaggcaatcatcatctccaaaaccacgaaacgagagaaaccgatgacgtcgaaaaaccaatctcagcgccgttagctcgtgaaaccaacgtgattacccgaaacctgcagcaaaaaaatcgtgctgcagaaacgttgttttctcttttttttttcaagaaaaggaataatagatgcaggaactgtaatgatccgatcccatttgatatggtcaaccaattaaccagcatcttagagctaatctgatccgagctgcacataatcagatcgattctgtgctcgagctgagctcgatatacaatccggcgcagatcgtgagctcgaaccgagctcgatcgacgggtaactgtcattgtcggtagctagcttgatgcagaatcacaagagtaaattaatagtaagattttagttatcatcacatactaaaaagctagtaccggccaaattgctctcggcagattcctctgcattttgttactcgcacaactccaccgggtcaatcgtggcaagcaaggcacgaaattaattttcttttacaaaactgaacagtagtatctttctgaacgaaattgaatacatatttctttcagacatccatacttgaccaagcacacgcataggcaggcagcaatcacgcgccaacatctgaagatcaagtctttgctccagaaagaaaaacacacaaaaaaaataataataacacgtactagaagaagagcaggtcgtcgcggagacccaagaaataaacgagtcgggacagaaacagaggcgatcgcgttgcgttgcgttgcgttggcaaatcctctttaaaaggctcgtgcccgtggcgccagaaatcgttgatccgcacacggtaatatgcaagagatgttgttctgcggcacgggcagtttcaaggacgtcgacggcaaggcggcggcgccggaggcgaagaagaagaagcagggcggcggtggtggtggtgggaagaaggagaacccgtacgcgtcgagggggctcgacaagttctccaccgtgctgtccgagctcgagtcgcggcgggagaagatccttcgccaagtcggcggcgccggcggcggcggcgcaccgggggagggcggcggcggtggtggtggtgagcatgtgctcgtccggttcgtgcagtcggaggggaaagggtgggtgcccatcgtcgtcaagctcccgcctgaggaggaggagcagcagcagcggaagggagggaagaacaagcggaagcagcaggcggccgcgacgtcggcgacctcgtcgcagtcgtccacgccaccgacgtcggagcccgccagccccagggaggacgtgatcaagcccgcgcgccccgccgccgccgcggcggcggcggagccggggagtgcgaagcggaaggccggcgtgaggtggtcgtggtcggacgtgcggccgcgccactacatgccgttcgtggcggtgctgctgctggcgagcctcgtggtgttcggcaaggtgttcgccatctgctgcacctccgtctggtggtacctcgtgccgatcctgacggccagctctaatggcgccggcggcgccggcggggcgcacggcgtgaggagatcgaaggccgccgtcaaggttctcggcaagaaggcgagcgacaagaagatggccgtgacgccattgctgggtccttcgcacggcaagaggggtagctccggtgtccatgagttgatctcgccgagaagtcatccacatgggaagaaagggtagtaattcgcgtggattcattcaccacacgctgtgaaaaaatcaacgccgtgtttgtaaatgtttgtacagtagggtggccaggaagatcagattttttttgttatctttcctaccgtttcgattcagtttggttgcaattgcatccagtgttcatgtagcatcagcccccttcttgtgtggctacccaaaattgttcataaattttacagaattttgtccattaactcgtccctggtgtactggcagtttattttcatctctatgtatgttaactatgccttcgacttctggatctctggttgatttgagagagcgccattcgtttatacgttgtggaaacatgttttttttttttggctctatccgttgaccttgtttttaggtacaatcatcagtaaagaacttctagattcaggcatgtgattgtgtagccacgcatatcacaatgaatagaaagtcaagcatgtttacttctagaagttagagaacttacttgtttgacaatccagaagaaaatgcaattgtacctgcctcgtcaatgtcaattcacattatctgacttttaaccaatacaaacagttatgcttagaatttgcaggcttaggctgatcttagccattgcaatttctcattcagcaaaattgtgagtttgtgattgaacaatgaatgagcatacattgagatgccaacagtgcaaattcttttacaaatcacaagcaagactgtgttgtgatgatctctgggaatcaaccaggacataggctaatagtaataactacgcaatacctaattcagaaagactttactgttagactaatgatgaaacaacagaatgatacagtacaatcattttccctgtccttggaaccaagtaatcccaccatcatgccatgccctatatccatcaatcctgaatcataagggaaataatagatgttagaaaatgttacaaagagaatggtaaaaatgaagtaagcaatacagcattcgggccaagaggaacaaatatatacaattatcaatacagccacaggcaaatcatccatgataactaaatgggatgcggttgatattgcattctatgctcccagccgttcagcactattaaacccccggcaagatgaaaatatgcatcaggatgcacccaatgaagatgaatgcacatcacatcacaaatacttatattagaaagatttgatatgttgtcctaccctaaatctctttctatgatctgactcaattcgcgatgtgtaatgtttcttccttccatgagccgatgaatttctctcttctaaattgctgcgaacaggctcgtattgtgcattgcggaagaaaccttcatgatcccaagttacttcatagtctaccttcaaccgtgatccttccttcaaacagaatagatgagtcagcttccattatgttttctaaaacataaaacataaatgataacaagacattaattgaggctgttctggcatatatagtatacatatgtggatttatccatgtgtaacaaatttatgcagcttaaacttaagttgggtgccaaggtagtgaatatgagatagtatatatcagtcatcactcatcagagctgtatgtggaaggaaagcaacanatcctaccaacaattgtggtcctcaatcctcatagaagctgatgcacttctaataatttctaatacctgtaagtatctaataccttagtaattttgtagtcctcttgtctagctaatttagtaatgatctctctagttagtaaacactaatgtggtcactttgctttcaataaacatagccatttatctgaccatggaatgtttatcggcagggttcaccaaacaaggaagcaaccagataaccataagctaacgcatgaaggtactgcctggcactctaaaagtgggttcaacccaacccaacccatcccatcccttgaaacaaacacacgctgatagagggtgatggttaacttcagtggaagatagtgatgtgatatcctgctaactttattggaagactcagaacgcttggatgtatttgaaaaggccaacaggacaaaatatataggatacaagaaacacaatcctacactaccacaaatacctctagcatacaagttcacacatcagaagggcatgtgaaggtctgaaggatgtgtgctatgcaacgtcagtgcatgataattgccagtaggtaatgctaaaacagagctgcacagttgaaacaaaaaacctatatagaaggaaaccagaaaggaaaatctagaggatattgacttcaaaaaaaaaatctagagggtatgctcacaatatcatttatatgtgttatgtgaactaataaaaagttaaggattgagagataactggtaacagaatatgaaaatcttactttttctaatgaacgtccacataatgcctgcattgcactgttgaaatcgtcgtagttctcaaattgcacccacactttgcaatttagtccagatataatctccttattggttccgtcttgttttgctccccattcatcatcactagaaatattaaggttcctgaaaattggcagaagaatgccaaagaaaagggtatgcggagtaagttccccaaaatgtgaagggcagttcataacctgcagaatttaaaagaaattgggtgcagtgttatttaaagaagtcacatgtatacaatagacattactccattattgtgcttgatgcactagggttatgtcgtatgttgttttgtgtgacatggattttatgcgtgcaatatctaatactactaaagaaatttattttacccatgttacttcccaagcttctttattatgaattttgaacatagctaacacattcacctaagctaccacactaacatcagaaactgtatgaactggtttttgctgagtttaattgctatcttggagaatcagatcatagatttcaaaatataagaagcgatatgagtgagaagaaacttatatgtggatgaaaaccaactagacagggcagaccttcaggtttcaggtggtgctaattttaatgcgcatattaagctctcaaaaggtgtgtataccggaatgggaaggcaagtaagaacaaaatatgagtccacaaacaaaataggaaaccaccaggatggacattgaacaaaactgaatcaaacaatttccttatggatgctcatgtcaactaagtttaggactcttttcgcttttattagcttacgtccggcactaatattctgccttgtatcccagagatatgaatgcatttacaatataatgaaccaaacagaagttgagaacaccaaaatgcaccttattttaccaagtgccgagaaaatagtgtgtgtgaccagcgtggaggctttcgatgatatcctcgtctccgcaaaccacctggatggcacaccccggacaagaatggtgtctggccttttcgctatcttcctcacaggattccctgagcaaagcaaacatcaattcaaactccacctagcaagaatcacaactaagagcagcattttcatttaaaaaaatgaatcccatactgctactgaggagctcggaggcgtagaaattctcccaagacttcttcattgccctgaagtcatcggagggcgggatctcgacgctcatccgaaacttaaccccctcgaggttgagctcgatcccggccagcttctcgaccagggagctcctccactggaagtacttctcctcctcctgctcacgggtcatctcctcggcctcctcctcctcatcatccccgttgcggcggcgtgggcggaggaaggagaggtcgcggacgtggaggacgcccgaggcgacgggctcgtcgcggcggcgcttatgcaggtcggggagggtgcgcacggagaggtcggagtcggggaggacggggagggagaggggcgggtcgcggaggaaggcgaggagcgcggtcttgagctgccactcgtcgacggggcggacggagaggtcggcgcggaagaaggtgaggagcagcttgaggcgcggcgcgagggagagcccgctcggaagggggagcggctcggtcggccggagggcggcggcggcggcggacatggcggcgcggtggtggggagagagacggcgggatggcggcggaccggcggcgggttggactcgacgggttgcagatgggccgggtgaatggacaatggagaaccggaggcgagagaactgttgcttcacgcgttgagggccgtccgatgggagatcaacgggtgatcgtaattcaactatcgcctatcggcctatggcgcggatgtgttgttagagaaaaggattatgtcgagattatgttcacgtcatgttcatacggactagcgccgatttgaacatgcaatttcgcacgaaattcatacatacgtgcaatatgggattccgagcataagaaaatcataattcgagttcaaagttcgaacacaactccacatcgaagacaatagatcttactatcatcaaatgattcgtataagattcaatgctaagggaactattctaaataaaattttaaggggatattcactcgttgtttgcagctactcaaatggttataaagaaataaaataaaaaatcgacgagatagattaatatatgatatatcaatccacaaacatacaagttaaatttaacttctacatatcgcaatttaaaaaaacaaatttaattgtcaatatacgttaactagctgtagttttttttgcaacttttagaagttgatttttagcttgcatgtttgtaaagtgatatatcacatgcaaacaacaaggaacatccctttaagagtttaaaatctactctcttcaatactctgtatttatgttgcaacaccttattctctcttactataaagttataacccactaactcttaaagcttaacatgcaaagatgctacatcatcgtcgactaacagttattacatttaaatatcatgcaaacatgctatattatctataattttataatttattaaattttagagctttaaaatacaagcatgttaaatcatcatctcacataatttaaataatatgttaatatatatcttcattatttttaataatatcttatatacctatatagttcatcctcaattagttaatgatatttttatcttctctcattaagccatatcacatcaattgtttttttttgtgcttaaatgatttattaaattttagagctttaaaatgcaagcatgttaaatcatcatctcacataattcacataatatttcaatatatatcttcattatttttaaaaatatcttatgtgcctatatagttcatcctcaattagttaataatatttctctcttctctcatcaagccataccacatcaatttttttttgcttaaatgattaatatatggtcaaattatctccacattttcttctttcattaagctatatcacctcaattgcttttaggtcttagatgattaatctatgattcaaactgtctccctacttttcttctctagtaaagtcgtatcactttacttttatatttgaatcattattttatataccatttaaatttaaattatcataaactacgttaacatactcttatgttgtgtagctattttatatattatttttacttattgttatcataataaactactgcagcaacgcgcgaggtttcacctagtatatgagatgttagctctcaaaaaatgaatatgggctggatttgagatcctactggagatgcaattataacttgcaagtcaatgtagcgataaaattctaaaaaatgcgctaattagacacaaatcaccctttgtaagaccctctttcgctgaaaaaaagttctgagtgtacatgtcgcatttccacttgtgatttttttcaaaacgctcagtgatatcactttaacttagaactattgtaccatattttatccccaaatttcattcgagtgacatatagcaatcccgtttgctttattaccaatctgcacgtgaagtgctatgcaacagccttgcattgcaccgggaaaacagtagagctcatcgccctccgccgccccggcggcacgcctgcctgagcggcaccggcgggtcggagagcttgccgccgacgatcagctcgaagacgaacctgttcgccgcctccgtgaagtgcaccccgtcccagctcacgctcctcgacgggtcgtcgcacgacttccccgccagcaccgacgtgccgttcacctccaccttcccgccgcaccggatgtccctgtcgaagttgtactcgccgccgccgtacccgcagcacaccagcagcgggtccccgaatcctgcaacgaacaatacccaccaatttttcaatcctgcggcgatttcaagtgtttcttctccggctccggtggtcagatcaacgtacgtaccgagctgcttggcctggctgatgagcctgtacttggcggagtagacgtcgacgtaggtgagcgcggcgtccgggagcgccgcccttagccggtccacggtctcgcgcagcctcgcgttgaagaaccgggcggccgcgttgtaggcgacggagcagccggcgtcgtccctcggcgcggcgagcttcggcaggagcaccaccgcgtacgtcaggcagccgagcggcgccgtgttgtgcacccagaagtacctccctccgaggctgtacactttctgcactcaccaagcaagcagagcacgtacagtacacatgagcagtcctatcgttttattcgaacggcatatttacaaaagaaaaataatttataaataaattttttatatacatcttcttggcaatataaaagtataggtcgaaaattaaactttgcgatagaaaagtataggtcgaaaattaaactttgataaaaaaaatcttaaaattagctttaaatataaggttgaaaattcagaatttgactgataagtataaacataagcgaaacaataaggccgctgatcatctgataagccgtggaaaaataaacaaaacaagcaaagattatttcaatacaaaacatttatatctctgttattagtgttttaaaagcaaatgctagaaaaaaaactacgatgaaaagatcctaaaatcatctcgaaaattaagttctaagaagattcaaaatttcttagtttgtcaatcagtcaatgaacctaagtgtactgtaactaggctgtgatcactgcattgagctgcacctggatggctgcactgaacctctccatgagatcagggacgtaggcctcgacctgctcagtgctcatgttgtcgaagtagcccattgtcaggtcgttctggccaatgtcgaacgtgtagagcgccctggagaagtactcagctttcggaagaatctccctgtaaattccacctgcacgaaaacagagtatatatcaacttcacaaaaaaaatggaactgaattttgagctctgaatggcgcatatgcagaggctgatcgaatttgtcttcacctatgttgctataaacgaactggcttctgttgatgaactgttcgaattggctggtctgcacgtccagggagatcgggctgatgccggagacgaagatgctgccattcgctggtctgatcgacgcagcggccgtcgcgaaattggcaccttgactgaagttactcccaactgaatcgaggtatgcactgaggtaacgaatccccaggctctgagctgcagcgtcaggaaaccaaaaaaaaaaacacagtagattcagagttcgttccgagtaattgggacgcactgagtattactgacccatgaagtcgatggtgaggcggccgtcgctgaaccggccggcgggcatgccgaagtaggtccggccgaacggcggcggcaccacggcgatgagggccgagagcccgccggtgtccgagttggagtcgccgaagttgaagatcgccgggaaatcgcatggcgcgtcgctgccgccgtcggagcttgccccctcggagagttgcagcaggagcacgacgaggagcaacacgagcttggcggtggtcggaggagcggcggtgcagcggcggcgacgtcgtgaaggcgccattttttctttccaccttgctcgatcgtagtgtgtgtgtgtgagacttgtgcacttgattattcggagctagcgctgatgtttcatgtttcataggggaggtatgtgtgtacgtgtcgaaccaacgagtcacacgtccacgaagcgttcgaagtccctgtccattctttctcaagatttttctaggtttgggtgttgtttgtattcagaattcacacattgtctcaggtttgcatcaggactggtacaatggggacaagagtttgtgactttttctggaagtctgattggtttctccttgtttgttgcacgtggcgtgaggatgacttatctacacttttctaaagtaacttattctctcttttgttttccacgtgtacgctttctaaactgttaaacgatatattttttaaaaaaatacataaaagttgtttaaaaaattatatcaactagaaagttagcccgcacatatgcgcggacacctatttaatgtgtttgtgataatacaaatgtttatatgtgagtgactttttactgaaatattttttactcaattctaaatctgttctttttttgccaacaattcattttggattgctttgaatgctagttttgattcccttctaattacccttaaagcaaataaagtctaaactaaaattacttgaaaatatgaatttataaaagaatattgtgtcataagaatggagttggttaccatgaaattatatatcatttgtattatgtgtatttactttttaaaatatttagcacatcttatttttggattttctaaactttaattaaggtaaaattttattatgctatatatgtctttatagattttagggcatattaattgaagatattttctattaaaaatatggctaagagactattttatctaactatagatatacctctatttacctctactttctccgtctcataattccaaggattcaaatcatatcccaaaatataaaggttgtaaagtactaactgtcccatcgaaccacccctcatttattttgttcctaatcttacttcaaccatctttattttttatccaattttatctcaaccgccttccctatctctatgtatcctttatttaatgagagttgtcatagttttttttcctccccttaattcctcctaaaatagtatgatcccttacattataggataaagatgatacaaagtatgcaccatttatagatggatttgtttggtttgtttgtgcctatgtagattaatttagccttgcatgtttataataatgtggatacatgaactattgatttagttgtagcgacataatattttactgatatttgaactatccaaaagcaagggtttaaatatggttatttaaagatcgatcaaatatttagcaagtatgctcatgaatttagggtggtcaatgtgcacacaaattgtgctgcccgcgcatatggacatgtgaaaaaacagggtcaggtgctctacgcaaattagttaacattccctaccttccaacaatgcaaatttgtttaaaatatgggtcattaatttaaataaaaaattttaagagctgtatgctttcaaattaatttcattagctagctattctcatgttatcactttttcttcaatcttagagttataacagtaaaggaaatctggatgtaatactttataaagataagctataataatcttcaaaataccacgggaagaaaaacatgccaaattaattggcttggtgaataagataatataccttcgtcccgaagatcaaaatttcaaaagtaccattgttatgggaacaaataacttaaaatatgcataaacatcttcagaaaacctgtaatgttatgaggaggtgattattagtttaacatcaaagagaaaagtaaaaaagaatgtgaaaaaactatactgaaccatattaaattaattaatatttttttataattgtatagctgcaaaaacgattatgatctttgttgcaaaaatatgtcattaatgaaggatattggtattgtatcctctctgcaaaacttatgtcgcatctacaaatcacctaaggagaagaaatatggaatttgcttttagatggatgatgggatggtgtctcgctaagcattgtgaggctgagtttaattttcacatgaagcttcctgctcaattaacggatgcagaccgatgccacgcttgactgcttaccggcctcatctttttcttaagcatcttattagccaaaatttgaatttttaatcttaaatttggagttgattttggggtttttttcatctaaatttatttttcagcttttgcttttaaatcactaagaacacgtatataaaagttttatttacaaattatttttagtttacaaatttattgtttcgaaacgatggagccttgtagatgtatacatgtaggacccacatgattcaatgacaaatttatgtggcatggttcaaattttccatatattgtatacagaccccaaaagagctacagtacaaatgctaccgcacataattctgagagcacctatgtgttccaatctcattcaccgctgttaattatatcggctgcaatgatgatggcatcaaacgaattagaatgcagatgcctcgtggccactcagacgaagtaaatctctattacgattcactaattacttagagaagggactaaacaatgcaattagtcttgagtggcattggaaaaaaaatatatagcaccatggatttacctagatcgatcggaaggggcatcacaacaactcgataggaagggggcatcatgatgatcgatggctcctttcctgacagttagcacctagcgagttgtactcgtattattcaagtgatgcacggagattaatcgcagctcctctttccaatctgttgagagtctcggatcgatacagaaacgtgataaactgcgggcctagctaagacataattacgtggattggaaatttttcttttaccttaaaatttctatgatttttttctaatttatttattaatttccttaatattaggatgccacgtggtggcataggagcgttggtaggagtgccacttggcggcataggagcgtttgtaagaagttttatgtaattttagtatataatagattcatttttttaatttttaagtaatacttaattactcaagtgttttgatgtgcttgtcagaggagaaatgttcccaacatgcaccttcaaacacagactactgtccgattgtaacggaaagtgttatgaactgaaagaatatccgctcatcttatgtataccatctcaatagttaaaaaaaataaaaatttggtaggacatattaatacacaatatataactccacaaacatgcatgcaaattcaaatacgatttcagtaagttgtagcaaaaaaatatatatataactgtgaatatgtatacatactcgtcagaatttaatttgactttttttaattaaaacttatagaactcatatttgaacttacatatatttttaaaaattacacagtacaacgcagacactcacaatgcacgcacactcactcatatgaacgcaagcacgcaaaccctactcctatgagtattttcgaagactggaccggcaaattatggagattgacaaaatcaccacaggtgtctcgttgtcgcctaccactaaaagcacaaagccgttaaatcctgaaaaaatcgctcccatagagagtcgaactcaatcttttcaaatatttattattttttagaattatttagattccccgttaaccttcttttctcaccggagaacatagtgatgagcttgaggctttcatggcggcaaacaccgtcattaacaaaaccaaaggtccaagaccatgcgcataacgccttcacatcgtgccattacggcgcaacggcgtctaaacaaaacttaagatgattcagaatcgtattgtcatcttccagattgtctagaagcatttcatcgctactcgttatgaatctcattctccctttattgcacaaaggaagcagtatatgtactttatatcaaccatatgcctctgcaatattgcacacttacaaagccagaggcagcagcagcagcagaaatggcagtacggcacagccaacctgacgacggctcgatgcacccgcaccggcggcgacgattcactgccctctgctgatctggcaggcctgcctgagaggcaccggcgggtcggagagcttgccgccggcgatctggtcgaacacgaacttgttcgccgcctcggtgaagtgcacgccgtcccagctcacccgcttcagcgggtcgtcgcacgacttccccgccaccacccacgtcccgttcaccttcaccttcccgccgcacccgaccctgtcgtcgaagtgtacctcccgccgccgtagccgcagcacgtcagcatcgggtcattcatccctgcagccacaacacaacacatcacgccaatggcacgggggggattgcacgagctcgctaggcacaactagctaagctttaccgagcttcttggcgtcgctgatcagcttgtacttggcggagtagacgtcgacgtaggtgaacgcggcgtcggcgtgggtcttccggaggtggcccacggtttccttcagcctctggttgaagagctgggcgacctcgttgtaggcgacggagcagccggacccgtccttgacgacggcgaggtcggggcggtgcaccatggcgtaaggcaggcagccgatcggccccgtgttgtgaatccagaagtaccttcctccgagaccgtacacattctgcaggttaccaatcagctcatgtatatgggtgtgtttagttacaaagtttttttttccaaacttccaactttgcatcacattaaacctttcatacgcacataacttttcagtcacaccgtctccaatttcaaccaaattctaaactttgggccaatctaaacacaatcatatgtgtagagttccatatttcagttcgaaattttctttttggcaacttcggtcccccgataggaaactattttagaaaaatattcaaattatttcagactagaatattctgaaatttctgcaatttcaaaaaattaggatcgatcggtacccctgtttttttttctttctgcaatatagaaccctgcatgtatgtgctacactactgctgttattagcggagaagaataatttggtgttcttttgagttttgaagaaaatagtaggagtattgtacaatctctgtacctggattatgttcgtgagcccttccattagatcagggatgtaagctatgacttgttcagaggtcatgtttatgaagaagcctgtggtaatgtcattctggccgatatcgaatgtgtagagcgcctgagagaagtattcagccttgggtaggagctccctgtagattccacctatgtgaagaaatggagcgaaacagaacgtgattgttgggttcaacgtggtactgaattactgacagaaatggattttttggttttcttgtcacctttgttgttatagacgaactggcttctgttgatgaactgttcaaactcccaggactgcacgtccaaggaaatggggctgaaaccagagaggaacaaagatgtgttctgccttctgattgacgacccggccgttgcaaagttagcaccttgtgtgaagttacttcctatcgagttgaggtacgcactgaggtaaggcagtcccaggctttcagctgcagcatcagagagcaagagtgtgtgtttacacagtaagaatctgcatttgatcgttcaaatagcagtaatctcgttgcatttgatgatttccgaagagtgtgagttgaagcctgaagcttttacaaccagcaccaaagctatagcacggactgccatgcatcacaaagttaaggtacatggcgaatggttcaaataagtttcacatgcgtctctgtcagtggtgttggtgacgacaagaacccgagttcagagccatgtgcaaatggttactactccagttcatggtttctactgctgtgtactactcaactattcttgcggtcctctcccaattagccaggacaactttatgctaatgccaccactttataccagaatgcttcaactgcaatcagaatttataaagcaaaacttccacaatctgcagcgaatattgcatagcatggcatatatgataagctcatggctgttttgtctcccagtttttctggccagcgaccactaaaactttctaaaagaccccttagggccaccaaactactatcttaaggtaatgtttctttctgtctctcgtatcaaaagctaaataaaggaggagtatctgatatattccccagctgcaatgcaacatcctctctacaaaatctccccgcgaggatcgcatggctgatagcagtggcgtgaccgtatctagagatgctttgccgcgagttactggccggcctttcgtcggattgtggggaatatatcgagatcgtgtcggcgctcggcagcaacttgttgcagtaacaataataccgtgtaatcgatgccatcgttggcacggacacacgggccgctcgtcaataattatggccatggttgggttggttctttttttttagaactgttgggttgggtcttggctggttgtagccagcttgccggatatcacagcactagcaatcaatcagtacgtgaaaatggtagaccttctctttcttttgcggacatttgttctaaagcaatcgagcaacctgttcagacgttcgtttttacttttaatttgggcttaaccattgcgagacactaaaacactcgagcagcaaacgctgaaacatctcgtgtctgcaacctacacatggaacgaattaaagctgatatttattggttcagagtgggagtaggtttcagttcgatcaagtatatgcagtcaaggctcaagggccctacgtgcagtcgtgcggaagaagaggcagtgaaaagttgataatagaaagaacgagagaaggttaattagctgattaagacgtgcaggggaaagaaaaagactctggttgcagtgattcagagacgtacgtaccgatgaagtcgatgacgaggcggccgtcgcagtagcggccgacgggcatgccgaagaaggtcctgccgttgggcggcggcgcggcgccgaaggtggccgacagcccgcccgtgtcggagttggagtcgccgaagttgaacacggccgggaagcggcagtccgcgccggcggccactgagacctgcgacaccagcaccagcacggcgacggtcgccaccaccaccgcggctgcgtacggaggaggcgccattacccccccaccacgcctcgttcgcgcgcgcggggcactgcgagcgagagcgacgacgagcagagcagcgtgggcggaagacgaggcggagcttagcagcagtggcgttggcgtggcagtgggcggaaatggcgaatggagatggatggttgtggatctgcggatagagataggcgggaggcgggaccgcgcgcgtgcgggagagaacggtgggagaccccaaacgcgacgcggtgccgtggacgacagcgatgggagggggagggcgcggtgggatggccggatgggtcacactgactgacgagatggccgtggtgtggtatggtgtggtgtggtggtgcgcgggcgtgggcgcgggtcgcgagcgatggtggagtggagcacagcgcacggtgtgccggcccggtggcgcggcgcacgggacgttggatttttgttgctgtgggttcgtgggagccgcgtccatgacgccgcgctgcctcgtcgcgcgcgcccggtggtggattcgcgtcgcgtcgcgccgcaccgcacgcgaccacgagccgtaacggagatttttctttgctctacgtgacgctttggaggcggcggtggagtggcgatcggcctatgttacatacatacgcgatctaggcaaagcgtgatccgggcgcgcgtgtcatcaatgacggtacgtgaagtagaaaacagggaagcatggccacgtggagggaacagatggg

SEQ ID NO: 10754 - DNA, 1732 bp, Oryza sativa
accataaaaccagaaatatatacccctaaactcactcaaactgttcaaaggaggtcccatgacagtatcgactacccggttttgctgacatggcatcctagtcagcaaaaaataaaaaataaatatgtgggacccacatgtaagtgagaaaaaacgtggggtcaacaatcctagtcagcaatctccttctctttttcttttttctcttcttctctttcagtagcggtgcgcggtcggaggtaggcggagcggcagcagcaggcgagcggtggctccgggctcgggaggtggacgcataccgctctcaacactgatccggtcaaatccagaagcggatgcagcttccgccggtgatgccgatgtgaagccatcatcattctccggcgatttggggttcccctcaccattcaccatggtggtgatcatgctctcccttatgatagaggcgtcatcatcacatcccctatcgacgtcacatccttctgcgatcgcaccgctctccggcttgccgtcctcatctgcgtcggaattgatgcggcttgacgacggagtggaggtaatggagcgtggcggccacgtcgcgagcgacggcaaggcagcggggccactccaccacgagctccgagcagcgccaccccagcagcgcgtcctgcagcgacccattgggtatgcggtcgtacgctagcatcatccgccggggccgcccctcgccccgcgccgcggacgacatcgagtacgtgaacggaagcagtatggagtcccgccccttcccacccggcttggcggcggcggcggggacaggaggagatcccggtgcggaggacaacgcgagaaggtgggacgcgacggcgaactcgttgtggaactcccgctccccctgcagcgaaccagcggcatcccagcaacccaatccaacgggacgcaccggttgcttcttgagcagttacccaaagaggaggacctgctcgaccgtcgtttcgtgctacgggaggcccgcctcgatggcgcttgcaaggagattgtgttcctctaatgcatcttattagccttccatgcgcacccatcctcgtcctcttccactccgcggtcacgtattgtgaggcgacgatgtgccgacgctcctagatcccatgcctcgtgtcactagtctcgttgttggtcatgctttgggtgttgcggtacaaggagatcgagatagagggtctctccaccaaattgatgggccggtggccggttccctcaccatcagcatccgcctcctcctaatctcagcctcccggtcctatcccctaccgtgaagcttatggtgttgatgcttcgctgcttgctgcctcatatcccctctctccccatgccatggtggcaatcgaggaggccatagggggagtgaggaggcccaggtgagaagctcctcgtcgccttgccgaccaccgctttcaccttcctgtcgaggagctagtaagctcgagctcatcggccactactattgatgatgtccatgttgagataaataggaaaagtagagaaagggaagagatggaagaagggatgaatgttccactgacacgtggggctattgtaatttttttatttattttggtaggagtgccacgttgatgccacattagctaaaaccggacataataatgttttgggatctcaagtgcaccagtattgtaagctgagacaaacactatatctggtataatacggttcaaggatgcaatttaaa

SEQ ID NO: 10755 - DNA, 1622 bp, Oryza sativa
gggggggtgtctgaagaagcacttgatgattatgacagcctgagtgagaatgcacttaatgattatgaaagccgaagtgaggatgcacctgatgggtacgacagcttgagtgaggatgcagcgaatggttacgacagcttgagtgacgatgcacctgatggttacgacaatccgagtgaaagatgcaccttatggttacgacaacctgagtgaagaagtaatcaaggatgtgcaagttgagcggcatttgtatccaaggctttgacctcattagaagaagcggtccttatgaagagcagaatcaacaacctgaaagagcttatccagaaaatgatcaatggacccattcgttttccacaaaaaagttaggaagcaatccacatgatgaacataatggaatcaacaatatgaaagatcccattcccctctctctcgatcaatagaataaacaatatgaaagacccccctctcgatgagcagcaatatgaaatatcccctttttgataaacagaacataatcaacaatctgaaagatcccatccccactccctcttgatgaatggaatcaacaatctgaaagacccccccctcacgatgagtagcaatatgaaagatcccctccttgatgaacatgacataattaacaatctgaaagatcccccttacagaatcaacaatttaagaaaaataaaactgtaacgatttgttattttcacctttacacttcttacattttataacctttttttttgactatgagactgaccttgctcaattgcaatgatgatgcaatgatatgagatgtagtagcataaataaaagaaatgttatctaggatacaatgctctggagtggatatattgcaaggatatcttcaaaccaattgtaagaaatattgtacatgatagctcaaggggatacaatgtttgtcttgtcgaccccgattttggaaatcggagatcttctgtgtttatcagtaccaatctctggatcagaagttggtacacacatacatagttgaatcacaacacatcacgaatgctttttttttgataacaaagaggcagaagcctcagatttaccaaggaagaactgggtgaacaaccagttttacataaaagcccctaaagatgggcaaattacactggaggatacacttatgcagtgaaggacaaaataaagtttgaaaaaagccatcaggtcctgcacaacaaactgctcacaacagagatgaagaagacgatgctccaggcaacggcgggtactgagcgctcacgataggttgcagaagattgaaccatggcataaacccagttggggcctcacaaaggagggttaaagccttggtttttcacatacaaatacaaccatatcttaaatgcttatattagggccagccatgccacacctatcagagaacaacagcgaaagataaaataatacaagtgcccaattaccatgccacaagcagtcgactgggaacaagacctagaacggaattacactacgatcatcttgttaggtatgcaagcgcactgacaagggtttctcttcaagccctatgctatatatatatatatatatatatatatatatatatatatatatatatatatatatat

SEQ ID NO: 10756 - DNA, 17345 bp, Oryza sativa
  unsure (1)..(17345): unsure at all n locations
tttggaaatcggagatcttctgtgtttatcagtaccaatctctggatcagaagttggtacacacatacatagttgaatcacaacacatcacgaatgctttttttttgataacaaagaggcagaagcctcagatttaccaaggaagaactgggtgaacaaccagttttacataaaagcccctaaagatgggcaaattacactggaggatacacttatgcagtgaaggacaaaataaagtttgaaaaaagccatcaggtcctgcacaacaaactgctcacaacagagatgaagaagacgatgctccaggcaacggcgggtactgagcgctcacgataggttgcagaagattgaaccatggcataaacccagttggggcctcacaaaggaggttaaagccttggtttttcacatacaaatacaaccatatcttaaatgcttatattagggccagccatgccaacaactatcagagaacaacagcggaagataaaataatacaagtgcccaattaccatgccacaagcagtcgactgggaacaagacctagaacggaattacactacgatcatcttgttaggtatgcaagcgcactgacaagggtttctcttcaagcactatgctatatatatatatatatatatatatatatatatatatatatatatatatatatatatatatagtaacattgagtacaaaagtactcagcaattcaccacacaaaatgcaacaatgtacaagataatacaaggagtggctatggttattttgcataaagctaagttcacaaatatcatttcacaaacctaaaacttagcattgactactcattcagtttcacatgggttataaggaaacacaacgtcgtcttcttgcagttaccacttgctaactgatgtgtttgacattgtgcttctatttcgacatatagatgaccttttgttgtcttctccagggtgatatatgtggtcattacattacttatcagattagttaggttcagtttaatggtaacatgtcgtgtttatgtatctctttagtactccctccgtttcgaaatataagaagttttagggttggacacagttattaagaaagtaggtagaagtgagtggtggagggttgtgattggatgagtaatggaggtaggtggaaaaaatgaatggttgagggttgtgattggttgggaagagaatgttggtagagaagttgctatattttggaacgaattctgagggctaaaagttgttatattttgggacggatggagtaatattaatctcctttttcttaatattgaaggattactagccaagtttgcgcctttgcggtgctacttaacattgatgcaacacagttgatttgatcctgttccgctagtggcagacggtagtttaaccattcggtgcgtgtgtttaattgctgaggtgtacagatgtataatataccaaaactattttttcccatctaagttttttctactttcaaatgtgtactaaagcaaacttgcatacaacattctgtgcatacgtgttaatggtaattagtactcagcacgtgtcttcaacatgttatagcaatcatgcttaattccacgtttaatttgtaattttttggagccagtttgcgcagttatgtttattctttgttcattggcatcatagaccagcgcaacgcaggtccaaagattaatgagatgcggacgtgtcagtcagtttgatcctgcaactgacaagatatgtaaacagcagatcaaaacagccgatcggctgacaagccgatggagtagttccagccagtagccaataatagccgatgtcgatactagccgatagcgatagggtttaagcaatcggctatatgtccaatgtagataacgatataaaggcaatcagctgatgatgatgcaataaaataacaatataatctagtataaaccaatcgactagcaatgatatgataaataagcatcgatccgaaggttaaagcacacatcggctggaggtccgatgtcatgaaatccacaagattagattaaacagttaaacctttgttgtcatcggcgaaatccagcttatatgtatgtgcaatccttatgagccaatacaacgtcctgataactcaccggctgaaaccccgatgaaacccttattggcaatcaagaagcaggctagagattatggttctaagaacgacttagtagatcaaacttaactgatgcagcactaagtatgaaaagaaacataatatctagacaatcaagctgttgactgatttttagggtggtagatgtctgagctaatctaatctagcaacgcgatttagtcgatatcggtagaaaccctaaaacgagaagcagccgatagagctaaattgatatgctaggactagattaatagagacatatgataaataggtaggcaaatatatcatccaaaccagagcaatccaagaggtcgaatgtactgatgcagctttgaatgacgctgatgtagatgagacaattgcctgggccgacggaacattggacttatcccttcgccggagatcgaagacgatgcagccccgcgtcgggtgccaagttccacagaaacgtaaaaaacaaaagtagaagtaaaaagggtggcgatgcgccgaattgtattgatcgtagattgatagattacaatgaccccgggtatacatatttatacctatagggagatactagtccttgtcggacaagaaagaaactaaaaaggaaaagataaagtccttatcagacactaaacatactttcctaaagataaaaggaaactaacaaactatacctaattaatagataactgtcatgtcgtatccttcttgaactcgaactcttctagataagcttcctttgattgatccgactccaccaagaacacgacatcgtggcgacttgactcccatcggctgattctagaactttgaagccgatactgactctaaaccgatggtaactttgggcttaccaaacataggtgatatatagctcgaagcattatcttttttgataaaaccgtttacacatgtgttttttttaagatattggctacttaagataatcttaaattttaccgataaagtatgtctctagggtctttgatgaaactgtttacacgcgtgtttgtttgagtgaagacattgctattcaaataatcgccagttctatcgacatcgtgcaatcaacctctggctccacgctttatagtctactccctccattctaaaaataatcacttatccaatttcgttgattctttttggataaagggagcaggactcaggtccattctaaaaagagtcacttatccaatttcgttgattctttttggatgaagggagcagtacttaggctgagttcttttgttcactttctcaactcaactctctcattttctgtacgcacgccttttaaactgttaaatggtactgtcggagaatgaactcctccaccagggaactgtgaggcccccctttgtgagttcggccgggggcagcgggtgagattcaagtgagattcgagggcttggtgagcggagctgcgtgatcttgagggggttaggcccctccaagacgatgagacaaaaaagatttatataggtttgggccgctatgaagcgtaataccctattcctgtgcatgattgattgaatatagaacaccagtgcttggggttgcgagacccaagcgccagttcgctcggaagtcccccctctccaccactaggcctagacctccttttatacctcaaggggttaccacatgggcctaacaacctaacctaactccggtggagaagtattataatttttgcattaaatgcatgtcttgtcttttgacttgggaagccaagcacacgtcgtcttgatgatagggcctgtcaaatcttgccgcctgacacggggggtgcccctgtcagtcaccatttaatgggtgaagacttctgggctcctattacactgggaaacgggagccttgctttgaccagagcgggaggatcgactccggctgggataagaggatgagaacctctcaccatcattacattatttgatgggatatgtcgggctgcacgtcgcctgacacacgcgatggtgcgcctgacatcttgggtcccatcagtcattcgaccggtcacagacctgttgagtgcactgcacaccgcattaaatgcggcgtggcgcgaccgctcgggacgccataaatgcaggtaggtgggcacctggaagcggacacctaacccaccgtacgtggtgacctagagagggggtcgggggagcccgacccctagtcacgggagggggcggccaccgcccgacctcgggcccgatcccccctcggaagggggggggagggagccacgtggcgctgggcgcggccttctccctctagtctcggccagggagtggtcccgccctacctcgggcccgacccccctcggggaagggccacgtggcattggagggcagcctcctccatccagtctctgggaaggagtggccgccgccctacctcgggcctgactcccctcggggaagggccacgtggcatcggggggcagcctcctccgactagtctttgggaaaggagtggccgccaccccacctcgggcctgactcccctcgggggagggccacgtggcatcgggggcagcctcctccctctaaacctaatactcccgggcccatatcaccgacaggtacgtttttttaaaaatttttctataggacaattgtttttaaaaaacatattaattcattttaaaaaattagttaaaacttatacatcgtttgtatgccctcctctcggctcctcccaaacaaagggcccgtttggggagattaagattatgagaagcagctggttggtagccagtatttgaaaatctgaaaaagctgggcttttcaacttccgacttctaatttattttctggattctataaatacaacctctcaaaatttaaaccaaaaagctgtaccgtctcgaaagcttctaattatgaagaaactaaagcagcaagctcccaaacagacccgatcctcactcgagtcgagtctcggtggggaggcccagaagggtcaagaggtcaaacagccaccggttcgcccaaaaccacgtacctccccgtaggccccaccctccatagaccgcgaaccgcaccgagcacatcccatccgccggtctccatcgccctaccatcccagccggtgggcgtcccctcccgcttccgctccgcctagcccaaagctgcgcagcaccctgaacggcaccacaccacggaacccctcaatttccacgacgcttcctaatcctccctcctcatcaaagccgtcacctcgctcgcgtcggcggcctcgactcccctcccccaaatcggttcccctccaaaaaaaccaaaccctcaaaacccttgcctccgctctctcgcgcacactcgtgctccctcctccccccatccatggctttctcccccgcctccgccgcctccgaggaggaggccgtcaaggtgaggtttcccccgctggcgtcgtggggggtgtaggggatctcccggtttgggcgtttttgttggtggagttttggggggactgattcggggggtagttatttggggtgcaggcggcgaaggtgctgatggtcggcgccggaggcataggatgcgagctgctcaagacgctcgcgctctccggattccgcgatattcacatcgtaagttttttttttttttggcttgctacgtgtttgcttcatccccttactcgcggttaaatttgagctgttcctagggttttagccgtgtttcgtgaattgagctctggtatcatctaggtagatgcacgtggattgctgggtgtctccagttaggtagttgcgggatctgtgatagggattggaggatagcgttgaccccagctgacaagtgggcactgtgtagagtatgcgtgggttatccggtgtctatctggagttttttacttagtgctgatgtttcagtatttcttagtttttttgtgaatcagtagctttgtgtattgtctattgtttcaccaattagaaccatgaataaacaatccgtcaggaactttagtattctttgcaaccatgcttggcagggattgttttgtgtaggtcattcttgttagaattcgtcataaaagttagtcgatatagcggaacgacgactaaccttcctgatcacttcagtcattgatcgcccaagacacgccagatgacgacacaggaacacacgatatttgttaacgaggttcagccgaagcctacatccccgaggctctgattatgggcgctcctccccaaccaatatagctcctagccgctacgagtccatggtcacgccgccatcatctccctgcgtgtctacgctacattgtagtcgccatggttacattgtggtgcgcccctctctatttaagagagatgccgggttacagagttcgactctaactccaccccctaacacctattacaactacaagtccaactgtaaccaaatagaactagtatattcgacacctattctaacagaattgttgctaggttcttactcttagatgaactgttatgctgctgcccttgtttcgttcactgctgatatgaaagcctccattcacatgacttcttttgaggttgatgtattgcacttggaccagtttggaaatagacacggtgtattctttgttcaggtatccataactaaatgaaatggtatttgaggcacctaagtttgttatccacacaatgccgacttggctgctattgatttctgatgattttcttttttggactgacgtttgtagttatgtttacaaagaaggaaataaaaccttttctaggaccacatgtcagtatggtactgggagataaattaaatcctcgtctattattttcatttcttttcatattttatctgcttttcgtttttttcttcactgatccgtttcttgcttctgacatactagtttacattacattgtcaaagggtcattttcccttggtgttgatggagctaatgaaaaaaatatcttgatttcctctcaaagtgttgtacacaaggaatttgatctttttctctacagattgacttggacacaattgaggtgagcaatctgaacaggcagtttttatttcggcagagtcatgttggacagtcaaaagcccatgtaagttacatttctatatgttgatatgattaacatagttgtatatgagctttctattatgtatgtatttgctgtattcaccttattattgctgctgcttattctgtttttgtcattgatcttgtcaggttgctcgtgatgctgttctgaaatttaggccaaatatcaatataacatcatatcatgcaaatgtaaaggacgctcaatttaatgttgagttcttcaagcaatttaatgtagtcctgaatggccttgataatttggacgctaggcgtcatgttaatcgcctttgccttgctgctgaagttcctttggtggaaagtgggacaactgggtttttgggacaggtgagttaagaaagtaccactgctctggtccccgtaactcttctgcatgtatgaacggatatataatacactctggcttatcttcttcgtaatctgtatggttaataagatttaccagacatacggccttctagttgagtatgttttgtgcacttaccattgttcactgtgatcatgtgggtccagagggaaagtgtggttgttacttaatcaggccgttttagtgcaaattatctaatgttgatcatagaacaggttttctaccttctccacaaagttcctaaaataatatggtcatttagacattatccagccttatttacaatctaactctttatacagctcaaatcaactcctggtggtagcttggccaatatttggtgcatgttcatataagctgcacaccttttaggtagttacgtacattgcatacagacattacatacttttgaagtgcacatgaatacatgatgtatatcatttgttggcctgtgatgcatgggactctggtaggcaaagctgaagagttcttttgtgtaccttgatgtattgtgtttattatcttgtgcatgatgggttttttgtggtctagaatctagattctgggcttaacaatagtgtcatttaaatcatcttctttatttttttatcacgtatatgtcaacaactaactgaaagaagctaccagtgttcactaaattaactaatggatgaatcgacctcggtcaaattattctgtttattattatattaggccgcaggtggtagaatccctgtctcacgagcaaaacagccaagtaagctaagtctatattttcaagttaattctcttctaaaattatttccattccatattttgcaggttactgttcatgtcaaaggtaaaacagaatgttatgaatgtcaaccaaagcctgtccctaagtcataccctgtctgcacaattacaagcactccatctaaggtttccttttgtcccactttcctcctaattatatccctctactgtgaaaatattagtttggaatgcccttagtcaaagtgcaaacctataaaaatctgaccacttgtgggcatattattagaacttaccacatagggatatttttttatttgtattaataatacggtatttcgtcacatctttttgtattcttttactaatgtatagtctatacagttacaataaactgatgttttggagtatgcgaacaaacttcataaaaaacagctatcagtatctttggattttcagattgggcttacagcaacaaaatgtgcaaatctgtccaaaatgtacctctgtaacattataattttaccttattttataaatataatggagtctattagtcaaagtagttttgaaggatccccccagtgtccaaaggccacctatttgcgactggactggaggaggtaaatagactaagtagttgtcaaggtgtgcattggaaactgtgtcaatatccaaaatggcaggtcacgttgacaaattaataaagaaagaagatgctatctctcctatgctctccatatcttcagttctcccatccaaatctatggacatctcactgttaaaagtgttctaatccatacataacttgaaaatcctcaatatgcagaaggcattcttttaacaagcacacactccgctttatggcattttttgtaattaaaaatctgaacttgacttcttgtgggaatactctgtgaacttgaccatttggaacaagcactgtgctgctctgatcagtttttagtgttagaattcattactgactttttcttttcacagtttgttcactgcattgtttgggcaaaggagttgctttttgcaaaaatgtttggggataaaaaccaggacaatgatcttaatgtccgttcaaatgaaagcggcacttcgaaatcagatgtatttgaaagaaatgcagatgaagatcttgatcaatatgctaggagaatttatgatcatgtctttggttacaacatcgaagtggccttagaaaatgaggaaacttggaagaatcgaagaaggccgaatccaatatacatccgtgatacattacctgaagaagctattcggcaaaatggtagttcacgggacatcaataatgagcaggaagaaccatctgctatggtctctttgggtcttaggaacccacaagaaatttggagccttgctgataattcaagggtatttttggaggcattaaaactattttttgaaaaaagggagaaggttgtattttattcggatctaggttatgtaacctttaaagttacttccatctgagatattttgctcttctggttttcaggaaatagggaatttagtatttgacaaggatgatcagttggctgttgagtttgttactactgcagctaatatcagagcctcctcttttggaatacctctgcatagcctttttgaagctaaaggtgttgctggaaacatagttcatgctgtggcaacaacaaatgctataatagctggtttgattgttattgaagcaataaaagtcctccatggtgattacaaaaaatataggtgactaggctctttgtttgtttcatgtcattgttgtagcatgtacttcttttttttcctaaagatagtaaacttaagctaaaatacctgctctctggtcttctggatatggtaatgtccagagagttctaaggtgctgccaattttctggaatttaatggcacttcattggctaacaattttacagaatgacatattgtcttgaacacccttcaaggaagatgcttttgatgcctatcgagccatttgagcctaataaatcatgttatgtctgctcagaggtatttttgcactttcttgggctatgatattcgtatgtttgttcgctttctttcaagtctgacccaaaactgctactgaatgcatcagacccctcttcttctggaggttaacacaaagacaacaaagctgagggaggtcatcgagaagattataaaaagcaaacttgggatgaacctcccattggtaatgattggctccactcttgtttttgaggatggtgagggcttagaggaagatgaggctgcaaattatgctctaaaccttgaaaaggtactaaccttcccccttcaaagcagtgaaattatatcctccatggaatttctttctttctaagctatggcccttgcagttgcaacattgttaaaatactattcattttttgccaactgagctttgtctggttattacaggtcttggctgaacttccagctccagttgttaatgacacaaagcttactgttgaggattttcagcaggaattgtcatgcagcattaacattaaacacaggtaacctatgaaccatgtatgctgatctgtttgcatatgggaggtctttctaaatgatacttatctatatgtttttcacatatatttcaatgaagagaaatcctttgccgtccaactatcttctcaaaaggttgggatcttgccagatgtaaactaaaaacagacaattttgcacaagtgaaaatgagctgctactaatttgctatacatggaccagtggtttttcacctttttcactaaagttatcatttgcagagtattatgatgtcacaacttttagtttcataaaatgtcctctacgtataactttgttctaacatgtaaggttgtttggctcattccattacatggatatacagtagcttataatgctgtgctatgtagatttggaagctatatgttatgatagtgtcgtagtgtacacatacagttgcctactctttcaagggggtagactgatttttcagtgattattacagggacgagtttgatgaagaaaaagagcctgatggaatggttctatctggatggtctgctccagtggagaagcaagttacgagtaatgggggaaaccagtcggttgcttcttcatctggtgcagattatgctgacggtattgttgaggacatatccactaaacctggaatgaagcgcaagctggatgaggttttagagttgaaggagaattgcgatgcatccagtagtgctcaagttgtcgaagatgacgatgacgacgatcttgttatgcttgatgagaacccaaagttagccaagaaaaagagattgcaatagcaacccctacggtatctgttccagggataacagcggttgacttccgctattatggctaacacattgttccaacgtaacatcttttgtaacttaatgatgtttagggctgataacactgaggtatcagtaagcgtactcagggtcatttttttgctttagatacggtactttaggaatgtaatttgtagcgtttaggcacaggagtgactaatgccctgctgacagtcagctgtaaggctgcacctgtgtttgtctagactggagcaatggtgatgttcttgtctactttctcgtttctgctatgcggtgatatatcttctgattgttttcatggttccgttgccctgatacgaggaatatattggtggatttagacttctatatagtgctcaaagcctcaaacgtcacaagaaagcagttcccacctgtgctacgtgttataagcaacagcaattttctcctgctgagttttctcccgttaagagatgcatatcgttcattaggtcttgagagatgcagatccggcccagttcttttccgcttaatgcatcaattgactctggtgtaagaactttatatataaataaatactgttacctcttcatcccttgtctatcactaacatccatatgattttagatgcatatgggttcaggtaaaaatctatttaaaatccaaaatatcttataatgtgaaaaacatcttataatgcggaatagaggggtataatagttaatccatgtattacactcgaataggtacatctcctcagccatccatcatagaacacaattaaagttgattagtaggataagcatctatattaggttcaagtagaggttgatcctaagatgaattcctttcagatgaaatgtggatgaaatctgagtgatgatctccttatatttgtaaggtaaaattaaatatcactcctatgttatgagtggtagtaatgttgatggataaagtttatttttcagaaattgtatttttggaagtgttgtgcaaaggcaactgatccacagataagctgaaagtagacctatggagtacttgagacaaacgaagatgaaatcacaaacacaagggaacacagtagggctcaattttttaataggaattgatcaaacctgagtataaggaaactagaattattttcaactagaaatcgaccaaacctgagtataaggaaactaaaaccgaattgcgataaaaaacagatatatcaaaaattgaattgaatctctacgaagtatactagtattccaacatctctcgttttctatcttccattcagcaatgcgatcatcatatcacagttgaattgaatcaatattccaagaacactaccccatccacaagaggaaacctacaactctgacgccgcaattccccaattcagggcaaaacactcgtctcacgaattcgaaacaacaaatcaatcaatcaatcaacaaaaaaatcaatgcaggaaaatccgcgctagtttccggccaccggccgtcctcgcgaggccgtcgacgagcgcggcgcccctcaaatggcagacgagggcgcagaaggcgatcccgagcagcagcgccgcgagccgccggagcccgccgcctcgcctcctcctccctcctcctctcctccacaccgccgcccacacgccgagcgcctcgccgaggcccgacgcgttccagtagtcggcgaggacggccagcttgtcgccgagcgccagggagagcgccagcgccgcgagctcttccgccggtgttgcccttctcctcccccttccccccatcccgaaccattccccaccgcgcgcgcgccgctgaggaagaggacggtgagggggcgcggccgcgggaggaggcggcggagggaggacgagacgaggcggcgcancggcggcggcgggaacgcgacgggcttgggcttgggcttcgatcggcggccgcggccgcgctgggcggcggcgcgcggggtgaagctaacggccgtggaggcggcgagggggaggtgcggcggcggcgtcggcgtcggcggcagcatcatgtcgttgcgtgcgaattgggtggagcggatcgagcgggagggggaggaggaaggcgttcgcgtgctcctctcccccgaccaatttggatttggaggacacgaattgcgaaatcgacgtgtccactgctgctactgtcgcgctctcctatgggtgaaggttcattctctgctcagaaattcatggctcgctttttaaactgctaaacggtaagttatgtgagaaaattttatataaagaagtttctctaaaatattagataaagggtgtagctatatttatggcgctatattttttatcaaaaaatagtcggcatgtatttacattgtaagtccctaaattacatatgtaattttagtgtatttacaatgtaagtctcaaaattacatatgtaagtactaaaattacatatgtaaattcgaaaattacatactaattacaattagtatgtaaatttgtaaatgaggtgtaactactgtgtaagtggctgaaaaaaaatcgactgtagcatatggcgccatatttctagcaactccgtagataaatatattttcaagtttgtaataattaaaactcaattcatcatacgttattaacaactcgttttgcgtaaaacatttaatcttcatcttcatctacattagtttcaaacaccagcattgtatgaaattctacaatcttgcttgaagtacaaaatcaaataatcatgaaattgattggaatttggaagagtgtatctctttgcactttgaaagcacaagtttataaccaatgccctatggtgcattagatggcaaatgcgcgatgttcaggtaatagaggttgagtccctaaaaaaagttgtatcaagttacatggtttgtttgactgtctattttggtttacaagcagcaacgaataaccaatcaaaactcggggcaagaaaacagctttctttggtttacttttccttactgaaaatgctattacaacaaatgactgaatgaacgtaagcaattgagcatcactcatatcatgtctgctcagtcgattgagggggtccgacatgctctttggcctttatgcatcgcgcatctctttctccctgcaattggctgattcttacaaggagaaccatccgaagctcgagcaccacagattgatggccatcctgagcttccggaaaacggtacagaggaagcatcggtgacctttattccttcatgcgcatcgcatctttctcttcctgccattggtattgtttcacggcatctgttgtccgtcaacgcttcacagatagctgcgacattgcctgtcactcttttctgacgtccctggcctttggatgacagtgtgctggtaggattctgcaatttgatcagctcaaaccacattcttccggaaggctgattctcttgggactgatatttaccatgagaaatctcctccccactgagcttgtcaactgtcatgcttttgaccttttcttcattctggagcaaatcaatgactcgagatgaaacaaactcttctgctttgcaaccattatgcagctgacattttttacttcctgaaattactttgttggtgcaggcagagttgtcactctttttggcttcacagatatcaatgacctcagaggtttcctgttttccatcttctataggagcttctccagtttttatttctttcgcttcaaagctataccatggtcttgatgattttttcactgttgctggcaaaaatttggagaggagttcactggtttgctgtgcttgatctgactcgctttcattttcagttagtggagatatggattcaacaactggaatctcaacttggcaagaatagctacaagaggagcctttaggattgactgtgattcttcctagtcttctacctttgtgtaattcacacctcttccttccttgtactggatggtcaagacaagaggagccatcttccagcatcactccacaaacatcgttagaatcttgttctggcatagttcttcgttttataacattgactcttttgactttgtatccttcagaacttcgacgtgcttgtttgccataactgttaccttcagatgtatttttccagcgaatgccaatttccttgtcaacattgtcaccagagttaactagctgaggtctgaagccaacaaatgttcgaattcttgggagcatatttttcataatgccagatgagacatcaacagacccatttctgcttatctttatacctgctttctctctgaacacttcctgtttgaagtgccgtactctgctaagcagagatgatctattgttgactgccccttgttctaacttgataagtatttcttcacggcgaagaccaccgttctgaagcttgttccatgcgtaatcaaacactctaagcagccgagcctcagtcttctcagcttcttgtttgttacccatctgtttatttgcacattaaagacacattagaaaagaaaaacgaaatccagtgctaattgctaaaagtggaattatgccataagattcataacttttttagggcacataatattcatagttgaccccgttgcttttgcaaaagctactaaagatatagtacttatacactccatccatcatagatactctgatagaccaaagatcttaactagttattaaaagtgataagatgaatctgagtgtccaaacatttgtcatgagcaaagcgtaacaaatcggatagctgttcgtgtagactacatgatagacaatgctggtgctgaagacaaaatgcatttttcagttcttcaaacttcagacttgggcatggtataatctcaaaatttgtggcaattgaccatcaacttctatttatttcactcaacaatttattcggacacgaagccattattgatctccacatgaacggtacagttcaactgttcaaggatccatttcttatctgaagaaacaaaaaacgagcatggaaagcagttttgcacttaccagagcacatcggaacaccaaggagtagcctctgacgaaaacttccctgaacaacccattccccgtcgcccgcgtattcgtctccgcttcgccggcggacggcggtgggttcccggcgtccaagtgcgatcccgtccggccgtactgctggagcctcgccctgacgctgtcggcctgcccgaggtacacgacgacgacgccaccaccaccggatccattccaccgccgagccgccctgataccctcgtcggaggccctcgcgacgcccagctcgtagaggccagggaagttctccggcaggttgagcaccctgtacctctggatcccttccttgccggcggcgtggtcctcccagtccgacggcccgacaagaacctgcaaccaggttggggaattcgatcgaggagcaaaaatcagatccaaatcaattcaagaactggcaacgaaatcggaggcggtagatggcaacccggggagttcaactcgactccaccggatcagatctcgtcagctctgcgccggtggcgggttggcaaggggcacctaacctttcatggggagaagagggagtcgtgcttggtgcgtgggtagtcctcccgcttcagcctcgctgggacggcggcggaggccgcaggcatcgtcgatccggtcc

SEQ ID NO: 10757 - DNA, 26966 bp, Oryza sativa
  unsure (1)..(26966): unsure at all n locations
ctcgggttctcttttgggctgggtttgggccctgtagcccgcggctcgatccgacccgggcctgggcgctgtttgtgttggggttgtgggaaacagcttttggccgtgtgcgctcggccgttggattgacgatccgatggtctggatgagggtttacctaaccgtatggttattgtgattatcacatgtggtaacttttcagtttggaaaaccacgatatacctcgtgataaccgcgcggtaatcgccaaactgcggggtgacggtaaccccacctcaaacggtttggtaaatcctagtccagatcaagagtggtggaaaaacaaagggggtttcatttgtcaggtactctaactgtccaagccattcgagctatagtgtgactgtgtacaactcgtgcggtaataattgtggtagattttcactatatattattagagaaaaatatgtagtgaaaacttaaaacttttgtaggatgtaaaaatatatgtatgagatttgtctacgtcgatatgaataaaagttttactcataatgacataaataatccgagacatttatttttctatgctatgatagtttttagtttttttccactataatgtggttttcattacatattttcctcgcaggggaattaaagggggcacattctcttcttttgcctcagattgagggagaaacatgttgagaaaaaattggtgacatgaattccccatgtccctcatatagcactttgaagtttgaaatgatagtttgtctctccctccccattttgcatggaagacatgcatgatgtagcatgttttctgtaaccagcgacggacatgaatttcctagttccgaacttacacatatatatatatagcttgtttggttcgtggccaatctcaatcaattaaaaaaattgtttatttctactagtagaatctgggtgagtggacgatttacattttatttactcttcgatattatcttccactatgatttaacgtcaatcattgatggtgatgtacgcgaaattcgatcggcacaataatcggtcgctgatttaagatattttaatttgtttccttggtgttttcaggagaagacaataactgttttgcaacccgttgaggcaacaatggttatgcatattttgtcaaacatatatggatatttaacaatatgtgctatctatgcctttaagttggtgttctaaatagttttcttgttgtctatgctttcaagttacgattttgtaattcgcagttgttcgacctgcaaggttgtaacatctgtaataattgttgtagcttttgtgaaataaagatagaaatgaatattgttgtttaaaaataatatagccatgatggggaggcctggcgatgagtctaggcaatcaatgtgttcaggtcttaggtccaagccatgtccacaacaggattttctctctttaccttgggtcctatagagacttttattgctttacttgaattggtaagcatcttcagcaatagctcctattttagagtccctaaaggttaaatgggggctgccctcatttcctcaggactctaagaatggttctaactccagcaacaacgtctatttcttagcccctatttctttttctcctctatttcatcttataatccatattttatgtttagtttaatattacaataatgtaaatattaatatttccaacgcatagaatttaatcaaatttaaattaataatttcaaacaacacaattcaattgaaatttgaatttttttttctaatatcacactgatatgtgcatatacgtacactagtgtgagtgcatggatgactcactagaatgctcgattagtgcatctgttgcggctagtagcagtagcagttcatccatcctacactcagtatccaatgatatacatgcatatatggatgcatataatcatatatgagctggacaatattaataagatatattatatccagtgcatacacaaaactgcatgcatatatgcaaggagatatagtagtagctccttctagatcagcatcaaatctcagttggccactggcggcagatggctgttcacacttaacaggaaccaaaccacgtctcatcgatatgtggaaaaatccatgcatacgtgcatccatgcaggtgaccaatactatagcagggcgatggccggattagagcagaaacacccgcaacaagacagtcggcagcgtgcaagcaatcgcacgggaaggagcacgcgtcgtggaagcattcccccgcgccaaagaaaactggataggggctggggatagagcccccaggcctaggggctgtaggagggaatttgggagccttcctactttagggccttaagtaggggccctgttgtactttatttttttagtctcaacctctcaaagttgtttaaggactgtatttaggggttttactgaagatgttctaagcattcgtggaaattgtactgcgaggaattttttttggttcattcctattcttaaccttgccattttttttttggcaacggtaagagttggtcattgcttttttttttggcaaaaaatagttagcctttcgcttagtttgctaccaaagtaagcaattagttgagcagtgtcaattttctttggctacaaaccaaataaatgactaatatttttgcactgtcaaatttactttagctagattgaatttggctacaaacttaaacagacccgagaactcaaactttcaaggaatttttgcactgcatgatgtatcaattttcccgtcattcgatttttatatacaacctaattctaaagcacaatataaaatctacagctgtacaatcgctgataccatgcaaaccgtgtcacatcagcatttcgtcaaccaggcagcaacagcaaagcgccatgaagctgcatgatcacgtaagaaaaatgtcatgaggataaaaattctacacgaaattcatagccccaagaaaacgaatttctagcatcttacaatcctgcgatgaatccacatttgggctgaggatgctccggcggcgcgggctcgtcgtacgccgccgacggcggcgccattggccctaaaaaattgcaaaccacaaaattaaggcgatcgattgaacgaaattttgccaaagcacacgctaattaatcagccaaatggcattcaaaaaaaagaaggcattcaaaaaaaaattaatcagccaaatcctctttttgccaaaggcggaatgcaatttaatagacgtttgccgaaacagcatatatctgagatttgtagaattactaattaattacctggtgctccatcgtgatgcaagctgctcgcccggtgctgcatatcgccgtttgctttgcgacgaagcgacggatcaaacgaaacgagagagagagagagagaacacaaacacaacacaacagagatgctttctttctgaacgaagagagaatctatttgttcagagcaaggaggcccaagaaaaggttaatcatgctgtgtgctgttgcgatgaacaggccacgcaggagagaacacagctggtttaaggttaggaagcctgcacaacgacaacgtagaggcaggcaggcagggtatccatctcttttcccccccggccgttaatgttagtattattgtgagccattgtttgcccgtctccagctgtatctctctctctctctctctctctctctcaggctcagctttttcttcctttctttctttctttcacctgttggatctaatcttggctttgcgagacaggaggtggtgaagtggcagttcgctttgccttgcgacgtacaggcaggaagcatacaatgcatgcacaaccccaacatagttgggtgcctttgctgtcagtggtgtggtggtggtggcatgcgttgcgtttttcaccgtcaattgtgcgtccccgtgtgcgtccttgcagttgccggtacggatacagccgggttagggcatgttgtcgtacagcagtgttacagtacaatcatgtaatataatctcgaactgcggaattgaatttttgtctctcgagggacactcgttttgtgcatgtcattgaaaaagtcatcaaaaattttaaaaatatttatcaagatagatcaatatatataatatattttcaaaaacatgcaagttaaaattcgactaatacaattcgaaataaaatataataaacttgacaatgaattacgtattctattcataattaaatttgttattgtttttctacctgttaaatttgaatattcatgctttgtgaagtaagatattactttttttttaaaaaaaagtttgatactttttaagtgacatgtaaaaacgacgagacatcctatttaagggatgaatagagttttcccttgtactcaacaattaggtgtgattatattttatcattgtattctcttacaacctacgacttcctctttttcaaagaaaaaacaatcttccaattacagtactggacatatgctatatctaaaattcgtacctagaagttttttttttcatctcttgtttggacaccagctgcctgcaatcacctcattcgaccaatcgaccactgtcatcttgttgtcatcgtgttatgatcgccataatgttctcaagcttgttggtcgaccactccagctgttgtattcacacttagacttcgtgggtccctagatcctacgctgctcactttgctggtggccaaaacgattgttgccagcctcagactatggaaatgcaattgttgtcctccatgatcacctgatttggcatcattgtgtcaccaatcgttagatttggcgcctccaacctttgggcggatttggaatgatcgagcttgttgatgaccgtatacagtactccctccgtttttaaaaatataacactgttaatatatattaaaaatatatatattaacggttttattgttactttgatttatcgttaaatgttatttaagtatgacttattattttatatttgcaaaaatatatataacacagtaatccctccgttgatcattcatcttactttaaaaaaattatgtaattatcatttattttattgttactttctttaagtatgacttatttttttatatttacaaaaatattagaataagagaaataatcaaatatttgttttaaaaaaatcaacgttatcacgcactaaaaatggaggtagtatctctgaccttgccagcagtactcgattagtcctgtttggagccatagtgctagctagcgaggcccttatctaggtctactctatctaccagcaagggccttggggagcgaggctacaccatcgcctttgtccgcataatattctcggccaaaacacaagtcaaccacaaagagacctcttttatatctctcccccatcttatatttttgctaagttatgagctatttttattccgtaaaaaccaagctagtacgggatgtacttggttttctatgagatggagaaaatatgtgttaaatatgcacttagcccattaacccaatctctcataactaatggttcaatatgcatctattttgtagtcaaaattacacatctatacaccgtactagtaaaaaaatgaactagagtgggtttgcaagttaacctacatgctctacttggttcatgctcctttattaaatcataagaatttcatggaaatttcataggatttagttcaactcgtctaaaattcctttaaatttcctccatttcaaaggttttagttcaacacatctatacaccgtactagcatacacgacttaattaactgagaaagatgattctcaaaccgttcatgcatgcgtagagatctattgaacatttgaactagttaacatgcatggaactgggcaaagtcaacaggccatgacaaaaagaacagtagtagctagataattcacaattagcaaaagcgtttttaacatttacagagcaagcaagcatgcagggcagcctaaaccgtgcatcctcgtgtgccagatgctttttattgttctcctcgaattgaattcctccatggggatgatcagatgatggatagctaggtacacgtatcattcgtcgtcgtcttcgtggtcgatctctctcacaacctcctgctgctctcgagcctcgtgtagccgaggatgcagttggcgtaggccacgttcttgagcgccttgccgtgccaccggccgacggcggcgacgccggtgcgcaccgccttgagcaggcagtcggccgtcttgacgacgctcctgacgcccatgggcagcgacaggtagggcgcgttgaagaggtggaactcgagcgacgccccggcggcgtggtggtggtggcccggcgacggcggcgagaagaagaaggcgagcatcctggcgacctggcgggcgaagccggcgccgagggagtggccgcagaggcagacgttctccgacccgaacctctcgatggtcgccctgagcgcctggagcgcgccggcgagccgcgccgagccgcggaggctgttgcgcgccagcaggcggagctcgtcctcgacgtcgcgccggatggtcggcccccgcagcagcgtgccgcggaacgcgatcaccgcccgcggcgcctcgccgtcgaccgcggccgccggctggtggtcccgctcgaagatggcgccgaacacggagccgtccctctcgtcgaccagctcgtgcgccagcctgtacctgaacggcttccaccactgctgcgccaccgccgccgcgtccctcctctcctgcctctccagctccagcaggtacaccgcctctatcaagcacgccatcaccatcctcctgtagtcgtcgtccctccacaccgacacgttcacctgcgccgccgccgccattgccatcgcaagctaagctaagctcagctcagctctcacactactcactcgatgacgccctcgatgtcgtagggaaggcgaggcaggggtggcgggaaatatatacgcggagtccggaaggcaagctggatggatcgatcaagccgaattcatttcgctttttactaattaatggcgggaataaagccaccgaatcgggagctaagctaccgacggatcggccgatcttttcacggttcctgcgacttgactggatcgacggatcacaacgatccgaccgatggatggcaacgtgcagcccgtgggtcgtaagctcactctctcacaagttcacaatagtcgcctccagctagccgtctggtttgatggatcgatcggatggtgtacgtcgttcgcgagctttatttaggggagggagcatatattcgccacggctaagcactggaccatggcttatagttcgttcgttcgtctcggtgtagtttaattgccctaaattaacatggctaaggatcgaatctgacagcctcagggtacgtgtgggtgacaggtggggcacgcgtttgcgccttggggattgtgcggggacaggtaggaggagtggggttgcttttgtcaggaggaagggtggttggttggttcgtcgtcctccggttgattagtgccgaagattgggtcgtttactttttctttgttagagcaagtttaatagtatagcctactgctagctttaatttatctatagctaatttaatagcatattcatataatagttgcttactatactattaacatatatagtccatctgtcatatacacattgcgtcttgaagtccgtgctgcagctggctacagattcgtagtctgctgcttttctctcttatcttttatcttattaaaatatgtttatagttagctaatagctcgttattgtacctgctcttatgtttccgttttcttttgggttttgggtggtttcggcgagaggatgggagagaaaaaaattagtgattaggaggtgatttgtggcacgtttaacactaaaccgaggggaatttgttccatctgatgacgttgggggaaggggggttaattcggtcgcgctccgcgtgtgttgattcgttcacacgctggcttgtgggcggtttcttctcgttcgtaatggttagacgcgggagtcaagctgcttatacgggcttggttttcttgttttcttaagaaaaaggggggccttggttttctttggaaaaagttacggggaatatgcatatttcgttcacacgcaagtgcgtggaaacatgacattggctacttcagtccttttccatcacatcaacatgtcatacacacaaattttcagtcacatcatctccaatttcaatcaaaatctaaactttgcgctgaactaaacacatccattgttctaagagaaggagagcgtttgataaatcacatagcaccttcatcaaaaaatagtttcagatttttttttcacatttgaatgtgaacatgctaatcatgtgactgaggctgcgttaacttttaattcttggatgttcaccgacaatttatcctattttaatcttgataaaaatctttatttatctttggatggtggcctcttccgttatttccccctactatttcaaagacgtgtgtacagggtttacatttcaatgaaatattaatgcgaatatggtatcgcaatatgccaataacaaataaggactcatcggttttattttccaaataagttaatacttattatacatagaacatgagaatacacaaatctactttaaaccctagtgtaatgcagagcaagaccatctcaagcccgcatggctacttaactacgagctttaggttagacttacaattttacaatatactatatatgttttaaaatatatggcattgttgaattttagacatgatgtttgactattcaccttattgaaaaaaactatgtaagtatttaccatgacttattttattattaaagctaggtactttacgggaatgctactgggcgagcgatccgctcgctcgcccagggcgatcagttttgcacacccccctccctccctccacatctccaccttgtttccttttttggcaccgcattacttttctattttagtaaatttatacacctaaagtttacacatctaaagtttagagacaaaaaatttataagtcaaaagtttatatatccgattcaaatttgaatttgaattcaaatatatatatatatatatatatatatatatatatatatatatatatatatatatatatatatatatatagtatttctatacatctaaagtttatacacctaaagtttatagacctaaagtttataagacagtttatatacccgtttcaaatttgaatttaaattcaaatatccgattcaaatttgaatttgaattcaaatatttttcatatatagtatttctatacatctaaagtttatagacctaaagtttatatacccgattcaaatttgaatttgaattatatctgattcaaatttgaatttgaattcaaatattttctatatatagtatttctatacatctaaagtttatacacctaaaatttatagacccaaagtttataagtcaaaagtttacatacctgattcaaatttgtatttgaattcaaattttttatatatagtatttctatacataattttttctaacttttgtttttcaaaaaaatttgtgtggtctactgtagtagaaagagaaggggaggaggaataggggagaggagggaggagtatagggggaggggggccggatccgattgcctgggcgatcgcctggcgatcgatcgcccattaaggccccccggtactttatatataacttataatcaaaccttgtatccaaaagtcactactttacagacaaatagtactatttcataccgggcatagaaaaaccaccattttgtgtttctttatgaagtttttactatctagtctacttaattagcagagcacaggttattttttgtttgtacctgttcagctgctgtcttacggctgtggcacaaccggcaccaatagtgcacacgcatacggcatggccacagccacaaccagcttgccgaacgggacctttgtttgggcttggactggtcctgaatgctcaaaagggcccgagccgcccggttgacccagctattgttgcttacataaacaggccgggttcgggctgctgaagcttgcagagccaagctgggttgagtggttgaggcgttgagccacacactacatgatgttgaactgggccacgtctcacgttagatgacacgaactaattaacaacactagcaggaatctagtaattaatcaaggcaattttatttcctggagcgtgtgtttcatatatatatttccaatgagctccatgttgtttttacatcagaattgttataaccactgctccttaaatattatattacttcacattattagcaccttttgtatccatcaaacagatcggcatattaatcctgaaacccactgggaatgagaatcttgttgggctttggttctagcctacggtcgatctgcagcccttaggtgctatataaacataaagtactaatctataactcattatttttgcattgccagcttgtgatcaccagacggtacactgggcattaaaaactgaaagcatgatcacgaatcatataagtgtgatttggacccatgaaacttcaatagaatacattatcaatcttatgcttatctcttgctagactctgtgtgttcacttcctccttagagtgtcagtggagtggtcctttgtagttggcatcggtttttttttctttcaagaaagatgaaccaaaagttattatgccttcgtacgcaagtggtaaggaagaatctgcctgaaacaaaatctgaaattgttggattggatgtttgggatatcagatttcccctaatgagagggcactgttgtgacattggtgtcaaggtctcaaagttgtctagctactcttgtctatgaaatgcgtattcgatcgatcagcatgatgatgttgatgagatgttcggctaagaagaaaacgagtagaaatgcagtagcatttagggatggtagaaagtaatctctggtagtataggtgtgctagtgcaacaagcttggactaatcaggagcaagtataagtctaggtagctttctaatgctgtaaagataagattaaactaaattaaagtgaaacaaagtgagatgaatgtaaagtggtaacagtactttgatcttcaggtgcaaccgtccaaggagaatatttatcttggcgaggaatatgtctggagaatattgacgatgactgatcgatccaagctgcaatggcttatctgaaactcatccaaaaatggagactcgactactaactcataaaccctgatccgacgaggagtttcgcgtgccttcgaagcagtgtgttttcttgtgctggaaagataagtttaattttttttatgacaatgaagataagattaagttaaagtgatatcaatgtaaagtattaaagttgtaatgcttcctgtttatccccaggtgcatgcaactatataaaaggagaatatttgttttcgtgaggaatatgtgtggagaatattggtgatgcctgatcgagtttgagatggcttatccgcagaacaatggagttcagactcatgcaacactctgttatgccagaagtttgtacgcctcttagagcaagtaaaaatgtgttagatgttggatgggtcagaattaggccttctccggtacaccaataccatccaactcaactaagtatgtgaactatgaaatataagtccacttgctatccctcaactttgcgtcgagtttgtttgacatcaatctccaataccagaaaccttcaaccctaaactatataaaaccgtgtaatttgggtcccatagtagtatggatgtctcgtttcgctgacgtgggatcctagtcagcaaaaagaaaataaaaaatatgtgaggcccacatataagtgagaggaaaaatatatgtggggtttacatgctctccttttccccctgctacttgcttgcttcccagacggcgtggtgtggcctcggacgagtcgatggtggccttgtggacgctgtcgcacgggaggcgggggatcacggaacctaaacctgtgcttgtccatgtctttgcagatatggaaaattttgcgtgcctccaatcactgtcggcgtcaccatccccaccccccaaccccccctcctccgatgtgcatggtggatggcaccgccacagagatgcctctcctcctttcccaaccacgacgcgagcaagtgcacggcgtgtggccgtggcgtgggccccacatatatttttttcttttcactaacatgtgggcaccacatattttattattttctttttgctggctacgatgtcactttagcaaactcagacatccatatttctattggatccaaattacacggtttttgtatagttttagggtgaagatttatgatattggagaaaagaaatgttaaacaaactcgacggaaagttgaggtggggggggggggggggctcaagtggacttattcctaggggaccagtgcagttatgtatttgaggccttgttctaaatgtttattgggccaacattattcgcatattatttatgccaagctttcaaaagtatgatttctcaaaaaaaaaaaaacatcaatattgtttagtccatccattctaagctatttacaaggttgatgatagtactacttcctataaacaagttgatcatctattagccttcatccacattattagaaagaacgggtctccaattggaaagaatgaagttcacacattttttttaagaaactgtgcatggataaattattgtttttttttgaaaaccgaagtcagcaaagctggtgttattttaagtaggggagaaaaaagtatttacaagattaccaaaacggtgaaagagaaagagagaggaaacaagaagctactaaacaatgaatacatcctaggccaataatctcacaatatttgtagctccacatatcttccatagcttgatttcatcatgtatcttgtctagaagctgcggcagggatttttcctgatttcggaatactcgtctgttccgctcacaccattttcccatgctactagcatgtaaactttttttttctttggctatgtctttttcaccttgagatgcccttctgatccaccattccaacagcggctcatctatatcacgtctggtcaatttcgttacagttcagtctacttaggattctctcccaaatcatttttcataagaatccgaaacattctggagttctttctgaataaaaggaaattccagtcttccaaacttggtgagccggtgagcaatgttgtcaccttagggagtatttagtttacgttaaaattgaaagtttggttgaaattggaatgatgtgacagaaaaattggaaatttatatgtgtatgaaagttttgatgtgatggaaaaattggaagtttgaagaaaaaatttgcaactaaacacggccttatatgaactagtgcctgcagaaacttcaatacaggggatgtgttcaccaaatcaataccaactcaatgcatatggtacgtccgtacatgaatgtactagactcctgcaggtggcattgcaataaatcaaagcaaacgaatctctttaattaatatgccaccaatactttcctttctgttctttaatttgcttctgttggtgttggatgggccaccaatccaccatacatgtgatatctggcaccctaaaaaagatgaagagaagttgtaaagacgtacgagagatggatttgagatcagttgctgctaaatcaagcaaggctggttagttataaattatgcaggcattgcactgttatcatgcaaaaagtcccctgttcaaattaggcaaatattttggagatgccatttcgaccatgtaaagtatgtgatcagattacacatatggttggataaatagttcactaatgttcaatttttatacccacgaatattacgtatatggtgtgttttcaatagaaatttagtgaggttgacctccatctcattgagaccgtgttaggaaacacatttgcaggtgtgtgtggtgcgcatgtgcgtcttccttccataaaaatcgttaagaaaattctgacttatcataagctagcactggtcagccatcatatgatcccatttcaggtttccccctcccctgagaaaacacaaatcacaccttttgagtttttgaccagtgaccaatccatcattccaaatttctccagctaagctatgacgcattgtccccaattaatacacacactgttggccgcctgacaaccgaaaatggccaacaacaatttgctaccaacagtggcaacagaataatttgggcatatgcattcagcgttcatgcaggaacaggggcgtgaggtgacacgaaagaaagctcagctagcaaagcaaccaattgcatggcaatgctcgctgtctgcagatgagccgcatcatgggaggcatggccagggccaggccgggaatagtgttgttttcagctagctgcagctttgagctggctatcactaaccacagctcgagagtgtggctgcactgcaccaggatttacaaaaccaaccgatttttgtaaaaccgctatgtcttggtttatagaaacatatcggttttagctggttttcatatgacattgaaagaaagtcttcggtttttgttggtttttgataaaccggtgaggatcggtttttatttctaaaacgaaaaggcaaaaccctgcactgctctatggggggctagcttgacgcatcatggcccattacaccaccaccttgttgtagatcttggaccatggcacaagggaagaagctgggggaggaggaaatgtaggggatcatgtcccattttgcaaggacagatgggggatcatggatatcttttttccaggtctagactattttgattggacagtaaattctgcctttttctgtttggagaagatgaaataatgagttgactaatgcatcacgaagcaccgtcattggaatatctaccaacaaaaagtttgtcacaagtagtttgcagctgataaggaatagtaatactttaataattcatacaaatgaaaaaaaacatgttagaaattcttataaaaacatggatctcttagctgtaaaggctttgatttggtgggtactctgtacatcagcagttaaaatgaaaatgagaatgagttcttttttagcatagcaccgaagatgactgagattgtcaagccccacttgtaatgaaaagagtaaattgcactcacggtacatcaactttgtaagtgggtgcaatttagtgcaagaacttgagaaatgagcgatctagtgcaataacttgacatgtaggtgcaatttagtataaaaactttataagtgatcacataaatacaacaactagcataaggtaatatccgtaggattactatgtaatggcataatgatatcgtgcgaccaggaaaaaaggtattactttactgaactgaccccgggcgtgttaatatcagttgaaacacgctttggtccctcatccgtgaatcaatccctagcgggtcttgtctcgcgtgattcagtttgagcaacagatcctgacgtaatacatcttcgaaaaaaaattcacctaccatacttagccaagttgatgcaccaaaatactaaattatcaagttcctgtactagaacgcaccaatttatcaagttgttgcacttgactgttcaattctcaagttattgcactatatcgcatccacctatcaagttgttgtaccttgggtgtaatttactctaatgaaaatatagtaaaatatggatattttggaggctataaatcctataagaaattttggcaagggacgatagatatatacctctaaagtctgaaaaaaaaacagtcgactgtaagagcaagtttaatagtatagcccactaatagctccaattcatctatagctaatttaataggtaattcatataatagttgcttactatactattaatatatggtcccacctgtcatacacacattgtgtcttggagtccgcgctgcagctggctacagatatgtagtacgctgcttttctctctcatcttttatcttattaaaatatgttacagctggctgatagcctgctattgtacctgctctaacacccaactcgtttggagtccgtagtggttcttgtgttggtccacgtggcccagttacggtgtaatggtggtggtttaatatcaccttgaaagtttaagtagtttagggttcctaccaatttttcaaaaacataaacacaccattgttccaagcaaggatgacctcggacaaaagattattgggttacacaaactgtatcgaaattcttatgaaaatgggctggcgctttggagaagttttaattgagttcatgttttttcataccatggcgagtaaactaccccaaaattccttagaaaaaaaattgtgttgatgagttgtttggtttgttgcctatgttaaccataccaaaggaaacaaaaatggcaatatcaatccccatctagttgttggcctatcagttgtgaccaaaattaaaattttgaaagacaattttagagttaattttgggtttttttattgtggtctagattatcaatccttgacttttacaatgctaatagcatagatataaaagtttattcgtaaattatttttagtttgcttcgtttattttttttcacggcttatcagcttcagctcaaattaatgtccaaagtgtaaatttatcattaccaagaatcatggtcatctttacgacggtctcaatccgaacaagctctagttaattgtgtaggtcttttgcccgcatgagcgcgggtttacggccggtggtaggaaaggcgatggatggtgtcgttgaacatcgaagaacggggagacgacaaaccagagaaaaagacagtgatgaacagcggccgtttttttatatgtgcatgcgtgattgctttgagtcctgagacgagtgcagaatcatgatgtctagagtcgtactttggcctcctgcttgttcgatcgattcaaatgaggagaaggaagaatgaaagaaagaaagaaaaaaaagaagttcccggcatacatggcagcacaaagctacaagtacttatgactgcgtcgtcgcgtcgagaagagagaaaaagaaaggcaaattctgagcctcccggatgaatccacttcagagattctcttcatcattggggttgcaaagctggttaatttagttttccgacttttccccaagaaagatgcatctcgttcaaacatgcgattttttttttctgaaactggacgaaaaaacagggtgtttagataagaaactacagctactgcaacagtggcaactctgagatgttatggatgtatttcttctgccattttttcagtccattttgttggcttgcgaaatttttctggcaaaccaaactgggcatatatggatgctagctggggcacactgatcatcattggactgaaaattctatttgttgagggtatatacctgtacatacatgccatgtgctgcagtattatcgtgccataccgggggtgcaaaacgaaatcaggccaaattcattcacatggcatccatgctatgcactgcacgctgctacggaagcgtacaaagtatgagaattttgtcacttttgctgctccatctacggcggcagtacagtagttggtacagggtaccccatgtcgaccccatgcatgatctgaatatacatacattcacacagatatattgcacatttacagcatgagtgcaatttaatattgctttcttggcctaaattattgatggtcacacccccttcgtttgtgacacggcgctacctacgcagagagatggttgtttcgttctgcgacacatgacacatgagatcgatcgcagtttcggtttcagattttttcttttcgaaaatatacaaaagaattacatatctttatattaagaccgagatacttatacacaagcaaaggctatgtaaatgtatggctagatcttgcgatatatatggttttgtgaccacgacagggccatcggttggcacaaggctagcatccctgaggactcccgtagaggagaggggaaacccgcttagatagggcgtaaacgtgttacttcctctgcagctgcgccaaccacctttctccgagttttgtgttggttgttaaagatcctattgttaccttctttccaaattaacgtggctaggatgacaattgtattatatcctttcctcggggttttgataaccaacttcctactgttgtaccgccacagtgagaacgattgtggattggataggaagcaccaagattggccaatggtgtttatgataatccacccaaaaaggtctctgggtaaccaatctagatgtagttgatcgtttcctcttgctagtcgcagaagacacatttgctctgatgaggcaattaagccatgcttgcttagcctgtatgccgtccaacaacggcgataagcaaccaataggaaaaatacagcacggcggcacgtgtttttttttcttttcaaaatggcttggatgggcagatttcacgaccaaaaaagaggattatgtaagctgacttggtggagtattgccctgaagcttcccacttccaaatgagttgctcgccgtctaaggtgattgcacctgaactcagagatttagactttttttacaggagaacagtaagggaggacccccacggtaaatatcaaattaaggaatatttacagggtttatgtgaggcatgaaaattacatagcgccaatccatgattgaaacaaaggtctatctcaaattctgagccttaacgtcaactcatcaatcttttaagcatagctttccaagttacaggagaaggatcaatatagagatcatcctattcaagcatgctttgatccagatattcagtttcagattttgtatatgtacatgttaatttgttttatatctggctgcatacgttaactagaatacgaaatgaaattgtacgtattaccatatgtctgcaattctcgaagtactgctcggttcatccagccgtctagctgcgtaatatatttcagggtgtagctgtagtagtattcagagaaccaccatatggagccacatgaacacgtttaatttccgagataacagttcgtcaacatttgtgactgacaggacaagctggaaccgttatacaaaacttaaaaaaaaggtaacatgtgagatgtgagcatggaccatggatatgaaagagagacactagctagtgttctaattggaggtacgctctgcaagaatggtgccaagttgccggggttcagataattctcagaagttttcccaatcaaagttcagtagtgatcagctaccgatcgatctatcaatcaacaaacggaccaggcctagcttctcccctctctttcaaacccctgatcatggccgaaaccatcagctgccgctgccgctgcacgtactgcatgctttgctacagctcaacagtcaaataccgccaactcacaacacaacttctctatcagtcagtacagtgctcgtctgctcgacctacccggccggacagtgcaaaggtccccctgcgtttccacgaccccatcactgcacgatctagcatatgatattaggtaaagagagagaagagctagcagtagcaacagctgctagctaaacctgcatgcagctgtgtgcagcagcagcagcagcggtagcactgcatagcaagaaagagacacgagcacatttctctcttttggagcaacaaagcttaagctatagactagctacagtgccggccggccggccggcgtccatcccaactagtacgtgatataataattatatatgttaatcaaacgatatgttagacaggttcttgttcttcagaaaagagaaaaggaaagttggtggtataatagtcactcactatagtcatatgtgcatgcagggccctgtctttttggccttccaaaaggagagaattgaaaccgggcgataaattcgtggcaaaatccaaaagaaggccgtgtatctaggacctttctctactatccaaaagggagatctcacaaagaatgtactagtccagtatatagttgtatatgggttgggttgcagtagtggtggtggccggccggccttgacgacgaacgatgatggccaccgcgtgcacgccgtgctctcggtgcgagctccagcttttttgcttgctagctaagccccttttgtttttcagccgtgctagttgctagctgctgcatcacactgctgcttgctgcttgctgctgctgctgcctttgcttgcttcgatctgatctccatattcttttagcctttctttcatgtgtcgcgcatgtgtacagcctactgatgggctcgccagtgtacgtactactacgtagcagtacgtactgcgtgctgctgctgctgctgctgctgctgctgctgctgttgtgtagagagtataattccttcttcacaagtcacaactggagggcaaatgggcaatgcgatgggagattgggagcaatataatggcatgcagcaagcaagggaataatttttctttcctctcaactcatatcagcatgcagctgatgcctgacaaagcctccaaggtaggttgctgtcgtcctggcctgaacggtcatttcaggcgcgcactagctggtctttgatgtatcccaggattgttggggcgacgggggaatcgcttttgtccagaaattggaacggccaaaatgtgcggtgttagtttttgatcagatgttggagttgcgctgcttaagagagcatgattagtgagattaaaggccctgttttcaacgtggggttcttacaggaattttggagagtttggaacagagagaagacataaatttctgagaagatctatatacgatactaccttcgtttcataacatatggatcaatacaaacagtacattttattagtatgaatgatcagatggtgtagattaactggcctaccaacttaaattaattgtagtataaaattgaaaaggggataattgtctttctaaatgtttgcttgcagacaactgttgtacataaatgcacaatgctagacgtgttcctcacttgatttcattccccagtcccgtagttgtcgtccatcataggccataccgccatagagagacgccacacgcactgcaagttcacgcgcaccacgctattgtgcctgcctgcctgtaaattaattcgaattgcctttctttcgtcttctcaatttccgacccacccaaaaccctagctagttcctctacctggaggaggcagcagcaatgatgcccaactccccactctccaccatgctcacgcgaacttgtacatggaaattcctagtgtatctttgtatatgccaaaaatatatattgctagtgtattgtaccgtagaagtccttcaatttctttaatcaatcccttccaaaattctacttgttctcaacagaattttcataggattctcctagggtctattggctaacaccacaatctgattagccaacccagctcacatccctcctatcttaagggtttattcgattgaaggggtgtgggattaatctccttaatctcatgtgaaattaattgattgcccaataccctccaattgccatgtgaaaaggattaatcgaacaacatgtaaatagggtatatggggaataagtcttgttcatatgtactaatttgatcaagattttagtgacatttcaagatttgcgactcatatcccaaatgccgtagcacatgactacatgagcaataaatcctgatttttttcccttttaaaacaaccttaatttcatatatgaaacacgtctctttagtagaaacaattaattttaccattctagataaaaatgggtaaatggttttgtagttgttttcttacgttaaaaaattagaaatgtaacagtttttacgattgtgtgcaatattaggtctggcatggagtatagaggcacgaagcatatgttcacgcactccattctagagggagtataagagcagggttcgtgtttccaaagggaacgggtcaaaacccatgaaattatgaggtttccacgtaggataaagtatattgtgattgaaaatttgaatggtcttttataaattcaaatttcaaacaatatatatgagcaaaatttcatcaaaatttgacaaaaccattgcaccgccgaggttgggatccaacaatccatcgaaaaaataaaccatgtactagagtaaatgttacaacatttcttaataatctattacataggattttgatttgtacttctaccataggactatcacattgagtaaaaaaaacaaaaggaaaagacataagtcaaacctaaccaaagcaagcaagaggagttcatccaaaagagaaaaaaaaaagaattaggatacaagataatattggatgcttgaaatgtgttttacactagattcttacacatggtaaaagacaaatgctctagctaaatgtccgtcatagttgtgagagagccacaaccaataaactttttatagattgcgtgtttaatggatttattgtctctattactttagtcctacagaagactatttctctaggtctagatcatgtagcggtggggccaaaaaaaatttagagagtatttgttatgaaaatcttattccctatagtaacagtaacataacgattttataatgtgttcgtcgatgggtcaggtagccgcctagggttatcgagcggtggctccaccactgagatcatgtacgctcgcatagtaactcgcggtatttgaatcgattggacactattgtgtctctctcttccactaactaaaggcgataaattgaatttttaaaacaatggtgataaattgaattgagagtggtggggaaataataaacagtgctcctacttgcagggtgacagtaccggtccacctccaccatccatcccctacactgtcgcgagcgctctctctctctctctctctctgagttcgttagcaaagccaaccaaaaaaaacctaaaagcaaggcgagcctcggcagtgagatcgagatggagaaagcaagcaaagcaaaggcagaggcagcaaaaggcgcccacacccactgccgctgcctgctgctgctgcccccggtaaatttaaagaacccctccaatcagagcgaggcatcatcgatccccctccctctcatcctctccctctccaccctcctctccttctctcatcgatccggccaaaagctactcaaatgttatcgatctcaccaaaagagaagcaaagagaaagagagcatcaaaagcacaaacaccaagccactcaccacacctcgcaatttacatggctcctactaggttgtgtagctgctactagctagctcagctcggctcggctcggctcgccattaaaatccccttgttaccgcgcgttgtttggttgtaccgcgccatatgttgccgcctcctcctcgtcgccgttgcttagatggatacgctgtttaggttggttagcctccaagccgcctccgagcagcagcagcagcagcagcagtcggcgtcctacaactcgaggagcacgacgtcgagcgggtccaggtcgtcgtcgcaccagacgaacgcgttctacagctactaccaccacagcagcaacagcggcggcggcggcggaggcggcggagggtactactacggcggccagcacccgccgccgtcgcagtactactacctggagccgtaccaagaagaatgcggcaacgccccacaccaccagctttacatggatgaagacttctcctcctcgtcgtcgtcgaggcacttccaccacggcgcgcgggtgcagcagcagcagccgccggcgtcgtccacgcccacggggacggcgccgacgccgccgctgtcgacctcgtccaccgcggcgggcgccgggcacggcctgttcgaggcggcggacctgtcgttcccgccggacctcaacctcgacttctcgtccccggcgtcgtcgtccggcggcgggacagcgtcgtcgggcgcggttgggggcggcggcggcgggaggtgggctagccagctgctgctggagtgcgcgcggtcggtgcccgcccgcgacagccagcgcgtgcagcagctcatgtggatgctcaacgagctcgcgtcgccgtacggcgacgtggagcagaagctggcttcctacttcttgcaggggctgttcgctcggctcacggcgtccgggccgcgcacgctgcgcacgctcgccgcggcgtccgaccggaacacgtcgttcgactcgacgcggcgcacggcgctgcggttccaggagctcagcccctggtcctcgtttgggcacgtcgccgccaatggcgccatcctcgagtccttcctggaggtcgccgccgcggcgtcgtcggagacgcagcggttccacatcctcgacctgagcaacacgttctgcacgcagtggccgacgctgctggaggcgctggccacgcggtccgccgacgagacgccgcacctctcgatcaccaccgtggtgtccgccgcgccgtccgcgcccacggcggcggtgcagcgcgtcatgcgggagatcgggcagcgcatggaaaagttcgcgcggctcatgggcgtgcccttccgcttccgcgccgtgcaccactccggggacctcgcggagctcgacctcgacgcgctcgacctccgcgagggcggcgccaccaccgcgctcgccgtcaactgcgtcaactcgctgcgcggcgtggttcccggcagggcccgccggcgcgacgcgttcgcggcgtcgctccgccggctggacccgcgggtcgtcaccgtcgtcgaggaggaggcggacctggtggcgtccgatcccgacgcgtcgtcggcgacggaggaaggcggcgacacggaggcggcgttcctcaaggtgttcggcgagggcttgcgcttcttctcggcgtacatggattcgctcgaggagagcttccccaagacgagcaacgagaggctggcattggagaggggagcagggcgcgccatcgtcgacttggtctcgtgcccggcgtcggagtcgatggagcggcgggagacggcggcgtcgtgggcgcggcgcatgcggtcggccgggttctctccggtggcattcagcgaggacgtcgccgacgacgtgcgatcgctgctgcgccggtacagggaagggtggtcgatgcgcgaggccggcacggacgactcggcggccggagccggcgtcttcctcgcgtggaaggagcagcctctggtgtgggcaagcgcgtggcggccatgatcggatcgtcgtgatcgatggatcaaagctcaccggtgagtggaacagcatggaagaaaagagctccatagctaagcaagcacgcatgcatatccaccatgcatggggtaagctagcaagctctctcgtgtgtgtcacgatcgacattaatggcggctcacacaaaggcatgtagggttttgaaacagcgtaggaagctacagaaatggatcacgtacgtacgtacacattgggttgcagcgatcgaggagggagatgatagttttagttcctagatttgcatccatttttattcatcgatcgccaacaagttcttggcgagaagatgattttgatttgcttgcttccatcttcttgtttatttttccccctttcgtttgtgtttcttcttaatttgtaagggttaacgacatttttcttcactctggagaaattttacgtgcatggtttttatcatgcgtacctgcatcgatctgatcatacctatatatattcatctagctagtagctagcatcttgcaaacattcatgctttcttgcatggttgttgagatgttacttcttgtcatcttgatgggagaaagtttagggcagacatttgcacggcctagtacttctagctagtcatcaaacatgaaagcactaattaaagtttgctactttgctagtgatagaccatagatatgtgcttacattatagtatttctttatgtacatgcattgtggttaaattaattaattaatcatccctttttcatcattctatcccatttgtaatatcactgcgctcaaaccacaccactaggcgtatatatatagtttggtcatagaagattatgcatgcatggcatggcatggatgtttatttaagttgtaaaatgactccccccgttcaaattattatggtttggatccttatttataggatatgtgatacatcaagttgatactaaaatactactactagtagtagaattcaagttctagccgaatatatattaaataacccctgatcctacacaggcgttgatcgatatatacatctgacttatttatatatgccaaattaagtagttggagcaaattgacctgcgggcctgctgtaagcattggttaaacttgacaaatggccggccttatgttgatttggttaagctaaagctagggaccatttattttctccatatatactactctctccgtttcataatataagtcattctagcattttccacattcatatagaggttagtgaatctagacatatatatctatatagattcactaacctccatatgaatatgggaaatgctaaaataacttacattatgaaacggatggagtactaatatctgatatggagtagtgaaaagatctgtcaatagttttgtgttcatgtacgtagttggtccaagaaaccagatcaagttttgttgactattgcaggctaagacctttgctatcttttgaaggaatgaccggcctgtcgttgacagattagtttctctcctcattaactactacttaatcagctaattaaatacttagagctttgatgctgtacagtataggacaacaannnnnnnnnnnnnnnnnnnnnnnnnnnnnnnnnnnnnnnnnnnnnnnnnnnnnnnnn

SEQ ID NO: 10758 - DNA, 659 bp, Oryza sativa
  unsure (1)..(659): unsure at all n locations
nnnnnnnnnnnnnnnnnnnnnnnnnnnnnnnnnnnnnnnnnnnnnnnnnnnnnnnnnnnnnnnttgaacattagtgaactatttatccaaccatatgtgtaatctgatcacatactttacatggtcgaaatggcatctccaaaatatttgcctaatttgaacaggggactttttgcatgataacagtgcaatgcctgcataatttataactaaccagccttgcttgatttagcagcaactgatctcaaatccatctctcgtacgtctttacaacttctcttcatcttttttagggtgccagatatcacatgtatggtggattggtggcccatccaacaccaacagaagcaaattaaagaacagaaaggaaagtattggtggcatattaattaaagagattcgtttgctttgatttattgcaatgccacctgcaggagtctagtacattcatgtacggacgtaccatatgcattgagttggtattgatttggtgaacacatcccctgtattgaagtttctgcaggcactagttcatataaagccgtgtttagttgcaaattttttcttcaaacttcaatttttcatcacatcaaaactttcatacacatataaatttccaatatttttgtcacatcattccaatttcaaccaaactttca

SEQ ID NO: 10759 - DNA, 737 bp, Oryza sativa
cgcaccacacacacctgcaaatgtgtttctaacacggtctcaatgagatggaggtcaacctcactaaatttctattgaaaacacaccatatacgtaatattcgtgggtataaaaattgaacattagtgaactatttatccaaccatatgtgtaatctgatcacatactttacatggtcgaaatggcatctccaaaatatttgcctaatttgaacaggggactttttgcatgataacagtgcaatgcctgcataatttataactaaccagccttgcttgatttagcagcaactgatctcaaatccatctctcgtacgtctttacaacttctcttcatcttttttagggtgccagatatcacatgtatggtggattggtggcccatccaacaccaacagaagcaaattaaagaacagaaaggaaagtattggtggcatattaattaaagagattcgtttgctttgatttattgcaatgccacctgcaggagtctagtacattcatgtacggacgtaccatatgcattgagttggtattgatttggtgaacacatcccctgtattgaagtttctgcaggcactagttcatataaggccgtgtttagttgcaaattttttcttcaaacttccaatttttccatcacatcaaactttcatacacatataaatttccaattttctgtcacatcattccaatttcaacccaaccttcaattttacgtaaacttaatacttccta

SEQ ID NO: 10760 - DNA, 1219 bp, Oryza sativa
ttttaattagttcacataacacatataaatgatattgtgagcatccctctagattttttttttgagtcaatatcctctagattttccttctggtttcctctatataggttttttgttccaactgtgcagctctgttttagcatacctactggcaattatcatgcactgacgttgcatagcacacatccttcagaccttcacatgcccttctgatgtgtgaacttgtatgctagaggtatttgtggtagtgtaggattgtgtttcttgtatcctatatattttgtcctgttggccttttcaaatacatccaagcgttctgagtcttccaataaagttagcaggatatcacatcactatcttccactgaagttaaccatcaccctctatcagcgtgtgtttgtttcaagggatgggatgggttgggttgggttgaacccacttttagagtgccaggcagtaccttcatgcgttagcttatggttatctggttgcttccttgtttggtgaaccctgccgataaacattccatggtcagataaatggctatgtttattgaaagcaaagtgaccacattagtgtttactaactagagagatcattactaaattagctagacaagaggactacaaaattactaaggtattagatacttacaggtattagaaattattagaagtgcatcagcttctatgaggattgaggaccacaattgttggtaggatttgttgctttccttccacatacagctctgatgagtgatgactgatatatactatctcatattcactaccttggcaccacaacttaagtttaagctgcataaatttgttacacatggataaatccacatatgtatactatatatgccagaacagcctcaattaatgtcttgttatcatttatgttttatgttttagaaaacataatggaagctgactcatctattctgtttgaaggaaggatcacggttgaaggtagactatgaagtaacttgggatcatgaaggtttcttccgcaatgcacaatacgagcctgttcgcagcaatttagaagagagaaattcatcggctcatggaaggaagaaacattacacatcgcgaattgagtcagatcatagaaagagatttagggtaggacaacatatcaaatctttctaatataagtatttgtgatgtgatgtgcattcatcttcattgggtgcatcctgatgcatattttc

SEQ ID NO: 10761 - DNA, 732 bp, Oryza sativa
  unsure (1)..(732): unsure at all n locations
nnnnnnnnnnnnnnnnnnnnnnnnnnnnnnnnnnnnnnnnnnntgttgtgcacccagaagtacctccctccgaggctgtacactttctgcactcaccaagcaagcagagcacgtacagtacacatgagcagtcctatcgttttattcgaacggcatatttacaaaaggaaaaataatttataaataaattttttatatacatcttcttggcaatataaaagtataggtcgaaaattaaactttgcgatagaaaagtataggtcgaaaattaaactttgataaaaaaaatcttaaaattagctttaaatataaggttgaaaattcagaatttgactgataagtataaacataagcgaaacaataaggccgctgatcatctgataagccgtggaaaaataaacaaaacaagcaaagattatttcaatacaaaacatttatatctctgttattagtgttttaaaagcaaatgctagaaaaaaaactacgatgaaaagatcctaaaatcatctcgaaaattaagttctaagaagattcaaaatttcttagtttgtcaatcagtcaatgaacctaagtgtactgtaactaggctgtgatcactgcattgagctgcacctggatggctgcactgaacctctccatgagatcagggacgtaggcctcgacctgctcagtgctcatgttgtcgaagtagcccattgtcaggtcgttctggccaatgtcgaacgtgtagag

SEQ ID NO: 10762 - DNA, 1759 bp, Oryza sativa
ctcatcgtgaggggggggtctttcagattgttgattccattcatcaagagggagtggggatgggatctttcagattgttgattatgttctgtttatcaaaaaggggatatttcatattgctgctcatcgagaggggggtctttcatattgtttattctattgatcgagagagaggggaatgggatctttcatattgttgattccattatgttcatcatgtggattgcttcctaacttttttgtggaaaacgaatgggtccattgatcattttctggataagctctttcaggttgttgattctgctcttcataaggaccgcttcttctaatgaggtcaaagccttggatacaaatgccggctcaacttgcacatccttgattacttcttcactcaggttgtcgtaaccataaggtgcatctttcactcggattgtcgtaaccatcaggtgcatcgtcactcaggctgtcgtaaccattcgctgcatcctcactcaggctgtcgtaaccatcaggtgcatcctcactcgggctgtcataatcatcaggtgcatcctcactcaggctgtcataatcatcaggtgcttcttcagacacccccccaatcattgtcagaatccaatggttgttcatccgatagatccaattctctgagaatggactgaccctccattgcgatggccatggcctcatctacaccaaccaattcccatagtccaggcaccttactctctcttcgcaacttgccaaacacatgtagttccagtaccttccttgattcgattggaacatcacataactgaatgaacgacctaaaaccataagactcagacatcgatctgttgcatcatcgaggactttgatatttgtgtcctctactgtccaacccatctatcttctcttatcttctcatgcagcatcctctagaccttcgcaacatcttgtaacttggtaagaccgcagatcacaatcatgatctccctaccagcgcggttgctgatagcttcttgcagatcctcagacagagaagctactagcgaagcagtagagggtggaggcggagaaggaggaggcggccgttgcggaaatcgcggtgcagatgtccacccaaataacgcatagccgttttgatccgatgctctaaaatcgcattcgcactagtaatttttttttctggacatttcaaatctactaaccaagagagcgatccaccacagtaaagctggagattgccatgtgtatccacgtcgctcgtatgcctcatgaggccacgttttaatgggccaaaattttggtccatatacaaatacatgcggaataaattcacttcttatccctcatttttatgtcgagtttaaattgcatccttgaaccgtattataccagatatagtgtttgtctcagcttacaatactggtgcacttgagatcccaaaacattattatgtccggttttagctaatgtggcatcaacgtggcactcctaccaaaataaataaaaaaattacaatagccccacgtgtcagtggaacattcatcccttcttccatctcttccctttctctacttttcctatttatctcaacatggacatcatcaatagtagtggccgatgagctcgagcttactagctcctcgacaggaaggtgaaagcggtggtcggcaaggcgacgaggagcttctcacctgggcctcctcactccccctatggcctcctcgattgccaccatggcatggggagagaggggatatgaggcagcaag

SEQ ID NO: 10763 - DNA, 900 bp, Oryza sativa
  unsure (1)..(900): unsure at all n locations
nnnnnnnnnnnnnnnnnnnnnnnnnnnnnnnnnnnnnnnnnnnnnnnnnnnnnnnnntttgaacatagctaacacattcacctaagctaccacactaacatcagaaactgtatgaactggtttttgctgagtttaattgctatcttggagaatcagatcatagatttcaaaatataagaagcgatatgagtgagaagaaacttatatgtggatgaaaaccaactagacagggcagaccttcaggtttcaggtggtgctaattttaatgcgcatattaagctctcaaaaggtgtgtataccggaatgggaaggcaagtaagaacaaaatatgagtccacaaacaaaataggaaaccaccaggatggacattgaacaaaactgaatcaaacaatttccttatggatgctcatgtcaactaagtttaggactcttttcgcttttattagcttacgtccggcactaatattctgccttgtatcccagagatatgaatgcatttacaatataatgaaccaaacagaagttgagaacaccaaaatgcaccttattttaccaagtgccgagaaaatagtgtgtgtgaccagcgtggaggctttcgatgatatcctcgtctccgcaaaccacctggatggcacaccccggacaagaatggtgtctggccttttcgctatcttcctcacaggattcctgagcaaagcaaacatcaattcaaacctcacctagcaagaatcacaactaagagcagcattttcatttaaaaaaatgaaacccatactgctactgaagagctcggaggcgtagaaattctcccaagacttcttcattgcccttgaagtcatcggagggcgggatctcgacgctcatcccgaacttaaccccctcgaggtgagctcgatcccg

SEQ ID NO: 10764 - DNA, 791 bp, Oryza sativa
  unsure (1)..(791): unsure at all n locations
nnnnnnnnnnnnnnnnnnnnnnnnnnnnnnnnnnnnnnnnnnngagtgacaggcaatcccccagctatctgtgaagcgttgacggacaacagatgccgtgaaacaataccaatggcaggaagagaaagatgcgatgcgcatgaaggaataaaggtcaccgatgcttcctctgtaccgttttccggaagctcaggatggccatcaatctgtggtgctcgagcttcggatggttctccttgtaagaatcagccaattgcagggagaaagagatgcgcgatgcataaaggccaaagagcatgtcggaccccctcaatcgactgagcagacatgatatgagtgatgctcaattgcttacgttcattcagtcatttgttgtaatagcattttcagtaaggaaaagtaaaccaaagaaagctgttttcttgccccgagttttgattggttattcgttgctgcttgtaaaccaaaatagacagtcaaacaaaccatgtaacttgatacaactttttttagggactcaacctctattacctgaacatcgcgcatttgccatctaatgcaccatagggcattggttataaacttgtgctttcaaagtgcaaagagatacactctttcaaattccaatcaatttcatgaatatttgattttgtacttcaagcaagattgtagaatttcatacaatgcttggtgtttgaaactaatgtagatgaagatgaagattaaaatgtttacgcacaacgagtgtaataacgtatgatgaattgagtttaatattacaaacttgaaat

SEQ ID NO: 10765 - DNA, 690 bp, Oryza sativa
cacaaccctaaaactctcaatccctgtcctcattcatatacagtaagatttttttttccagagagtacaaaatgcaggggagagagggatgcgggcacgggtgatgatgccgaactggccgaggccgccgatcaaggacggcgaagaagaggtcggggtcggcggagggaagaagagggagaaccgagagaggagagagaatgacatgtgaggcccacgtgggccccactattttaaaaatatttttgtgtgtagctcacatgtgggaaacgatttttattattttccgagatataattgccaggtaagcgctacgtcaatgtcatgtgggatggagacctagtcaaaccagccacgttagggccacgtcagccaaaaccgcctttcaaaccactgagagacctcatttgcaccggttttgacagtttaaggactggttgtatctggttttagggttcaagaacgaaaaacggaatcggtgtaaaaataagagacctcagataaacttattccttcgataaattatagacttcatttttcagttccggtatattaactaccctgtgatgaagttcatcaagagcataaccacccataataagtgtattcagataatttaatacaccatttggtattgaatatttgatgtttaggaaaatatttggatcttattttgaactttaactatta

SEQ ID NO: 10766 - DNA, 1021 bp, Oryza sativa
attgttcgttgcaggattcggggacccgctgctggtgtgctgcgggtacggcggcggcgagtacaacttcgacagggacatccggtgcggcgggaaggtggaggtgaacggcacgtcggtgctggcggggaagtcgtgcgacgacccgtcgaggagcgtgagctgggacggggtgcacttcacggaggcggcgaacaggttcgtcttcgagctgatcgtcggcggcaagctctccgacccgccggtgccgctcaggcaggcgtgccgccggggcggcggagggcgatgagctctactgttttcccggtgcaatgcaaggctgttgcatagcacttcacgtgcagattggtaataaagcaaacgggattgctatatgtcactcgaatgaaatttggggataaaatatggtacaatagttctaagttaaagtgatatcactgagcgttttgaaaaaaatcacaagtggaaatgcgacatgtacactcagaactttttttcagcgaaagagggtcttacaaagggtgatttgtgtctaattagcgcattttttagaattttatcgctacattgacttgcaagttataattgcatctccagtaggatctcaaatccagcccatattcattttttgagagctaacatctcatatactaggtgaaacctcgcgcgttgctgcagtagtttattatgataacaataagtaaaaataatatataaaatagctacacaacataagagtatgttaacgtagtttatgataatttaaatttaaatggtatataaaataatgattcaaatataaaagtaaagtgatacgactttactagagaagaaaagtagggagacagtttgaatcatagattaatcatctaagacctaaaagcaattgaggtgatatagcttaatgaaagaagaaaatgtggagataatttgaccatatattaatcatttaagcaaaaaaaaattgatgtggtatggcttgatgagagaagagagaaatattattaactaattgaggatg

SEQ ID NO: 10767 - DNA, 374 bp, Oryza sativa
  unsure (1)..(374): unsure at all n locations
nnnnnnnnnnnnnnnnnnnnnnnnnnnnnnnnnnnnnnnnnnnnnnnnnnnnnnnnnnacagcaaagcgccatgaagctgcatgatcacgtaagaaaaatgtcatgaggataaaaattctacacgaaattcatagccccaagaaaacgaatttctagcatcttacaatcctgcgatgaatccacatttgggctgaggatgctccggcggcgcgggctcgtcgtacgccgccgacggcggcgccattggccctaaaaaattgcaaaccacaaaattaaggcgatcgattgaacgaaattttgccaaagcacacgctaattaatcagccaaatggcattcaaaaaaaagaaggcattcaaaaaaaaattaatcagc

SEQ ID NO: 10768 - DNA, 822 bp, Oryza sativa
atattttatctgcttttcgtttttttcttcactgatccgtttcttgcttctgacatactagtttacattacattgtcaaagggtcattttcccttggtgttgatggagctaatgaaaaaaatatcttgatttcctctcaaagtgttgtacacaaggaatttgatctttttctctacagattgacttggacacaattgaggtgagcaatctgaacaggcagtttttatttcggcagagtcatgttggacagtcaaaagcccatgtaagttacatttctatatgttgatatgattaacatagttgtatatgagctttctattatgtatgtatttgttgtattcaccttattattgctgctgcttattctgtttttgtcattgatcttgtcaggttgctcgtgatgctgttctgaaatttaggccaaatatcaatataacatcatatcatgcaaatgtaaaggacgctcaatttaatgttgagttcttcaagcaatttaatgtagtcctgaatggccttgataatttggacgctaggcgtcatgttaatcgcctttgccttgctgctgaagttcctttggtggaaagtgggacaactgggtttttgggacaggtgagttaagaaagtaccactgctctggtccccgtaactcttctgcatgtatgaacggatatataatacactctggcttatcttcttcgtaatctgtatggttaataagatttaccagacatacggccttctagttgagtatgttttgtgcacttaccattgttcactgtgatcatgtgggtccagagggaaagtgtggttgttacttaatca

SEQ ID NO: 10769 - DNA, 747 bp, Oryza sativa
ccctgatacctcagtgttatcagccctaaacatcattaagttacaaaagatgttacgttggaacaatgtgttagccataatagcggaagtcaaccgctgttatccctggaacagataccgtaggggttgctattgcaatctctttttcttggctaactttgggttctcatcaagcataacaagatcgtcgtcatcgtcatcttcgacaacttgagcactactggatgcatcgcaattctccttcaactctaaaacctcatccagcttgcgcttcattccaggtttagtggatatgtcctcaacaataccgtcagcataatctgcaccagatgaagaagcaaccgactggtttcccccattactcgtaacttgcttctccactggagcagaccatccagatagaaccattccatcaggctctttttcttcatcaaactcgtccctgtaataatcactgaaaaatcagtctacccccttgaaagagtaggcaactgtatgtgtacactacgacactatcataacatatagcttccaaatctacatagcacagcattataagctactgtatatccatgtaatggaatgagccaaacaacctacatgttagaacaaagttatacgtagaggacattttatgaaactaaaagttgtgacatcataatactctgcaaatgataactttagtgaaaaaggtgaaaaaccactggttcatgtatagcaaaatagtagcagctcattttcacttgt

SEQ ID NO: 10770 - DNA, 539 bp, Oryza sativa
aacatcatctaagacgagcaaaaaccttctttcatgtaaaatgttctggaggtaggattgcaactccttctcttccttgtgatccatttgtgtctccaatggctcacaggttgcaacctcaataatccgttttgtgattctcattgcatcaaattggcgagatacattcacccatatgcacaatgagaaatattccttcacattgacttcatcaaagattaattgaaccaaggcagtttttcccactccttcaatgccaactacacataggaccttgaggccttcatgcttgtatctgtccagacagaatagtttttgctttatctcttgcttctcatgcacccttcccacaatattattttgcattaccaatggcacgtggttgatgaagccattgatctctgcacctagtgcattaagttggccggtgatcattttaagcttcctcttcatgcttcgaggaagaactaatggaatatacatgttgcgcatcatcctgttcctgtgcccgtcaaccaaagccttgttgtgctgagcct

SEQ ID NO: 10771 - DNA, 409 bp, Oryza sativa
  unsure (1)..(409): unsure at all n locations
gctcggtacccagtacgtccccgaatgagatcggaaccatcaacatcaacaattttgatctgttgagatcatccaaccttcaaagatgacgccgccgctgcggagggcatctgtacggtatttccgaccattgacgatcttgaggatgatgccggaagggtacaagacgccgacacctctagagaccgaaaccgactactacactcatcgggtttaagtgcggttttggtcagactcggagtaacaggccggatatacttcctccgtctcaaaataaagccattttgaggttggcacgggtattaagaaagtaggtgagaatgattggaggaagtgtgtgattggttgaaaagagannnnnnnnnnnnnnnnnnnnnnnnnnnnnnnnnnnnnnnnnnnnnnnnnnnnn

SEQ ID NO: 10772 - DNA, 493 bp, Oryza sativa
  unsure (1)..(493): unsure at all n locations
nnnnnnnnnnnnnnnnnnnnnnnnnnnnnnnnnnnnnnnnnnnnnnnnnnnnnnnnnnnnnnnnnntggattagtaacgtaacataaccctatcgatcacttcccaacaataaggaacagccgataacaagttataaagcgcaaccaatctagattacagcgtgtatatgataactcgatggattacatgaacatgattaaagtgtcataaagatggaagcattaaccccgagaatgcaagccgccataacaaactttacctctagttgaagatcgaatcgatgcagctcaacccgaaagcaagaactcgtcgaaataaaacgaaagtaaaaagggtggtgatgcgccgagattgtattgaactgttgttttgattacatggtttcgggctctatttatacccgagatacaacatatatccttgccggacacgacacttatctctaacaaactttaagatnnnnnnnnnnnnnnnnnnnnnnnnnnnnnnnnn

SEQ ID NO: 10773 - DNA, 593 bp, Oryza sativa
agcatttggcagatctaaagcaccagccttattttttcttttgatgcagaacaccatcatcaccaacagcaatagagttagatgtaatgttggtgaacacaatgcttcccttgcaatatgagcaaatatttcagaaccagtgaacaacatggcaaggaatggctataaaatggaagtaatgttacattaaggatttcattggtttacattccagtacatctgacgagtgcaaaaaggaaagggaacacatcaaaaactcttggctgtgatacatcaaaattgctattgcaggagtataacacagtagagcaatccatttcccgatacaagagaaataaaaaaaccattgccatgttggtgctttgttggggagattgcaaaaacattcttccaagtagctttcatgcaagtgacgctccgtctccatattgctaacaagggagttctgaccatctacttttgtatttcggtgtgtccacaagctagaagttacaacaggcagttaaaatggagcatgcaaaggccattccctgtgtctaaatctccagtacccaagaaaaatggtgaactgaacagcatggggggatcctcta

SEQ ID NO: 10774 - DNA, 713 bp, Oryza sativa
  unsure (1)..(713): unsure at all n locations
nnnnnnnnnnnnnnnnnnnnnnnnnnnnnnnatacccctgttttagttgctaattaaacaagttcttggattgaaattgttcaattaattccctgattagtagccacacctttcaggcttttcagatcgatcgttcttttgacctatccaccaactatgattagcgtagccctggttattgagggtgaaccatcaggatgttcgaccaacctagtcactggcaagtgggcctacggatataacagtcgtgcttcagaaaatgacatgccaaaatggcaatctaatcgcccgtcatgcttggttaaccacatcagcgattgtataaaatggaccaactgacttgtcaactgaaatacatacttatattttggtttgtgaggaaccgaaatacatggtttaatgtatatatatctagcttgatctcactcagtcgtggaaaaaatgaggatttgccgctgtccaacagtgatatttaatttcataaaaaacaacctatgatatgtataagtacgaccataataattgagccaagcatatatattttgtactaggatagaggaaaacgggtgaagagatgcaacatataaaaatcacaaataccctgtcaaattctaaagatgtatctagatgtaccgtttgtccaatgccctagaatttgattttcctggaacaaagtagtaatttagaaaatttggttactagtttttttttaa

SEQ ID NO: 10775 - DNA, 17244 bp, Oryza sativa
  unsure (1)..(17244): unsure at all n locations
nnnnnnnnnnnnnnnnnnnnnnnnnnnnnnnnnnnnnnaatacatttataaaaaaacttgaatcaaattatccctcatttttcgttcaccccttcatctttctctctctcctgttttatccgggattcaaatgaagctacggcaaccggtgacgtggtcagttgactgggatgagtcctcactcctcagcggtactttattgccatattactgtttttttaaaaaaaatctaccacaacacaaaaaccaagctggaataaccggaccaaccgaaaaccaagagaatcgactcttttctgttgggtttggtttttcattgtacggtcaatttatgctcatcacggctaaacctgctgaaaaagtcatgaaaaacgcaataacaaacaatagtaactgattaaggatacataaatgattaatgatttatgggataaccttctgctaagcataatggaagtgtgggttaaattgaaacagccatatatttgggtgcacatggcaccaacattggaggatgcactatctttatgctagttatttactcaacataaatttaggcacattaataagataatgtcagcactagttcacttacctctaaaatttatcacaagaatacaatataatactacaagctaggagtagagaaaaaaaaggtcaacaaagaagtatcctgacccagttaaggccatgtttgatttagcttaggattataataatctgggttattaggagtagcttattacaatctataagctagattactataatatagtaatccactctaactatgcttttttagattattgggtggctaacagctaacaaacatctaataatctaaagaaacaaatagcttatagtttattctgtgttggcttattataattcaacttatagtaatctggctcaataattgaaattacaataaccttaaacttatacatatgtaatatgacgaccattttgtactctcgagctttctttagatttttttaattcacgtgaataaccaactagtttatgaattgtcaaaaaaaacccctttttttgtggggtatccaaaaaaaactttatgcatagtgaggctggggattgagtcatggaaaaagttcccaaagtcctttcttttttaaaaacagggggcccgtatgtaaagaagagaagcatcacaattaatcagctttcgtgatacccctgttttagttgctaattaaacaagttcttggattgaaattgttcaattaattccctgattagtagccacacctttcaggcttttcagatcgatcgttcttttgacctatccaccaactatgattagcgtagccctggttattgagggtgaaccatcaggatgttcgaccaacctagtcactggcaagtgggcctacggatataacagtcgtgcttcagaaaatgacatgccaaaatggcaatctaatcgcccgtcatgcttggttaaccacatcagcgattgtataaaatggaccaactgacttgtcaactgaaatacatacttatattttggtttgtgaggaaccgaaatacatggtttaatgtatatatatctagcttgatctcactcagtcgtggaaaaaatgaggatttgccgctgtccaacagtgatatttaatttcataaaaaacaacctatgatatgtataagtacgaccataataattgagccaagcatatatattttgtactaggatagaggaaaacgggtgaagagatgcaacatataaaaatcacaaataccctgtcaaatcctaaagatgtatctagatgtacgttttgtccaatgccctagaatttgatttttcctggaacaaagtagtaatttagaatatttggttactagtttttttttaaaaaaaatcgtatttttataagcgtggagcaacataatctgtggtaaaaatctggaaaaaaaacgaatagaacagagcctataacatcctcaattcttttgtccacggggaaaatatcagctatgtaggcgaggattctattgggtttgttctttcgagatgcccattcattatttgtcaactgtcattgctatatcttttgttcaccacgcacgaagtcatgttgcaacttttggtaaagctagcatcaacaattaatctatcattaaaacaagaatcatatttttttgaaagatcaccactattaaaagaagaatcgatatgtaactaatgtaactcttaacaatcttcatagtattatccatgtctcccgatacaaacaaagaagttggaagcacggggcagcttccatgttacacttttcattttcttgagactatattggtgatcgatcaacttgcccccacttataataattactcttctataccaaaactgtccttgtggagtgctgggttgcctaatttaatccccatttggtactgtatttagtggactatatcctccaatcatggcaattaatgaacacttagctacacatacatacatatgctgctccccacttaagaccaaagaagaatgtctttgtcagcatgcccataatccacacagattcctcccttggtatttgtctgccacccacagtctccactaattaattaactctagacaagttattagggaggttagttacactacgttttagaactctcaggccactaattaacatacttacttgcttaagataagctactttatcaatgaactagcaggtacactgtgcagacagaattatatgttgtgtagtatgattcaagtaaagggttaattgaccttaacgcaaagaggcatgtatatcgatagcttgttagatgcgtgcatggtttagaagtctctctgaaatatcaaatgttactatcattgctggctccttgcgtgggcttgctaaacagtgaacatatttgaaaaaagaaatactctctctgttaattatgaaatgtttgatgttgattagttcttttttaactaaacatataacataaaaataaacaggagtacaatacaattagaatgctggcgtggacactatttttctttcttttctgtttctagcgcaaatttactgaacactaggcagtaggcacaggcgacaatcgcatccataaattgacatattagcatcaaatcgattatgctttagctttgagaaaggttgtgaatatgaaaatatgtagtgatacagatgagaatcagattctctgacctttttcaaaggtacacagaaatgagtttggtgcaaatacggtgacaacagtgtagatgatgcaaaaataatcatcgttcaatagtactgtagcatgtttggccttattaattccttgtgaattggatatcggaaaatatcccaaattaagttcgacttaattcacctatgcctttatattcaactaaaagtctgaggagtgaactccaaatcggacgttcgattccctctaaatcaggtggttaaatacttcacttaaccattaggtgaaacattaagttatacatggtgaaaaaaaattagtaactgaaacattgactttttttaaagtacgggtgtgtttagttcacgctaaaattagaagtttagttgaaattggaacgatgtgatggaaaagttgaaagttgtgtgtgtaggaaagttttgatgtgatggaaaagttggaagttcgaagaaaaagtttggaactaaaccaagcctatagtgaaaacacacattgaaacatgctgctgtcatgtatgaaacaataagtcttaacggtataaaacatatgtatttcgttcattagaatatagtcatgtgatatcttattgtaaagatttaactacaacaaatataatggtgtgattggatcacatattggataagtagtttagaagaaaaaatattttaaagatctaaaatggaaagagagagtgtgcaaatagtacaagacaagagagagagagtgtgaaagacgttgttacgtaaactttaaaacacgctaaaaacacacggaaacatatagctgtaatgtatgaaacattcacttttaacggtttaaaacatatgtttttcttttatcggaatataatcatgtgatattctatcataaagatttaattaacacgagcatgatggtgcaattgtatcgtaaattggataagtactttaggagaaaatatattttgaaaaacaatatatacatgtatggatggattgagtaggaaaaacagtaggataattagttggttacagtgccggatagatcggtatactgatctggagcattctccaaagtcagaggatcctaatcaatttggctaaaatgtagtgaccttaaatcaaatcaaaatgccatgcttttgttggcattcattgtttttgtgtggtaccaaaataaatagaagggagaatataatttgtccatggtgtagtcgacttacttataattggaatcagtaacaatcataacacaacataatcctaggtgggattgggcccgagccccaccaacatgggtgggtctagtacggcggacatgtcaagacctattacatctgcacgtgtcggcttctctcgctatttcattttttggcgttttcgtgtgcgcatgacagacgcaacaacccctgaatccatgttctctagcccacgtgcaaaaacctttccaggcccactagctcaagtattttttttttctttctcatccagagttctcttatctatgtacatgttttatgtgggcttagactatagcccaatacatatactactaatttatcatacatagtaattttatctatataaacattttatatactaactttatacattgcaactttctgcacggaaagtttatacacatggtaactttatacatggtaaatttttatatatgaactttgcacatataaactttttgatattgattttttaaaaaagtgtatgaatgaattttaaaaataaaaaaatatgtaaaaagaatatataaactttctatatgcccctaaatggaaaaaaatagaaagatgtaggttaagtagtatttgtaaactacatgcaaacttaaaaatatatggtgtgggtccaccttgcatgcacgcaatagaaaagtcaagtaccaaaagaaaaaaaaagtgcatgggtagcctgacatggctcgtctctccaacgccgaaaacatgctcagtccgaaccagtggcggaaggaatatggaatgagaatgcgtaaagaaagtgatcgcagaggccggagggcaatcgttcgccaattagcttttccgcaccaatactacttactccctccgtcccataaaaaaccagcttctggttacgaatctagacgtagcgtgtgtctagatttatagccagaagttgattttttatgggacggagggagtatgtaagagaagaancgatagaaaagaggacgtcttacttttttttaccaattctaaaaccttaagagagttcgaatgggtcaggtgttgataggagttcatagtagcagcatgaaggtatgatcgactacctgataatggagtgtattgcacaaaacggtacacgcacaaatgttcacaacaaactattgtaaatatacttgctaaaatcacctctagaagacaagctcggtaccactaaattgcttcactttgtctcttctaatactaaaacctttacaccttgcatattcattgtaaaacttgtaaccatcttactcgcttctaaaatgcttactagcaaccatgttatactcctccatctcctccaagctaacttcgttctcagccattgtgtgccactgtcaatacgtacatagtaatcatagacagagagatgaaccatatcagcatattttaaaataaaattaacatcttgcgtttcatacatcacttacaaaaatatattaaaatttgcaagtcttcacataaatcaagtagttacaaagacgagttgtgtcacacacagatcacatcacaaatagaaaaatggatgtaagaataatgataaaattattttgtgaaaaacatcctacaaactacaaagtaataaaggcttgacgaactattggcaaatgttaaaacaaatgatttatgacaacttgcaatatataaacgttcaatggaaccagctttatgacatatatggataataccttaatttttactaaatttaagtagcacaatttacagctctgtgacattaatttgacatagctcactcatctagctatacacctaggtttaatgcgattctagttacagattttcatcctacttctctcatcaaagacagcctagtgttcgtaggcagatcttctaaatacaaagtcaatcaacaagattaaatcccacctctttttcttaatgtgacagcaaattttcatatcgacatgaaagttaagcacaccttaaattgcagaacaaaacaaccattgcgaaaattaatcattacagttataccaaatataggtccgtgtcttaccagaagtctaagcttgtgtagacactcagcggcgtcagggcaggcagggcaatgaggccaggctagatatgtgagacggggggaggcagcgtgggttggggaacacagaagctgtgggaggttggatgcgggggagaggcaaggcgccggggtccagggacacaggagacgctaggcgcataaaggctcggcttcttttggcttcctagcctaaaggaatcgggatggaggcgccgggacgggaggcaagggtgccggggatgcacgatacattcaaaagaagcgctagcacgaacagatgacgagatccaggacaattacttcctatggacaattactcttgatgaaaataaatctcaatttcaaatgactaaacaacccattttaaatttttaacaaataccaaacatacccttctatatactgcaagtatatacacgcagtaaaacgtacagtaaaagtcctcacgtatacataggcagtgaattgaagaacgtttacgacgaatggatcttgacaaagctcatcattttctgaagcagtgcatgcagggacgatccctttctattctttgacaacgtaccatcgtaatattgccggccggttgtccccttaattaaatcagcaggccatgccattcaatccgatcctagattatgaattatctagactgatgtgtaggaccgtgcaagaaagttgtggatcagaattggactaaccaaagtgaattgttaattaaaactgtagctttcagacaacaattagcagcacgtaacatcaatttatcatctgtggagttaggatctattacttcctccgtttcacaatataaatcattctaatattttccatattcatattgatgttaacgaatctatatagatatatatgtctagattcattaacattaatatgaatgttaaaaatgttagaatggtttacattgtgaaacggatggagtactaattaatgatgaggacaaaaactcaatttcggcagtcagacttcaacgtgcccggcacctgacctcatgaaaacaaaggggccctcatcaattaattttgatggcggccggttaacttaattcgatggtttcatggaattttgctttatacggagtactctctcagtaaaaaaagaactaaattcctgcgtttccgtgtctaacgtttaaccgtttgacttatataaaaaattataaaaaaatttaaaaagataagttatgcataaagtattattcatattttatcatctaacaataatgaaaatactaatcataaaaaaattcatataagacggacggtcaaacattaaacaccaaaacttaggaattgagtcttttttgacgaagggagtatatatatactattaccactctctctctctctcttcagctatggctataaatacgaacagtaaaaaaatacaatttctttttagaccaaggtagtactatattgatggcagtagcttcccccttaacacactaaattcgtgggttacctactcatattgatgtggatgcttacactactgtacattaaagatttgttatagttttgttatactctttccatttctaaatatttgatgccgttgacttttttaaatatgtttgaccgtttgtcttatttaaaaaattaagttatttgattcattgttaaatatacttatatgtatacatatagttttacatatttcataaaagtttttaataagatgagcgttaaatatgtgctaaaaagttaacggtgtcaaatatttaaaaaaacagagggatatatgtaggacctaacttcattatctctatatgtaccttagcctaagacataatcacatgatttctaatattaatattactacataattttagtgttttcttctttcgaggcgctttctataataggtgaagttctcgggccttttttttttttaaggtgtgaggagaggcagttctcgggcatcttgaagctaagaattagggctttgggaagtgaaactcagaggcatcatcaccttatgtatggggcttttctctactcttgtacagtaccagctgtgaaactcagagacatatccaacttagataactcgtccactgaagagaaatgcactcggccttagatattagcctggatcaaccaacaattcgacacacgatcctaaaaaaaggaaagctaattttgacctgaccgtaacatgggaaattttgccgtgtccccctagacgccgtcgctgtgcattttagaaagcacgtgggaatttcggcagctcatacttttctttcggacgtgactagacagctaggctagtggtagccagctaccactccatttaagagagatattatccacttatactttaaatgtaattttctcttaaactactcatccgatacgatccaattgcaccgttgtgttcgtcacaactaattctttataacaagatcttccatgattatattttgatgaaaaattataaattacttttatcatatatctaaattacttttagatttcaccaaattacttcttagacatataaaagtaaatttaataaagactaaaagtaatttacatatattatggaagtaacttataataaaaagaaagtaactttaatgaatgccttttttcattggacgtgaagtcatatttttatccctacaacgaatttacttctaatgtcgtgacaaagttacttccgttttgtttttaagttacttttataatatatatgtgcattacttttagactttattgaatttacttgtatatgtctaagaagtaatttagttaaatctaaaagtaacttatacacatgataaaagtaacttacatatataataaaagtaatttataaatataaatattttttcatcataatataataatgtaagatcttgttacgaagatttaattgtaacgaacacaatggtgtaattggattgtagatcggataaataatttgagagaaaactttgtttgaagaggaaaaatacatgcatgtctattaaaaaaagggacggtctatactgcaaacgcatgttttttgtgtcctatttcagtcagatttctgtaccacacgatttacatctaacaactcacaaaaactgctacaataacatattataaaagtctagatttatttttttgagaccaatacaggccaaaaaagcccatctatcttaaaaacaaattgacaagcccacaataaagtctaaaaaggtccctagaaaaacagagacaaaggcacgtgatcaaacagagcccacaaaacaaacatatttagaaagcttgcaatccaagttgatgggcatgtgatgacagctaactattacagatcacaactaggaccacctctttccaaagagatcacacaacacacgccgcaacaatccatattatactagggagatggagctagaggaagagaaagatcccccaaaacatcaatccaaaatcaagatgaattcagaagagatcaagaagagaaagatacgcttaggaaaagatcaagatccagaaaagaaggaaatgtcaggaaagaatatcaaatctatcaaagaaactggtactaaaggtcaatccaaagaactccaaaaaaaagaatcgaagagcagaaagagcacaaaagacaagtccaagaagaacaaaggtgagtgaacagaaaaattctccaaatattacctgcttggttcttttcagaatttgattcttcttttggaatttgtttgatcagatctgtaaagaaaagttaatgaggttagaaatgtagaaactgattagatctaaaaaaatgaatctattctaatatgaactaaatagagtcaatctgaaagtaaatctgaccactgtaagtaaattgggcaaatcactgtaactgtcattttagaactgggcaaatcactgaaattttcagaatggtgaatagtgtgaatctgttctaatatgaactcatatagtcaatctgaatgtactgtcaatgattgtgcagatatgactcaagtttcagcaaatgcagaagaatttcacaaggaatacaccaccaaagtgatcagaaaagaatcaagaacaggtataaattattttcttgcctgatgagaagcaaaattaagatttgcttacattattttcagtcatttaacaattttcaaacaagttacagtgaaagaataataaaaatacatacaaaagaacactgtaattttagttcaatatgcatgtaactgcaggaaacactgtacaaattctaacaaaagcatgatctaaggcagttttattttcaaattgaaatggtttcagattcatcaagcatagaacaagtcatcggttcttcaagcatacaggaaatggagacaaatgaacaagtaaaatcaaaagacacttccaaaggtatgtattcctcatacttgacttttatttttgtttcatttcaaatattttagaaatcaccaattatcatagagtgaaattgtgtatttgcatgatagcagtatattcaaaagagcacataatggtcttaattttcacatatttgtctacaaatcaatatacaaactagttacagtcaaatatttataaaattacatagaaggaacactgtaaatttagttcaacaaacatgtaacttctagaagcagtacatatttcatatcaaatcaacaactaaaagcaaattttattactattcattacaacattataaggactatacaacaaatctaaaaaaaagtaattcaaagcaaaaatgaaatgtctagtattgactaaaacgtaacgtcaatgattgtgcagatatgactcaagttccagcaaatgcagaaggaattcacaaggaatacaccaccaaagtgaatagacaagaatcaagaacaggtataaattattttcttgcctggtgagaagcaaaattaagatttgcttacattattttcagtcatttaacaattttcaaacaagttacagtgaaagaataataaaaacatatacgaaagaacactgtaattttagttcaatatgcatgtaaatacagggaactttaaatctaaggcagttttattttcaaattgaaattgtttcagattcatcaagcacataacaggttattagtactccaagcatagaagaaatgcagagagaaaaataagcaaaaaactaagctgaaacacttcagctgaatctaataaaaaacaaaaacactaagctgtacaatggtactgaattcaattcaaaaactatttaatttcacaattaaaaattggtgctgaaatcagcaaattgaaacaaattatagttaaatagtaataaaattacatataaaaataaatgtaattctagtattagttcactgtaatttataatcttgtgttttaaaccttctgtttttttcaggaaacaaagataatggacaatcagggagaagcatttctttagacacaaaaaaaggtatacaaaaacaaaaaaatatcatatatatggcctcagaaattgtccacttcaattagtacaaaaaaaatggacatttcttagtattagactataatttttttcaatattcacataggcaaaatttttatcaattttgcaagctcaaaagaattagttagctatagattgtcaagcacctttttacatgcaccattctcaaaaactagtatataattcttgcacttcaaattagcatatataaaaacaaaaagaagctagtacactagattattttgctttacagatgttaatttgaagtacaaggatgatggactaattttgggaaaagcaaaggtaaaaaggtgcttgacaagtgaaggcaaaaatttcgcctatgatgatgagaagattttctttattattggtgctcttagacaagtaaacaaacaacacagaggacaataaaaaaaattgatatttaatataaagataaatttcagagttggcaaaaaagatattttcgctgaaactaatactaaatagagattcatcactggcctaaaactttaaaatacaagcacaaatcaatgcttctcccttcaaaataaaattacatataaaaatgactgtaattctagtattagttcactgcaaattatattcttgtgttttaaaccttctgttttttgcaggaaacaaatataatggacaagcagggagaagcatttctatggatacagagattataggtgaattttaatttgaatatttgttacatctagatattctccaaatatcacagtgaaataacttattatatttttaatttctatgaagcaggaagaagtatttctttggatacaggtactattaccactttgagttatatctttctttctttggatatatctatatatgtcaaatttaattactgatgtactgatttgaattatattacaaattatgttctgcaggaaacaaagataacaaagatgcagaaagaagcattcagcatggaaacattcagaatatgactcaattagttttgacagaacataacgcaaatacattgatttcaggtaagaaacataattagtttcaaatataatctgcaaagatcacatttagacaaaacatcatagttaaaataaaatttagctggtttgaatcatatattgtcaaaatatctgtcaaaaatagataattagtgatttcatgatgacataaacaatttcatttacaaataaatatgcagacactcatttactatgtagatattataattttcaaataagttacagtgaaataaaattaaaattacagttaagaaacactgtaattccaatattagttcactgtaactaatgaaaaaaattaacactttagttaaaaaaatatcacagagtgatattgtgtatttgcacagtcttaatggtcttaatattcatatatatgtctagtaatcaacataaaaacaaattacagtccaaaaattaaaaaaaaacatagaattaacactgcaaatagagttgaacatacatgtaactcctagaagcagtatatatttcatataaacaagtaaagcaatttgatttaccttttatttaattttgttggactctgcagcaaatctgaaaaattcagagaaaacaaatcattactttcatattttgagttatgtttatatgcagagactaaaatgagtaatgagtaatgagttatgtttatattttgagttatgtttatttgcaggcatctcaagaagaaataagcatcaacgacaagatgaaattaaatagagaaaaaacaaattcaagtgatgagtacaacaattgtactctacatgatgaatggtctcttttaggagtaagttttggaatgacagaatttataatatcaaacaaaaatcagcaatacatgtcataaaataaatttgttttcaatttgcaggctcaaaatttttcatatacaagtctcatggaacaaattatatcatctcaaccttcaatatctgaagttcaggtattttacaagtgtaataaatgtaatgttgaagacagataaacaatattattaatgtgtaaaactaacattttaaatttcaaatgcagcaagaaatatcaacagaatcaaactttgttgctacaccaagagcatttcaggtactcacatatttcataagaagaaagaaaatagtaaatatgtattaaattttaaataattgtcttattatttgaattactttttgtgtagaattcaatgatattgacaacaagtagaacataagatattccttttgatatggattatgctaatacaaatcaggtatgaattaatttatttttttgtttctataaatcgtatttgtgatacaattaatgtttgagtttacttatgatattatttgttctaactatttttaaaggttgaagatgaggatctggaagataatgaattggaaaattggaatcttgatatgttcaatctgtcaaacggtcaaaatgtaagatttactaagaacttttcattactgaaaattttacatttgaagaatgttattcaaatctaaaagataaaatttgatttgataataattgttgtgaaattaaagaaaaaaactttttaaaaaataattgtttgaaatatgaaattgaatttttgaataagcaggtgcaaaattcagctgacaacagtactgaaattggaaatcaagcaacaacaaatgttgatacagtggaaagtaatgatttagatgcaaatggagaaatgttgacagaagaagatataaacaattttttggagcaagaacaagaagaagctacaaaaggaaataatgcagcaattgatgcgaagtacattccaagagttgatatgcagttcaaatcaattaaagaagcacacgatttctttaacttttatgctttgttggctggattttctgttgtcattgctcacagttaccacagtacaagcaaaaaaaggaatggagaagtgattagagtaacattcaaatgcaatcgacatggaaaagcaaagtcagaatcacaagaagaagaaacagaagagacagtagtagcagagagaaacaataatgagattaaagccacaagttgtaactgtgcactggtaatttctaagagaaatttgatttggagaattataagggttaatttagatcacaatcataagatgagtccaagagatgaagttagattcttgaagtcacacaaaaatatgacaacagaagagaaaatgatgataaggacactaaaggaatgcaatattcccacaaggcatatgattgtgattttgtcaactttgagaggagggctgacatctttgccttatactaagaaggatgttagtaatgtgagaacttgtataaataaagagacaagtagcaatgatatgatgcaagttcttcaatttttcagaaagaagaaggagaaagatccaaagttcttttatgaatttgatttggatgagaataagaaggtgacaaatttgttttggactgatggaaggtcaattgactagtacgagaagtatggagatgttgttagttttgatacaacatatttcacaaatagatacaatcttccatttgctccatttgttgggatttcatgacatggaaatacaattgtttttgggtgtgcctttctgcatgatgagactgcagaaacatttaaatggttgttcataacttttttgaaagcaatgtcagaaaaagcataaaaaacaattataactgatcaggacggagctatgaggtcagcaataagacagatttttccaaattcaacacataggaattgcttctttcatatagtaaggaaagcattcaatctgtctggaactttgttcaagtcaaaagaagggttgtatgatgagtatgaggatataatgaacaattcagttactgaagaagaatttgaatatttgtggaatgaaatggttgattcctatgaggttcagcacatctactttttgaagcacatgtggtcaattagaaagagattcataccagtatacttcaaaacaaatttttgtccattcataaaaagcacagctctaagtgaaggtacaaattcaaggtttaagaaagatgttggtccacaatacagtataataagctttttgatagaatatgtcagagtaatggacactattcagaatttggagcagctagatgatcataattcaaggacaaaaaggccaagcaaactttggtctcattactacattgagtaccaagctgtcaagctgtacaattcaaaaatattcaaaaagttccaagttgaacttaagaggacaacaagattacaattgattgaggtcgagaaattgaagacttatgaagtttttcttgcattgaatcagaaaataaaagtagtaagaagaaggaagtaccttgtaattgttgactctgaaaaggaggaatacacttgtatttgctcaaaatttgagaaagatggccttctttgctcccacatattgaaaattatgcttcacctcaacattatgaagattccaaagaaatatattatcgatcggtggagaaaaaaggattacaaagaaaaatatgattttgaagatagaattatacctttatcggagagctcaatcctcagattcaatattctgtcaaggaaatgtgctgaaatagcctcacaaggatcaaaaagtattgattcgttccaatttacagttgatcagattgacaagttagaaaaagaatcaatatcaatgaattcagagcaaagaacaaagcagcaaatggagatagacaaaatagatacaacaaatggagaagtcattgaagaaacagaagaaaacaatgaagaaattttgatagatccagacatagcaaagtcaaagggaagaccatctcaaagatacaaatcatttagagaggaattacagagtaaagaagtttatcattgcagttattgtcaacgaacagatcacacttttccaacatgcccactaaagcacattgaatttgatttgccaagaaagaaaattagaaagacaaaaaacacagcacaaaaggtaaaaaagtatttattttaagaattctcatttgatttaaaatatttaatttgaatttgattgcaattgcagaatgcagaggaagaacaaactgatggttcaaagaagacaaataaagggaaaaaacaagaagcaacaacacaagtattaatggagcaaaaagggactaagaaaagaaagacagatggctaaagttgaagttagaaagtagtgaagcagaaaatagttatactgaatatgagaagttatattcctgcgtagtgaacaattgtaatagtcgttcagaatagttacaatatatgaagtttggtactttt

SEQ ID NO: 10776 - DNA, 6010 bp, Oryza sativa
  unsure (1)..(6010): unsure at all n locations
nnnnnnnnnnnnnnnnnnnnnnnnnnnnnnnnnnnnnnnnnnnnnnnnnnnnnnnnaaataaagggaaaaaacaagaagcaacaacacaagtattaatggagcaaaaagggactaagaaaagaaagacagatggctaaagttgaagttagaaagtagtgaagcagaaaatagttatactgaatatgagaagttatattcctgcgtagtgaacaattgtaatagtcgttcagaatagttacaatatatgaagtttggtactttttgtgatgtgacctttcaagttgttatcttactataatagttacaatatggcgcagaaattgtatctatacaaatctactataaactgttgagctaaagtaatcttggttttcaaagtattcctgttgaattaaatcagccctacaaaaaaaaagaaaaaaaaagctaaatgtaaaggtaacagaagaaaaaaaatttaaaaacatattttttaaaaaaagttaaaatgactacttacctttgcataatagtcagtaacaagtttctttgttgcagagttcagcacaatgttgcatggatggaaaaacaatttgttgacatattgaatccttatgttaggaatgtctttttgagagaactggttggttagcagaactcttggacgccaaatttccatgaatttcagagtaaaaataccacaatcaaggctaaaaaaacagaaataaaaaaaacataagtcataaataataaaaattactagaattaaaataacattcaaagagttaacatttgtaatttaccgatttgtttgtcttggacgaggtgggtatattatcttgaaactagcaaagttaattggatgttcagggacaaatttcctccatacaattgaaaattttgatatatgacaaaatgaaacaatcataaaaataaattattctatacatataataatttgcaaaaaaaaaatcataccagtctgcatctagcattgtattgatagtcttcttcttcttcttcaaataaggagtcaatgaaaacaaaactctcatctttcaaatcaacaacaaacagaaaccaatgcctcaaatgcaatattgggaaaaacagctgaaaaaaatgatacaataaaaacaaatgtaaaaacagagaaatctaatacaaactaattcaattaaacattacataagtacataccatgtcacatatctcaattggtctagcaagtgatgctccagaaaaactcttttggaccattccaaaattagtttttgaagggtgtttcataagatcattctgaaataaaaaaaatacatactcaatttgcaagtaactgagttgtatttaataaaaaaattaaaaattacaaacacttaccccaattgaagagaagaaatagtgtcttttggattttgaaggatgaatcgatttaaacatatatcgacagaacacagacattacaaaatttgataattctccaccttgtttgaatgaagaaccaaaagatgagaatttgcagtgaactccatcaatattaacagtttcttgactgcagtaacagtacaaaacttacatatatgaagaaactgaaaaaaattacatgaaaaaatatttaaagttacagttaattttgcaagaaaaaaaaagtatgcagacattctaacatggagcagcacatgcttgcacaagcattcaatcacagctaaatgttcagcaagtaaatataaaagtgtcaagcttatcccatagcatatcaaaaactataaaaaattaaagatcatgatcatataaaacaataatttgcaatcagtcagaacacacccttgttggttatctttctcaaaggtttttctctgccaaaaaaatttaaagaaaagaaattaaaaaaactaaagaaaaaattattcaccaatgtaataaggtaataaaattaccttatttttagactgttcaccaagcatgcttaatttcattttcaaagaatggagaactagatcattgtgaatctctaacaatgcatcatcgataattgagtctgattcaactttatgtctctgaaaataaaaaaatatcatattaaaaaaataatgttaattacaaaaatctaaatatgcattaatcataccttctttttatggtcatctgtaaatggccttttaccaagctttattttcaatttcttcataagctcttctttagttaaatgaagcaaaggatcattttcctcaaaatgttggtccttaataaaaaaacaagaagattcaaaaaaaatattgaaataaaaaataaacttccatgataaatgaacatgacaaatgaacttacatgattatcagaactttcatcatgattagataaatgaacatcactatcatgattatcagaactcaaactacaatcattgtcactgttagattcactagaaatatcaacttttgatctttttctatgacccatgactgcaaggagagaaaaaagatctcaaaacataagtattatggactaaaatatataacaaaacagaataaaacatgcaagttaaatgcaccatgtcatatgaaaataatattactttcatatagtagaaataattattttcatagagtagtgtcaaatgtgtagcacaaactcatgtcatatatcagagtatagtgatgactaggaatactatactcttctccttctgaacaaatgtattaacaatactcttctccttctgaatactaaacctgagcatgcaaaatgaagagacaaaaattgactactataaaaaacattctagtacagaaatcttcaataacttgtgttatttcctcatgtaaggttgtcattgaaagattaaaaataccaaactaaaatgcaaatggcatatagcatttgtggatttctagaaaaaaaaacatcctgaatcagtgcataaacatccacctaaatagcatatagcattttcttgcatagatttagaaactgacatcaaagcattactacaaaatcaatcagtgcacagaacatgcaaatcaaggatatacagaagggtcaacaaatgtacattgcacacatctagttcacaaaagcaaaagcacagatctagttcacaaatgtaaaaaagcaatcataaaaagatatatctaaaatgaaatgaatcacacatctagtccacataaacaatatctagggctaagaacacaaatcacaaccataaacataacagtacttttctcattttgaatactgaacctgaacatggaacatgcatcagagacaaaaaaaattaacaaccataaataccattctaataaagacataaaacttgaaacttagtacaaaccagcatatcttagtcatgcaaaaaacaattgataatatcaataacaaatttaactgctcatataaggttgtcattgaattaacatatagcatttgcagatttctagaataaaaacatcctgaatgcattactaaaaaaacaatcagtgcatatagataggtgaacatatgtacattactcccttatttgcacacatctagttcagaaaaaagcaaaaaacacagttctagaacaaaataaaaaagcacgtaactagttcacaaaagcaaaagcgcagatctagtgcacaagaagacaatatatagggctaagaacacagagatcaccgagtcataaacgaatatgaatcaaggggattcaccatatcaaacacatacatagattccgagtcgaaacaaactcagatctacaagccccacgaatcgacgacctaaaacacaagggaatatcagaaaaacgaaggggaaactcaccaaaatcagctccaacttcacagccgcgtcgtagccaccagcaaaccaaaaactacgagaagagaaaaatgaagagatgaatcaacacaagagcaacaaatagaagaagaaatcaataaaaaatggaaaataaatctgccaccttcacctcccgcaaactgcgcaacaggactgcacaatcaccggacggaatcgccaccgctcctcccgacggaaactccgccgctccgcccgacggaatcgctgccacgtcgcctgagacgacgagaacgagagaaatatatctctctctctccctctatctgactcactctctctccgtcggcacaaaaaagacaagcgcggatttcaaaattcgaacagtgcccatgggtcccacacaggctgtcgaaaaaaatttctgatgtgggtcccacataattaccacacacaaaaaaaaaagcccaaaagcctagacacaaataaaaagctcataagcccacacaccgatactacaaaatgaactacaagccagtacgaatcacaaagaaatccgatggcttaaaaaacgaacgatagagccaagaaaaaacatgtgactgccaaatagccatcccgttaaaaaaatgcatgcatgtagtacgagtacgatgtagtagactccacgtcttctccatatttaggcgtcactggttaaggtaaaaacgagaggcctccaaatagattttacgttttctttttgttatatttttgttctctgaacgaatgattgggggttatgcatcattcatatggggtgatagaagtcctcttgatagacaggactagcgccaaggaaaaagagaacaaaaggccaagcatttgtctaacgaagatcaaattaattaaaatcagatcatctcatcacctccgtgattgtgggcctgtaaactaatcttctgcagtatctcctcttccaaccaataacgtcgttaattaattagctagattcgctagtcaacattaattgcttgaaaattttcacatcgcatcattatgagaagagagaatcatatccataacgtagtccgtttcaaatgaatgaaaacgagattagaacgaggaagcgaagtacgatgagagagaatatatagtttccgtgacattgtacactcacataaaggacgtagggatcagacggccatataattatatatatatagtcttaaaaaaatatggacatatagttcagcaatgtatatgtgagagtgggcagcccaatctatcacccgtgaactatccaggttacattcattggacgagatctactccacaagtttacaatcggcgtataatttttaaactctgggtctgcaaaatctaaacgtgtgttcggtactttggtttggagatgaggtaagataggtaggcatattcttgttttctgaatgaaataattcctaccactgtttgccacgagagatgagacggtgtggcctatgggtccacagatttttaaggacatggctacacagctatggtagctgatttgtctaaactagctaccactccatctatgataaacactatccacctacacttcaaatacaattttctcttaaactactcatccgatttacaatccgattacaccgttgngtgnnnctcgntnggntgtccactgctggatctggcatgatgatggacacgacctggcggcagtgaatcggcgacggggctacggccgagtcagcgctttgtgtggtggcggcggtgacagcgtgagtcaatctggaggcaggaatcgaatgagaaacacatgcagataataactttttgtgtcacacatgcacataataatttgatttcaattatctcactggtgtattctatagtgggagggaggaaaattaaacagcaagtacaaattcatttgtattcactattttatctctatttcagtaactttgaacagatgcataatagccattgataatttaatattaggatgattcatagtagaacggagccgctccctaatgatgaagctcaccacgttgatccaatgcaaaaaaaaaaaagaactaaacaatcaggcctgaaatgttcagactgttcatgcttatgctctaccaattgctatacaattaaagaagaagatccaagaatacatatgcgtaaaatatgagtttccacctcacagcaagtttcttctctgacaaataaaatgatctaaactcacatcacagtaataaaaataccacaacc

SEQ ID NO: 10777 - DNA, 1677 bp, Oryza sativa
gtgagatcttgttgtaaagatttaattgttacgaacacaacggtgtaatcggattgtaaatcagatgagtaatttaagagaaaattttatttgaagcatagatgatagaaatatttgttctatttgcttgatcaattattactatagtaaagtatgattcttcaagacatatctggacaacggctgattggatgataaggtcgctcattatgactaaatcgagagcgctctcgatttagattttacggatttttaaggtagagagttcatcgggatgttaagggagtattcttcttcggagattacaccattccatccctcaaacccttgaaaattggttcattttatcctgatccatcacatctctttagccaaacacatattaaaaaacaaatatgatacgcaagcattgtttccattttctttagttgtgcttctccattatcaattgccaaaatgagattctaaacccaacattatttatagatgtgcagtggctaagcttggctgcaggatcagatcgaaggggccaatagcccaataccaaatgctagcacgaagggaacacagtggttggaggaatgtcaaacataacttatcattgtaaaccagctagcattcttctatagtaccgtactattcattctgcgtaatctaatcatcgagataagggagggttaggctggcaccattttggtgagttacaatacattaaacctctgatcagagcttgacaacgttttccatccatcaaagatatcaaatttttcgtgcactcggatcagagaacgatcgaccgacaatataatcggccggtgaatcgatccggcccaagcagacagcaccactgtctgaactaactaaatgtctgcaatattgtagtacgtagtacttgcagagccggtgttgaccaactgatcaaactgttcgtgatatatcgtcgtgtacgtgcagatcgatcggtggtacagatgtgggcaattataattgagatcgaccacgctgatttccaacgattggtcgtgcgtctctactacgtacgtacgcgcaggtggttgacacatggatattaattaactatatgcacagattgctactaactgatataggagtacatagtaccagtatctcttaaatttctctccctctgtactctatatttcctgcttgttgtattggaactactgattcgtgcgcatgtgcggtgaacatataactcgcacacgccacaagtacataaacaatttttccaagatgactaaaacagattttcgcgtgcggacctgtgcctaggggtctatgaaaataaaaataataataaaaaagaataacaaaaatttcaaaaatccctcgaaaccataggtccgccgccacccggtcgccaccgtcaatcaaaaccctagcccactgcctccacctaggccatcgtcgttgaggtcatcatcatcgctttcgaggacttcgtcgttgcgggggagggcggccgccaccagaaccgtgcaggggagggccgttgccgccggatccgcatggggggaaggtggatgccgccggatacgtgcggtggatggccacctttgcccttcctcgccggccaagcccttcaccaccgttgggagggaggagaggggagatgagtgggggagaagaagaagaaggccgggacacccgtcatcg

SEQ ID NO: 10778 - DNA, 5958 bp, Oryza sativa
ggactaggggtgaaaagctagggtgtcccactacatggtgaaatagcttagggtggcaatgggcgggacgggcatagtttgacaaaaccgaccctacccccccttcgttcaaggcctagttataaaaccggactggaccgatggtcggacgggaaaaaacgggaacaagagccacgaccggcccggtccaggtaaaagaccgacatgctatcgaaccagcaatgaaccggttagaccacccggttttggagaaaaactgccattaaactggggaataaaaccgcttccaaccgggcttggcggctgctgtacgcgcgcatgggtgctgttggggggaaaacgagcgaaaatgtgcatgggcctagttattaagaccggaccggaccggaaataaccggaaccagagcctcgaccggtccggtccaggtaaaagaccaacatgcaatcgaagcggcgatgaaccggttagaccgcccggttttggagaaaaaccgccattaaaccagggaataaaaccgcttcaaaccgggcttggcggctgctgttggggggaaaatgagcgaaaatgtgcatgggtgggattcgaacccaggaccacatgggaggaagtaaacaccccaaccaccaaactatcatgttacttgtgtatagatagaatgcttaatatatttaagagttattgaaccggattaagccaacggttcaaccatttgaacctgtgaaccattgaaccaagagcctcaccggttcaattaccggtccagtcttaataactatggttcaaggtaacccctgttgtagccccggattgaagaatggagcgaaatttgtccccggcccggcccctctggggccctcactcatcctgggtcccacacactcagtgctagcggtagttgccggtggcagccagagggagaggagaatgcatggggcacctacaatcggaggaagagggagtagaacgacgcaaggagtagtggccggccggcgagatgggggagacgacatggagcagcatggagccgcgcacctgagcgcctgtgactgagagcggtgatgtgaatgcagcgtggagcctcgatgggcactagcagggtgtggtgaagctgatgagcgacgcggcgtgtgtccctcgttgcagcctcgcatgatttttttttcatatgagcgtcacactaatgcactatggtgagccgctgctgttgggaacgatacgttcgttgtggatttgttgagatgggttagggtttactttgtgttttaattttatcttctctaatgggttgcacaagatatacttgctaggctttttatggctactacgtatgggttgtttccgatgggctttagactgctagtggacaacattatttctagggttaatttgatccatgccattgcaaagttgtcatattgcaaaaataccattactattcgtgaaatcttctacatgccactgaaattttgtaaaattcgaaccgttcgattgtcgtcaacatttttgtcaacatctccgtcttagcgcaaaaaaaaatatccaaattgtcctttcttttcacatcctcattctctctcctttgttcttctccaactccggcgtgaatagcacgaagtggccggcagctacggcaggttctgaatgctatgaggggagtagtttaattcgggagcgttttctttcttaattcgcagctaatcttgcaagtggtcgcctggccttgtagagtgcagttgataagatggacgaaagaaataaaggcatggcctatgagctcagtttgccggctgagctagtcaaagcgattctttgttgttttcttttgcaccactaccactaccaacctgctactaatagagaacatcatcgcacgttagatctgactaaatagaggccaaggacatctcgccgttcgtcatcgctccggccactcccaccgccacaccagcacctaccctagctcccgcactacttctaaaggccctgccaatatgataggcatgggtgctgatgggcaggagtggtctggctcctctgtgaggacgaccctaagcctctgtcgaggcctagctcctcccaacttttctgccgatgccattggtggccatcacgactccacgaactggtagcaacgggaaggatagcaccgccgtctccttgcttctctacctatgccatcggtggacaccactagcaggtggggaaagaagagacttggacggggtgctcatagaaatcttgatggcaatggaacatttcaaattttataaaattttagtggcacatagaagatttcatgaatcataatggtattttttcaatagggcaaatttcgaagtggcatggatcaaattaacccttgtttctatacttccgggcccctatgtatgaccagcgggtgaagaagctgactcggccctagccacgcacgaagtcggggccccgcccctactcacccgtgggtgaaaattctcccccactcttggtcccataggggcaggtcctcgccggatccccggccccaacagggcaaatgccacccctagatgagctaagggcggatgaaatagaaaggatgagggaaaatgccacccctagatgagctaagggcggataaaatagaaaggatgagggagaatgagagggatggagaccatggctgggcaccgactccaggcactagcagcgcaacaggaacgatgaccgcaacaaggtgtgaaggcgacgaggagtcgaatgagaggaagttgggaaagagcgagaactcgagaagacaacaatggttcggtcatcggtctccagggttgggccggtgtggccagaagtgtgtgcccatggtgcatatgcgtgaataagcattctagtgttgtgtttaccctcaaatttgtaccccgataaactctagtgtgcaccttctctttcttataatgatagctagcaaggacttgctaatggctttaccacactagggttatagggatggaacgggagggtggtagggttggtagagacgatgggtttagagaggtattgctaaggcctaagtagcagcaaggaaaggaaatgatggtaccatatccaagtcatatgctaaagaaagacaataggacaataccaagtgacgagagtaacttatgacaggcagcaatggcatatctagtgccaaaaccattggagatggaaaaggagataaaggaaaattaatacgataaaatcggcaatgatacgtagaaaagagaggaggagggggagggaagcgatagtcaggaggacaggagagggtaatgatgacaaaccgatgagaagcattggcaacaagaatggcttgaaaattccctatttactgtgtaacttttcccctcgcacttgtgtcacccccatgtgggccctagccgcctctagtgcccccaactcatccacctctggcctcgccaccaccagagcaagccgttagtaagttgcgtcgtgagctatgaaggaagtaggggggaaaaccctagaggcgtgggctagaatgtggtgcaatgcttggggggtatagatgaagctagtgcgacgtggcagatagggtggcacagatagaggttgtgcactggtggaggttgtggcaatgaggatctagccaatgcaactggtttgggacaccgggagagcgaacttggtgatggtcagatccactgtgtggcagtgcatggccaaggtgccatgatatgacgagagggtggcgatgatgcgggctagaggtatcgtaactgatgatggcacacagggaggtggcgatgactacgtgtagttggaccctcccagcatggtggtgcgactcaccccttcttgtcttggtgagattggctggcaagccattgtagcacgggagccaagaggcgcaagccttgacctaggaggtgggcgggcgggcgatggcatgggcacaacacaataagaggcaacaacatcatggggtgatgatgaagcgattagtttgcctaagcggcaacaacgtggaaagtgagtttggcgtagggtggcttgcaaatgtcaagccctacctaatggtcagttgcaagcgtggcgttggcacgatggttccacgctaaaggtgctttgacatgagagggtagaaggtttatggcaaaagtctagcctattcgaggctaacaatggcgacacttatggacgttgtaactttggtgagggcatcacacctctggatacatatgaggggggggatcaggaagcacttggagatgctagaagatggaggccaaattcatatcaagttagagtcaacccgaaatccaggaccagcccacactaaatcattgcccagagctcatccgaactctttttttgacattttacatatgtattgaaagctaacgggactaccttcctaaagggtctggtctcacggcaaaaacatcttctaagtcaatgggaaatgttgaacaagagagcctccaaaatctatccgggtgttgcgccattgtctttaaacccattgggccatgtattgtgttggagtccatttgggacgcatccaggggtcatcggtcgatcctagaacatatttattcagtagccatcgtcgaactagggttgggttttgcttcgattattctgccatttgtgacattcatcttatatccgcaatatattcagatcgtatcttctactctcttgcttgtgttcccgatttgcttataggagataaccttatcggcgaggttaaccgtgtttcaactcaggtgatagccaatggaggagtggtgcagtaattgtgaggggttcgatctatatggtcggagccttgggatcatcaatgttgaggctccacaatcgacttatccaataccaataggaagatcgcgacctacttcttcatcaaaccctactaggacattgttgtgtaatctctctttctatttctggtggatctcttcaagtgaaaaccacgtcttagtttcaagacgaacgatggtggctttcttggtgttgtaacattcctgaatgcgtcatttcaaaagatccattccctttcaaacctctcaatgctggtgtctcttttggtgtcggtgagccactacaagatgaccatgttgatgggctggttagggggggagtggtttcatcttctcatgcaccctcttcctctccagcctaaagacgtggacggagttgggtgtttcaggtatcgggtttgtttttgctccttagcaacgtgtagtatctaatagtagaacattgtttccaactagagacaacctaaacgcaggctggtcgttggttgctggagaaatcggtgtgcatgcgcgctggaataaaggcggttggccaattggcaattagccagacctatacgtgcacaaatgttaatcaattctagtaccactaccagctagtatatgacataccaccatgcactatatattttcagagattcagataacaggcgcacgcggggtgtatgtatgtatttataattggcccctcttgccattgcaaaatgtatgcatatatatataattacgataatcaattaatatccatatcatgaccgtaaacaatgaaacttgggttttgataagctgatgatctttaattaacattatcgacacaattagatgattgttagcacatcctaacttctgtaggtattgtgaacgacgaactaacaacttttcttcacgccctgcacgttttaaacacagcagtgttaaggagaagttgagttaattaatttattagtcagtgttttagcataatttaaatgtttctagcataactaataggctaatttgcgcgcgcacttgcatataagagtgcgcctaccggggctaaaaagccagagatcactccagccactacctccttctgctagcttcttctcaatttcttcaattcttactttagctatagctagctagctgggacaatggccgggaggaggctaccggcgt

SEQ ID NO: 10779 - DNA, 628 bp, Oryza sativa
ggcggtggcgacgaaggcgagcttgggcggcggttgcgctgacgcgccatgcgcgggagggtggtgccactcgtacggcgacggcgccgccgccgccgccgtcgctggcgccggcgacggtgacggtgccggcaagaagaacggtggcggaagacgggtgatggtggtggcgaacgggcgcgcggagacggccggcgcgctgcagtgggcgctgtcgcaggccgtcaggcgcaacgacgcagtcctcctgctcgccgtcgtcaggccggcggcgaacgcgtcgtcagacggcggcggcggcggcggcgagtcgtcctgcgtgaacatatcgaggacgaggtgctaccagcagctggacgccatgaggagcatgtgtgaatcagccagaccagaggtaattaattaacaaacacatcaacttcttagttaacttgtgtaatttaaatctccttgggttcattcgtgctatgcttaaatgatttgactgttcaattagaccccctttttaaaatgccagaatacattttctacagtaagttgtcctctaaaaatatgttacagcaaagtttgagaggttgagtatactcctatttgacaagaaacagtgatcccaacatgtaattagaag

SEQ ID NO: 10780 - DNA, 7203 bp, Oryza sativa
cgactctagaggatccccaaatgtattgaagaaggggtaagtggtgatatatttcactttttatttaaatataatagcatatgcatccaaataggctagtagaaataatttctttttaaaaatcgaggaagttgtaatggcatagatcccgttcgaatctgcttaaaaggatgattaaattttagattaaagtggcgcgtttttcaaactgctaaacggtgcgtttcgtgcgaaaattttctatatgaaagttgtccttaaatatcatattaatcctttttcaagtttgtaataattaaaacttaattaagcacacgttactaccatctcattttgcgtgaaacacttaatcttcatcttcagaagattcaaacaccacactaattaaccctaaaacgaaaagataatccagctatggcccatgaaacattaggcccaccagccgccggcccccaccaccaccaccactgccactctattcacttcacttccaccgcgcggcggcgaggcgagcctggctgcctgcgcgccgccgccaccgcccgacgccgcggcgtgtgttggcgagagcgagaaggccgccggcgagcagccacaggagttcctcctccccgcagaatgcggccgccggcaatggcgaatcgccgccgccacttgagtccgccggagaccccggggagccgtaaaactcgagacgaagaaaatttcaccgctttgttttttttccccttcttgtctcaccttactctattccaacccttcctttatcactaaagttctcaaccaaaaaaaaaaacttcctttattccttttttttcttctctcgcgctcgattcgcttttgtttgttgggtgcaacagcaacaaaataaaagaagaaaaaaaaaatcgatccgcaaatgcgtcggcgttgcgtgcgagctccgatctcctaaacctcctccaattccctcaacgaaatctctctctcgatccgactctgctctctatccggcctcgatcacccccaccaacatcctcctccgattccctcgccttctccttctcctcctccaacttctcgatgacttccactatactaagctagctagcccccgccgatccccgcggggttttagtttagctccgggccacccaatcgccgcaggggatctttcccggtcaagaactcgcggtaaatttttcccaaatctttgcttgtttttactcgagtcgagtcgcaatcgttagcagtagcactggtcggccatcgccgccgccgccgcctagtcgccttcgccgatgttttttttttctctttttaaattcggtttgcgactcgggctatctcgcagattcgggggcggatacgggggaaggaaatctgtggtggattcggatcgagctcttcgttttcttgctctttgtataaattgcgatcaggggcggcggaaacaagggttcttctctgtctctcttcattagcgccggcgacgaggtgaggtgaggtggtggtggaggcgatcgaaatggggtcggtgctgtgctgcttggccgacgacggccgccccgtctgctgcttccgcctcccatggccgatcttcaacgccgctcacaaccacaaccacaactcggtatgattctacctctgcttttttttttttttgcttcttgattgtttattttgttattacttttgcgaaattgcgcttctattttgtgttcagattgtaagcaacgatgaggcgctgattcacgattgagtttagtttttttttattagtttctggtgtcggtaatgtgtgctttgtgatcttgactcttgcacgcgttaggtgttgtgtcccggtgttattgaggtcacattgctgctgagatgagcttggcaaagtatgtaaaaaaaatgtgggtttgaatagagttcgcattgcattggtatgggaaaggaaagagtgattgcattgtggctttgaataaagaaagggttgattcgtgtgtttgcatgttaattttgttggatactttctctcagtttttgtgcattactattaactttaataatccagcaatcgataaattgtatggatatggagtactactagtatcaactcgctgctatttttagaaactggaattgcacaactgtcaactgggactgaataagtaagatgctgcatgttctcaaataaatattcctgcactagacttttcctgcaatttctacacatcattttgtcatctttgctcattattttagatcttctctctatgcctgatctttcaaccatgtgctatccatactcactctgttctaaatggtttctctacagggttccattgctcgtccaagagcggatacacgagttgcgcctgatcaaggaagaattagtctcactgctccatcacagcatgattcgatggatactttccgctgcccgccaaggcccttgccttgggatgatcctcgattcagccatcatacagagcatcacccactagtaggaggacatgacaaagcttcaacaacgttccacaaatctggtagccttggagaaagcaagaatgctgatagcatatctaattccaaagctgtcaaggatgatgggccttccacagctgtgaaggatgatggatcatcagtaaaacaccattcagatggtctgcacattggcaaagagcaagtacatgatcttttcgactttgaggacgactgtccaatatgcctagaaggttagtgaaaacagtaccactactcttttgttcatacatacactatcttatctttttctcagcagatagtgtttactatttaaatttctataatgcaaaatattaacagcaagagaaaggggggagcattcaaacattgttatgctgtagcagaagatacgtgttcatgttgtataattctagctaatgaacagtgttcatgttgtataattctagctaatgaacaatgctcaattgtggtggatcactacattgtgaccactctgctgccataatgtcagtgccatcataaaagaaagctaaatttccgtcaaaaaaaataaaagaaagctaaatcatgctcaggtctatttgcttgcatgattttggtgcttgtgtcgtaaagatctttttttttctcgcagagtatgattatgagaatccaaagatgacattacaatgcaaccacaatttccatctttgttgtatttatgagtggatggagagaagtcaagcttgcccagtctgctcaaaggtacttgcttctacttcacttttaacttcacctcagaagtgaagcgtttagcttgactccatcgacattaatgatacctttctcactacaggtaatgctgttccatgaggattcatgatcataatgctgcaacgtttctgtgatgttggagagtggagactcacggggactggatcacctagatttgtgtacatagcttgacgaaaatcaaagtcgctagattgtttgctgaaacttccagcggcgcaaagattttttattatttttttgtttctgtagagcatataattcttttctcatttttcagaaaaaattggtagcttgtgtcaatccacatatcacatttcgattggatgttacagatgcgcgtttgagtgattgcatttgcttctgatgctgaaatacgaaacttctgaaagccctagcatctgaacttgtgcttcctgtttgagatgacgagagattctttgcattcttcaggtcccatcgtaataagccaaacagcatatttgcaaacgaaaaatatttgtgaataaaacttttatatacgtattcttagcgatctaaaagcaaaggctgaaaaataaacttcaataaaaaaacgttaaaattagcttcaaatttaaggttgaaaatttaaattttgtctaacaagtataagcataaacgaaaagacgaggcccgttcttgccatgactgagttaagtccaatgaacatttctactattcctactttgtggacctatctaatattcctgcatttttcattacaaaactatatcacgcctgcttgctctctctcaaaagaaaaaggaggaataatcctgcttgctctctctcaaaagaaaaaggaggaataattgtattgttgcaaccacaacaaataggagtactaattttcgtcattgtaagctcgagtgttgttaatttagccaaaaaaaaaagggaatattttgagctttcatgcggaaaactggtcaggaactgttttaaaatgtctcaaataaagaataaattgcaaagaaaaatttcctgctatgttactaccacttttcacttcaaattttgtagattataccaaactggatttcaaaatgccttcaaacatttgtggtattcaaaaggttccaaaaaggcaaccaatgaaaaacttatccggatttggagctatagtctaaaatcctatataattatttctagaaagctcagcccaatagcaacatttttttattagccgcatgcctaaacctttggtccatgattggtgaaatcgtccatcaccacacatgtgatgcttccaagtccttaatatttcgttactttcttgttgtattgtactcgaacggatactcttggaactttataggactctgctgaactttgaattttactatttcatcaccggcaatctgtgagcaaaggcatagctgtcaattacgatggcagatttatgcaaatagagcatcgcaccatctattctttagttcttcagttgcacagaagaggggtgattttttatttttgagctaggaatgtaaatcggcacacaaatcattgcatcaccattcatataccgacaattttccgtaattaggtaagtgttcgcaagtccattagaattcggttcagatttcgtaaaattcaacctcttcagaccaggttaaatacaaaaaccactaggttcaaactgaattttaaattttcaaaatttaattagattctatcagcttatcaacagattccacgaaatctaatgcagaggattgtgaaccctgattagaactatttgaaaatgtacaacagcattcagtaagatagttaataatactttaataattttcagtaattaggttagtttgaaaatgtaagcatgtagtaatatagttaacaccaacattactactaataacacattgaagctcgcagtcagattgactagcagatttataaacacaatgaaatagataactcaggagactatcatttaggagatatacttaaaaactaatcataaccagctcacagagcattcgataactgaatcatttcttcatctcatcacaggcaaatagagaacagcaacattgcttctagaagatagttcactggtttcagaacacaagtaccaaaattttaaaagtgcaaacagatattatcaaagtctgcaagggttggattccacagtaacgtaacatcaaagcacataggcttaacgataacggcgaagagagacagtctggttgcgcttccaggtagccctgcgggacggcctggccttgtggtgagtgtgacccttgccgcgcagaccacggtacttcttgccagcagaggtgagaccacggagctcacggtgcttgtgcacaggcttgcagagccagttgatccttgggtcattgcggatagcactgtgagcaacatccacaaggatgatctcaaagtacttgtaggtggagtcctgcattaaaccaaagaaaaccaagtcattaatggaaggcagatacattgttgataatcatctttgaaagatctcagtaaagtgaaatgtacctcgttcacccagtaggagttgagcaccctgagtccgcccaacttgcgcccagctctctcctcagcaactgacctcttgttcctctggaacttgagctgggtgataccctggtgcttgggcttgccgtagacaatacccttgggcactggcctcttcctgccaccacgcctcacacggacacggtaaaccacataaccctgaggaaaggtaacgacaaatagttaagcacaatattttgattacaggacaaaatattcaaatgtgattatataaattggtaaataaatgggagcacccgtacaaaattttgctcagagtatcaatgacaaacaatgcaatttaagttcaactacggcagcaaactgcttttgcagtaagtaacgcaccaaacaacattacctatgccaattacaagaaaaggtctcaagggatgatactacaatggcaagcatctaccatccaatcgaatctaatggagaacacaagacaagtgatactgtccaagaaagcactaaaaacagattaactcaatgttctactaacagttaacaaatggcagtaacaggttccaacaaatcaacagcacagtcgttgaacctaaatcagcagaacgataacctagcagagtctagatctagacaaaaaagtaagcctccatttctacaggacagatcaatacttcaaacattaacaccatcatcaaccgcgggcacaagagaacatctggaggaggggaggtaacctgcttggccttgtagccgaggcggcgggccttgtcggggcgggtggggcgggtgaggcggacgatggccggctgctgcctgtactcccagcaccgcacgcgctgcacgaacctcatcacgtccgactgcttcctcctccatagctccgacacgtacttgtacgcacctgtgcacagcaaaacgacggaggacggatcaggagagagatggaggtggaggggtgggaaactggagacgagagtgatggagggaggcggcgtcggaggaggagctcacccatggcggcggcggcggcggcggcgaacggcgaaaggcggcggcggggaggtggaacgggagaggagactagggttcgtgcggaggcgcgtggcgagaggctatatagaaggaggcgggggcgcggtggccgtcagatggggctagggtttttctcgtgcggttggatgttgcccggggaaggaatggatgggttactgatgatgggcttggcttgggccttattaagtgcagtggtgccgcacaagactcagcccaggagccagcctgctgctctttctcagcctgattaaaaaaatagagaatctattctatttattccactgagttggttcgagttcatgatttgccatcaacattatcactttctataatatactggtgaatttatcaattgttatacaatacgctatt

SEQ ID NO: 10781 - DNA, 6282 bp, Oryza sativa
taaagaggacacataaaaattttcatattttttgaaacttctgatgagataaattaattgttaatcttgtatgtctcaaaggtattttgggtatttttgaaaataaggcccaacccaatgacatattgtagaacaattgataaagtcgctggtatattatagaaagagataatgtcgatggcaaatcgttgaactcgaacaaactcagtggtatagaatagattctctctaaaaaaataaatgatactagtagtttgttattattctttattatttattacggtcttggagatacaactttgaccccaaattatataagtgtataaaattacttcggaagttacatctaagaatatcatttttatgttttcaaactaattattttattaaaattcattgatacatattgatatgatcttatccaaagcatcatataatttccagtgaaaagactaaccacgaaattagtatgagtaatagaatgtgttggaacagcaataaaatgaaatagacaatcaatatattaataaattcagaacaccttgttgttcacataaaaattgcttgatcactccaacaattcatctcctaaatttaagccttttaatcgtatacatggtggatattgagctagcttagcttgggttgttattctaacgagataaaaggttgggtcgacttgatctgtttgctaactcaagctggcaacacattggcgttggctggacctcataaaaacggcaggctccatagcaccagagctagtcaacgaggacttttgtgatggtgccaaagctcgtcaatttttcattggagcatggagtcaaacgaggcgtcggagctcgtcaatatgactgctcagcaatcggtgaaggggatggcaactggaggaggagagttagaaacggatccaaggagctagcatttgggcgggcaacggtgaactaggggtcactagtgctagcactgccatggctaagcaaggacttaaccatttggcaacaggctaggattaatggtgttggcactgctacggacagccaagaagagcgaactggtgactagagaaggggatcatctggtgttggcgctgctatgaatgggtgggcgacaaatgaaagtgatgacgacaactagggtgcgaggcagagatgattgagtcatatatagaggtggatatcgagctagctcgattcagttcctataggaaccggtattgttcatccattcaagaaaaagggaggaaactttcctaccatgctaatttggtagaaaactgcgtgaaaaaaaatcgagtgcaacatctttttctgttcccattgcataggatcgaggcaaatgaagtcttgatgccactaatgcaaggattaagcatcatcaagcttttctactttttattatttagtactgttatttagagataagaagctaactctctaatcaactttgcatgtaccgttgcttcctatgtttttcctatggtttatctagtgcatttctaacctattcttatgtgttctttctattcatgtgtttttttactctacattccaaatgagctcttaatagttagccactaaatttgcatttctatgtttcggcaacatgtctttataaaaccacagctaaaacacagggggagaactcgggagaaaatcggtgttcaggacaaagtgctacgtttctcagaagagaaaaaaaaagggggcacagacgcacagtgcgttgctgctcctctggcgcttatagggcctttggggcttcttgggccatttggttggtcgttttggttgcccagcccaacatgatggtgttgtgcagcagcagtcaagttaggatagttttaagttgggcaagtcaaaaatggtccaactctttacatatcctcttgcagttacaactttctaccataaccaattcaacttatcaacaacaacaacaacaacacaaggtcagataccttggtcgaaattattacagaagagcaaagatgagaccttttacagaagcaagaaagatgagaccttttacttttacagcaagggcaaggtgcaactggagcagccgtaattttcacaggagccaaaaaaaaaaaagccggtgcgtgcatacacttaggacatgtattttcttcacagcgttctcaatttttcatggctatatacagctgttaaaaatgtagaatattatcatcatcagattacaatagattcaagtacctaccgtgtagcaaccatatatcagcaactcttattctttcctgcaaaccagcttttattctattttgcacatgctttaagtaacctataagtgtttcccacacgcacaatcattgagccccatcttttgcagcaacatcaaaagcccttgtgaatgcatttggaggctggccgccgctgagctgaaatttcccatttatctggaaagtaaagaaaaaaaaacacagtagtttgaattatcatggacaagtatccagtcactgaccaagtgataagataaaaagtgcaagagatgatagatatgatcatttaattagtcctcataccacaaagtgaggaacaccagaaattccagaggaatatttgttgagttcttccttgaccttttatccccaaaagaaatgttaggatatttgattcgattgcatctgtcacaaaaagatggtcactagaagtgaacatcggtggaaatgtacctcatcgactcctttgttagaatcttgaagaagttcttctgctccttctatgcccacctttcttgcagcatccagcagaacttgccttcaagcatttggaaattattcacaagattgaataatattgtataaaatcacttattgtcaacataaaaatatatatagggaagcaggatgggtagctaagttggcaggtggacatgtttgctgaagcaaatcaagaagataaagggtacttttcttgcccaaacatcaaaactcctacaaaaatttatcattgatagatagcatggaatcatttctgactgcaactttgcataaagaaaaggtgcctaaaaagggacatctaggaaaaaacttcagcagtatagtaaatgctgagaaactattcacaacccttacgcaccagaacaaagaaattggttggttattttcatttgccaatactgaagcagcacatgtaacaatggaaaatgcacaacgtgctatctgctttggtttaacattctaaataactcgcatccatagtagaatgtgataatctagataacgattccaatatgaaaaggtctgacatattccttttcggaatttcatcagtcattcttcattttagcaacataaaatgagtatgtttattacgagtttgtctcaaggagtaatatagcacagaaaagaaaaatgcacgcccttcaatgtaccactaccaacaggaaagatgtattatgcatcttgctgaaagcctcatacatagaaaaacgattaagtatggctgatttatgtgatttctcatgttgtcccatttctgacatgttctaaatcaataatagtttgtcacaaatatatatgaccgaatatgcagaattgacaaagaaaaataaagtgcaataagattataaatccattcctacaatcttgaatacatactcaccgatcaccaataaactttccatggcaaaagtaactttggaataattcttcaacaagagcactttgtttgtcataaccttggtgcccagcaagagttatgagcctatggctgtccattgtatttccactgtattaagtatttgtatcagcgaactagccaatgatgcatgctaaaaaaaaattcaagactatagcttacgtcaacccagacatgtcatattccatcccaagtcctctaaatatctgcaaaaagagcaaataaaaggctgaatatgatatatatgatgtgaacaaactctgcctttgcattgttcaaatgtattaacctctgtcatacgagcagttgcatgctcaaactgaatagggccaaacttcatccggtagtaatcagatttcttgatgccttccttaggtgcattcggatttaaaaagaatggatgccagcggacctaatcagcaaaaagacacgctagttttacgctgtatgaccatgaagttggacaacaataattttgaagaagtgaaacctcgaaatcaaacttgtccttgttttgctccatagctttctcgaggttctttttcccgacaaagcaccatgggcacaccgtatcagagctcacatcgatctgaatgagcttcttgccagcgtttgaagccatgtaaatcctgcatgtgtataattcacaaagaagctaatcagaaatcggatcaaggcgcctcatggatccggaaagcaaggactgaaaacaagtaaatattttgaatggttgctggtacaggccaagatcctaacacctgtcaagctagtgatccgaatttttcatcgaacacacaagctagtgatctgcagatggcctcaaaacacggtttatttgctatgcgatctgcaactagaaacagcaaagacatttgatcttcaactgtgtgggagaaaatcaccaaccagagtggctgtcagaaaattaaaagagttggggatgtggaagaccatctcaatgaagttctcatatacagttggcatatgtgggaggaacatgatatgaggacctttcaaaatgaggagcttgaggcccatgcggtgtcattcttattaacgagaacattgataagtggaagtgagcaatgtaacagtttggtgtaatttggtgacttaattattcgatgttatatcgtcctcccatagcctcgtaatggccctagcattttcttttggtttttggccatggctactagctgcttatccaagtgtttgtaacctaaattctattacatattaatctttaagagagaatcccttatatgccactagaatttgaccagttcccttatatgccactcaaaattggcttctcccttatatgtcactagtttaagtttttccacccttttatgccactcccaccactatagtgttagttgactgttagtcaaaggttagtttttttcgtaaatgaccaatatgccctctcaactaaaaaatgtgtaaacttcaaaaaatcataactaatttattttaaatcctttttgagtaaacaaaattttatcagaaccagtgaaaatgctctttatattaaaaatattattggaaaactgcatatttcatgcttacattgaaaatttatttgtgatggtaatggctaaaattgcatgtgatgcaaaaaaaaatcaattttcatatattgtatccagcagctatattagtactaaaatacatattattggttgtatactaattctcaaggacaaatgcgtctttttacaatgaagtatacggtcaactagcggtggactggcggcaatggcataaaagggatgagaaacttgaaccggtggcataaaaaggagaagccaatttgaagtggtatataagggagccggttaatttggagtggcatataagggattctctctaatctataacaaggttccttcctttctttgaaaatagaaattggctgaaagtttcctctgcaaaaaaaaaaggctgtacaaactgtgattatgacttcatggttttgttatcactaagctctacgccaaacaaacaaaaagcaaaattggttttagaaaacaaataaaaaggaaaaataaatttaaaataactgaaaattgacttaggtgcagaattggggattaacatggcttgtagaaaatgaaaatggtagttcatcttctcctatctttgctcacttgctctaatttttctcaccaatgtattaatctagccaaccggttggcaatatcaatgataaatcgatgatcatcagtctttggaagaaaatgtcttgtggcatggcatcagcataaatagcaagaaacagcgcctgttctctgctatgcctagtataaaggagaactatgaaacacagaaaggtagtaactatcaaagtatcaattgatcaatcaattaattaaagatcagtttcctattgaaatatagtaattggcaagttcccctgttggtttagtaaagaaaaaaaaacacacagtgaagatcagtttcttgcatccctagagagcaggaaacaactaacaactgtactggaagaaattagaaccgccttgttttcttgggatgaacagaagagcagacaagagtatatgcaagtatgcatcgatggtttcattcaaaagggagagggagaggataggattga

SEQ ID NO: 10782 - DNA, 3423 bp, Oryza sativa
  unsure (1)..(3423): unsure at all n locations
nnnnnnnnnnnnnnnnnnnnnnnnnnnnnnnnnnnnnnnnnnnnnnnnnnnnnnnnnnnnnnnnnnnttgtactgccacacgcgcgcgcgcgccgattcggcctcggccgtgggcatggcgaggcgaggcggccgactgaagctgagcctgcttgctgctctttcgttatgtaacagacgagaataaagtcaccattaacaaatgagagattcattgtgatgtaaccttcacgacaaatgagatttattttgtggtaaccttcacaacaaatgagatttatttgtgtggtaatggagatctttctctatatataatgcaaggcaaaggctctcaaagaacatgtcttcctcctgctattgttccttggtgatactctccttctgttcctgcgatgtctctctatttccccagttctgttcatcccgcgcgcacgggtgatcgaaacgagcaggtgcctccgaaactccgtccgcttgagaacctgcacgggtaggcgggcgatcaagtttttgggtaacgcttcaagcgcaactgctccgcatcatcttcaccaatatgttgacaaccagcgacaacaacaacactggagacttggggagcctcccgtcaacaccaacggaggcaatactgcctcaaactccagtgaagggccattctcgaggtataatgtttcacaattactgtttgttcttcgtttcctacaactgtcagtcacaatattattgcgttctcttgtctatgttaatgcttattctatattaagcatgctcatgttgtacacatctagcactgtcactagatctactcaaattacaaatgtcatatttattgtcttaatattttggattaaaatatgctgcattatgaccaaatttcgattaaaatatgccgaattatgaccaaattttgattaaaatataccgaattatgaccaaatttccaacagtgtggatgtgcgccgctgcacatggcttgccgctgtgttcagttccccactcacaccaacggcacgccccgccccgccctcgacttccaggccgcctgtagccatctccagccctatcatttcgggtataagctatacggtatatttgcaaagaatagataacttgtaaataaaatttttataagcgaaaagatgagtccggattcttcgccgttcctgcaaagtccgcatcgacgccgctacccgctatctccgtggctttagcttttttctttttttttataagaaaatcatgttctctccatcggattttcgtttgctccgttttgggttctggcttcttcactgtacactccatacacaaagaagctgcgctgatatgtggacctgtgaactatgaagcttacatgtaaaccactcgaatcaaactcaaaatcaaaggacagtaaataagaggatttggttcctccatacagccatgttctttctccaatagaagttggataaagttttggatactcgtggcacgcttttcaaactgctaaacagtgtattttgtgcgaaaactttctatatgaaaattgttgtaaaatataatatcaatccattttttaagtttgtaataattaaaacttaattaatcacatgttattaccacttcgttttgtgtaaaacacttaatttttatcttcatcttcatcttgagattcaaacaccaccacaatattgacgacatatgtaacgagtttttttgggtggataaaaaggataaaaatgctaaactatatgggtatatgtgtagcttaattctcataggtagagtacgtagcaaggttgggcgccttcttttgaaataaaagaaataaaagtagcagtacacaatacgtgtatgatctacaccaagctaagatttggtgtaatggttgtcgtgaatagaataagaatgttgatcataacgctttattaacatcatagcttgtcttcagtcatttctttctgacttcgaaatttcctctatttatccatgtcaatgcatttgcacttagataaaaaaaaattctcttagtattgtaagaaagatccaatcttattgggcttcttcacagtgtccagctaagaaagtagttctaattacagtatacatgaccccaacgtaaaatagtttctccaaatgctactttggatagtgtacttacttttcttacaaaatgggagcctaaggctaatctaacctgcacgatggacctttacttttggacgacgatggtgccagagaatataactgttgtttgttttgcccttctacaataaaacatctgagcataggaacatttggaattgtcaccaactttggacagttgatcaatttcatttcttcaagcactggaattgtgaatacttctatcacctcatcttcttgccacttttccaagcttggcatatcacacaggataagactcttcaacctccagaagaatcgataatagctgacctcaatgttgtccatcgatacattgtcgcaaaaaagtgtgagactgtccattccttcaagatgtaggacctcaagtgatggaaaatactgcacaggaggaagcctcttacatcttgcgcaatctttgatggttagtttaaccagattagcaagagtttgacctggcccccaaattggaagtatgctaccagggtatcgccaaaccttgagtgtctgtacacacataggggttctaagagcctccatcacttcctcggcattgtatgcatttacctcgtcattcctaaacataccccaacacaacaacatattggacattcttgtttttagagataaatttgcggcctcggcttttgatttgtccctcacgttcttcagattatatatttcaagccgcccaccgagatccatgctcttgatctcttcaattccatacccatcaccattgcccactatgtaagttgtcagtgtttgaaggttctgcaattgtcccatatttgacggcatgttttctaatcggaagcagccatcgatataaatgtgccttaaattctccataaacctcatgttttctggaagttgctttaggtaaaaacaatcggagagcctcagagtttgcaggttatagatcatgaaaaagtcctctggaagcgacgttatccaacttcttgacagatcaaggtacctgagatgcttcatatcttggcaactaaatggaacactggcggacaagagaccatgcaggtctaacgctctcaaggagttggatttccaaaaatcaggattagacacacttattcgacatccttctccttgtgacaacagtgtgtggataccccatgcattgggtagaatcatatcaacatctaaccctgaaccaaccactgacaagtgatggagctctggcatcacttctgtaagttggtggccttgatgtaggattcggatctcttttccagcagctgacgttgctatgccatgaac

SEQ ID NO: 10783 - DNA, 24289 bp, Oryza sativa
  unsure (1)..(24289): unsure at all n locations
tatgccatgaacaagagggtgcatcttatagattgttactccattgtaaggttgactgacatcttgaagaaatgatcttgactgtagcctatctaacatccaagcccccataccttcagtatcgtaccataccatatcattagccatccacagctggatcagcatatcaccatccacttcaaaagcttcaggaaataaagcacagaatgcaaagcacctcttggtgtctggttgcaagtgctcatagctcatctgaagtgcgaccgaggctacacctgccgtcgtggtcagcatatcgctttctgcaagagccaaccattcattggcagcttctatgacactagaccattcattagaggttcccttctttctcagcaaatccccgagtgttacagcagctagaggaattccatgacacttttgcacgagggattgaccaacctggatgagctcgggtttgtcatctaggccacataacattcgctgcctcattatggaccatatctcatcatcactcattggtcccagctcaatgatgccagatgcaggtgcttctaaggttcttgcaacacaaagttcacgggtcgtcacaatgaccgtgctccctgatgctccagatgccagtgaggttctgagttcttcccagccattggtgttctcatcacaaacatcatctaagacgagcaaaaaccttctttcatgtaaaatgttctggaggtaggattgcaactccttctcttccttgtgatccatttgtgtctccaatggctcacaggttgcaacctcaataatccgttttgtgattctcattgcatcaaattggcgagatacattcacccatatgcacaatgagaaatattccttcacattgacttcatcaaagattaattgaaccaaggcagtttttcccactccttcaatgccaactacacataggaccttgaggccttcatgcttgtatctgtccagacagaatagtttttgctttatctcttgcttctcatgcacccttcccacaatattattttgcattaccaatggcacgtggttgatgaagccattgatctctgcacctagtgcattaagttggccggtgatcattttaaagcttcctcttcatgcttcgaggaagaactaatggaatatacatgttgcgcatcatcctgttcctgtgcccgtcaaccaaagccttgttgtgctgagcctcccatctcaactcctccagtagatgctcaactttgaaggtgagtaacctcaactcagccattgaaaatcttagtgtcatatctttgttgttctgtcctgccaacgatgaccgttagccaaattagacatcattgagtacaaaaaaaaaactctagcttgacatattatcgtagacttgtcacttgtcacaagttaggcatattttaatatcaaaagcacatcggtccatgaataaatattaaaaaaatggcaacaaactcataaaaccatgatatgttctttaggtatatttgaagatagagagcacgtcagttcaaagataaattagaagaaaaaaaaggtttttatagagaggcaactgcattatcccccttattttcaactcaaatgatgattttacccctgcttttctaactttgtgattttgccctcatttttttgaactgaagcttgtgcttgcccccattccgtgtcatcttaacggtgtcaaaggaacgtatgctcttgcagatttgcacatacttttcttaatatttttgtgattttgcccttggtttgacatcaagcattttgacatgaatttttgcccggttttcacttgaattttcacatattcgatttgaaaagatgagggcaaacacaatcttcaaatgaattttgcccctgtttttatatgattttggacattgttaagaggagacaacaaaatggggataaagctcaagcattagttaaaaaaacagagacggcaaaatcacaaagttagaaaaagtagtggtggaatcaccattggagtttaaagtagcagtaagatcgcaattgctactttttaatggtataccaaatttgtcatattgtttctatttatccgagtgttaatgttgctttctcatgggtggtaaagttcatttatatctatcttaattattaaggaaaatggtatctattactacactatattaaggaaagaaacatgttttttttattattttagtatcaaaataactctctgaaaataagaaaaataatattataaaaagcaatattttctagtgtgtatatttacttggagtatcagaaaactttatgagtattataaaaataaaaaatctagcatttacatagatagcatggatattaacatagaaaggataactatgtcttgttactactttccctctttcgtggatgtatttgtggaagaaggcgataggtttttatttaggaaaaatcgtaaaaaaaatatggctgggattttgtgaaagctctagctcgagagagtagatgagtcacttaaaagaactaggaaaaaaaaggcagcaaatagagataacaaaataaaaacatgtaatgcattaatatgaaaacccttgtgtaagaagccatgggcacacaagtaaaagattggttacgaggcgataaataaaacaggggattaatgtacctttttatttatttaacattttcagatgtatcatttcatagcttcagcatttcatattcctaattgtcatgtgaaaatgacattaatagatctttcatgaacatcttattatatcatcaatttttatgaatgacaagtaaaagaacttcatatacactagttaaaaaacgattttcctggacgaggagctatttagattacagacggaccgttttcacgtccgcccgcaaaaatcagcctcccattttcacgtgcggacccttaagaggtctgcacgcgaaaatcgattttcgcgtgcgggcctcttaaaggcctacctacaagtctatccttactccttttttctctcctcaacactttaaaatttcatccttatccacccatcatgatccttatcctctctcactctctcacctctctctcactcccacactgtctcctctctctcactctctcactcagtcgcggctcgaggatggacgtggccaacggcatcatgcagctcagcgacaggcgcggtcagcggcaccgcacgactcggcagcgggcgcggtcgtcggcaccgtgcggcttggcggcgggctcggcagcgtgcgctcggcggctggcgaccaggagcggacgaccgccacccgctcggatccggcggaggcggctacccctttcccggatctggtggcagcggccgtcccccgcctggatccggcgggcgggcgggcttggacggtggggaggcggcggatccggctaccgcgacggcgacgatggagaccgcgacggcaatgatgatgacgaccgcgaggagggtagtggcgtcaactttagggttagggttttgtttttttggatttttttcggttttttatttttgcgtgcgggtgacatagccaccccgtagatttttgcgtccagatgcgccacctgtacgcaacaatagcgatttttacagatacttcgttacagacggttgaaagatccgcacgcgaaaatcgctttcaaccgcacataaaaatcgttattttactattattataccagtggcttctatggttagaaaagaaatagctgaagttgtttattgtaaatcatggtgatgtcctaaatgacaagtagaaaacaacacaaaaagtaaggctataactcgtttcttttctagattttgtttctgaaacttgccttttgttctcaaatactagatttcttatagggtttcaagcgctgtttttcccaaatgggccgctttcaaggaagtaagcactaaggacaagtcaggaggcttttaattgaattgattaataagcatcttatgttgcgctgaagtctaaacagcatcttaaaaataagatgtagagtatccttagatgcatattgtaatttgtaagaactattaatccagagtagccgaataagttggccgattaattatagcatattaataacgtgacactgtttcgcatgatgactaaggtggtgtgtttgcaaactactccctccgtccagaatgtaacaacctattcccattctaagacaatatatctgggtattgtcctaggttgctatgtacgttctgggacgaaggtagcagtagacttcagcaatctgctgctgcgcccttttttttttgcatttcattctttttcattttccagggggaaaaatgatatattattctctcaatgcatgcatatactacgggcatgtttgttacagctctaagttctaaatataactccagaagttgagtctagagtagagttgtggagctgcctaaacccagctccacaactctagtacattttgtgagagagctccacccaattccactcccagttttggtggagttgaaactgtttggctgagctccagctccaggaggggtggagctggagctggagctgtgccaatcagacccgtaccctctgtttttttaacatatgatgcccttgacttttttgacaagggtataaccgattcatcttattcaaaatttttatacaaatataaagaatttaagttgtgcttaaagaacatttgatgataaatcaaatcataataaaataaataataattccctaaattattaaataagataaatagtcaaatgtatataaaaagtcaacagtgtcacatattaaaacagagagagagtacctgcttattggcttttcaacagtaccagaggcaacctggttcatgaagtttacatctgtaaactcaaaccctcgacaccccccaccctaaaaaaaatccaccaacaccaaatatatgcctacagtatcacagaataactatttgattgagccgcacagaaacacatgaatcagatgagaaagataagctcaaaagaaaagtttccaagaggttagagctcttgctaaatttcctctaaaatatttgtaggattgtccattctatgataatttcaaaggatataatgggacttaatcctgtttcaaagggttttatagaaaattttttctataagattaaaatcctccaatatccctacgtttttcctccaaattaaaggagccctaattgttgattgagccataggaaaaacacagaaattgaataagagaaatagggttaaagaaaaaaattttcaagaggttggagctataaaattatccatttcatataaatctatataatcctttgttttaaaactcctcgtagaaaattcttttatagcactaaaattctctgaaatttctattttttcccaacaaatcaaagaaccaggaggggtgcatacataccagttcttccagcggattcagccgcttgtcggagcatctgcagactttcgcacagggtggagtactcgcgggcgatcgtgaggacacccatgaaacctctaagaaatttgtcagatgccttctgtaccaggctgttgaggatggccgtcagctgtccgcccccgtcgttgtcgtcgtcgtcgccgccgctggcggccttcgtccgctgcttttccgggcgaaagccgcctctaaagcaactcgccatggatatttcccgtacgtgctcgacctcgttctcgtgcttactaggatgaatggcaggatgtgggaagaggcaaacagatagtagtagtacatgtgtactactcctatgtatagtactcctagctcttacgttggtgtttggatcagagacttaactttagtctttatatttagacactaatttagagtattaaatatacattacttataaaactaattatataaatgaaagcgagataatttttttaagcctaattaatccataattaaagaatgtttactgtaacctcacataggctaatcatgtattaattaggctcaatagattcatctcgcgaattagtccaagattatggatgacttttattaatagtctacgtttaatatttataattagtatccaaacattcgatgtgataggtactaaaagttttactcccattcaatgtgatagggacttaaagttttactcctatctaaacaggtctaattccttctcccaaatatcggagcagaaggcgaagaagatgcgaatgcatgtaccagtacgaatgaaggcaaatccaaaagtcaaattttgctacttagtgtttacacatactagtacgaacagaagtaaggcccgcggtttagttccctcgcaacaaattttataccctatcatatcgaacagttgaacacctatataaagtattaaatgtaggctaaaaaaataattaattgcacatattaggactaatttgcgagacgaatcttttaagcctaattgctccatgatttgataatatggtgctacagtaaatatttgctaatgacggattaattagatttaataaattcgtatcgcgatttactaacggactctgtaattagtttttttattagtgcccgaacaccctcgtgtgatattctatatagtaatacctgatgtgacaccggaaatttacatcctggatctaatttcgctaaatccaaaagtcaaatttcgctagctctaaaagtcaaatttacaccctggatctaatttttaaacacccctaaatccaaaagtcaaatttcgctagctgttggtaatcatcaccgacggagaccgaccggctatcgagaagagatatgattgcagcatttatttttctttcctttcattccttccaagatacttactccgtcccacgatataagagattttatctaatctagttgtttcacgatataagaaattttactatactacttgtcacatctatcaactctaattcaaatttttatccattttaaccatcaactacccactcaccaataagcaaatatcatttaataggggcattttagtatttttttttgttatccttaaactaccaaaaatgaataatcccttatattatgggatggagggagcattgctatcttcttcctccatttaaaataagacaacctattgaaggatatgacatctagaaagggataaatgattgtccagattcgttacatctctcttgtaggttgcttattttttttatgtagagagtacttcattcatcttagaatataagaatttaaaaccgaattatactaatattatagatctggagaaatagtttgttctaaacaaaagataaacccgcatgtcgttatactacccacggtttatttttctaagacggatagagtatacattactgctagtcaacttttgcatgcgcaatctccaaaatccttcaaactgcagcgatgtgatgtacacaagtgccaacttaaaagctactacctccgtagtgggctagtgtgtgctattggtcaacacacggatcacctggtcaagtagccagtgcaatatttgaagagcaaatttcttcggagagttcctttgacagctaatatatggtttaggtggtgtttagattcggggacttaactttagtccctttatttagatactaatttagattattaaatatagactacttacaaaactaattacataaatgaaaactaattcgcgagataaattttttaagcctaattaatctataatcagagaatatttactgtagcatcacataggctaatcatggattaattaggctcaatagattcgtctcatgaattagtccaagattataaatgggttttttactaatagtctatatttaatatttataattagtgtccaaacatttgatgtgatagggacttaaaagttttagtcacatctaaacagggtcttagttccctaaattttttttctcaaaaacgttatatgaaatctttagacacatacatagagtattaaatatatgccgggtttagttcccaactttttctttaaacttctaacttttccatcacatcaaaactttcttacgcacataaactttcaacttttttcttcaaactttcaattttagtcaaactttcaattttggcgtggaactaaacacacccatagattaaaaaaactaattgcacagttatggaggaaatcgcgagatgaatcttttgagcctaattagtccatgattagccataaatgctacagtaaccctcatgtgctaatgacagattaattagattcaatagattcgtctcgcgatttccaggcgagttatgaaattagttttttcattcgtgtctaaaaacctccttcgacatctggtcaaacatccgatgtggtatccaaaagttttcttttcacgaactaaacagcccctaaacaattgttcaaagaacacaagaaattttacaacatatgattgagatttgagaaaccgtacgtaggaattcttgtccatcatgagctttgattgtaggattgccttncaaaattctactcccccattctaaaatataagcattntgaggacattgatnagtcaaatattnttaactttgacccattatggaanaaaatcaatcatatttaattgacgccagacttgaaagcgcggattacagaacatcggtgatttctgggatcgtatttttgcactcattaaagcgccgaatatagtccctcaatgactcgcccggattctgcgtcaacgcgtgtaggttgtcctcgatcgcgtggcgcttgtatgtttcttggaagttagtgacgaactgttgccacagttctgcccacgaagaaattgagtagggcagaaggtgaaccagccatgaacgtgcagatcccttcaacgcagccggcaagtagttcgccaatgcgttgttgtctactccggcagcatagagtactgtggaatagacatgaagaaattcttcagggtcggtgcttccgtcgtatttctctattgctcccggtcgaaacttctcaggccatcgaacatctcgcagagtacgagtgaaagccctgcacccgctgccaggggcagtaggttgtcggcgatcatacgctcgtcgcggatgtctgtccgatgaagatgacgaagatgatgatgatgatgatgagtcacttggttccggggcgcggtttcgaggacgacgctcgagtatgtgagccttgctgtcgcccatcgttgttgtcccggcgtcgatcttcgtcgtcgtcattgtcacggcgtcgacctcgactggtatcgcccggcacccgctgctcgcgattagtatgttcgcggcggttgtggcgatcatcacggtctcggttctcgctcggatgtcctccttgtttgccgttcttgcgatgtcacgaagagacgcgatgtcgggaatggttttcattatcttgagtgagtcgcgcttctcggcggccatttagatggttgcggagatcactggtgccgcaaggtggaggggtagcttgacgcagtggcgtccgctaatcaggctgttccccattagcgtcgccggtcgacgtttgttctggtggcgccctcacggcggcctctgcgaatgcgttactaaggttagccactgattcccgtagtcgttctgcccattgatcgagatcagcgttcaggacgggatcgaaggggctttcgctcaatatcgcattgagggttctgatatgttgggccagcgtcggcgtaaccgattgatcctccattcctgtgttgccgcctctagatgtgctggttccatcgatagcgtacacgtcgcgtggtgtacttgttgatgatgaggccaggtcttcgagtagatgtaggacagatggctcgtggggatcgatatcgattaccccgacgaatcgatctaaagtagtcgccgcaccttgttccttgtccgtatctctaggagagatttgtgattgctggaccttaggggatgacaccttcatggcgctgagaaggaccttgcagcttgagaggtcgtgagtctttgccttatagataggacaatagacatcacgagttggagaaatacgttgaattccacgctctttgcaggcacagatttcagcttgtacgctgaggaaaaccgagcaagcttgcaaggtgtgcttgctagtcctgtggagtggacaccaagctttagtcgccccggaagttgtccttgtaggctcgtgcttcttgtgggtagaacaagatttggccgcattaggatccttctcgggcttgaatattgtcgacgttccgttctccgcttctgcgggaagatctttcgacatggagtcgaccggggtcgtaatcatgctgttctcactaccgataattgctgcgccagtcgagatcggcattgtggtgttgaccgggaagacgatttcacctacttgagtccacatcagcatcgtcgaagttgaaactccttggtcgatgccggtgttgacgttgtcgtcgagaaggcttgaagtcatagtagtagaaccttgagcaccaagtctccctacttggcgcgccactatcgacagtggatacccgtagatcggatatagagggtattggggtccgttggtaccaggatctacgtagtacgacatcaagcaaaaaaagacaaggattatactggttcaggccccttagtaggtaatagccctaatccagtggatatgggattatatgatggaaaccacagattacactgggaatagcagaactcaatgataccgacaagaccgtagtcaagttggtccgactagatctcacggcgacttggctcctgcacgctccaactccctagactgtggtgggtgtgttggcagtaatattcgatgccttaggtcctgcccaaggggtcccttatataccgcgggtcagttgatctccaagtaggactcggagatatcgaacccctcacgatatggtatagacccagtctcgtctgagtagaactccttccatccgtagattccgtctctatcacgtgatagatttccttaacgtatacggaaactatccgtatacgcgcgggtataccgtatcggtattcaacgtacatccaagaatagagggtataccttatccataaccctgacagaaggtaatatgtaattgccatatctcttgtatgcagcatacaagcatatttctatctcgcatatctcctccacaagtatgtaatcaattgtttccatcatgattatcttatagagcttcgtactacaaaagttataatgtaggtactaaaatttaagggttaatttgatatgtgccattataaatatgcatatccagataaatgtcattacaattcgtctatttatagtcgtgccactcaaattttataaaattgtaactatgccatcgccatcacgttttttatcttcttcatcatttgcacgtgggacccacccgtcagattcatcttcttcctttcaccctcccttatcatattcctcaccatctctctgtacggcggatgggaggagcggacgagcagcgaggtggcggccgtcattatcgccggaatgttggaataaatggctaggcccaatttaattcaattaaaatctcaagggcccacaagaaatgttagagacaataataccaccttagagattaaaagtggagtatctcaacttaaaaaatgagttgagattccctgttgaccggttgaggtgggggtcagacagcaacacgcgccgagcgaggctgagggcgtggcgaggcgagcggccgctgctctcttaagttttgcaatggttgggaattgaatccacctacgattatttctgtaacggacgaatcaattccttgattgattacgttgttactacagtaacggaagcaaaagtgaccgggattgattcttagcgatcgggattgattctcttccccttcccctcctgctctcgatctggtcgatttggttaaccacaccttcgcctgagtacctgcacgggtagatgattgattgcgttgttactacagtaatggaagcagaagcgatcgggattgattctcttccccttcccctcctgctcttgatctggtcgatttggttaaccacaccttcgcctgagtacctgcacgggcagacgggtgatcaggtttttgaggagtgcttccgcacgactactcgtgtttcttcctctgtttgtcggtgtaaacatcgtcttctgcttcggttgttcagcgaccatgtcaacggacaatgccaacggcagtgcgcctggagacggcaccaacggaggcaattctgcctcaaacatcagcggagggccattctcagggtataacactgctttcatcgtgtttatgttctttttttcatatgctactgttaggagcaatggtttcattgtattctattgagatgaatatctatgcttatcctttactaagcatgatcccaggtttacgtttattgatcactagtttactccctacaaatatcatacttattgtcttaatattttggattaaaatatatcaaattgtgaccatatttccaacacggaaagtttgaatcctcacctagacccatcattatcgtcaggggagggaaccgagactcggagagcatagctacagccatggcgccgactcatcacgatgcttctctcgcgcctccaccgtccaccctgctgtcgccgcaccgttccccatgccaccgtcgccatagatttgcctccaggaggtcttgcagccgaatttgcggcttgtttggtatctcgagggaaggggattgggagtttacacgagggaattgatgatgagattaagatgggaatttgattttttatcccaatatcttgtttggtggaggtgatggaattgatagggagtttagttggagattaggtcattaataaaaacggatggctgagatttgcttaaataaattaaaggaggaattccctcccaattacctgcccctacccaggtattgaaaagtagggagttctttccttgattttccatccccatcccaccaaaattcccatgtctcccaaccaaataaaacacttaatagcctcgtccctctaaactcccaatccctccttaaaaactttctccaaccaaatgggccgttggtgtctgggactgacgacagcaaaagattaggacaccctctctggtaggcctctctcttctttcacgggctggcctatcccttatccgagctcttctgtagccgcaacgctcaacatgatgacacgagaaaaaggtttgggtgatgcagtgttactctgatccactcgtttggtcttgtgcagatttttcctttcactgtttcatttttttttcatggtaactgattggcggaggatcttcgagtgtttcgtcgaaacaagaattcggcaataataaaaaggtagtacacaatacctaaaagtggatgaatacggagacaaagaatttaaacaggttcaggtactttcaatgagaggtaataccctactcctgtttggagatttgaatccaccgagtgtagtattgatctgactatatgaatcctctgccctagaggacctcctatccgtcttatataggatggagggcaggattacaagatagaaaccttaaccaatacggtatcggtttcctaaatctactttataatattatcaaaccaggactttaggtcgttccgtaatatacaaggaaatgtaatacctaagtcataatttgtacatttttcatagatataagttatcccctataactagtcggataaccatgccgtgtgggtatggggtacccataatctccacagtaacccccgagaccttcatagtcgaaaagataattttctctcgaactagattactccaaagccgagtgcttcaatcatcttcgccatggtctcccgagtacttttaccaaatctgaagactgtggagggctgaaaaataattaaatgtaaacttaggtgcatcgactagatgcacctaataggtgtagcccccaactatgtggttagttgaataaactaaacatatagtcaaggagtaaataatctaaccaaccgagtggttttgataattgtagtcaaccaagtgacttaatattaatggtcaaggcaaagcatgatcatgaagctggggtgtcgaagagcaaggagaagggggcacgttgctataagtgtcatgagtttggacatataaggaggaattgcccgttactgaacaagaggaaaagtgcgattgcaagtttagcagctcatggtgatgattcagatagcagtagtcatgagattctcacagtgtctaacgagaagtctgaagaagcgtggatgttagactcagctagttcctatcatgtgacatcgaagcgggagtggttctcgtcatacaaatatggtgattttggtgttgtttactagggcaatgacacgagttatcgtgttgttggagtgggcgatgttaagttcaagatgtatgatggaaacgaggtgctactttcggatgtgagacatgtgccgggactaaggaaaagtttgatttcacttgggagcctacatgagacaggttggttgtattaggtggattctgataggaagaccacgaatatcatgaaggacagcaagactgttatgactggtgagaggacaagctcatgttttgtacaagttataagggagtgatattgcaggtggagtcatggaagatggatatactggtgttgatgttcacaatcctaaaggcggcgagcctagcataggctcgtcgggcggctcggcgtgagcgatagaagaaccaactcaagtcctagtacacggaggttcaagcaagtaacagattcaagttggcgtggcatattcgtcaaggtggagtttgttagagtttgtgtcgaatatgtgtacataattggttacagtttagaacttagagttgtaataggcattaggactagagtatgagttggactctatcctaggatctctcataaatagagggacatgcctgttgtaactgcatgatgacttagcatagcgagagggagtggctgccggcaacgtctggccgtgagtcgttgtaactctcatacgctgtatatgatggatcggggaggagcgcccgtaataagtgccccagagatgtatactacggctgaactccattaccaaatatcgtgtctcggtgtcgtcatcatgtttggatctcctatgatgttttcttccgcgtttagctaccgatgtagatttcgggactggttttataacaatacggtctacggatatccccgccgataatggtattccctccgtttcatattgtaagccattctagcattgtcctcattcatatagattcatgccaaaaagtcttacattgtgaaacggagaaagtagtttttatgggatgagaatggtgaattgagggagaaacttcctcctattcaatatacacaccttctgtcccataaaaaactcaatcctaaccggtacggatatgaacacgtgggtgcctagattcgtagttatgattgaaaattttctaagaccaagggaatacttggtaggaggtgataattgagagaaaattattcctttacgtcgcctaaacagatcaagtctcaaccattcgtactccctccgtactcgtaaaggaagtcattttggacagcgacacagtcttcaaaacacaactttgacttcttgtttctataaaaatatttattgaaaagtgatattgtcagggttatggataccacatacataatagtagttgactaaatctcggcaggatccaccacatactatgtcttatacggaaactggcctcgagggagttccggataaggaaagacaatcagagttctacatagaaacgacaaggactactcggattgtatccatattggtttccctagttctacttagacaaggggacacctatggatataaatacaagatcccctaggaggagaggggagggggaccatggaagacacccatgacaatcaacgtacgcccaccagaagacacaacatacaagcctacatacgccaagacacgccgccggatatcgacttcagggataggcatggctattcccctacggtgtctccggataatgtcatgagatacgaaagcgctatctctgatctcgccggacacggattcgaggaggaaggctaccctgttgtcgactaaaagtcagaccttcagaccgccatgtcgacaatagttagataggctaccccacatattgtactggtgtgattatggtgaataaaaagcaacatcggctccgaccaacaggatgtagggctattacctgactgctcagggacccgaacctgtataaaaatccctgtccccatctcttttacctcagtctcgcatatatcctaacactaacgatccccatattgtccaaataccgtagtcgagacatcaaacgtcgacagtggtgcgccaggtagggggattttggtgctctaggatttcgacgagatgggtttaagaagatggactctccgacaacaagctactcgacgactttagctatgaggagatctaacccaaccggagtacgtccccgaatgagatcggaaccatcaacatcaacaattttgatctgttgagatcatccaaccttcaaagatgacgccgccgctgcggagggcatctgtacggtatttccgaccattgacgatcttgaggatgatgccggaagggtacaagacgccgacacctctagagaccgaaaccgactactacactcatcgggtttaagtgcggttttggtcagactcggagtaacaggccggatatacttcctccgtctcaaaataaagccattttgaggttggcacgggtattaagaaagtaggtgagaatgattggaggaagtgtgtgattggttgaaaagagaaagtaggtgaagaagaatagttgtgattggttgagaggaggaggtaggtgaagaaatagcttcattttgggacaagacactgtgctagaaatagctacattttgggacggatggagtaccactgtccgacatcaccacgtactgatcgcttctgacatgtgcacatgcatatgcacagactcaatacgtgcccaggcatgcattggtttgccgtcatatacatgcaccgaagacaattcaacggctactaaggctagttaaggtaattagtagattaattaatttaatcaatctactaattccatagatatatccggcatatatctacacaagtacgcaatattttatatgtaatttatcgtatctatccagatcatgcagcattgtcagatcaataatttattatgtttacctagagcatgttttttatataatgtccgttgtgcgagtacttccgacgataggccaactacggtctaacgctgggggctcgctctattttcttctgtataaatcatgcttgtttacggtttacataatgcctgatatttaatctgctcgttatatcctgataatactagaagatccatgcaattttttgagtacatactcgatattatctgctatatatcttgccttctagaaaatatttttcaggaacaattgagcactcgagtaggttatggtcgagtacactccattatcgagaatattctcgacaaatgtggagttatcgcacccaacctaccaacaaagaccgacgacctatctcatagcaccggccatggctggactactcgagaaaaggttgttaatagataattcctcgtgaacgccgtcggcttgatcacccgacatgattgcgaacggacatctggatatgctataagttgggtacgtgattcatgctggccacatgaaatacacttgcaataaaccaactctagcacttccattggtgtgcgagagataattccgctcgctcactggttctcgcactagtacgcagcaatctctcacaccgcaacgtccattggtgttcgagagataattccgctcgctcactggttctcgcaccagtacgcaacaatctctcacaccgcaacttccattggtgttcgagagataattccgcttgctcactggttctcgcaccagtacgcagcaatctctcacaccgcaacttccattgatgttcgagagataattctgctcgctcactggttctcgcaccagtacgtagcaatctctcgcaccttaacttcagatggtcaaggtacgactacggcagcgtagcggtcctcgcaccatgacttcagatggttgaggaacagctacgactggtcttcgaccggcagcgtagccgtcctcgtaccacgactccaaatgatcgagagacgcctattcactggttctcaaccagttgatcatagtgatctctcgtacatttgcttcaagtggtcgagttacgactactgcctggtcctcgaccagcgatgtagcgtctctctggctacttcgactttcagtggtcgagttacgactactgcctggttctcgaccagcgatgtagcatctctccggctacttccactttaagtggtcgagttacggctactgcctggtcctcgaccagcgatgtagcgtctctccggctacttccactttaagtggtcgagttacgactactgcctggttctcgaccagcggtgtagcgtttctcccactatttccacttatagtggtcgagttacgactactgtctggtccttgaccaacggtgtagcgatttctccccctacctctacttcaacaaagttggtagcaggtacacaatatcgccaagttttttacccagagatcccttaccacgacgacacctagcgttgaaacctatcctactgtccctttacgccgtcctgacaaggcctccgaggaacctaagggatcttcggctggagacgcccagagctgataagaccttgtcggatcctgtagagacaaaagaccatgtaagatctggtcgtgtaagagttctcgccgtgcgtattaaccaagccgtgtaatcggaaattgacttttccaacttcacggctgggggctaggatcagtgcttattcaaccaaggcaggtcaagggtccaagagccttatcatccgagaacgattatctgacgacaaggctgggggctagggagagtgcatgactctacaaactgactgatcgaagtcgttaagagagaagacgctcatacacaaaacattgatcggtaaaattaattcatttttagttttccatacatattataacatgtcaccctttgagcattcgctcgggggctatttctatttgatattcttttctgagtattgatttcaggaaaattctattcgacattgatgaagactccatgtctctatggttctacaccaagatcgactaaggcgagttcgacaaatgtcgacaaagctccgtcgcagactctacgccttctcgatcgcttgagaacggttgctggatctcgacaaggaatacggaatgaagaaatggtgtacccgccgagataaaatttcttgacttcaatccaaattctcgattacagcaagacgagagacttagtcgtacgctctgtactttctcggtcgacatcagagattgacttagacaaaccctttcggtgcccgcacgaggctgataaaggaagtctaacgttatctctaaactcactgagaacggtcacgtgagctcgataacagttcctccgaagtctgcggttgagaatatgaactcgttcatttgcatcgaagtcgggggctactgtcaaggttatggataccacatacctaatagtagttgactaaatctcggcaggatccaccacataccatgtcttatacagaaactggcctcgagggagttccggataaggaaagacaaccagagttctacatggaaacgacaaggactactcggattgtattcatattgatttccctagttctacttgaacaaggggccacctatggatataaatacaagaccccctaggaggagaggggagggggaccatggaagacacccatgacaatcaacgtacgcccaccagaagccacaacatacaagctacatacgccaagacacgccgccggatatcgacttcagggataggcatagctattcccctacggtgtctccggatactgtcacgagatacgaaagcgctatctctgatctcgccggacacggattcaaggaggaaggctaccctgttgtcgactataagtcagaccttcagactaaaaaataagagagagcaagactaaaaattatagccccatattaatcacatcatcaattttctcgtccaaactttcactcctcttgccaaacaatccgtaaatagttcctaatcgaatggatttctcgataaggccgatggtcgcattttgaaagcttgctcagtttcgatcgcctccgtcgtcttcttcccttctccagatgccctgggcgtcgcaccgccatgagctgagcttgggacaccgccgcttgtcgacgaaccggagcttaccgaacgtgctcctcagctgccgccactcacagtccagacgctccaggaacctcacccgcaacgtctccacgacgtcccacgtcacgtcgtcgccgaacgcgcggagcctcccgccccggacgcacagcttcctcaggccgccgccgcgcgccgggtgcacgacctcctgcagctcctccgccggcacgcgccgcaggtcgagcttcgcgaggcgggggaggagggacagatccatcctcccgccgccgccggcgtgggctgcggcggcgccccaccgcacgctcagcgactccaatgccgcgaacccgtgcagccgcggcagctcgtcgtcgggcgccacgggaagctggcgccccgtgctgacgctcagcttccgtagcagcggcagtgccgcgaggtcggcgaggcggcacggggggatcttcttgccaccggcggcgctggcgaccacgaagccctttaggacctggagccggtggagcttgcagacgccgtggggcatttggtcgagcaggtagcactcggacgcgtcaaggtactcgagcttccccagcgacgccatggacgccggcagggtctcgaggttgtggcacgccctcaagtcgagcacgacgaggtcgcggaggtcgccgatggactccgggagcgactcgacgagcgagatgccccggaggctaaggtacctgaggttccggcacgccgccgccgccgcggcgcccaggacaccatccggccggaccatctcgacgtggtgctccggtgacgtctgccaccgcccgagctggagagtccccatcccccgctgctcgcccagccacgcctcgtccatctccaagtatcgctggctcaggttgtacaccgtgacatactcgccgccgccgccgccatggcggctactaccacgggtcctgcacagagtgacgcgccgtgtcgtgccggggaggcactcgtcggtgggttcgccgtctcggtcgaaggcgaagtagctgaagctccgcgcggccgcgacgaggaggtcccggaccgacgggtggaccctgcagtagtgcgccgtgtggcagtgtgggcggagcatcgccggctggaggaggccccgggagaggaggtcctggaagcacgccttcccggcggcggccgaccgcacgatgccctcgccgatccaccagtggatgagcagcctcctcttgatcgccttgccgctcgggaacacggcgaggcaaagggcgcactgcttcagctgcgggtccagggactccaagacgctcttcaggtggccggagccggaagggaacgcctcgtcgccgccgccgtcgtcgtcttcgccgccgcgggtgttggtcgtcatccgcatcaccttctcctgcagagctgctcgcaccagctgcacggctgatttgatctgctccatgaaggagcagagctcgatgtggtccagatcaagaacgtcatcctcatcttcgccgtcgccgtgaccatcgtcatcaccgtcgccgccgtacctgtgcaaggtccgaagatccatttgcatctcttcgaccatcgtgtcaatcttctgcagccggtgttggatagcagagaaaacatcgattggttcccggcgagctaacatggttgagtgtagacacgaaggggaaaatgaggcaacctgaattgtgctatgcacctaccacgacccctatcaccctatgatgtttatagtctttcaaaattttgcaaaggttggagtagtagatgtttattagtgttctgattttttttttaaaaaaacacacacaaaatttgggatgttgttgccgcggtgctaagaaaggtccatgggcgtgggggacgagcgagtccaggatggctccatagaggttaccagatagcaggttgagcccacgttcctcgtctatcctagcgagaatggggtcatcactgctgctgctgtgcctggaaaggatgggatcaccatcgccattatcgcgccgagggaggacgaagtaagtcgcagtcattgtgctgagggacgacgggtagcgtcggcaccggtgctattgagtgagtatgagaaaggtcgttgccgttacactgagaggcattcatggagaccacccttgtcactgtcagggaggaaggggagcattgccaccgtctccagacgaggaaggaagggggtcagggaaatgacactaccaatgggaaatggtacggtggaacaaatatccccgtcatttttgcattttcaatctgttgcctttgtcagggcgtctctaaaaattggaatttttaaagtaggcaaggggctgccgtgaaatactgatgacatgtgtgatgccttcactcttcaacctagacgaatcaagagacatgacgagaggcaaataaggaaatgaacatatcgttttgattgtctgaattaggagcttagcaactcactagtcaatactcaggatgatcagcctcacgctaatgcccaaacgtgtggtggcgaagctgcacttgggtgctagccagatgaaccgtcgagacgtcagtgcagggcatatgcatacagtcaatgaaccacatagtcacataggggtgttaccgtatcagatgggtatgatttgtgaaggcagcgccttagcactcatcaagctgggccgatgggttttgctctcttcgattttgggcccccaaaatttctaggggccctattccatcgctcagttggctcaccctcttcgacgaccatgatctttatagatattatgaaatcggtatttgggtatcatatttggatcgtggagtgtcggcttacaccgacaaggtatggtgtgcagatggatacctgatcttatctaatattgtgataccatataaatcctaaactacacacgttgagagatattttctctgtcctaaaatataagtattcttagaatagtgacaagttaaatatttttaactttgactattaattaaaaaataaaaaagatcaatcatataaaattgatgtaactagatttatcatcaaacaaactactatcatactccctccgtaaaaaaaactcaatctaagatgggataagacatattctagtacacagaatatgttacatcccatcgtaggttaggtttttttatagagggagtagtatgcaattattttcatttaaaatgttttattattatagatattgttggtcaaaataacatctcgaagatcgtgtcgaagtctaaaattggttatattttaggacggagagatcatgaacgactctcattttctcgtgtgtttcacgcctggctaaaaattaaaaaaaaatctactcctagcttggcacgtgacctatgcgtgatccgcaaccgctctcaacctccaagagctcgtgagtcgagaaatttccggcgtggtcggtgcccattttggtcagaatcgcacgagcaaagcaacaccccccaccccgcctgagaaatccccacgtcaacggcagcaaccctcccccctcgatctccgcctgtaatcttcgattcgtcgccggcaaccgccgcccgccgccccccgtcgatctccaaccgcagccttcgccgtcccgctaagttggagagcagcacaagtgctgctgggagccgcttgggggaagccggttcgggcgactgaacgccggggagcgccgccgccactcgctagctccggcctccgggggcaacgccgccgagccacgtcgccggtcaggtatatttcggtttttctgaatacggaaattccatcaacaccagtatccaagcttaagttaggcctcgcaaatatttcaatccagggatttgtgtgccgcatgataacctattagtattattaaaccatccttccattgctctaaaatttgagctctgtattg

SEQ ID NO: 10784 - DNA, 15361 bp, Oryza sativa
tagaggatcccctaaaccatccttccattgctctaaaatttgagctctgtattggtcgatgattccacgaaagctcattggagcccccccaatgacccatgttaaatccacccctgattttagttcatatgctccgctttatcatttttagctaaagatgcatcatatggtagttcgttcgcactgtaatgttgcttcgcctgcttgtttgattgagtggctcttcctgtatgcatgtcctaaacaaacaggcaatggatatggatgatatgctcggtggcctgcgtgttgccggagtgccgaccaagagcgcaatttacttatgggggtataaccacagtgggcagacggcacggaagggcaaggagtgccacttaaggatccccaaaagcctccctccaaagctattcaaatggcaggatggcaagaacctcaggtggattgatgttgcctgcggtcgcgggcacactgctgcggtcgcttctgatggatcgctctacacctggggtaggtcctttatttttccttctgttctttaaatcagactcgaataatttgctaggtgaatggatgaaacttcaaatgaatttattaataccattattgtttatactgaactttgatagtttacttattatgtctcgtgtattttttcctcaatgttatgtcagcacaggcatttgcgtcagtgataaaaatactattatgtctgctcacactatttataagtcgtatcagtgttacaactttctgttttctgacataaccatgttgtatgtgtagtttagttaaaatagctatatagtttctaaaaggatcacagtactccccaagtgtacctaattcaatactaggatataaagtgcttagtttagtgagggttagtttgcaaagtcattttatcaattatagcgcttgagcgccagagctaagatgagttaattctgttgcacccataacagtggttttacttgttcctgaagaaaatcactcacatccaacttaaaaatatgtaggggcgaatgattttggccagttgggagactggacagaggagagtgcaaaggaaccccaaaaggtgaaggcactggagactgaatttgtgaaatcagtgtcctgtggagcacattgtacagctgctgttgctgaacctcgagaaaacaatggcactatatcaagaagtaggctctgggtctggggactctatcaggtctgcccctcatatgattactgtccaatatgtgtgatcagcaatttatttaataaaatattcagcacttgcggtatccatgcagggctcagattaccctcgcctattctggggagcttttgcaccaaatacggtaaatttggattgcactgatctgttgttctttttgtgtgtttctagtagatatttatgagatctaaagtttttacctagtcagacattgcaggtcatcgatgctagtatttttcaaactcatcatatttaagtaatcacccatagtcttcatttcctatttatgtgttaatcttttatccctgtttgctgttgatacctgttatgccatggccacaatgcttagatagcagttcaaatagatgaactcttaattagttgtgtcatgtgtatgttgatgtaccttgggttaactgttacagaggttgtgtacatgcatgcatccaggagtccaaattccatagctgttactattcctagagttggttagtgccttaagataattaggaataagagataagattctaattaggaatatatatcatttgagttaatagaggcaagtgaagattataatatttctatatccttcttcatgttgttcctgactttctatatgtgacatccctgttgatgtagttccctgcaaccagctgctgggaagaacacgtccattgatctattgctactagcttataacagctaccttctcacattgaccacaaagtaaacacaataatgtatacccgcagtctgcattaagataaacctgtttagatttcaattggatttactctggcatattggcatcgtataccattgcctttatggtttgagtaaatatgatctaatccacaaggtaatgtatttgaggaaatagaatccaaatttcctcacgaaaattggttctataccatggaagatctatcttcaaatttaaccaccgaagttcactagtacactttaataccataaaaaattacaatctatttattgttgtttaccattccttcatattgcaaggatagaactgttaaaagctgacatttacccttaaatacaccctcacttaaccactttatctgtgcacgcatgagttttggaatcatctgtcttcattagctaaattggcagtgcacaaatgtattcaggtgtacaaaaccaatcatccaacagtaacaatcacaattatatgtgagattgcactggatggatgcacataggcatcgggtgcaacagagcagtcaaccatcacctgcgcttccagccagttcctcagccttcgctgcttgagccttgaggtatcccttccactatgattcccctcccagtacctcctaatccacatccctcccccatctcccttccctcccgctcattgcagccatggcaacctcaatctcgatccctctgcaatcatccagcaattccccatttccaaactttcaccctcttctccttcctctcctcccatcccttgttcctgcaggccaagtagggactgccccttagactaggtgcagcgctgtattgactggcagagagaggtggcattaaatgcaggagcagcgccatagtcagggcagcaaaggaggatttgatgctatggacagatcgaaacaggaggggaaaaggcggtattctcattattgaatttgataaaagaaaacaaaacaaacattagtcctaacagaataaggtgaaacgatatgaataaatctaaaaattaggaactttggatggcattaaaatgtaccggtgaactttgatggtaaaaatctaaaaccaggatctttcaatggtttagaaacaatttatcaaattccttaatgcctttgatgattctaaaccccatttgaagctgaagtgctcaacactgagagggttaaacataatggccatgtttcttttgcactagaatgcagccgttgctgccacagctgcagacacgtaatactgttcgggttggctgcactgcatctgaaataagtgcagctgaacagggccaaagtctttggagttacatttgcttattgaccaagaactatcctgtctgtgcccccaatatcctaataagctagtaaaaactcccggcatttgttaaataaaacaacaagcaaaagtggatgtgccttttttgtgcattctaggttctgcattctatgtgtgcatgcatctcatgtttctctgttattctaatgtgtacctgaaagtgtatttttggtcatttttcacttgtcttcgtttcagccacaaacttgttcattcattaatgaaaagtagatgcatatgcttgtttcttggctctacagtctgcatctacatgtatctcctagcattataagctgatctctaaagaaactgattggaagtagaaaatcaaaattgtgtcaggtgcacatctacagttggtttaagagaagtgaacaggttgctatgtgtgcttagaatgccatttatttcactatttgatatttttgtacttatgaattgcaattacttgttattttcttaacttgagatttgtgtcatgaattcattcttaaagatactggttggatgtacttaatatcttccatatgtacacaggtgatccatcaggtttcctgtggagctgttcatgtcatggccctatctgaagatggcctgctgcaggcatggggtaatgtgcaaaactaaaactcatttccatcctctatacacgtttttaaattgtgaactttttatgcaactgtgacactttgttaatctgatggataattggtcaatcagtagtgctagatcgttaggctaatgggatagctggttacgtgatgatatttcttgcaacaccacacaaacaagaggatataccccccaacttttttagttgttttatttctagctattaacaagatacatgcaacttttcttactaaccaggctataatgagtatggtcagcttggcagaggttgtacttctgaagggctacagggagctcgtgtattaaatgcttatgcaaggttccttgacgaagcccctgagctagtgaagattgttagagtatcatgtggagagtaccatacagcagctatatcagaaaatggggaggtgtaagtcatctcaaaggatgctgatctctgctgttggtgacagttatgtggtttctcagctgaaaaaaaaaggattgatttatagtggccgaactatatagtgctaactgtaaaaataaacaggcaaatcgtctctctttctgtccttttttttggaacatggcacagcagaggaagcccctgcagttagcttttcattaataaaaaagatactaatttacaaagtagaagtaaaagaaattgaagttacagggtcataatacagttcaaaagttgatctctcaaagtatcattaatcctaaaaaaagaagataacaatcctccttgaaaagcattgacaagtcaaaccaacttttttttttcaactgatgacttccttcacactccctttgctgctttattaagatcactatgtacgacataatatatgtgattttctaattatgtagacaccttctcaccttctgtgaacagaaaatgtgtcatatgcttatccacagttaaatcatggtattacagaaaataattatgtagacaccttctcaccttctgtgaacagaaaatgtgtcatatgcttataacagttaaatcatggtattactgtacttaaatggcttgtcaggtggttttgcgaattatttgatttgctagtctattttttttatcatatgctcgctttgtttccaactagatgtcagatgtcaatttataatgcatgctaccaaacctttaaaactttgattagtaaaatatacaaaaaaaaaggatccattacatggtaattgtattagtagacctgttaaaattaatttcacaccattgcattgtctatacttttacaatttttactaatgtatagctataaaagaacgatcaagctgtgtccatgtaattttctaaaaaaactattgggaacagagtgcgcgttacaagtattttgagaattttgttcaaatccttcatgtgggttgtaacagcttattttatgccttctattgtggaacatatgtctaatagactaacaggaacatgattgtttctttttaatttttttaaatatcacctaattttgcagatatacttggggactgggaagcatgggacagcttgggcattgctctcttcagtctggagataaggagctgatcccaaggcgtgttgttgctcttgacagaacagtaatcagggatgtgtcttgtggtggggtccactcttgtgctgtaactgaagatggagccctttatgcttggggtggaggacatgtgggacaactgggcctaggacctcagagcggtttcttttcttgtgctcttaatggatctgatatgcttcttcgcaacattccagtcctggtcataccatcaggagttcagcttgttacttgtggtcattctcacacccttgtatctatgaaagacagccgcatatatggttggggctataatagttatggccaagccgctaatgaaaaatctacttatgcttggttcccctctccagttgattggtatgactctcagagtaatattctttcatctgtattgctatttttggtagttaattacagtatgaactttgaactttgcacatttcgcaatcctcagtcttaacctgttctttttaataatataggtgtgttggagaggtaaggagacttgctgcaggtggtggccattcagctgttttaactgatgcatgttctctaaaagaactgtgtgagttcaagctagcagagacagttaacatgtccaatgctcttctaatagaagatgttgcatcgcggactggtggtgatgccttggcacgtctgtgtgagaaattgaggtatgtacactgaaatttggagtcactaatgtttcttgtgtttcatatggtcaagtcctcatgcaatctgttttccaggccagtgagaaacattggtaacataaatcatcattagtgtgatcttagttccatgtgagagtttccatgtatctcggatatgcattctgcatagttgtctcaattattgaacgagcataaaatccacagtacatactaactttgctttcgctgttttcattcattacattagcctattagtttctcctctctgctactgattttggcatatttacagggagcatttggttgagcaaggagagtgtgagctgttggaaaatcaaatgattgaagaggtggaggctaaagcctaaatactctagtgattcatcgctccttcgtaggcattgattgaagcattaatcgtcttgttgcacttcatatgaagtgtgattgtagtgtctggactgaaggctctaattaattgtctattggactgtgaagtcccattggtgtctccaatgtgtatcaaagaaatggggactacatgtatgttgtatgtatcatgagtgactgttgttgtagagaaccaaataacctttggcaacttgagagctgtgctttgtcactgaaactaactgtaagattgagagttgccaggtcatagtagtgtgattcatgtctggtctcttttgttaactgtacacgttggaacgctagactccggttcatgttctcggctatgctgtggtttggtcctccgaatattaagcttttcactaaactctctaacaacaaagtcgttgtagtatagtggtgagtattcccgcctgtcacgcgggtgacccgggttcgatccccggcaacggcgatttctttttccctttctttgtttttttggctgctggcaacggcgatttctttcctttcccttgagattaacccacgcatttcagtttcactacttctgtagtcatcttttttattaagttatttgaaattgggattaatccgcatttcaatttgatttttgtagttcatctgtgctcttttacaatgcttttcaatggagtgttggttagtcgtgtgatttctgtctctcctgaggatttggaggaggccgtttggtttgtgacccaaagtgaaccatgcttaaaacaaatgtcttcgggaaaagaaaaaaggcattgttaaattgccactccttctgtcgtagaatatagcgatctaccattggacaggacatattctatattacatgataatatattaacctgtcaatatcggtagtttttataatacgtccaattatagattgttatattatgggaaggagggagtgtgccatattctctcgcatttcttactgtcaaacacgcagctttgccaaaattttgatctctttacagctcaccaaataatagcttagctaatctcaccaaaatattggtaacagcctagccagtctcaccaaacttttgacaacaatccaaacgaacacattttaccaaaggtgcccattcgctatgagttttttaacacacccgattttgcaaattccagttccagctagatgttccaattgcagagacgtgtaggcatttcaatgctgctgctcagagccccattggttttcctaataaatcaaagcaaaaatttaaatttaagtttggagttgatcttaaaatatgttcacttttaagtcgctaaaaatacaatttttttgtttataaactattgttattctctaataaacagttttgacttgttagaaaatgcaggcaaccaatgagggccttgaccattcgtccataatgcctacgaaatgatttagaaatataatatggtagtgcatacaattctcagaacaaccaacaggtatagtgatttgcaaaggttattaaatacaataacaccatttagcaaccaaagcacgactatcaaaattacatgataaaattattattgtcttgaattatgtaaacgatgataacaaatccttttccagctacaaaagaaccagcataacaacaaagaattataaagttgcttaagtaatctctcccttcatctcaaaaagagctatatctagggggcctaggccacagcaacactttcacttaaagggtactttccatcctgcgacacacaagctcccaggatcaatctacttggccttgccgttctcgacagcagcagtcgaggggttcagctcatcccaggcctcgatccaggtgaccatggcatcggcaagcttgacgaagtaggggtcgatcttgccgagcttctccctgacctgctcggcgagggagaggtagcacttctggacggtgtcgcactccttggggatggtggcgttctggaagaaggggatgatgtcctcctgccagaagatgcccttgtattccttcttcaagttcacgaaggggttgctagccttgctgtgccagatgtacggcagtccagtcttcactcccaggctcaggtggtcacagatgacctaaagtttcaagaattaatattaattattattttgtgaatggaatgttcaactgtgcaatgagaaaagacatatcatgtaatagattcatggtaatgacttataacttttcgacagaaacacaaaccttcatgcaccatccagcccacatgtcgtcgtagcgaccaataggctggccatcacccatgagaccaaagtacattgcaggaccgatgagatcacggtcaaaagcaaggttcatgccacacatggggaacaaggttcccttgggcacagtcatgacagcatcaacatacctgaacaaaacaaaaaaaaacaggggtcagtaaaacttattgatgcaagagaattgctgctgaatatcagatcagtcaaagaacatgcagtacctggagttcctctcacgaggcttgaccatctgagtaggagcatcatagtcagggatgttaagccacaggccgtgagagacagcagtcttggctccctccctgaggctgaaggggtaaccacggacaaagtcagcgccttcgcggtagggatcatacaaggtgttgaagaagaacggggtggacgggctgaggaggttcttgatgtgctgctcaagagcattgatgtccttgccagatgggtccttggcaacctacaatgccaagtcattcagttggtatgagatctataatgcaatgctaccaattgaaacattattacatcaagctaagctattaccattaccaatagaatgaattcgatcgcaacattactagaaaatgctacataagctttgaacttgaatggaagatcaaactggttcttaatatatttgattaagaaaatgttgtggatctcgcacaggagagagagccaaaatcacatcattatgtcaatttcatcagaaaagtaaaaaagcctgaaattgacctcaaatgcaccctcaacttggatcagatctgaagcaattatcccagatctagcgataccaaagcactctgataccgtttggttaatacttgacaaactgaacttgtcacatgtgaagcagacaagaccgcgtaagataagacgaactcccctaaccaaaatgaaaaggacccatctaatgacaatcatttaactaaccaactaactggcaagatctaacatcaactagagaaattgaggcatgcgtaattatcatatactaataattttaacaacacataaagccagaaaccaaacaaaagtactaatccttttcgaacactgcacctacctaccaaccaaccaaccaatgtgatctaccacactagctgatgctcacgctcaggtgaagcaagggatcaagatccgccgatgcgagatccagatctgatcaggccagatctggccaattccgaacgaaccggacccagatcccgggcttcccccaccagatccacgcggaattccgcaccaaaacaaacacagagagatcgagatcgagatcgagaggggaacttacgaagcagtcgtcgtcgatggtgaagacgtacttcttcttggagaccatgtagccgaagcagcggcatgcggagtccttgaaggagatgcaggaggccttggggccgaggatccggttgatgtcgttgcggttgtagagctcgtagtcgaagccctcggggacgcggatggtcttggtcgggtcgccgtcctgcacgatgatgaggtggtagggctggaagaagggccgccacatctccaggaagtccaggttgcggatcgtcgggatcacgatgtccagctcgtccttgagcagcggcgtcgacggcaccgacgccgacggcaccgtcaccgtccccgccatgatctctccctctccctctccctggatctcgcgcgcgcggaggaagaggaggaggaggaggaggtgatggtggtgaggtgtgaggtgtgtgtgggtttgggtgggtggggaggaggaagcgatttatagagcgggagctccgggaggacgacgactttgttattcgtttccttctttgctttgcttcgcttgccttgctttttttttaaaaaaaattgtgtataattaattagataggagtattatattattttgtgcctattttgttttggtttgcgtcatatgtttgccgaattttgggatgcgtccaaatttattttgggttggatctgggagagacctgtcggtgcatggaaagagagaacgtgtgtaccagtgtagaaggtttgaatttttattttttttggtttgttccaagcggtggataaaagataggggtatcttaatatcgtttttattggagataaggggtaaaagtgttaaatcaaatgaaatgcacaatagtggcagtggtttaaagctctgcttatctcaaaatcaatggaaagaaacggccgtttcctaaaatagaaacaaacaaatactccatccatttcaggttataagatgttttgactttggtcaaagttaaactgttttaaatttgactaagtttatagacaaatatagtaatatttacattaccaaattagttttattaaaataataattaaatatatttttataataaatttatcttggatattactattttttctataaacttgattaaacttgaagaagtttgattttgaccaaagccaaaacattttataacttgaaactgagagagtaagagtaagaaacttattttgtctatataatatcacttccaatagatgtttttttaaagcttgcagtttcaattggttacagtttctcaaaggttaaaattcctacttttatattaggtccgaggcattacgcaatgtttgtcttgataaaactagatatactctctactatatcttaagccgctacaagcgactcaacatttacaatcatgagaacctaaaccactattaacgcctcgtcatttactgttatggagaacatgattactattttatgaacaattgttactaaaatgacaacatatttatagttgcgagatatacttacaatctttgtgaggatacattttactattttgtatgaatacatttatgctcacgagggaagaatggtactattaccttgagctctactaagcacttactatttgcttatttgtttgagtatggaataaaatcgggtgcaatagctatggtgactgtaactttgatggtcacaagtgcatgcaaaatgaatccaataaccaactttccgtctcatgcgagaaggtgaatagcgtcgtcaatgatgacttcaccagcacccgtaacttccatctctctaccagtgtcgaccacctccaccgctaccacgttcaacacggagcacatctccacaaccaccgaagtatctccccgtcgaattccaagttctttgtttcgtcgtggagattgctaacttttcacgctcatgtaatcatttgcaccaaacattgcaattaatcgagctttaaaaaatcgggtgcagtagctatggcgactgcaattttggccaatcactatgatatagagcatgcaaaatgaatcaatgttattttttaaagcccgcagtttcaattggttacaattttttttaaggtttaacttcccaattttattttatgtctgaggcattacgctacatttgtcatgttaaaattagatctaatctctagaccttaagccgctacaagtgcaccaagatttacaatcatcggaacctaaatcactactaacgccctgatatttaggatgacctaatctaatctctgtcggcttggcggcatgaatctctcactcgcagtcttcggctagcatagtgatgtgaccatcaagtatatgcatacaaacaagcatgagaaatataaaacaatgccaaagaatacatcggatgaatggaggatctacaagatatttgagtctaatgagttttggaatccagttcgacctccaaagacaacactgacttcaaacagacctagcgccttcatgtcaactccgatttgggtgatcttagacttgatggaaagcttatctcatcgcctttcaaatgtatccggtttcatatccaaattcatctcgagtcaacaggaatcgtaaaaacaagacattattgttgctgaaaccaaacttgggccttctaatagactagctaggcccatctcggaagtgtctccctccacctccacgaattagcacttaactctagatctattttcctctgtaaatgtctatgtacaccctctggaacaattgggtttttttagttgaattttggcaagtgccattcaccttgtctctagtgctcgctcgattaatcagcgagtatagatttagagcccccaatagtgggtgtgttgatttgccgggttgattagatctatcacttcaatcgcaactattactttgtacttaatcacctattcgcaatatttagattgcatcttatcttgttcttgcagtgttctctcgtttgcattgcagggatcatcaaccacgcgccgcggttggtacgacatcatttgtagtgtagcgattgcacagtgtcctggatttgttctggttggtagccacgtgttaacagcgaaatttggtaatcggcaaagacgtcatcggcttagaatcattatcggctgcagcatctcggaatcagccgatggaagttatcaagtcgccaatagtcggattcctgctatattcggttaaggaaatcaatctactaaaggaagcttatccctaggtgaccgagtttaaagaggatgtggcatggcagtttatctattaattaggaatagtttgttagtttccttttatctttaggaaagtgtgtttagtgtccgataaggactttatatttcccttttatctttaggttagtttctttcttgtccgacaaggacttgtatcgacccatgggtataaatatgtacacccggggtctatgtaatttatcttcacgatcaatacaattcggcgcatcgccaccttttaccttttctactttattttatcgtccggcgggacttggcacctgacgcggggctgcatcggtgttcgatctccggcgaaggggtaagtccaatgttccgtcggcccaggcaattgtatcgtttacgttggcgtcgttcaaggctgcatcagtacattcgatctcttggattactctggtttggatgatatatttgcctacctatttatcatatgtctatgttaatctagtcttaacatatcaatttagctctatcggttgcttctcgttttagggtttctgccggtatcggctaaatcgtgttgctagattagattagcttagacatctaccaccctgaaaattcagtcaacggcttgattgtctagatattatgtttctttttatacttagtgctgcatcagttaagtttgatctactaagtcgtgcttagaactataatctctagcctgcctcttgattgccaataagggtttcatcggggtttcagccggtgagttatctggacgttgcatcggctcataaggattgcatatacatataagttggattttagccgatgacaacaaaggtttcactgtttaatctaatcttatggatttcatgatatcggacctccagccgatgtgtgctttaaccctcggatcgatgcttatttattatatcttgtttctagccgattggtttctacaagactatattgttattttattatatcatcatcagccgattgcctttatatcattatctacattggacatatagccgattgcttaaaccctatcgctatcggctggtatcggcatcggctgttatcggctatcggctggaactactccatcggcttgtcagccgatcggctgttttgatctactatttgcatatcttgtcagttgcaggatcaaactgactggcacgcccgcatctaatcaatctttggacctgcacaggagctaagcagatctctcaggccggtgtgttcgattttttcgtcaacaccacgtcacaaacatcgcactcgatcaaagcgagagttatcccctttaccggaagatcgggccacgagagagtgtcatcacatagtcttcttcctcgaacatgaactcaacgagattagaggtagttctagatccctcgtgtcagcctatgttgctcctacattgggtttatctagatctgtattggctcgtcttccattggcgcagctagatctgtctagatgtgttggcgcgttgcctttgctccctcctcctagggggccttgtatttataccctcggatgtcctcttgcccaagtaaaactagtgagacaaatatggatacgatccgagtagttcttgtaatgctagagtagaaccctgcttctcctttccttatccggaacacctttctactcgatataaataccacttaattttcctccttgcgatggctcccaaagcatagtgtaacctattgctgctttcttctaatggaatggcgtgttgcgtgcaaccttttatgtatttgtgaaaaaatgtccttgctataaaaatatcacctgtaaatgaatccataatccatcgaggttatcgatcacattaggattgtgttctcccccttctttcccaactcatctccctctttttacgcacacatgctttttaaacggctaaacggtacattttttaatgttttatatagaaaagttactttaaaaataatattaatctatttctcattttttttaatacttaattaataacgtgttaatgggtaacactgtattccgtgcggtaaggtgga

SEQ ID NO: 10785 - DNA, 2940 bp, Oryza sativa
tcccccttctttcccaactcatctccctctttttacgcacacatgctttttaaacggctaaacggtacattttttaatgttttatatagaaaagttactttaaaaataatattaatctatttctcattttttttaatacttaattaataacgtgttaatgggtaacactgtattccgtgcggtaaggtggagtttccataatgggcagcactgtttttcgcatggacggtgttgctgtttaagattcacacagaagggaagggaagggaagggaaggaggtgggcttggggtttcatcaaagaagatatgacgtgaatgaaagcaacggtaagctggagcacaattaatatatgctcatatactccgtatgtatatggcatattccgttggaatctcttcgtacataacttaacagggtgaaattggatgcgttgggatgaaatcagatggatggtaacaacagggtgaaagggcagggccggatcggatcggagctggtgctcatgattttggtgagcagtggaattcaattgagagcaacaaggtttgccgtactcagcccggtgagacgtgagtagcaaagaagcgcgcagctagcgtggaatttgatttgacccagcttagctactactactagactactccactgcctgcctcgccttcacctcacctgtgtgatttgtgaatgtgctaccgtgaccgtgatgaagggaagcagtgagaggttggcctggtcagtggtcagcacgtcggccacgggccgccagctagctagcgcccagatctgttgggtttctgtacctacccggtaattggtgcgccgcccgctccgctcggttgggtcgcactcgcgcacgcggttaggcgtgccgtatataccatacacacacgtaggtggagtacgcggttaggcggcagcaagcgagaccggggtgtggatcgatcacatcgcgcgcgatggaatcttggaatcggcaaggggtcaggtcaaccaaccatgcgcctgcggtagagagacttgttccactccactctacgactcgacttttccactcaagccggtgtttctttttcatcctatcataggaacgaccacatgtacagattattgtaggcacgcatagcacactcgaacaaacgaagacactcgctacttttttttttctcttgcagtctcactaatttcctactaataataataaataggaaaaaaaccaaattacccgtgaactatcgggtgattacgaattactccctagacccgacaatcggtcatatttcatcttcaactattattaatacaaaatgaaaaaaccctcaattttacggacggttttggttctatgtggcattacaatcaaaatttacttttagaaaaaaaaatgatgggatgaacatgtcatattctacctactatctgctctttcccctccgacggtcccacctctctatctctctctatccctggccgaggagccgtggcagttgcgagcctcctctcgcacgtgctggtggcgcctacggggctccttgcacatgcaccgacagaggccgaggaggagaggcgcgagctgacggaggccgaggaggagcagcggtgaaagctacgagccttttcacgtacgtaccggcggaggttgaggaggagcggtggcggctactgggctcctcgtaacgtgctggcggaggccgaggaggagcggtggcggctccgagcatccttgaccgcgagaaagctcgaggcaacagcgggctcgtcgccgcttgcacgcaatgtcctactccactgatgttgcaatccatgccgccttctatggccccatcggcaccatcctcatgaacgaggtcgacggtgcgagcgatggctctacacaaatcacgccaccgccactggcaacgaccgccgctgcataaagcatgattttgtcccggctgctccaatctccacccacgatgacggtggcatcgatgtcctcgaggcggagcttcagcaccggcagagctgtgcctccaccacagacacacacatagagagagagagagagtacgctgggagggagattggctcgtgggagatagataacaagtgtaccgtacaattattattattttctttgttgactggatttccatgttgacgtcatttgtgcaacatcatggtcaaacccgcccaaaacagtgttagtggtaatttatccgatattaataattgatggtataaaatgtccggtatttaagttaagagggtaattcatactcattcaatagttttaatagggtaattcatacttttttattattataaataatagaatcaacgatttaattctttctatgaactaaaattgggttgttcagctgtgctgcacattgctgcgtcacaggttgatataattaatagtgtgtgtctaatgtataaatacgtgtgcataggacatgtttaatggtatacggagtacaagattattaagaccgcgcgtttttagatgagatgataaaaacttaactattaaaaaataacactctaattactattatttcatttttctttttcatcatcatacaatggttgtttccattttatagaggcaagaatcgagccgttgttaagcataacaaggatgttttgtctcaattctatctctttctttcatgtcaacaaatcccttctttctataaagttaaggctaaaagctcaaacctcgtgcttccacgtcatcatcaaattgtgaaccgttggatgaatacattagatcacttctcagatgttatatggaatgcagcataaagcccaacccattagttaccaggtaagtctcttcgcctcctcaatgctaaatgtagcctacatgaacacattggcccatctctatacacatctacatgtatccaacccgtcaatccgtataaaagagctttatggctgaatgtttcttcag

SEQ ID NO: 10786 - DNA, 11817 bp, Oryza sativa
ttttggtgcctaattgtacaacctttccaaactaccttgactctgcctcaccggacctaactacaacataaatatccctttgactcattgccaagcccacgacgtattgtgttctctctctttaaacccaaatgaacatccctgaccattttaacccaaacactacatcatgaaccatcattatcgatcagagaagaagtgggacgtggccgtggactttgtggtgtggagatgaagaaatcctattgaaatgagaagtggaggccgtcgaggacatgaaggaatattaaggcacgcacgtcgtccgggagagccggagaggtggtaatgaactatactccctccgtcccaattttgagtttttatttacaatgtttgaccactcgtcttattcaaaaaatttgtgcaaatataaaaaatgaaaaattatgcttaaagtacattggataataaagtaagtcacaaagaaaataaataataattgtaaaattcttttgaataagacgaatggacaaacaatacaagcgaaaacttaaaatcccttatattataggacggagggagtaactaacaaggtcacaaggtgcaatatcaaattataggacttgcagctaattaagcttgcttctagtttagccgactgattgatcatgcatcagtaagtcggtattagtaccgtgtggtccgctaatcatcatcatcatcatcatcatcagcatcaacaacaaccttgtacggagctgaatttatgcataccagtagtagcttgttgactctagctcgatcgatcaccaattcggtctaattatttgattttttttgttaataatagtagttttattaaacccagctaaatatattgttctaataacacttctagcctctccaccgtaacagtgcaaacaaccaaacacatatccacacactaagaagataaagtcaatagaaaatcaagagccatctattcgtaggctagatcatcacctatgtgttggggtaaaaaaaaaacttgtttacatgcttcaattgtagacaaggcgtaatgacaaaaccctatagctgggttctcaagaataacccatgactggaggcaatgtgtaattagaaaataatctacaaaggaaaataagcattttttctttaaaaaaactcattatttctcgagagccaattgcaccaatgagttgttgccaccacaattagaataagagatctaagctcttgagtttgtcaccaagcctaaatatacgtggcacattacttggcgaacaaaatgttcaatgcaaccaagattaaagatcaaaccaaccgggctaaacaacattaaaaaacaaatgttttattatttctttcttatgataattcttattacctttctaatgttttattgatatattttcttgatgtaagtaccacaaaaagttctcattttgagagaggctttaacttacatatatttctgttaacattaggaacacgcgtatgtaccaacacacgctaatgagatttagctgagaatctcctattggttgttagtttctatttaaattcatcttgctcatgaaacaaaacttattagcgatgcaggtaaagagatgattatgtactaccaacttagagccatcaatatctcaatgccaagtgaagttaaaagggattgtttggaaaacatttgagatggtcacatgtttatgtcttacaaccatgtagatatgagggtactgttctcataaagttgtattacctaatcatttatcttccaaaaaatcgaacttgagtgctatccttacccgtagaagaatcgaacttgcaaacattagatttggtccaaaagcatgaatcctcatgtttccattatacttgaaatagagtttgtgatcccatatatttgttgcgcaatatttattgtcacacttcattagttgtaagtaacttaaaaaccatttgaagaagggctatatttttaagttctaaatcatgaatatccaaaaccccttaatctttaggacgacacaaaatgtcccatcttgccaattgttggtatttgttattgtcacagataaatccataaacatatggataccactacaacacttcgcctcggagtattccaagggtatcgaatcatagggaacgtgtgtatatctaagaatataatccaatccaaggacaacaactaatgataggcttaggttagagaggattcatatggtttaattaactagacataagttaaaggtaaaaccctatcgattgctttgggcaccagctctcctctggtctgtcaagctgagtcagcctgtagctatgtacccgaacatgtggagggatacaaagaacggacatagctattaccacctgccgcctacttcattttccgtggatcacacaacaaatgaatgtaaccgctaacctagacatcatgcctaagttattgattacaactcttgtctcgctcaggaacttcttctttatccaaattcctagtactagagcacttaatataaatactaagtgacgaacccgcaatgatgagaatatatctcacttaagaaaataaattaaataccaacaggaaatctcaaacacttactttattaaataagcattcgtcgaggtacaagaggagaatgttgatagcttcggcactctttcaaacctttcccccactattctacttattttctctacactactaaagtgatgtctaaaatataaaagtgagttatactctactttattgtgtgttgtgaaatggcttgagctccttcttttatatgtccatatgacggttggaatggcagttgtgaaggccagtgcacccacaaccatcattaggaggtgcacctggccatccacgttgaaggtggagatgaggggcccatatgtcagcccctagaggaaagcggtggagacaggtagggcccacattttcgatcgaaccttagtttttctttgttatgatgcctcttagtttttccttttgttttctcccttccctccttggatcaggctcctctaccttcaaaatcatttaactttctcatataaagacacgatgcatttaaagacagaggatctcgatccctctcgtgacggtcgacaaatctagacccgcaaagataaacacactgttgagtttactagtccaccgtgctagctagctaggtgtcgcgttcaactacttgtgatgtctctggagatcatatcgctaactgatcagtactaactacagtattaaccaatagctgctactctgtccttttcatacttttcatattataagtcgcttaaacttttttctaagcaaccgatcaaatttataaaaaaaattagtaacatctacaccactaaatataacatgtttcattaaacataacattgaatagatatattttgttttgtattacaaatttgatacatttttataagcttgattaaaatttaaatatatgataaagctacttataatacgaaacagacgagtaattaattacgatatatacatactccctccgttctataatacaagagtttttgaagggatgtgatattttctagtgctacgaatctagacagcctctttgtccaaattcgtgatactaagaaatgtcacgtctttttaaaatcttttatattttgggataaatggtgtagtacatatatagtagtgtaggtgcaagttacattttcggttgagacaaatatttgctgggatacgtacactagtagtgctccttctatatattttatattcatcatcacgtaagtataaaaatgtctttttaattgatccttatataacctgacccggtccttcacttaacatgcagtattattatatctatacatacatgtaattggggtattagttaagaactcgttccttgtatataggagagttaaagtctgcttgtttcttatactcacatcaaatgaaatacatggaagaagttaatagccctatcgtttcgcttattagtggaataagtcaaatggcatacttataaacaaaaagtaatatgtgaataaaacttttatatacgttttcttagcgttttaaaagcaaatgctgaaaaataaacttcgatgaaaaaaccttaaaatcagccttaagcataaatgaaaagatgaggccttatgttttaagaaaactttgttactaaatatatagttttgcgatacttcactttaaatctatagttatgtgataaatttggtgctaaatatatattttttgatacatctctataaatatatagttttgtgataatttggttaacgtatatgtagttttatgaaatttattgtaatgataaatagtatataatagagaggcagtagtatgctaaggggagaagctatattgtgttttgacgggtgcacatgaacccttcaaatttataatttcacttaaaatcactaaaatatatagtgttgtactgaaattttctagattttcaatgacagtgcaccctcttgttttaatactagcttcgtccttatgcaaccagcaggctgaatgacgcagccgttgaaagtcaaaatttaaagcctcgtaccccagtacaagcagccacgcaggcatcgagcagcgacacatgcaagtgcatcgcgttttccccggcctttttccagcacatccagcctgtgcgcgcgcgtccctttgcgtgccccatcggccatcgccagcccaccaccatcagctgcctgtgcccaagaaaaaaaaagaagtttgcacgactaaactcgatggattgataaaggaagagtattagcttttctttccctttttttctcgcctaagtgtacttattatatctactggtaatagtagtacgtacgatcgctagcctaactaatttggttctactaattaagatcgttcggtcgcagattttgtcatgtagcgcgcgcatcctgtttactgctttgtgacccatgtacagggaattaacgtacagatctgcacacagtcatggattcccgcggccaaactattcctcctcttattaatagtcacatgatttcccggatgcccacccgccacccgcacgctcgaagaaatcccgtcagaatatatactccccctgtactttcataaatgacgccattgactttttaaccaacgtttgaccactcgtcttattcaaaaattttatgcaaatataaaaatacttatatcatgcttaaataacattttgatgataaatcaagtcacaataaaataaattataattacataaattttttgaataacacgaaagatcaaacgtttgtaaaaaagtcaacggcgtcatacattaaaatacggagggagtatatttctattcttttctcataattagttaggcacaaaattttagagcgatttttcaattattaataaatggaaacttacaaacttaaagtgaggagaattttttttgagaaacacggtataatcatagacgcttacaacacgtgcacgctcatatctttatgaacacatatatacactttatccctataaacatctcccaaagactaaaccggtatgtcatgagattgatgaagtcattatggatgtctcgttgttgacaggtacatcgtctaccaccgaaagaataattagccataaatacgagcaccggtgtcaagtatagaacttgagaattttgattacatgaaagacgcgcagagttacacttgcgaatgtggagtgctcctccttaatacgcgctcgaagagacgaaggctagcacaaaaactttagcttacaaaaatactattaaaagcatgcaaacatgtattagtaattgtaagtatcacctactccctctgtttcaggctataagactttctagcattatccatattcatatagatgttaataaatctaaacacacatatatgtctagattttttttggaataatcaccggaggggagagtttccccacctgaatccactactagaaaaatcatttgttggtacgaaaaaaatcgtggcatcaatactaaaattgtggcaatagatgcatgttgccacaattttaaaatcgttgctagccgtggtaataaatagcgtggtaataggttattgcaacgatttttttttgtggtaataaatttagatgttgccacggaatggatatggcaaaaagtcatattgcaacacttcacatcgttgtaataaaaattattgccaccactccatatgtggcattagttttatataccaaactaaaagttcaaatattaatctatcatcctatctattttatctatttattttttttgatattgtgtcttggctaggattcgaacccaagacctatccttcacgcatgctctcctttaccaactcacctacgcatcaattctgttgaaaatgcatatcgttccatttgagcctacgtaactgagatttgaatcatagatttgaatatctaaaagatttcaaatgaaaaggttattacctataaaattatagatctcgtcgagagctataatttccatataaaatttgtctcaatccgtgttcatatgaaaaaattaagttaaattatgagacgataatttttttattgcaacgaatttgttgatcgtggcaacaaaaaatagtgaaaagtaccatgtactatgtaaattgccacaaaaaataaaattgtggcgatagaacatgtttttttgcaacaatacgattttttgtggcgatatctcattttctattgcaacaaaactactaaataaaacaacgattgtatatcgttgtaataaaatataattatttaccacggaaaaattatcattgcaatagtacaatatattgctacgaattattttttgtagtaataatttggtggcaatagctcaattatcttgtagtgatcttccattgctaaagaaagatagttctgagttacagagattgggctataccagcggcgagccattacagattaaacagaagaaggggggaggagaaactgagaataagagaggccaccaccttccccaaagagacaacaaattgatgttaggcacctgcaaaaaacccaaccaaaagccagagcaacctaatgctagcacccaagctcatcaacaaacatttccttatgcagacttggaaacaccagtactcctcgtcgaagggcctttctgccacaaggtcagcttggtttaatagcgaccaaaagactgtggaagtcaaaaaccacccgcatcaagccatcaagaatccaacttaaacttgttgctgcttgtatcagtgcatgccgacgccctttgggggaaggaagccccattggagggagggccactgaaggttgcggccataggccgctcgcatcgagttttctttaatccggctataacaatttcttgcaagttccacgccctccaacgcccttttagggaaggaagcctcaaaggaggaagggtcgctgaacaatgtggttgaggacatgccaaggaaaagagaggagacgaatagggagctagacaagagagaagtggtagatgggggaatccaatagatggaattccaacaactgcggcagcagggaagggctcaagatcagatgctaagccagccgaaagagaaccaccagctctaacaacaagacaagccatcaagcaaggagcaagcctaaaagagatccagagagaggtgaggcacgagcaacacctagatgatggatgagagccaagctggtcagggcaaggagtagcacaggttcggtggctaaagagacatcacagttatagagcgcctcaaagaggagggaggacaggggagggaagatgttgctgggcaaggtcacatttatagagcatcgtaggccacagggcgttgaggccacagcccgccgccggcgccacagagccgaccacgagccgtgggtcggcgcaccgccagccggaaccagctacggtgcacaagccgccgaggccaaagcctccacccccagccgcagggggtggggggggagacaaggccctctgccgggcgccacaaacccgggcattgaaacctccgcccccgcgggctccgctgtcagcctttgccactgttacctccgccgccggtcgccactgcgtcttccgcgcgcgccgacctcctgtgccggctgccgccaaccgccgagtcgccagacgctgccacctcggcctcccattgacgccgcacaggagtagcttgctccggccagatccggcgtggaggcgccagatccacccgtggggaggctggatccaccgcctccaccccgcgtcatcggactctcctccgcgcgccggcccgtcttccacgcacagagatgggacgccatcgagtgttggcctcgctgccgccatcctggctggccgcacggaactccgacggcgcgctccggcggcggcgagggaagggagaggaggagaaagtggcggcggtggcgctaggtttcccccgagtcgcccgcgcgtgggcgacgcgtggggcaagaatcataaggttctgtacgtttccaggtaccatatatgtctagattcatccatatatgtctagattcattcgcatatatatgaatatggacaatgttagaaaatcttataacctgaaacggaggaagtatatatttttgaacttgggatgaagtttaacgaggccacgacagagacggctccaccactgctacatttcccaaaaccggataacttaaaattatatttaatttatgtttcaaactgttgcaagactatcattttgttccattcaaaacttaattttgcagaattttcatactaactatgaattctatacaagtttactgttttaaactaggtattttaaagtcgaactttactgttccattgactcgttttaccatatttgagcaaaggcaacacaagtgtctatcgacgtcatgacgtgacctccacggatctggtgttgatcgatggactggatgaggtagagccagagagctcgctatggagctggcgattcgagggagagtaacttgttactagggttggagtggtaaatggtttaaccttttagcgtataaaatttgaggattggatctaaaatttataacctattcatttgtaacctaaaaattattttagtgctagacagggttgtgaaaaaaaatccatggaccttaacccattactaaccatggaggcacaacttttctggtttctgctgagactatccgttacagttagagcttatttggaacgtaggattttcaaaacatagctagggatatgaaaaatgtgggatcaagtgtgtcatctcaaatcctttgtatgaaaaattacaggaaaattgcacgaataaccatttggatggagcacagaaaaaatacgggaataaaaaatagagatagattacaaatgaatttttttcgaggggtagaacctcatgttaagaattctccaaaatctcctatgatttgaggcactcctaaggaatttcaaaagaatttagggaagccatttgtttgttccaaatgaccatatagcaattttttccttgaaaaaacaaaccctctaaaattgatttgttccaagagagcccttagggaagtcaatggcatcactgtatcgtgttgattgatgctaattatccagtagctgcgtgaggatgaagggtcaaaggctgaggtatatggttcatggaaagatacaataagttaaaaaaaagatagtggctaacaagtaggccatgttttaatatatatatatacaattttctatttgtatgggtcggactgtaaattaagttattcgtactaatatactccatccatttctaaatatttaaagccattgacttttttaaatatatttaaccattcgtgttattcaaaaaatttaagtaattattaattattttcctatcatttgattcatttttaaatatacttatatgtatacatatagttttacatattttacaaaatattttgaataagacgaatagtcaaacatgtgctaaaaagtcaacggtgtcaaatatttagaaacggagggagtatgacacaggctaaaaaccgaaaaaaataggtgctaccttgtaaatttacatggcccattagattccgtagccatttaaaccacagtatccttccgtggttgattcgttggctttggccaccgaagaggaagggcaataccgctcgaggctttcctgcgttgtaaatgcctgagtgcctacccagcttcctcctcctcctcctcctcctcctcttcgtcgtcgtcttcttcttcttcttcttcttcttcttcttcttctcctctctctctctctctgggttgtcaagagagtgtagtttgggctaccgtttgttggaaggccctagcggtttagctctttttaaaaagttctaccctacatgtaagtgagatgatcactaacaaccgtcatatagaaagcacaaccgccggggagaaaatgatctcaggatcggagccctgtgaacctttttctgacgtacgtcactgactcaagagattaaagaaaagacactgattcaatagtaaactcctatatatatatactctttttttcttaaaaaaaattacactcgtacgcttgctcggtggtaaaggcacaagtccttaaacttgtcttgactctatcatctatatatattcttgaactctcaaatatattttgggtttccgaacttttcggggtgccatcataagtccaaatggatatcaacccactatgcgtattaacatggcatgccacgctggatcctcctcctctgcggggacttggtgctaacatatggatccaacgtaaaaggaggaaccgactgacaagtgtcgctcacaaacttattttttcttctcctattcttttctttttccttgtcttcctatagttcgccaaagagcagatgctgttgttgacgatgagtgaaggacggaagtgagagatcgatgccctccattgacgtactgagaagccgcgggacagaacaagcggcgaccgcaaccgtgaactcattggttacaagggaaggagagaaagaagggcgagtgacatggacatgctagccatgggcacagagtacggtgccagggatttcacctcaccatctgcaagtcgtcaagccaaagagatgggggacaacctccaccaccgccagccctcggaggcaccatcctcctccacacctctctccctcactcatctgtgccaccgtcttctaggagggcgataggatgggcgtgtccctccgcgtcggtagcacatcgcctatgttgttcaagatcgaacagatggtgcatgctcgatgcaatcggcgatgccgatgagctctgtgccaagcacctccgcacctccactccctctcctattgatgcctccatgaatctctatgcctttctcctcatgtttttaactccatcacaacattccagttgaccacaagtggaaaggcgctcacgtctaggctattgtcgggcaacatctccttcttgtcaaagctaatagctagggcgccgacttttgtcgggcgagatatcgcctggcaggggcttgagtcccaaggacaccaccaagctggaacttgaggacgggaggcgggtcctcaccaaggtgtgttctcgaatgtgagtgcgatggcatgagggagggggagagagaggcgtgagggagagactgacatgtgaagtctacccttgcgtgggatccacatattatgaccaagtccacaagcatcagcgtggtatgccacgttggcgcacagagcaggttgagatctatttggacttgtgacggtgtccaggactgtcacacctggagttttcccttcccttaggttccaaa

SEQ ID NO: 10787 - DNA, 10475 bp, Oryza sativa
gtgtccaggactgtcacacctggagttttcccttcccttaggttccaaatcactaataaatggcttcaagaatttgctttggttaaccaagagaaaaccccagttaacaatacattaaataatcggaattgtcctggagaattttttttaattctctttgctatgaaaatcactaacatgacttaaagagtcaagctaataatttcttcctttgcctttggtcatgaattgttcccaattcactcccctctcagtccgcggtttcgttttgcatgacgaaccgtatccgtttcagttcacggaaccgtttccgttcttttcctaaaacggcaccgcattgtttttcctttttgggaaagtcctagtctcccccttgtttcctttttccctccccctccccagccggccgtgcgcccctcctccccctctctcgtgcgcgccccctctccccctcttgttcgactccctcccctcctcccaatcctactccctctaggactccacctttccaagtctagtcctctcctatataagtgatccctcccctgtttcttttccttttcctcctcaatagcgccaccaccgccctagctgctgccgccgccatcgtcgccctcacgtcgcctcgccggtaatccgttttccctcttaattgaattggttgaacccaatgtcaattatctccccatctaacctagcccgctgtgtcctctctagcgtcgcggtcgtcgatgatctcgtgcttgccgccggaccgccgctgccatcgtcgtgttccctcgccagttttgctctccggtgagaacctccctcttgttttagggttagttttctcctcgttttagttggtttgagtcgtgctgctaaaccctagtcgttgcaccgcgcagccccgcctagccgccgctgtgccgcaccgtttagccgagccaccgccgtgccgcgccgtctagccgagccgccaccgtgccgagccgccgcagcgctgctgtgccgagccgagccgccgcctagcagagccgcgccgctgccatgccaagccgccgcctagccgagctgcttgccgccgttgtgccacgatcgcgctttgctagaacctagccgccgtttgtcccgttgcatggtagttgagttgtttagccgcaggtgcaaccctaggttcataccgacctatcgtttgccgtaccggggctttaccgtgaattgtgtctagcccgctggtttagccgcagtcattgttgagtcgttccctcgttcgttcgaacgaggtgtcctccgtggatcgttcgttcgtccgtgttgagtcgttctttagtttagagccgttcagagccgccggttccgttcaccggtttcggttgatcatttgggtgatctcgtgtcatgtgaaattgactcgttgagtcggtatctcgtgagtctcgcttgctagtcaatctatcatttgttcttattttcctttcgggcattaatctcagtcaattgattaaggtttttatgttattagtaataacgcagagcatcttgtaaaattcataactaaataatctgagctctgttttaacccattcaaattgcagtaaattcgttaaaatgtcaagaatccatgaaaattggtttcttttgctgttttagtagctttttagcttgtattcattgtgtgccttgtttgtcgtttagactccggcagtttcgacgctccagtttattttgacgtggtcgctgaggttccgtcagctcaagagcaaggcaagtcatacagatatcatttatcatattgagcctatttgcaaaacccctgcttttctcttaaaattgcattatttttataatgtcatgcgggatggaatttaccgtactcagtctttatttaccctgattcattgatagcctgggataataatttgactagatgattggtttaggaatgcttagacatgcttagatcaactagctcacaatgggatttactataatatagtccttaattttatgatgatgttatgccatcttggcatatggttaattaattaaatatgctttattggtgggtcgtgggtacatgcatgatttatttggtggtcgtgcccataacaattaaggaccggttctcgggaatccctggaagatatactcgtactaaccacaagtcagatgggctccaggctgaatcttaagtataatcttttttagctagcacaccaatggcaagggtaggcatgatggagtatggatggaccgggaggtgatctatgctgcttccggatttacctaggcacaagtagggactgcccatcgccttatagggatggggtgaaaccggaggtgggtgtgctggttaggtgtggttatatggagggttttgtcacgatttctgcatgatttatttggtggtcgtgcccatgacaattaaggatcggttctcgggaatccctggaagatatacttgtactaactacaagtcagatgggctccaggctgaatcttaagtacaatcttttctagctagcacaccaatggcaagggtaggcatgatggagtatggatggaccgggaggcgatctatgatgctttcggatttacctaggcacgagcggggactgcccatcgccttatagggatggggtgaaaacggaggtgggtgtgctggttaggtgtggttatatggagggttttgtcacgatttctccctttggggcatggttttatgtgtggaatcgtgtcttgtgggtaaagttgtacacctctgatcagagtaaaactattcaaatagttgtgcccgcggttattgggtggtcaaccagctcaccgtgattagtctcaccttaataatttgacttaatgaactggtgtagttcaagtggtttggtttggcttgtcgtaacgtggtttagcgttggacagtgatgatattaatactgcttaattatctactgttttactgatttcaacatatgatttataaatgctgcttttactgtaaaatatcttatgagccaatcctttgattacccttgcatcataccttccacttggtatgacttgttgtacggtggttgtactcagtcttgctttatttttcccaatcccccagaagctaagaaaattttccaatccccagaagctgagaatctgtcagattgtgagttagaagctgagaatctgtcagattgtgagttctatgaagattaggcttgtgccagacgtcaagattttgcctatggagtatggaggaagtttcgctttgctgagaagattaagtttagttggtctttagttttttcgctgcttttctgagtttattttatatttttgtaagacgtggaactgtatcaaattgtcgatttaagggttgaggcagcatttattatgacttttgcagccttggagtatctagtgaaaatgttcaattcaatattttacatgacatggacatgttagctatacttggcaaccaatctcatgtcgctcataaccagttactgaacaaggcccttgtgtcacttatcattgctatgacattgtttgatcttgtaactaggaggttaaggctgatgttgtaccgctcaatttaactaggaggctaagtcaccctatcctgctaggtgtaaaattgacggggaccaaggccccctagtcccacccgttgtaaaattgatgtttagtgactcatactagaagaacatcttggatttaatctaaaagattataatgatcttcatagagagagaaaagatattgcaagatgctaaaaaaatattaacagtgtttcaagaaacaagtcatattagggttgagataatttttctacataaacatggccagctgtaatcctttactattagcattctatgaaacaacaaatgaatacattatttcccttactccactacttgttgaaaactatttcatttatgacgaagaagtatttgtgtattgttattgtttctagccatctgagaaaacaaatcttatattgtatttgtatactaatttttttatgactttggcaatgcacccgaaccactacaaacaagtatggaataaacatgtcatttttgtgcccctacttagttataagcatcatttttacattctctaacaatccttaactgtaaaatttagaaataagatggaaaaatttcatgataagacaaataagcatcattttttacatttataacaatcctcaactataaaatttagaaatgagatggaaatatttcatgataagacaaaatagtgaatttattctcacaaaaacttagaaagagtttatcacatttttaagtgtttttaaatgattttaatcctcttaatgccatctatagatttcatggttttaattataagtaacactatccaaattcttattccaaattcatataacaaccactgatagtaatgacaactgcaatctaaatttttaggtttctgttgttagtcggatttgccacatgattatatagatttgtggggtttgactagtgtaggcaaaaactacgtatcaaacaacatgtacagagaaaacatggacttcttattgaggacatcaccactgaaagtctcatctagtgacactttgtttattggatcagctagtgacactttgtttgccaaggtcatgactaactcaaccaaagagcagatgtatgcagttgagtagtgttttggtaggtgtatgcagttgggcagtgttttggtgttacttatattagtaattgtaagaggtgtgtcaccaaggcattacaggacatgcaacaagtaagtgtttcaaagatggatgctatgacattttatagcttatgtaacctcagaatttctggtaaagatcttaagtgcaatattagacatgacaatgcttatttagtaagatggttatgttatttgttgttgctctggcaagatatgcaacatacttatcatgctacaggacgagaacaggtaatacgaaatggatatataatatcatatatggactcacaaaattcttaattgagttaaaccgtttaggatgccagatttttgtggggatctagtctctactccacattttcaaatttgtttggtgatctagtctctactacacattttcacatgtcaacatcagtagcgacttgaatattctttgatcttgtactcgctctcgatgtaattaggagtctaaggccgatcttctacccgctaaatgtaactaggaggctaaggcccctatcccgataggtgtaaattgacggggggccaaggccccctagtcccaatcaaaattaatgttcagtgactcacggtaattgtatttaaattgattatacactgtagcataaatattaagtctattcagaattactggtgagttgtatcttgttacatatataaaagggaaaattgtaaaaaccaccctaaatgtcactatgagtttgagatgcctccccaaaagaagatttgttgcaaatccccacctcctaattcatcttgttggtttgatttaggcaccttctctccacacgtgtgtgattcctgaagaatctcatggcgaaatcaatcaagccccactcgacgggagcaagagattgtgttgtttgttctgtataagacgatcatttcgttgggttctcatggccatttcatagtgtttttcatggtatactagctatatatttcaaactgattcatgtgtactgaacaatatattcgttttttttttcagggacgtaatgagtatatagcaacatttgaacatgaagcagtaatcatatagccagatgataaccttataacttcatctgttgcaattggtcagatggcccaaaatagcagatttcagtgcagtttaatcaaaaattgaggccacgcaatctaatgcaaaaggaacctgttgccaaatcatcacgatgagcgggacttagctaatttcaccacgagatgctctaggaatcacgcagtgcagagggaaggtgcctaaatcaaaccaaagtgaattaggaggtggggatttgcaacaaatcttcttataggggggcatcccaaacttgaagtgatatttggggtggtttttataattttccctatataaaaaggcgcaacatatttggcctatacaatgcttggaacatgacaactaaacaatatgaaagtgcattaaggacttgttgatttcactgagttgagataataaaattgatataaaattaaattcaagaaaaattattttcccaagatacgatttccttccaacaaaacggtgtttaggttaaatgcacaggtagccagtggacaattataaaaatttaaaaatatattttaagagttcgagaatttaggtgatatatataacaagtaaatttagaaactgtccattcacttaactaaaaagagtaccttcccacaatcgacagaaagaataaaccattgcgaaatattttaccttacgatagcttgtcggtcgaacaatttcagtttttctcgttaattatttgctctactcgtaccgataattgccagacacgttttcctattttctgtgattggtttcggtctcgacgtatcactacagtgtaattaggtatatgcattagatgtgtcctcctccatcgtgtacgtccatgatccactatggtgtggtcttgacaatttgattagttattaagcgtgtgcacatgtgcatgctgaaactgaagagctttgcactgttcacttcgatcgtacatttctttttcgtgccaagacaagcatgctagttaagctggacaatccacaacacgcattatatgtgcatatatgtctgtacaaaaacggaattaattaagagcaatcttgattcttgaaacacaaatcatatgagatctacctaagctctcaatgattaacccacacctcccccttgcgatggacagatatgatggttttggtctctcacactcacaggtcatagcacgtgcctgcatgaccctttccgtcgaggccacgagctaaattacactgacatgttacttccattaatcaaccagctgttagttaatcagtgactagcttaggtaggtgctttgctactttctcttttttctctttctttcgcttttccagccatgagatgtaaaattaatccagctagatagttaattaatctaagctgcgtggatcgatgcatggatggatggatcgattcatcatccatgggaataatcgcagctgcagctagctagctagtttagcagttgccatcacatatcgggatctgatgcccagctgcctgagctgatgaatctttttgcagcggtgtagcagctgaacatgattgatgggtaggttgctcgatgcccaccgacactgacgaccatctcgttttatattaaccgacagcttgattaactcagctgatggggaggctgcatggagcctgtgtaaagcatagatccccaaattgttgtggcctgcctgcttcactagatagtgcctgcataaatatctaattaaatatcccattttcttttgtttcctgcataaaagagtctcttggcatgagttttctggagattataattgattagaaggtacaaataaattgtttctaaaacaaagaaggtacaacaaataaattctacagggaaaatttgatctcccatgcatgtgagtgtgtagcaccggcacaattttggtctgcttaatcaatttgatctgcatcaagttgtagttgactcggaggatatataaacctgcttactaggaggttgctctaaatgtgcacacgctttgttggttctgaatctctctgttacaggatgccttggaccattgggttaatgtctcactatgcaaacctattgaagcattagtcaacagggttcggctatgaattattaattagttagaattaaataatatctgaatgacaataataaagaagaaaaaaaatagaaatgacaacacaacaaaatcagtgatcacagctaaaaagctttagaaaaaatactttaattttacactagttagatattaagtattctatgaaaaggtgaagcaagttgaaatatggttcccaattgtactgttttagaaaatgtcctggcgaaaatttcatagaaaataaatcgttttcttttaatgtacttatttgttgcattcaattgtatttttatcattagtttttgccattgaaaatacttttatggtattataattgtatttgtcagggttatggataccacatacctaatagtagttgactaaatctcggcaggacccactacataccatgtcctatacggaagcaaccttcggatataagaggagttccggataaggaaagacaaccagagttctacgtggaaacgacaaagactactcggattgtattcatattggtttccctagttctacttggacaagaggacacctatgggtataaatacaagcccccctaggaggagagggaaggggatcaacacccaacacaatcgatatagaagccacaacatagaatcctacatacgccaagacacgccgccggatatcgacttcagggataagcacggctagtaccctacggtgtctccggatactgtcaggagagacgaaagcgctatctctgatctcgccgggcacggattcgaggaggaaggctaccctgttgtcgactacgagtcagatcgtcagaccgccatgtcgacaacagttagataggctaccccaaatattgtactggtgtgattatcatgaataagagctataccggcttcggccaacaggatgtaggattattacctgacaatttaggggcccgaacctgtataaaaatccatgtctccgacgattccccctcaatttcgcgtatactctagtaccaacgatccccatactatgcaaataccggaatcgcgacatcaaacatcgacagtattattataaaaaaaatagaaatgcaatgatgatcaaagctgagtatcaataaccataaatcgcgtttttagggtaaatcttcaagtagtaaaaataaaaacagagtcactactagtttataccttaacggttcattaaatatctttgtgtgaattattgttctgaacgaagaagcacctaccagtagtgctgctagtagttgaatccaatgtcccttttttttttttgaaaaaattaatgttccatgatgcgagcgtgcaggaagatgggatctatgttggccgagcatcaaacgactactggtcctccaatctgatgaggtccagactactactcttgtttttgagatgtcatgataacaagtgtactaccgatcaatacatatttttcacttaaatggtaataagatggtatgcggccctttatgcaactggtactgtggtagaaatgaatctacacttgcccagttttttcttttcttttcttttttctgaatgggtgtatgggtaatctaattttatgataatctttgaaggtacagacggatgaattaactagtatttgatttagcgacaggtataaggcgacggtggaagtttcggtgacttgtaaagttgcaagagaaactatcaaatacatgtacagagaataagacgacatgcaaatcacctgtgaatgtgacagtacagctaaacacaaatcaatttttcatagccccaaaatccatgttactagtggtacacaggcagtatgaacagaaagctccaacttaacaactagcttagcaagtccgcagagaatagcatgttagttgcaccgacggatttagaatagcatgcatttgacaaatggacatgcctgcagtactacctgttctaacattaatacacaaggatttaagagctctgtttcaaggcctgagcttctgctgcagccatggggtctgcattggtatcagtctcctcttctttctccccttctttttctgcagccaatttctccctgtgcagcttctctgctgcctgcatcgctgcacgctgctctgcctgaaggcgttgcatttcttcttcctgctgctgcctctcgaaccaagtatctgcatcagcccaaactgaaaagagacaaacaaacttgtcagcattttaccattaatcaatgtttagaagcagtactaacaaaagcacaagcaacaaagggatgctcgacatacagtacgaatcaatcacattatcaaattcgtaatttgttcagatgtatctagtgtcctgatggctcatatatagtagagtttatatagatgatattgcgacaaaatgctatctttgatttcagctaaggcgaatcgtgctgcaggcatagagggtttactagtatataagcaaacagttatacttaaaacatgtataaaataccttgacatcatttttaccctctgatccagatcagaaagtatacctggtagaatcatctatgaaaacatagtaatatggtagaagttcttagcagttagcagtgttccacaatacataatttatcagctgctttctgctacaatcattttaagccttagaaaaaacaaa

SEQ ID NO: 10788 - DNA, 36988 bp, Oryza sativa
  unsure (1)..(36988): unsure at all n locations
aagggtttcagtgccaaaacaaggcacaccattatatggtaagaaaataattttcccaccttttggcaaagtaagtgttttcacccctctattagtgaggactaacgtggtaaaaactaaaaagcttgtatgctaccatgaatataggtggtaggagctgaataattccacaaccattggtatttcaatttccaaaaataatgtcttgatttgaaaaaaatacaaaaagcttgaacaagaaattatggaaggcacaagcattggaagtacaccagaagatctatcagagtctgtgcagtagttccctaaatatgagctgagcacttgtaatgtgcatggtagggataaggggctactaagcctaattaaggtgttgcttgaccaggcaacccaggtgcaccgtctgggcagccccactacaagggcaaggaagaggagggagataccaaagacttttatttacttcttggttaatgaaaagagatacaaacctcatccttacatcaaggaatttgacctataagaaaattctctctaaaattaaggaaatacctgacagctcaacattatcttatctctaaacaactatgatgcacaaacacttcagaaaagttgagcattggtgtctaatgacatgtgcagctctgatacgcttaggatgcttatcgaccaaatgtcggatgattatacagaaaaaataacttcttttattctccgagacaaggtcgactcatccccgaatcatatgtgacaacccaacccacttggccaggacactaaaccctaaccccatctcaatccttcagctcccctcatctctggttaatagaattctagaacatatagacatctactgaaattgaattctaggagttaaggatcctatttgaggtacattttccttgcttaaagctcgcaatacattatttcagtggcaaacgattgaggatgtgaaaataatgcatatatactacttttttattagaacgtgtagtggtgtcaccatatcagtgtcatgcacgtggaacagaaaaagggccctagagtgtagtgattccttctactatatgagtctattgggtgatacatgacagcaattatgcaataacgaaaatcaagatgaaatgaatatattgcaaaaaaaaatgaaataaacaaaaaagatttcagtgcaggtaagtggtatgtacagctaggactcaaggaaaacatcattgagaaagatatagaagacctacaagattgcaacacaacattagacttgatggttgctcagattatttagctaaatatttaaaatgatgtaagtgtttgtggaacaaagaatttctcttgaacattcaaatacacaaaggacagttccgcacaagtgatgctttgatcattaagtaactatggctggattaaatcattagatgcatggcaatactactctgtggcaagataatactactttttttgtgaacgccgatgcagtgattcaggaacaccgctaatacaaattgtagtatgtacaataaattatatagtgtggtcattcttgttcttttcattctcataaaaaaatttctaagttcatttctattcttgaaatatagcagtcttgtaataaactgatggttaaggaagtcttcactctcatcggatgttggcgcttcctaaaacattatccttcattttaaaaggggcctaaaattgaatgatattttcagacgatgagaaatggagaatcaccaaaatgattaccatgacctaaaaaggacttcattaacattgcattatttgtttgttcatattatcaatacaagtctctaagaatagcagtctccagtgcattgtgaagggttgcaagtcctggaggaagaacatcaagttctatattatgggaatagttcattactaatagtatcgacgtgctttcactacacagggatcacaaagtttagccttctacattcctgtataatctgctaatcatgtattcactttcctcaaagtatacatcaacttatgaaataatttaaatgcccagtaaaacaaatcgagcacattaccaggctaattaatgaaattataatactgacatagttagcagactgcattggacagagaacagttaataacctaatataggttatcgaatagagtgatgaaacagtagccagggctaagtagccattcttgactggcatttcaaacttccagattttaggaacagcaagtgcatgcaaatgcagtacgcacctttggtgctactagtgttacacgtttttctcagaagaatcccaagctagcatgtcaatagagtccgtcaaagattgttagaaaacacttacggcatccaatattaataggaataatttcgcatcattggctccatctattagcacaaggctcatgatctactacgatatacagttttgtaatttgtacagactgaagacacaagggtcatgatcttatataagttaagcttgctctttcctacagcagttgcttattgccaccattacaactgaatcaaattgaaacatttggagtgctacagattataattgggacttttagcactgtgatttcgacctaacctagcaaacgctgatgtttaaatatccaaatgccctattagaaaaatataaggctccagaatttcaagaagcacctaaaacacactcattcatcaactactaccaattgtaaagtaatcattgcaagcctcaatagaggtctaaattctgcaaattcaaataatgttaagaactaaaattttctgtggactacaagagctgaattttatcacatgagatagttctacttccataacagaaaatcaaattttgtagggcatgctactcattgagttcaatgatacgccactctcatgtctcactgactaatggccccaggacccaaatgctaaagataatgttgaagaaacaaggatcttcaacattttaaacttttcattgttcacattgataaccccaatttgttacaagcaaataaaaatgaatggaagaaaattcatggcagtgaaaacctaaagacaaatcatgataaaatacaagtcatgacaaaagacaaatcatgataaacttttgccattgtttactcttactagatcaggcaaaacacaagtcctacaatcaaaattctttgcgactcctcaccctctacgatctggggtctggaccacgcatttggcatttgcaccacattgcaaataaaaatttaaggaccaaaacgaggtagtcaaaaccagcagttctagagttctagccctaagtcaggaaactaagcaggtataagcgatgagcaatggagacgattggacaagcaataagaaggaaggaaggaagctggacatacttggctgtgctgcccacccctgctctcctcccttgatgcgctcagggaaggcgtagttgacggtgaggacgcggccgaagagctcggcgccgtccatgttgtccatggcggcggcggcgtcctcccgctcgaggaaggtgacgaagccgaaggagcggtgcttctgcgtggcctggtcgagcggcgtcttgacgtccttgatctccccgaagggcacgaacgccgcgtgcaggatcttctcgtccacctcctccgccagcccacctgcggcaccacaaaaaccaagaaacgaggcacgggttcagctcagctcactaccacactgctactccgccggcggccaggaaaaaagataaccccgtgaaggaggaatttcgtcgagcaggtggcaggcgtggaaaagaaaaacagaagagaaagaagaagacgggtgaggagagctctagcttggagctcgtggcacgactggcacgtacctacatagagcgtgttcttctgcaccggctggttcatatctccgtcagcggcggcggcggcggcggcggcgacggcgggatggagatcagcgcaggcggctggcggactctcgtggagacgggagccgaagcccggggggagggggggacaaggagtcagagaggagagtgtgcggcggaagcagcagaggaggccggcagcggtgctcgccgggatggagatcggcgcaggcggcgcggcgcgggcgaaggagacaggacaggagaaggggaaggagaaggcgagcccgttccgccgcgatgttgttcgcgatatgggcttttccgtacccccagtctcgtttcggcttacgctttgggcttctctggaccaaaaacagcattactccccggagtagtactccgtatcagaacttccttttttaaagactgacagaatgttactttgaacttttgttttttttttactttgttacagaattaaaagaaacatcaaatgctgaaaaaattgtatttcttatcattgtaatttttaggttttatttaaatatatattatataagtatcctatcttactataaagttataacccactaactccttaaacttaacatgcaaaaataccacatcatcatccattaacaagatgtcacatcatcatccactaacaataatcacatttaaacattatgcaaacatgctatattatctactccctccgtttctaaataattaacgccgttgacttttttaaatatgtttcaccgttcgtcttattaaaaaagaattaaatatgtgaattaattctttttctatcatttgattcattgttaaatatacttatatgcatacatatagttttacatatttcacaaaagtttttgaataagacgaacggtcaaacatgtgctaaaaagtcaacggcgtcaaatatttagaaacatagtgagtataattttatagtttttataatttaagagcttttaaaatataagcattttaaattatcatcctagataattcacataatatttcaatgtatatttttattatgttttatgatatcctatatacttatatagtttatcctcacttagttagtgcttaaatgattaatctatggtccaaattatctttctctttttttctctaattaagtcatatcacctcaattgtttttagcctttagatgattaatctacggtccaaactatctcccaacttttcttcttccataaagtcataccaccttactttttacgtttgaatcaccattctacatactatttaaatttaaattatcataaaccacattaacttacttaatctgatgttatctagttatcttacacgttatttttttattgttatcatactaaattcccgcagcaatgcgctgggtttcacctagttaattagatgtgcatgctgtaaaagataatcactgtgacttcatcgtgggttgcgaccactttttatttcagagtaaattttataaaaccacaactattatggttaaatttgcacaaaacaacagaaattttggcaagcgacatataacccagatattatggttatgaagtttcacaaaaccacattgttagccattttgacatactcctatatcaaaattttgaaaagtaacatctatattatggataaaatcctcgtaaaatctgagatatgattgtaaaactcaaagtatgatagatcaaagttaaaatgatcaatagtgtggtttagtgaaactttagaaccataatacctgtggttatatgttacatgcaaaaatcttcatggtctcgtgaatttgtacataataggtagtgttttacggaatttactcttttattttatcatactcatccactccaaaggcccaagtccatctttgctaccattgaataaaaaaaagatcagtctatcaactatagttgaaaagtaactctctaacaagggggatttataattatgacactgcaaacataaacctttgctataatgaccctggacccacatttcatagacatagatgggcccatttgtcatccactcgaagtgtcaaaacaatgaagccccaatgtttgcagtcccaatattgcaaaattagcttaagggtgtgttcagatgcccctcttcccaacccctctccctcgttttccacgcgcacgcttttcaaactactaaatgatgtgtttttttaaaagtttatatacaaaagttgcttaaaaaattcaaattaatcctttttgaaaaaaaattagcaaatatttaattaatcacgtgctaatggaccgctccgtttgccgtgcgcaactgtgcacgttcccatcccatctactctctatttctcagctaccgtgaggcaagaaataaagtttgatgactttgctatgtttaatttagattataaagcagaccattgttatagattatctattggattatagatataaattaaacatttcaaaaattcgatgaataacttgaaaaaatcagagcctttttaatgcattactacaatatatcatattagccacttcctgatcaaaccattatacttcctccgttttatattaaaagactttttagtattgtacatattcatatatatgttaataaatctagacacggcaatgctataaagtcttttaacctataacggaggaagtattatttacttcaatccaagatcagtctaacctgatctcgctccgtcaacagtgccacccttgcacccacactcaatggccaggtgcccatagtttcttcattatgtgtttgattgatctgatcctaccgcttccgctgtgcggtttcgatctcacgagttgctggtagaagaacttgttctgggaggaggttgggggggaaaggggggggggggggggggatcgatagatgcaaagtcgggaggagtggggggctcaagtcgtgcggccgaaggcgcgtccttgtgaagatggatgaatttttagaacagaagcgatgtcatgcaaggcaagcgcgtgcagggaaacaaagtcgaacgaaaagctagctcagagtagaagttttcttccagagcaacagatgtaataacagacgatgagtacaaagttatctttaatttttataatataggtaatgataataaaattatttttggtggccttttgtttcgaaagaattacaatcaatcttccggatattgcaggtcgaattactgcgaattgaataaaaacgacttagattactagtctaaaagcaaagatacaacctccatttatatataattggcaaaaaaaaactgctaaatatttcatctgcttgaatgttggatgtagtccttgccttgcttaaatgaggatacaaaatatccaaaaacaatatccgattattatgccgattaaattttgctcagatcaccactaatgagagtacatatgcgctggattgtttcacttgccaccgcccctaacaactaaaccggccaagttagtaagtttcaaactaaggcccacgatcattagagcgtagaaggccggacggttagcccaacccatacttggttggggttggaggccggagtccgaagtgccggagaaattaatggagtaaaccggtgacttgtccgggttgaagagcccgaagtgcttctcgatggggaataagttcactttgagaccctcaaaagtgatcgaaatctaatccgtaaccctaaaccacaaaaccggatatcttgaccccttaactcttaaaagcggtgcaatttaactccttcggtggttttggaggacggtttcgctgatgtggcgcatacgtggctttctactcatcaaataagttaaaaaaaataaagtgaggcccacctgtcagtgagtcctctcctacgttctctctttcttcattgccagcagcggcgggaggacggggtgagcaccggcggctggtggcatcggggcgcagcgcagtcggcggctaggacggcggcggctcggccgcggaggctcgcgatagtgggaggacgagggaaacggcggcggcggcggcccaatatgctgctcgtcatcctcgcccttgcggttaccggcgcggtctccgacggctcgcgagtcgctggaccacatctccatcaactgcatcggtgtcgggggacatgtccggctgccgctccatccactcgcgcccgttcagcaccgacgaggagggcgaggctcctcgtccccgctcagccgcggctcttcttggatagtcccgactggaggcagtcggcggcggggagggagtgggaacgggagcgggacgatggcgacgacagaagaggaagctggctcgcgtcgggatcttggtggttcgtcggcgatgatgccgtgtgcgctgatggatattttgcaatcttgagctttttaatttctgttttgcatgcatatagtggctggctgaagtctggcttgttctttccagttatgcatgtaacgaactgctgatggagatgaataaatagagaagaaaacagagaagctgcggtgactggtgagacttaagcagcacaaaaaccactctgatcttcggtttttcagtttactgttcacagtcttacaatcttcagagtttcaaagattcagtgaggttgagcgtgtgagttgtgagcgaattgcaagtttcctgacgatggtggtggtctccccctctcccccgccgtaggcgacgacgcgatggtggagagcgcgtccagcgcgccgttcccgagcgacaggagcgtcacgctggtgatcgtcgggagaggcggagcaaccacgagaggcccttgaggctagagcagaagtacaccgccgccgtgtcaccgagcaggtagaacagcacggcgagccaagccgccatcacgccgtagccaagaacccgccgctccacaccgaacacgcagtcgaacaggtacaggtagtcgacgtagtcacgcgggaatcgccggcgatcatggccatcctcctcggcgacgtgctcgcacctctccccatagctctcaacctggaatacaccgccgccatcgcgacgcccccggatcccgccctccttggacgacgataccacctccggcggtgtgccgccgcgcggcaagatgatgaagaagaagacgagcaggagcaagaaggccacggtgacgctggcaccgatcagcacccttgtcgccggctagtgcgaagaacagacgccgaccccatctcgccgagagctggcctcgccatcgtcgactcctccactgtggggaccgcttcagctcccgccgggcggcgccacaccgcagcccatgccctgccgccggccaaaggggaagaaggggagagaaaaagagagagaagggagagagggaggaggactgacatgtgggtcccacagttagtgggccccacatttttctgtgtgtgaatgacaaacgggtcccacgtaaattttttaattttaatgccacgtaagtgccacgtcaaacgccacgtggatcaaaggctcggtcaatattgccacgtaggtgccacgtggcgtcacgtcagcaaaaccgctctctaaaaccaccaagggagtcaaattgcactggttttaagagtttggggggtcgagatatctggttttgtggtttatggtcacggattagatttcgatcactcttaacggtcatgaagtgaacttattcctctcgatggcatctcccttcttctggttctcgtcaaacatggcgaatatgtaagtctccaatgccacgggcctcttgggcgtgccctttccgacatggttgatcaagttctggttgtacaccctggcgttgtccttgctcgcgccacgaccgtcagccgatggccacccggtctcggaaatgacgacgggcacatctgaccctccctccttctccattgccgagtatatgctgtcaaccatggcatcgaagaggttggtgtaggtgtgtccgttgtcatctatcgtcgtcgagcttggccggaagagcgcgaagttgaggtcgacgccgttgtcgttcttgtaggcgtagtaggggtatacgttggccagcagcggcgatccgtttgctcgccaagaacttgacgatgggacccatgatggagggggggtcggcgaacgcgcttccggaaggcagcggcgagccggcgaccaagctcatttcaacggcagtggacaccttgatgtggccgccgaggccggccgcggagagcgcgtctctgatgttgttcatggccgggaggatcttgggcttgtcggcgccgtctttcacctcgttgccgacggcgatgtacttgatgttgacgtccgggtagtacggccggacgttggcctggacccaggcttgcgcggcggaggacgacgcgttggtggcgtcgttggaggcgagagagcggacgtcgggggcgtcgaggacgacggcgattctggtgccgcggagggcgtgcaggatggtgtcgttggggaggtagatgcgcatggcgtcgatgtggttggactggtaaagctgcaccacgtcgcccggccggcgccggcaggttgtctccgttggtgccgtagcacacgccgatggccaaatctccttcgaccatgtacgacctccgacgtagtttgagagagccaaatgcaaatgtgtgtcggcgtggagcgtcacataggaggtcgtgcacggttaaaagaggtttagacctgtgatacattaagccactactaaaaactgattttcctgtgcaatgagctctttagattgcagacgaaccataattggtcgcgtctgcaaaaatcgtcccatcatttttgcgtgcggatgcttaagaggaccgacacgtgaaaatcaaatttcgcaggcggacctctccgtacgcgaaaatcgatttccgcgtgcggtcctcttaaaggcccgcctacaagtttattctccctcactctcttccctctcatcaatttcaaaaatctaaagtcccatctccccacagctttatctcctttctctctctccccacagccttatctcctcctctctcacctcctcccgacggcgacggtgacagggacggctcaggagatggagagacgcggtgggggggcgtgggacaccacagagacgggagcggcagcgagcggctcggcagctggcagagaccggcgggtgcgtggcggctcgcaacgatgacgaccgcgcgtggaaggcggtaagaggcaacagtgaccggcccccgcctggatcttggcggcggtggcttcgggcttgcaggcgcggcgggctggctccacggcgacgaggaggtggccggatccgcacacacgcccctaccgactaggaggaggaggagcggtggtggcttcaggcaggtgggctcgccggcgaggaaaaggtggccggatccgcccgcacgcccccaccgacgacgaggaggaggaagagccggccggtgtgccggtggcttcgggcggacgggtttggcggcgaggaggaggtggctggatcagcgtgcacgcccccaccgaggacgaagaggcagctggcgccggtggcttcgcatgggcgggcccaacggacggcatggatttggcctcccctcgctcgatctcctccgtgcacggtggccccctccagcgacagatccggcagtgaggaggcatgggggtggcggatcaggcgacggcgctggcgacgacgaggacaacggcgaccacgagggcggcgtatagggttagggtttcggattttattttatttttcggtttttaatttttgtgtgcggacaacataagcacccgcacgcgaaaatcatattttggcgagcgccactcgcacgcaaaaattccatttttgcagaccctttcgcccgtgcggttagctctaccacatgtgaaaacccctctagaaccgcacggaaaaacctgttttgtagtagtgagccaaaattataaatttaaatatgtatcttacaagattttgaacataaatgacaccaccttacaactttaaacacatggcatgtatttgactgatgaggaaactacttcgttcggtgtttctgatagccaccaaagctttgagatttgtgtgaggggatagagatacaggtccattggttcaatcgctgttttttaaattttaagaattcatttataaacaacaaacatgttccagcagcatcattaatcgagcttcagtgttatactccctttgtttctttttagtgatgtcggttatttgttttgaactaatcaacatcatacattttaacatgaggggatcatcgtttatgttgtcatatggacttgccattatgtatactttcttcgttttcaaatatggttcattttaggatcttgtatctgatacgaccatggatactgttgatacaaccgtcgctcacatcaatattaagttgaccaagttttagaatccaattcggccacctgctatagtactgacttcaaacggccgccaaatatacgtacgggctccattttgggtccatgagtacttcatggaaagccctcgaagtactctttccaacgaaaccagcctcatctccaaattccttcttagttggttgcaatcgcaaaaacacctatattggaccgatgggcttgtaactttgtttgggaccatgacccaagtgaggccaatgtagggtgcaccccaaccaggcggagcatgagcctagggaccccttggtcgtcctctcaccttcataaatagctagatacccgttcagggttttgtttagattaaggcaaattttgctataagacatcgtggcttcgtggttttagctataggacaccacgcgaagtgacttttggggaaagacactcgcaaaagttggatatttgctggtggacaccacaccattaaaataatcatgtgaaagagaagagagaaatcacgtgaaagttctaaaatgcccttgggcccacatgtcagatctgcaactctctatatatatctctttctcaagcacatggggcccgcatgcaaacctctagcatcgttttccctttcttcttcttcttcttcttcttcttcttcttcttcttcttcttcctcctcctcctcctcctcctcttcctcctcctctgctcacaggaggaacaggtaacgtgaggcgtggcaagcttgatggcggctttccatgggcggtggcgacagaggaaggagatgcataggccggcagtgggcgagcagcgtagtcgcaggaaagacagccggcggtgaagccggtgtcgacgaggtccgcggggaaggaggtggatccaagaggagacagccggaagaggcgagtgacgccgcacagaggtggtggccggcgccgatgcgggccatgcggctggaggagtccagacggggttgaggacgatagggctagtggcgcagtgacagaggggagggcacccggtgttccaggcaaagaagctggcggggagcttggggacacggaggacgacgacggtagcgaaggagattcggtggtcagcggtggaggtccctaggcggtcgagggcaggaggtgaggtgaccatcctctaggtgtgatgaggacacaactagctcagatataaccatgactaccttatgtattaatcaactaaaggtgcagatgttttacattagatttacatgttatatatttgaacaaacgttgctacacaatgagtttcctatgtttttgtttgcataggtacttgcttgggcgaaggaaaagagaccaagcgtaacaaattcatgaatgatcaaagaagttgattggggaccatatcaagaccttctccaagtacacttccatctcatcacgtcacttttggtctatagaagacaagagataaagttctacacgttttggattcggattcgggcctcctgacagcatcaacttcaaacagacctagccactgatctagaaggaatttcggggcccatgagtacttgttggaaagcttatgtagtctactttcagatggttttggtcccacatcaaaactcctaccgagctgccgagaatctgcaaaacaagccacgcacctcatccagtccgaatctgattttgagttttggcattgtaattgtgtcatgggcttagcccaagggggtgtgcgccctagggcaaccctaggatgtcactaatcatattaattcagtagccgtcatcgtttagagttaggttttgcttagattactctgtcaagaatagttttgccgctagatcggtttgtggaaccccaaattcgtgtgcttaatcattcatatgcaatttggttgcaatctatcttgttcttgcttgtgttcttcgattcgcatgcagggattagccttctcggcgaggtcaaccgggtttcagcacggttgataaccagagaagacgtggtgctgcgattgcggggctcggtagcgtgtttgttcagaagccggatcgagttgtgtcgcgactccgctcaaatcgattgtttatcaatacctatcggaagatcgggacctaacaccccttatcagttggtatcagagcgcggttgcccgttaggtaatttatcttcccataaccagaaaattgcaacacaaaaatatttactctttacctagacaatttgagccgttgcattgttctattagattttgctttgttaaattctagattgtatcatcgtgtcgagtgctggtttagttttagatttaacttttagttttgagtattgcatctgttcatcacctagatctagggttcatcactcaagtgtgagagttgtacgtcagttttgggttcagtttttcatctcgtcgattgttgcagggaccttgaaaaattgaatcgtctcgtcgtcgggtttccgtttttgtgatttggagaaatttttatcgagtggttagagagttgcttgatttctagggttcctgtgttgccgtgtgttcccgagcttatgtgtgccatgagaaataaattaaaaaaaacgcacgaggttggttgatatgggttggatctgttagatataaaaaaaatattagtggggccacccttatcctgtggaggccggggccgaaacccccacccccacgtccgcaactaccacctcccctcacggccgaccacctccacctcacggcaatttctcccgtgccgcttcctcgattatcacattgtttggtattttggtggttgtagatttgagatatttttataaaaacggaacctacatgatgtgagcattccatttttgaggtgatctaattttagttttacactttgtatttgagtccctgtaatattcatatttacatttgagtctttctttgaggtcagtggttcagttcttgttgaaaaaaaagtaaaaaaataaaaaagaaagaaaaggcaggaaaggtgcaaagaaaaagaaagaaaaaaaaagccgcacctaaaaaaaggaaaaaaaaggcagaaatgtgcttaaaaaagccgcattaagaaagaaaaaaaaaccattcatccttggagtatgttttcagagtgcagagttgtgcattgattcatatctagtccttagtgttgtcgggtgcttgcttgagctagagttgagtctagactaggccagcacattgactagtaatttgaactattattcaactttgcattttctgattagtacaattgtgttcctttgctactatatattgtgcctcccaagttccacatatattcttctggtcagcactgctttgatccttgcaatcgccacatcacgtccttcaaggtgtcacgaaccagccactggttgtaccgtccttagcattgctggtaagacacttgtaagagcttagtaggacgcttccatttgcttgtctccactacaatccatgttctatagttaatagttctctcttttctattgacaatggcatgtgcacgtgatgaaagtactctggtgcaacaagtgctaagttctcaaatggagaaagcggagcaatggcagtaccacgaattatttgaaacaaagtttgtggttaaggatagagcatgtcatgctataattgatagtgaaagttgcaacaactctgtgagttcagatttggttgacaaacttgagttgcctacacaaccgcatcctcatccatattacatcgaatggttcaactcttgtggtaagttcaaggtaaatagaattgtgagaataaacttttcgattggaaattaccatgacactgccaattttgatcttgtccctatgcaagcatgttctttgttgtttggtcaaccataggtatgtgataataatggatcgcatgattttgttgctaatacatacacatttagacataatggtcgggaaatgaaattggtacccatgagttttactgaaattttcgaagataatcttgaaaggatgaagaatggaatcgaggaaattttcaaagatagtattgaaaggacgaaaaatagaatcgatgagattttcagacataccaggaaagatactaatattgcgatgccttcaactaagtctgagttattacaaaacgaacgtattgttgtgcctattgctttggatattaatatgttgcaggcatctgagaacaaccaaggtaatgaggaggaagagaagaaagacgaagagcaaaaagatctatccatagctccatgcatgcttgaggaatgtttaattgatcaagcgcctacaatttcagaagatgagaaaaaaggtaaagataatggtgctacaactgctcaaggtatgcatagttatgatgtgccaattatgtccactacttatactacgttagagaaacccatagtggaaacaattgttgaaatacctttgtcacaagacaaattgcttgatgtctcttgtgataaagaagagttgtgcgatgcttcacttatatccatgccacaactagtgaatgaacatgttagttctgtagtagagccacccagcattgagtttaaacatgttattcacattgatagcgagaatgaagagcttaaattgctatattctttaaatacttggggttatattcaatttaatgatttttgtccactcaactgtttagagaaaaaaattatttgctagatttgaattgccatgccgttctgatgtgatttttcatattattggcaattatgataggtaaggagaatataatgtgcatcgagtatatatttgttctaatttgactatcataaaatgtattgtctagagtaccgcatgcatataagtaattctctatctatggccatcaagaaatgttcctcaccggatgttgtgatacataaagataagttcaatacgctctatgacaaggtgaaaccgaggacggtttctaatcaagaaggggaggatgatgaggacacaactagctcggatataaccatgactaccttatgtattaatcaaccaaaggtgcagatgttttacattagatttacatgttataaatttgaacaaacgttgctacacaatgagtttcttgtgtttttgtttgcataggtacttgcttgggcgaaagaaaagagaccgagcgtaatgaattcatgaatgatcaaagaagttgattgggaccatatcaagaccttctccaagtacacttccatctcatcacgtcacttttggtctatagaagacaagagataaagttctacacgttttggattcggattcgggcctcctgacagcatcaacttcaaacagacctagccactgatctagaaggaatttcggggcccatgagtacttgttggaaagcttatgtagtctactttcagatggttttggtcccacatcaaaactcctaccgagctgccgagaatctgcaaaacaagccacgcacctcatccagtccgaatctgattttgagttttggcattgtaattgtgtcatgggcttagcccaagggggtgtgcgccctaaggcaaccctaggatgtcactaatcatattaattcggtagccgtcatcgtttagagttgtgttttgcttagattattctgtcaagaacagtttcgccgctagatcggtttgtggaaccccaaattcgtgtgcttaatcattcatatgcaatttgattgcaatctatcttgttcttgcctgtattcttcgattcgcatgcagggattagccttctcggcgaggtcaactgggtttcagcacggttgataaccagagaagacgtggtgctgcgattgcggggctcagtagcgtgtttgttcagaagccgaatcgagttgtgtcgcgactccgcccaaatcgattgtttatcaatacctatcggaagatcgggacctaacaccctcatcaaggtgggtcaaccgaggcggcggcgatgagccgaagggcgttgaccatggcaatgtggaagggagattgtagatctgacatgtgatctgacatgtgggcccaagggcattttagaactgtcacgcgatttctctctcatctttaaccagaaattattattttaatagatgcaatgtttactagcaaatatccaacttttgagagtttcttcccgaaaagttacttcacgcggtgtcctacaactaaaattttgaagtcacgatgtccttttgccgtgtaatcccgtgatcggttagatcaccggtttgctcgttatggaaccccaacatatcaattgtattcaattcctatttgcaattcagattgattttatcttattcttgcttctttcttcgatttgcttgtaggaataaggttgatctgcaccgacaagattaactacccacagagaggtgtatcgatcgctaagacacaacacaacaacgtctcgtacgattgtagtcgggtcggcaacgtttctcccaaatcgtagttatcttcaactcaccgaaaaagcaggccaataatagtcgtgggtgcattgagtggagctcagggttcatcatagtcggtcaaacctttttaactaacttagcatatgaagtattaactaatatataaatgctatgtagctacattgatgactttatgtgcagttattagattatcatggagaatactttcatcatataactttatctacttatataatactttcttttaagaaactgcaagtaaaaattatcatattggagaccgatgtcaatgcttggaatcatagtgaatatgtgatggcatgaaaatgtatgcatgctatgtactacttcccttttatattataaaacaatttgatttttttcctaattaaacctttttaagtgtgacgaagtttataaaaaatgttagcaatatctaaaacgtaaatttagtttatcaaatctaatattgaatatattttcataatatggtaatattatgttagaaatattgctatgttttttataaagttactaaagcttaaaaggttgattaaaaaaatcaaagcgttttatagtatgaaaaagagtgtaccngactctatagttcatggctcatgaaatcatctccagccttacaggtctagattttgatcgtcgcaacaatgtggcttaggaaatgatttctggcatcctacaatcgatactggcttagaactatgaatttggtgatttggcacgattttgaactatgaactgtgaatcgataccggcatttctggcagtttctctccccaaggtcgatagcagatcatgaatttggtgattgtttcccattgcgacacgttttgtgcggtccttataagttaacaccagtaagccaaactatgaaaatccccaatgccacactcccaaatgccatattcccaaaaaaacttgaataaattgccattggtacacctacattagttgatttcctgccattttggtccattcttaacgccacatcaacagccacctcatgacaccatcaagaaaatgacattgatacccctgccctttcagtccaatttttttttcggggactttcagtccaaatttaacacagcccacatcaaataaaacacaaccgacagatgcacaataatttcacaagcaaacacagcttggaacatacaaatagaatttgcaaacgctagacagatcaatctaccaaaaaaagaatatcagggaaaaatccgatgccaaaccaaaaggagggaaaaacgaatgatctattgctcttttacctgggccaccgccggcagagtcgctggagaacggagcgacgcgaagtcggacgaggagtagggacgcaaagcctagagcagggggcaatgcaaatatcagagtttttctcctactcccagtgtgcaagggcaaaacagggatttcaccccatccaaagctgatgtggcataaaagaaaagaaataaaatggctgggaatcaactaatatatggatctagtgacaatttatctaaacattttgggatgatggcatttgggagtgtggcattggggaagatagcaaatagtaaaaaaaaatcctgtcttaccttaggttcatacgagcatagaactgattgtgatacccacctttcaaaagtatccttcatacctaccgttaaaaatgtctatgaacaagcttctaaactgatggacacttttttgcacaccattacaaattctgagtgatccagacctcagacgggaataacccgtagatctgttctttaacatcacaaaagggaacagtacgctcaaattttcctgttttcacgtcgtacgtccttacacctccccaaacacgcagtccaagaagccaatcgaatgcatgtatgatcacgggggcagagaaatatatacagtgaggccgtatcccgggcaaattctgggtgggtaagcatgcggagtgattcaatctgaggaatagcgcatgatccatcaaaacattcccctgcaccacccccttgcatccatccggatcaaccttgcagatttggaacgcgatgccatccgggtagtgacgcgcgagaatcacacgaacctgcaggagatcaccccatggcgtcgacactagatgccgagtgaggatacatcctaatcctccgtagggccttgcggcataaatcacctcccttgttggtccgttgctcgctccatcaagatcccacttctccaccatcctgtgcaatgtcacggcgtggaacctccccttgtggtacgcacagtcgagatatctgtctcccccgcttagagttgaagccacctgccacctgctctggcctgccttggcaaaagaaagccgctcgccgttgttgtggatgatcatcacgacgtagtcgccgcctctggatggactgcaagacagcactgccttttggtagaaccatatccctaaccgatacgcttcgaacctgctgtttgtttccaaaaggtagttctccaagttccctccttcgctgccatagaccgcctccacgcaggcgaaatcggtaatcggtgggagggggatcatggccagtgtgacagggttgtggagcacgagattggagaggtcatttgccaaaaccagccagccgtgagaggccccgtagcacgcaacaaaggagccctttggaaaactgactctgtagatcttgtcaactgcatcaccagggtggtagaggttgcaggtcaccgccgagcggcgcctttcgtccagccttttgtcaacgtggttgccccatgacatgatccatggagtgcgagaacgcgggacaccggcagccgtggcggcggaactccatgtggtgcagactgcggcgaaggcaagtgcatgaggaagctccagtcgttccaggatgattaggaggagatcaatagggaggtcggacaagctggggcttgcacaaggtcctgctgcagcaaacattggtatattgcgaattaatattcagcacaaataaaacactctgcatgcaaacatatttgttactagtaagagcgaacaaataaattccatctatagttcggacaacagcccctcctggtaagcagggcttatcgaattggaaaggaacattgaatccaattcggacacgaagaaaccaatacaaaagaatcgaacacaacgattttgcaattggggctatcagaattagaaccggactcccactcttctggaaaacgatctacgtacgcaactcatgataggaacgaattggacgcctaatatatagcaaaaaagaatttaaaaggaaagctacccgtgagattgtaaaattaataacaatttaataagaagcagatataaaattaatagtttttccatgtataacaagataacaagtgtttgtcatctcgctaacgttctctttcaagatttacatgacccgaatactaaaaggatatctgtactgaaatttgttgatggcaaaagtacatgtttagaaagacgacaaaagtacatgtttagaaagacgtgttaacatatagccatgttatcaacctggtgtaaactgaagcatgtatcacggtatggtatggagaacataattacacgaatggtgacgtcgtgttgtacaaagtaagtggacattggtgagtaacattcggatcatcaatttactatcttctagattatgttttcgaattaattttgatcatgagaacctacctttgctcaccagtcgggaacgtctttatacacgatattttattgccaggtcccataaccaacactacaatctttaagcaaaactaattccgacacactgggagagatgagaaattgaggaattttatggactgatgcatttgttgctattaattattatacttgcccatgatttttttcattaaagtatgcgtctgtttttcattagtatcataaggtcattacatcacaactgttatattacgtgtcgactgtaccatgtaataaatagtgttcccatagaccctttgtctcataagatctacactcccctaaatatgttagctatagcatgtgacaatccaattattgtggactgtgtaagtttattttggtcatagattcagaaaataaaatgagtttgaatgaatattatttacttaaattgctcctaagttggttcaacagtctccaaaaagatgtgaggcaatgactgcagttagttagttctgtatacagagtgtatttgccagttgccacccttgcaattatttgaggggcaatacttttatgaagcttaaaaaatgaatttcaatacatctgccctggcttgaaagtaaacatgattttatttttaagattgcattttagtttacaggagatgtacagtgtagctaggtctgtcatttttatttgtaaaactcaataggtgtaaccgctgctattttaatgcatatttcaaaaccatgtataccacaactggtactgttaagcagttctgcatcaacactggttattatttggtttttatacaataccactatgttaattagtgtggaatcacttacccatgtcctcttaataatttatcctctgattgcactaataaaattagggtgctatatggcataagttatgcacgcaatacactacactaaaattctgaatgtcttgtaataaaattgttatgcacgcaatacttcttatcaagatattctaaagtaaaacgtctcaaatgcatttacaaacaagttgacaagcgggcatattacatccacacaacattgtattgtttcaggtccctagaaatatacctaatgctacgagagctattcattcccaatttagatggtgaaactttcttgaaaacaagaattaatcattccatatgtgcttaccttttactttggagcaattaggcacgggcaaggtgattctttctgttccctcaaggcattctgtttataccccttggaattggttgggcttgaatccaaaaatccagagcataaaacaatatataaataaactcccaatgaaatgtttcaaaactcccgatcacaatagattcattggtctactttacaatatcttcctccttgccctctactacatgcaaatgtagtaggaccagcccagttgaaacaaaaacgaaattaggaactacatgaaccatctatttaaatccatggttgtggaagtaccgtaggttaggctcgtataaaagggttaactcaaatacatcactcttcagttattcgccatatgggtggcatgctaacgctacatacaccacaatttagtaaagcagtatccttttaaaaattgacagcatctttttagagtaaatgtgacacacatgcagaaatagatcatgtgtgaaacatagatgtatacaattgagtaaccggagtatctctagagtaactttgatagcttgaataactggagtgtggagtgaagtagtcaacagcagagcagatttttcctgattcatgcaaaactgtaaacgtcggatacaaggaagtggacataaactattttcataagataagatgcatagattattttcagttttattggcttgatctcttgcagttaagtgccatatatatattagtatttgacatgtggaactatagccacgaatccgtttactgacagatcaaatcctccaagcataattgactataataaagaacacattggatttgaatccaaggaaacatatcacacatgcacgccatcaatcacgggtgcatgtactccaaatatacaagggtctaaatatacatttcactgatatagtacacaataaattatatttgtaaatatacatgtgtcaatcaattggacaatatcaaatatgtttattttttgggagcatgtatattgtacctgattggagccggcctatgtaacctgacgaatgagtttgaaccggcaacggcgcttccaatggaaggggaggttggccacgacgaggctgtgtccctgaccggacggcgataaggctttgcttgataccgtgacaggaatcagggaatgcggcggcggctgaaaggccggatgagagtgatggcacctatagaaccatcttctcaatagagtaacataacaatgcatagtagtcaataaaatcagtttaggccatacatcagtgcttgcacataaccaatgcagcacattttacatattcaggtgtcattatttgaaaagcaatattatggcgtaactcatcgaatccactgccacacggataatagacccaccctggatatttctttaaacaaatagacaaaagcattatggaattttcagaaagtacatagtttagctcatgtaaattttatatgtggctggaattagctcaaggaaagaacgaatcccatcatcatgacatcataccatctcattgtcatgttacattttcaagggaaaaaattatcactgcagaaagcagaacttggatataacctaaaagtaccagaagccactttgaaacttggattaattccattgttgcagcagttgaacgatataatacttgaaggttgtatatgcacgctactaattaaagcacttcatctgaatttacagacataaacatcctgatcataagagaaattaaatcatttgcattatataaaaagttgcagatgctaatcaaattgtttaaaacaggacgtcgtcattgataatttagtgtgatatgtgcacacacatcagaaacatagcactgtcaatccgcaagtaaatgaattgccattgcttattaaattttggaccaatcgaggaaaaatcaagaagaggaaagagcaaatgaaataagagaaaaggatctccatgtaccaggcagagagggccattgacactgatcaggtagaccactggtgaatcgggtagatgatggacacgacctggcggcagtgaatcggcgacggggctacggccgagtcggcgctttgtgtggtggcggcggtgacagcgtgagtcaatctggaggcaggaatcgaatgagaaacacatgcagataataactttttgtgtcacacatgcacataataatttgatttcaattatctcactggtgtattctatagtgggagggaggaaaattaaacagcaagtacaaattcatttgtattcactattttatctctatttcagtaactttgaacagatgcataatagccattgataatttaatattaggatgattcatagtagaacggagccgctccctaatgatgaagctcaccacgttgatccaatgcaaaaaaaaaaaagaactaaacaatcaggcctgaaatgttcagactgttcatgcttatgctctaccaattgctatacaattaaagaagaagatccaagaatacatatgcgtaaaatatgagtttccacctcacagcaagtttcttctctgacaaataaaatgatctaaactcacatcacagtaataaaaataccacaaccaatatcaaaacttaaatactacaggacctaaacctaacttatatctggattggatcgtaactgctgaaggcaatactactcaacacaacggtagaaaatgtgcattatcgttaaaatacctgctcatgatagtgtaacctataaagagatggggatttcagtgcattcgcgtttgggaggggaggaaccggaatatagatttggattttgcagtgaataaagatgtactaattatctgacggggaattaccatcgatccatccaatctgcaaggtgctctctactattgtgaccttctcgctcccgctgtcctgcacacacacgcaaataacaaagaaaaaaaatcagagaagggggattggagtcaaggaatggagataaaaaaaaaggaaggaccaggaagtctgggcctctccgttaaaattcaaagagttagggataggaatttaggagatcggggatggagaccttcaagtgtacgatgcaggcaaggaggcggtcttcgtggtgggacgggcgtagaggaggcggccgacagcgacagggttggcgcgacggagtcttggcggcatggacctcggtgactcatgtgtagggtatggcgacggggacggagatcctgaccagcgaaggagaacgtgcggagcggatgagggttgcagcgacggcggcgtcggcgtggatcgtgggtggctgggtgcggcggcggttgagggggagcggctgagaaagaggcgttggacgatcggcggaggcggcggtggcagaacggctgaggcgcgatgggagagaggggagcgatcccgcaaagagatgggagtgaggggaaattgcgaaatcacggatgaggagatcacgcgaggggagaggggggaggtgggagccacgggatggtgaggggatcgcgattggcgtgaggcagcgtagtggttggcgtggtggcaggccggcgtccgttttttgcgcgtcggtgtggcggcggcggcgtcgtgcagtgtgcgagagagaagggagagggttgcgcgcaggttgggggcggcgaatcagagaggggctgcgcaatcacgcgattgatggagggtgattgatggaggtgggaggcggggatagatctataccgttcaattttacacagagatgatccggaccgttctatgaggaatgaaaaaaatgagtgatgaatgaatgagtgaaaccatttgttgaactatagggtagactatagggtagatacacagaacccataaatttatgcaccgaaaatgcagattgttttttttcgcaaaatctaaaggagtgcgctctcgattttgtgttaaagagcgatgcactcattcgtgagagaaggtccagtgcttctagcacgtgagagaaggtcctgtgctgctagtacagctacgtgagaaaaggtacagttgttattagtgcacacaatgcatgcctattttttctttttatagaattttctctcaaattacttatccgatctacaatctgattacaccattacgttcgttgcaattaaatctttacaacaagatcttacatgattatattacgatgaaaaaatatttctatttataaattacttttattatatacgtaagttacttttatcatatatataagttacttttagatttgactaaattacttctatacattcataatgctctaagttgattatttttattattgcttttaggtaattctttattttgtggactttataaatcttatctacactttacttgtgaatttactttacatagttttttatttcagctcactcacaatataattatttctactacagagagttactccccccgtttcataatgtaagtcattttagcattgcccatattaatatagatgttaatgaatctagatataattttaaattaaagttactttcttttcttttcgttataagttacttctataatatatgtaaattacttttaagctttactgaatttacttttatatgtctaaaaaaataacttagtgaaatctagaagtaatttagacatatcataaaagtaatttatggtttttcatcaaaatataatcatgtgagatcttgttgtaaagatttaattgttacaaacacaacagtgtattcggattataaatcagatgagtaatttaagagaaacttctctaagaagaaaaaaatacatagatattgagtgtactagtagctttttttttttggaaagaagggtgtctctctttagtactatccagctagcactctcggtatagttgtgttcttcttcttcttcttctttttttcgtccaaggccacttgtgagttgtggctacctgcaagcacaaaccatctgtgggcaagtggagccgagaggacctgagagcaagtttaatagtatagctaactgctagctccaatttatttatagccaatgtaatagccaattcatataataactgcttactatactattaatacttgttcctacctatcatacacatattacgtcttagagtccgtgctacagctggctacagatctgtagcccgctgctcttctctctctttttttatctctttaaaatatgtttatagctgacttatcctgcaactgtacctgctctgacacgaccattccaaacatatcgaaatagcaaaacccttgtgtcgccttccctccccggcaaaccccttccgccgaccccctcgtctcgcaagtctcgcaatccacctaacctaacctagggtttggatttcctctcgccttcgccgctcccgaattccccaccgcgccaccggcttgggcccatcacctcggtcgccggccggtttaaacgccacgatccacctcccctgctcccggatcccccgccgtcacgcccggggtctctcctcctgattcggcaccacgatccacctccgggattgccgccgcgccacctcctccggctccatcagctcgtcacgaccggcgtctctccctcctgcttgcttcgacgacgccacgatccgcatccccatccgcgatcgccgcctcctggacccgggtcttcaccgcctctcgacttcgtctcccagtacgcatatgcagctgccatgccgactgctacaggtggggaagcgccggcttcggcgcaggagtgcacttccgtgggtttgggggctagattggtccgccttgatggcaacgccattaccacagtggccgaccttcagttgtccggtccaattccttctccacctccccaagacattgatacagccaccatcatctatggagaggatatcaggccgggtacctacctggttattcatgcaggagttgatatccttgacattgccagactcactttccttgaggaactaccggtggctgccaggaaagggtatcccacggaagcggaagaggagaaggacgccaaagctgtggcactggcaggcaggaaggggactcccactgaaatgggagaggaggagaaaggggtggtggcaacgccccatcaagagaaaaacatggagaaactggaagaaaagaataaagaagctgagaggttgggaatggaggaaagagaggaagaagaggggaacgaaagattgcgggaggaaaaaccatggcacaaccaactgtggggcgaaacagtgcgggaagaaaagaattggcacaatcaattgtggggtgaatcagttgaggaggaagaccattggcacaatcaattgtggggcaaaacagtgcgggaaggaaagcattggcacaatcaattgtggggcaaatcactgcaggaggaagagcattggcacagtcaattgcggggcaaatcactgcgggaggaagagcattggcacagtcaattgcggggctgatcactgcaggaggaagagcattggcacagtcaattgcggggcagatcactgcgggaggaagagcattggcacagtcaattgcggggcaaatcactgcgggaggaagagcattggcacagtcaattgcggggctgatcactgcaggaggaagagcattggcacagtcaattgcggggcagatcactgcgggaggaagagcattggcacagtcaattgcggggcaaatcactgcgggaggaagagcattggcacaatcaattgtggggtgaaagattgccaaagaaaaaacattgccaccaccaattgtctttgagactgtggcctggattttctcgtgcggttcttgttttacactgttaagtttaccccctataagtttttcttaaggaaagctgtagaagtttctgccgttaatatattaggaagaagatagcaaagggaccaggcagttagaaaaacaattaagttcttgtttcttgtctgagaagatactgcaatacatgtaggtgtgtgtaggagttggatgtaggtctttcttctttgggtgcttttgctttgaggtgaaaggacttaagagttttcatctgtatgcttaatccaggttatcctagaacgttgcccaattgttatcttattgaggacggttagtgtccaaacacttttgattttttttaaagaactgctgaatcttcttcttcagttgttaagaacttacgactatcttcctgggctgcatcaagttggaaaatgatctcatcatgactgttgccaactgtaaacgaatgttgcccacattgtctgttccatcttatcagatcttttgccagctgacctaactttagatgcagctttaggtagggattgcatgttacgactggtttttcccaagatctcttcacatcatataaaacatgtgcccacctcttacattacttcccaccaagagaagtggggaatggtctgaacaatttgtcgagaaggtgtgccatggacgctgttgagaacattaaatcccattcagttgaacagactgctctatcattttttttttgtctgagttgtgttgttagtttcgtttgtccaagttaagcgacgcccattaagtggaaattcctttatgtgtaatcatgcccttaaaatggttatcattcccaaattcaagcgattgttatttttgtctgtggccctcctgtaagttttactcctgtgcaatttatctcataatagtaacttgcttttccttcgtaggccaaggttcatggaaagcaacaaaatcatatagcttacagtggctgagatatgacaacaaagaagcacttttcggattcataaataaggaacaaaacagaaatatcaaagatgctgagattttgttaagcaccatggtaacagtcatcttttatacttgtcattgtagggaaaaattccatttgattctcgcaaactattttgtgtcgcttaaaatgaacatttcttcattattctttattgtcttataacatttaattctgttgcagaccttcaatcactggaaaacaggtttgatgtgcaagctagaatttgaaggacacctggtacataaataacaactttctgatataagatgtttgataccttttctgttatttatcgcatttcatcttactctatagcccaatctctgtgacagtatgggtatgggattaaatcccagcatggataacttcaaaatcaataaactgttaggtaagaaacctatatatatttgcatgcattaaagtgttgcaatgacaatcaatcttgtcaatgaaatctttaacaggtaaaggtcgatatggggaagtgtatgaatgcacttattctaatggtcaatatgcagtaaaaacgattgatgtaaccaattattttgaccacactgaaccaaggtttgtgagtgttatccttctctaaggtttatattcttaaatatgccattttctaagttgtaaatttctttatttcagagaagtcagcattatgtcttgccttcaagacgcaaacattgttaccttttaccaggtactcttaagtccctaacaaaaaggtctttacacttctaactgcaactgttaattatgtttctgaatttgaatttattaggcgtggtgtgaaaacaagaaagaggaaaacaaatttcatggttttggtgtacatgagccgaaatatatttatattcatatggaggcctgtgccaggtacaaacacattttctgtatgcttgttatcaattacacttcccttcaggccacatgagaaactacaggcagctaaaaaaaatccttttaaaacaagccgattctcttgttgtggttgacatgattatatctatagaataatgttaaggatgcttccagaaacatgcaaaactgtagaaacgaatttgagaagtagcgaattggttgaagcattataattcaataggagcttgtattgaataagagtcgatatattcttggaataagaggccactacgccattgcactgtcccaagcgattagaatgacggctgttaatcaacttttacagcttatagacttctcctgaaattttatatatcacatgcaggaccctttatgattttctgtgtggaaataatgaaggaacaattcaggacaggtggtctctttttgagagaatcgtaaaaggtgtaagatgcatccatgctactgggataatccaccgtgacctcaagccatggaatattttccttggaccttgtggcgctgttagaattggtgatttaggacatggttgctggtctaaatcttactgtgatggtcgacgtggttcacctgattgtggaaccatgttgtattcggcaccagagctcaggaatgggctgttggttactgataaggtattccttatcacagtttcacttttcaaacgttttcaactatcagttaatagtttcacatataatttattcttgctgttatcgtaggttgatgtgtacagtttaggagtgatatatcttgagatcttcatgcctgctgctgttagtgttaacaacagagttgatgcattgatcgatttgatggaaagacgatacaaaccagaatggacagcttggtccatcgatatggaattcttgaaggacctaactgctttaaacccatgtgaccgtccatctgtgggtacaattttggtacgtacttacgactagcaataaacattaaactgcttgcatatagcattaatttgatcattttttctgtttttatttttattacaggaatatatcgccgaacacgcaagtgactgttgagtgctaatgtcagatgtgcaaagatgatgataatatcgttagtacgttgttccaaagaataatcagaccaagcatttagtacttagtattttgcatcagcagacgtattattgattgtatgatcaatcattgtagctatgtagtacctagctttggtactcgatgtagatttccattgagatgaactctcataatctgaactagaaatttctgtcaatcctcaatgtgtattgtcctatgatgaactctcacatcagaaatactctctctgttgtcccaaattagatgttttaactttttacttgcaatgtttgatcattcgtcttatttaaaatatagtgtaaaaataaaagaatgataagtcgtagcagtgatacacccgcagcgctcgaaatagtaagtcaagcgccacacgccgatctcccttttttttcccttttttctcaacctccctcccttcgatttttcctcccactctgtttcctgattttccgtttctctcaacctctcccttctgaattttcctctcactccgtccgatcaaaataaatagagtaggtctggctcgtaacagcgagagtaacaaaattactgcttacgagaaaacaccgagagtaataaaaatagaatcatgctatacgtacgacccatccatccaaccagcttacgacccaaacggtgtagcaacacattgcgagacggtgtgaggattcgtgctgcatgctgctgacggcgcgtacatcgacgttgtagtcgtctgacagagtcggatgtgtgggtcgtgtgtgtagcattttccataaaaatactaatctcggtttctctgttccacacatccctcctattccttcctggttgtaatataagataagtgagaccatgtaaatgaataaatgattttggttttcgcacatccctctcgttccttgccggtcctaataccaatcctattttactataaagttataacccactaactcctaaagcttaacatataaagatgtcacatcatcatcatccactgacaatcaatacatttaatatcatgcaaacatgttatattatctataatttaaaatttattacattttagagcttttaaaataaaaagcatgttaaatcatcatcccgcataattcacataatattttaatattgttgatataaaaacacgaggcctgagagatctgcttaactccagtgcaggtcaaaaacttgcctttgggtgtgtgagcatgccagttgatttgatcctgcaattaacaagaaataaagacaaagaaaccatgattaaatccataaacgatagccaatcggctaggtgccgatgacatataatttatttttgagccgatgtcatatatgcatcgatcggcagtcattaataagtaagaaagaactaaatctactcgatcggctgtagatattagcaatatataatccttatgttgatatatacttaaatcaagtgattgagatagatcagtcgccatgccgagacagtataaatcacttagatcgaaataaatattaacatcgagaatatatatgttcatagcatagccgatcagatagatctagcatgaatcggctaatactccgataccactctatattaaaatattaaagcaaatagaatataccaaacagaagcctaatatacttaaatgcaacaagatcttaacataaagggcagatttaacatgtcaactaagcacataagataaatatcgtcaaagggcagatttaacatgtcaactaagcacataagataaatatcatcaaatcaggtaggatcggctgaaaccctgatgctaccctaatcggcaaccaaaggcaggctagagattgagattctaatcacgactcataagatcaaactcaactgatgcagctataagtatgaaaagaaggacaatatctagataatcaaaccgttggatgtgtcatagagtggtggatatcctatataatctaagtcaacatcggtatttaacctaatcggctgccttctactgacagatgttagccgattataggttagatagcgatattgccgaagattatataagatatatgataactcgacgaattaaataaataagattagagtgtcatgaagatggaagcactaatcccgagaacacaagccgccataacaagttttacctcttgttgaagatcagaacagatgcagctcaacccgaaagcaagaactcgtcgagacaaaacgaaagtaaaaaagggtggtgatgcgccgagattgtattgaacgtgtgttagtttgattatatggggctcggggtctatttatacccaagattacaaaatatgtccatatcggacacgactcttatctctaacaaactctaagataccataagtctttgcggcagacttttgtccaagcaaatctctaaggaaattacataaaatatcctaattaaaagatataattgccttctcaggactctatatccatgcgtggcaatcctcatgaagcacatcaacccaacccgaccacgtacgccttgtcatattgtcggattcggcttagtcgattaaccctgtccaactcaaactctatcgatcctggtcgcagccgattcggactccagctgatctttactctgattccgggacgatctccatctcgaactccgtcccgattccttcttcatctccgatccttggattaccaaatttggtcgttaacaaatatatatatcttcattattggttataatatnctatgtacctatgtaagttcatcatcacttggtaatgttatttctctcttatctaattaagccatatcgatatcgcatcaattgattttagtgcttatgtaaatttatgttgtttagctatcttacacattatttttacttattgttatcatactgaagtctcgcacgaacacgtggagtttgacctggttactaaaatgattattaccagcctctcccatgttgatactacctaggcgtaaccgcctaagtaaaaaaaataatatacaaggtaaaaaatataaacactttagacggtgcccacagtttaaaaacattaccagccccgttgataaaaaagggatttgctataccacagcttgctggtccatttatccattgaacccattcacaagtatactccaatggatccaaaattctaaaggggctaaatggttcgaaccctagaaaactgagaacatactaatcgatccagactcctctcgttgctagacaccaaaaatcaatggcctataacaatctcaagatatcgtctccattaagcattctcacggactgcgagatccatcatgtatttataaacattcattttgatgaaatcatgattaatagggtttcctatttccgtgtgtacattgttttgttttcatcaaatacatggttttgatcttcagtatatttaacatcatttatattgtatgatcacagcctccgttatgtccttacgttagacgccactgacttttcggtatatgtttgcgtattcttcttgtaaaaaaatatatataaccattatttaatttttatgatttattttatgtaagtatagcttaaattttaaataaaccaatgttcaaacatacgcagaaaaaatcaccggcattaaaaaaaaagaaaaaactgaaggtaggacaaatttttttctaccgttgcaaacgcattggcgctaactggtagaagggaaaatcgctccaacagttcatctacaagcaccagaagtttgcggccagtacattttgagttcccacaagagaa

SEQ ID NO: 10789 - DNA, 448 bp, Oryza sativa
  unsure (1)..(448): unsure at all n locations
nnnnnnnnnnnnnnnnnnnnnnnnnnnnnnnnnnnnnnnnnnnnnnncaatgtatatgtgagagtgggcagcccaatctatcacccgtgaactatccaggttacattcattggacgagatctactccacaagtttacaatcggcgtataatttttaaactctgggtctgcaaaatctaaacgtgtgttcggtactttggtttggagatgaggtaagataggtaggcatattcttgttttctgaatgaaataattcctaccactgtttgccacgagagatgagacggtgtggcctatgggtccacagatttttaaggacatggctacacagctatggtagctgatttgtctaaactagctaccactccatctatgataaacactatccacctacacttcaaatacaattttctcttaaactactcattcgatttacaatccgattacac

SEQ ID NO: 10790 - DNA, 546 bp, Oryza sativa
gcagaaatcgtgacaaaaccctccatataaccacacctaaccagcacacccacctccggtttcaccccatccctataaggcgatgggcagtccctacttgtgcctaggtaaatccggaagcagcatagatcacctcccggtccatccatactccatcatgcctacccttgccattggtgtgctagctaaaaaagattatacttaagattcagcctggagcccatctgacttgtggttagtacgagtatatcttccagggattcccgagaaccggtccttaattgttatgggcacgaccaccaaataaatcatgcatgtacccacgacccaccaataaagcatatttaattaattaaccatatgccaagatggcataacatcatcataaaattaaggactatattatagtaaatcccattgtgagctagttgatctaagcatgtctaagcattcctaaaccaatcatctagtcaaattattatcccaggctatcaatgaatcagggtaaataaagactgagtacggtaaaatacatcccgcatgaca

SEQ ID NO: 10791 - DNA, 573 bp, Oryza sativa
  unsure (1)..(573): unsure at all n locations
ggcgaattcgagctcggtacccaccagcagttctagagttctagccctaagtcaggaaactaagcaggtataagcgatgagcaatggagacgattggacaagcaataagaaggaaggaaggaagctggacatacttggctgtgctgcccacccctgctctcctcccttgatgcgctcagggaaggcgtagttgacggtgaggacgcggccgaagagctcggcgccgtccatgttgtccatggcggcggcggcgtcctcccgctcgaggaaggtgacgaagccgaaggagcggtgcttctgcgtggcctggtcgagcggcgtcttgacgtccttgatctccccgaagggcacgaacgccgcgtgcaggatcttctcgtccacctcctccgccagcccacctgcggcaccacaaaaaccaagaaacgaggcacgggttcagctcagctcactaccacactgctactccgccggcggccaggaaaaaagataaccccgtgaaggaggaannnnnnnnnnnnnnnnnnnnnnnnnnnnnnnnnnnnnnnnnnnnnnnnnnnnnnnnnnnnnnnnnnn

SEQ ID NO: 10792 - DNA, 5371 bp, Oryza sativa
  unsure (1)..(5371): unsure at all n locations
tttaaaaaaaataaaaagaaaacaaagctttatagccttataggcagtgatccacttagcacatttcgcggaatggaggcgtcaaaagctattctagctaagcatgcagcctccggatccggatatttgcttcatcgtccttcatccctttcaaagcaaagaatattctaaacttaatttttttcagagtttcaattcaataaaataatattcagaatttcaaaaggacttatatatttttcataatttttgtacacttcaaattttactagaaatataagaaattctactagtatttgctaattaagtggcgttgtgcatgtgtgtaggtgaaggtgaaggtgtgcgtgatggaggcggccggccgggagcgcgcgccggcggtggtggaggctgcgaggcgccacggcgcgtcgctgctcgtgctgggccagcggcggcggcggcgggcggcggtcgcgcggtggctgcagctggcgctctggccggcggtggcggcggcggcggcgaatagcaagtactggcagcggaggggcgcgcggaggtcgacgacgacggtggagtactgcatcgagcacgcgccgtgcctggcgctgggcgtgcggcggcggagctccgacggctacctcgtctccagcaagcgccacaaggacttctggctcctcgcttaattaattaatttaatttaattaattactagtgctttgtactagctaattgctgcgtagactggtcaatttgattcacatgatgctggataaggaagatgttatttacgggtggtttcatatcctctatagtaatgggaccctgatatgcgaggtactagaaggtggaactcacatatcagtaactgtaatggcagtaatattatggtagaggatcctcgccttcacggtggggttaaagcgcactaaaagtcggggagtatgctgtaatgtataagtgattggcataccaaatatcagacggttaaactacaaaccaaaaatatgacacgataaaaccctgctcgttgttgcgagagttaactatgataacaacaagaaaaaaaaatgtgtaagatagtttaaacaatataaacttacataaacataagtttacataagttgatgtgatttaaattcaaatagtatgtatacataagttgatgtgatttaaattcaaatagtatgtagagtgatgatttaaatgtaaaagaaaaataatgtgtctttgtgatagaacacaagaaggaagataatttagaccatatgagggaagaaaaaaaaagataatttgaaccatggattaatcatctaaggactaaaaatattgatgtgatatgacttaacaagagaaaaaaaaatagcatgaactaagtgagaatgaactactcactccgtttcacaatgtaagtcattatagcatttcttacattcatattgacgttaatgaatatatatatatatatatgtgtagattcattaacgtcaatatgaatgtggaaaatgttagaatgatttacgttgtgaaacggaggaagtatataggtatataggatataaaaaaataatggagatatattgatatattatgtgaatttaacatgtttatatttaaatctctaaaatttaataaattattaaattatagataatatatcatgcttgcatgatacttaaatgtaataattactagaaaaaatatccgtgcgttcaactggtgaaggatattttaatcttattattattggtatactgtttaattaaagtgaaatttaatgtgggatgaattcgttatatatatatatatatatatatatatatatatatatatatatatatatatatatatatatatatattagaaaatcatgagttgcagttatgatcgtctcaaggtagcatgcgagttttttttaaagtgatttcttatacaactctttttgtattttcaaaagtgaacaaacttcaaaaccgattcaaatatggatatgtatttccaaaaccgaacggacttaaaatcgactcatacacagatgattaccaaagtatcggtaaaaacatctttaatttttataatagtaaagattagtggatgatgatgtgtcatctttataaatgtgactttatagtaagagatgattagtcatgtacctgttacgtagagtagcgtagttgaacgttctaaacatgaagttttacatatttgcatgggaaaaaatgataatcattattttcaaaatttacctggcaaagtttttggataataatcaaaagatattttttaatttttagaacttgattttaggattgatgggaaaggctcgaggctttgcaacctacctggtcttaggcttaatttcagcggtgtaggcatctcctggacttcgcacattgccggatttgctactaacttctatcaacatatgtaaaatttgatcaatcgctgtaagacgctaatagttgtatggaccttagatatgagtgatattgtgatctaagttaaaccatatagaatttgacacatgagagggttcaagcatatctcaccataacaagcggccggacagtgacacagaccaggcaaatgaatagaatagttcaaaatgataaatattatggggattaattgatacgattctattacaaccataccatacgatgccttaaaaactttcaactctattttatttttttaaatcaactcaattttgaattcttctaactcggattttgaagctttcagctcaaattttgaaactttcaactcaaaatttaaaacttttaacttagatttgaaaactttcaactcaaaatctaaaactttcaacttaagctatgaatactttcaactaataattttaaatttttaacttgattttcttatatattactccctccgtttcaggttataagacgttttaactttggttaaagtcaaactgtttcaaatttgaccaagtttatagacaaatatagtaatatttataatactaaattagtttcatcaaatcaatagttgcatatattttcataataaatttgtcttgggttgaaaatgttactatttttctctacaaacttagtcaaagttaaagtagtttgactttgaccaaagtcaaaacatcttataaccaaaaacggagggaatactttattacgaaaaatgattcaaaaccataattaatgttaaacgctattaacgctaagcgcgtaactaggcccgcgtgggcacgtgatgtgcgcaccaggtcgcctcctgctgcagacgcgctgtgtcagagggtgaattcctcaagtgggggatagtaaggcccccttgttagttcggctgggggcagcgggtgagaatcgaggactcggtggaaggtgtgatgtagagggggtcgggcccctcaagaacgatgagacaagagcggtctatacaggttcggaccgctgagaagcgtaacactctactcccaggggcgaagccaggatttatagctagggggtgtgggcagggtgaacaagtcataagtcaagggaatcctctacgccgataaaacaatacacaatgtattctgccataaaaaagcttgaatttagctttttagttgtatcattagatgtttgacagtttgagacttaagacaccatgctcaataacgagacgcaatgggaggacagagagacgtgtgaagccgaagcaatgatgacgaggagttgatttgcatcgtctctccgtctctttcttattaattgattttctataccatgtttattaataatggactaattaacatgctaatgcgctagttagtacaataagcatggggtcggataggggggtgttggcccccttcggcaccccttgtagctgtgcccctgcctactcacgtgcttggttgatcgagtatggaatacaacccttgaatctctgagacactagtgtgagttagccaaagaatctttctctttctctccctccctcacgaggcctggacctccttttatatctcaaggggctgccacatgggcccaaaagtctacctagggatgagggaggacattctctacattaaatgcatgtcttgtcgcttaacttggaagccataagcacgggcgccatggcatggggcccatcaaatcgcaccggctgacacgggggacgcctgcgtcatttaccatttaatagatgaagacttctgggtcctcatgcgcgccgggaaacggaaaccccgcgttgaccaggtcagacgaactgactccggctaggatgagagactaaaaaacctttgatcatcatgacattacggggcatgttaggtggcacgccgcctgacatgtgaccagtgcgcaggcgcactatctcggtactattggtcactcgactggtcatagaccagtcaggcgcatagcacgtcgcattaagtgcggcatggcgcgcccgctcaggtcgccttaaatgcggttaggtaggcgttgggaccgcccacctaactccgtacacgtggtgtcctgcagagggggtcggggcccgacccctaggcatggagggggcggccactgctctaccccgggcccgacccccctcgagggagttgttgatgcgaaaaacacacactggcctggaagatctgcttaacttcagtgcaggtccaaaatcttacttttaggttcgtgagcatgccggttgatttgatcctgcaatcaacaagaaacaaagacaagaaaaaccatggttaaatctataaacgatagctgatcggccagccgccgatgacatatcatttattttcaagccgatgtcatatgtgaatcgatcagtagttgtaaacaagcaagatatgactaaatctgctcgatcggctgtagatattaacgatatacaatccttctatcgatgtatatttaaaccaagtgattgggatagatcagtcatcatgccgagacagtataaatcacttagatcaaaatatacattaacatgaggactataaatgtttatagcatagccgatcagatagatctagcatgtatcggctaatactccgataccactttatattaagatattaaaacatatataatatatcaaacaggagcctaatatactttattgcgaataagatcttaatataaagggcagatctagcatatcaattaagcatataagatatagaatagctaaatcaggtaagatcggctgaaaccccgatactatctctctcgacaatcataaaacaagccagatatcataataataaatattacttaatagatcgaactcaaccgatgcagcattaagcataaaaataagtacaagatctaggcaagatgatgaaaatannnnnnnnnnnnnnnnnnnnnnnnnnnnnnnnnnnnnnnnnnnnnnnnnnnnnnnn

SEQ ID NO: 10793 - DNA, 10730 bp, Oryza sativa
  unsure (1)..(10730): unsure at all n locations
atatgactaaatctgctcgatcggctgtagatattaacgatatacaatccttctatcgatgtatatttaaaccaagtgattgggatagatcagtcatcatgccgagacagtataaatcacttagatcaaaatatacattaacatgaggactataaatgtttatagcatagccgatcagatagatctagcatgtatcggctaatactccgataccactttatattaagatattaaaacatatataatatatcaaacaggagcctaatatactttattgcgaataagatcttaatataaagggcagatctagcatatcaattaagcatataagatatagaatagctaaatcaggtaagatcggctgaaaccccgatactatctctctcgacaatcataaaacaagccagatatcataataataaatattacttaatagatcgaactcaaccgatgcagcattaagcataaaaataagtacaagatctaggcaagatgatgaaaacctataagagatggtggatacaccatataaattggattagtaacgtaacataaccctatcgatcacttcccaacaataaggaacagccgataacaagttataaagcgcaaccaatctagattacagcgtgtatatgataactcgatggattacatgaacatgattaaagtgtcataaagatggaagcattaaccccgagaatgcaagccgccataacaaactttacctctagttgaagatcgaatcgatgcagctcaacccgaaagcaagaactcgtcgaaataaaacgaaagtaaaaagggtggtgatgcgccgagattgtattgaactgttgttttgattacatggtttcgggctctatttatacccgagatacaacatatatccttgccggacacgacacttatctctaacaaactttaagataccataagtctttgcggcatatttttgcccaaacatatctctatggaatttacatgaaatatcctaattaatagatataattgcctatctgagagctttatctccatcgtggcaatccctgtgaagcactttgatcgattccagaaacagccttgaaaccatcttcatcggaatcggctgtatcacctctatcggctgtgttggctgtcctctatccaatccatctcagccgatgcaaactccagtcgatgccttcgcagccgatgcatactctattcttcgaatcgatctctttgtcgaatccgccttaatcccaatgtcgaacctgattcacaatttaccaaatttggtagtcaacaggagtgccacgtgagtaccgggtttagcctcttccctctagccttgatatcctcaggcccatatcaccgacacgctgattaggagcccctagaaagtctcacaaaaccgcactattgattattttaagtttgatctatcacaattttaaattctaccatcacatcttaaatttataatcttttatccatcatataaatattacatgcatgaaattaaagctttttaaaagtttgatatacgactatgtaaaattggttaacgttgtggttttctgaaactttcggaccataatacctgaggttatttttcacgtgtcaaaattactatggtttttgtgcaacttgaatggggttttatgaaattttacttttaaaaattaaaaataagatccatggatcaattagaaaccaggaaatgatcaaatgataagtggcaatcccagctgcagcagtcaatgggctaaacgcttttgggcctccaaatccaaacgggcctaataggcccattagccgacagcccatcaacaacagcaaaattagggaggcagcggctggagcaaacctccactaaaaccctagcctccccgctgctcctctcctccccccgtcccccggcaatggcgaagacgaagcccatggcggctgccgccgccgccgccgcggcggacaagaagaaggggaagggcaagaagaataagcaggggaagaacggcccggctgcggtcgcgatgaaggcccgcggcgcctcggcggcggcggcggcggcggcggcgtcggggagcaacaaccccttcgaggccatctggtcccgccgcaagttcgacgtgctgggcaagaagcgcaagggggaggagcgccgcatcggccgcgcccgctctgaggccatccacaaggtaaacagtcaatcaatcgatcaatcaatcagctagtggaaggggcgggatttgggatgggtgaatcgatcggctgatgattttggtttttggcgatgtgcagagggagaacactctgctcaaggagttcgagcagagcgccaagtcgtccgtgttccaggaccggcggatcggggagagggacgagacgctgcccgagttcgacaaagttatcctccgccagcagcgtgagcacatggtacgcgtctgcgctgtggattcatggttggagattttctttttgagagagaatgcatgttttgcgtagaacagtcaacacctgtagcatttctctggtcaggacagatgaataaacttgatggattgtagttactagtaaaaatgaagtaaccttagagctttttcaatgaggaaaaattaatttgttctccgcttacaattgttcctagtgatattcgccttgtaatgtaaccacattgttcttatctctggttagtaactttaggatgatatcgttataagtgttttcttgtattactatagtttgttgagttcccttttgtaattctatctaggcaaagctgaaacgagaaagcaaatacaatctatctgatgatgaggaagatgaggttgatgttcacctgcctcactctctctcgggaaaagatgattttgatgaagaagtgcctcttgatgattatagtgatgaagaaggtttgttccatactctgtcttagtgtcttagcttggcatataatcatcttattttcttcttggattcctgtgaatcttccttttctgacattcatatggaaattttggtttcttgaagctagcgttctgttttctgcctcaaatgatgaatgtattaaatatttgttgtgttgttcctgaaaagaaacagtgtgcttgtttggtttggagccaattttgccctaccaaattttgtagtatagaatttgagcttgtgtgggcaaaaaatggtagcaaaccgaacattcatttcatactattgaagttgtcaaaatttcagtagggcaaaaataggcttcaacccaaactagcccagtaactattgatggcctgcaaaatcctgtctgttgatcatttgtgcaattgaggacgtaaccctttttaggctcagttttagttgatactggcaggtagcgatttttcccccttacgtgtagaatgtaggtatgtgtatttttaatggttcattatctataaaaagtgagtcctttttcttgcatatactacatattataataaataaatggcttacctgtaataggctcataaacatgcactaattttagttttcttttcatcattttatttgttaacttcaccattggagaaattaagatgacattattacatgaaattgttttcttgcatcatagtagtctccaaaatgaagtagagtccctatccacatgaatcaacatttatgattagattttgttcagcgtgcttaatcctctgtaattttcaggtcacatgatcctctcgaagaaccgcatacctctccaaagtggtgatgttccttcagaaattggtcttcctgaaggaactaatgtaagttttgataggatggtattaggatccaaatttaatcagtccgtctcctgtgacctcaatttaattacacttgttggcaggttcacaagagcaagaaggaagttatgtcagagatcattttaaagagcaaattttacaaggtacagcatcttctgtgattagatgccatatgtgttactttggtacccgtccttttgttcttgtgtgatcatttaggaccttattttgttttaatattaagtagatcgatcgaactgtcattctgctgtttttctggtatatgttgaactatgaaactttacaaaaaaaataatctgaattcagtccaggggctaatatgatttaatccatcatactacttacagtttttttgcttagcccttgctttttgcgaaccattctcggagataggccagtgaaacctggctttaaccttctatccctgtattcgtcgcaagcaatgataaagtattcttgaatgtttccagtaatactctgttggtcttatagtattttgggaatatgcactatatcctgttactttttggacgtgctcattattagatctacattgctaaaatcaaacaagctgaaatacttgaggaaaccccattaaaacacaatcgtttttagcaagtgaggaggctcgcctatggaatttggttggggccaaggggctatctttgatatggaccctgcttatgtaggcgtgtgcgttatgatgttgtaagagccttgttgggcgctttggcttttgtttctttcagcatgtatctgtgtcatggatgcatcttttcctcctattaatgcaaagatacacagttctcatgcgtattcgagaaaaaaagatctaagttgctgtacatgactaacatacgctatacttgcagtatttttgtctcatgtttccggaatgttattagttgtgtgtgacatgaagaggatgaagctgtttcttaaaacacaaaatttcttccttgtgcaggcccaaaaggccaaggagagggaagaggatgaacatcttgtagacaagttggatagtgactttgcaatgttagcccagacacaggcgatgttgtccttgactcgatcagctagaatggatgcaaataaatataattcaagtacagtccagaaagattcatttggtttgactgccaaggagatttttaataaggtatgttcttagtgctacgcttcttgcttctacataagttgttaataatcacactgttattcattcaacacatgttctattagaagaatgggtttgcacccggtcacttggatgcaacagttggttaaaatggttttgcatgcatgtccatgagatggacaaatgattaaaatggtttatgttaatggttaatattgttagctgttaatatactttttaaatgtttcgttcaccttaaggacctggatatggtactatgacattatgaagtcatttttctttggataaattcattttgtacctatagattacaggcatttgtctttgctccgtttttgtgtcaacagactttcattgttggctgtggggaaattcacattgatgtattttttattgacgttatgatggtaaagtctgatcagtatttgttgccaggaaaaaccagatgcatatgataaattagtgaaagaaatggttatggatcaacgtgctcgtccatcagacaggacaaaaacaccagaagaaatagctcaggaggaaaaagaacgtcttgagaagttggaggtttgtttcatattatttcagggttgaatgcagttattgtattcttgtttatttaaaatgtcccagtgccacaaattctcctggtggatgcaattgtcttacctaaaacttcttacatcaactttgtcattggatgccatatattctttaacaatttatttatgcaaacactggtgcaccatttgttttgtgatttaatcaagcatctaattaaattttatacatgcaattctatcacatcatggttgtcttttcgtatgaaatactgatattgaatctctctgatgctggttggtcttctagaaagagcgtcagaaacgaatgcttggaactgctgagtcctctgatgaagatgatgatgatgacgaggagggtgaccgcagcacgaagctagacagctcaaaacctatatctggtgatgatcttggtgattccttttctactgatgagccagcaagaaaggaaaagggctgggtcgatgaaatttatgaaagagagggtaaaaagattggtgaagatgctgaagggtcagacaatgaagaatctgatgatgatggtgatgacgatgatgatgatgctgaggatggtgatgatgatgctgaggatgaagatgaagaagaggatttaagtgataatgactttggtaatatgtctgctagagactgggagcaaagtgacgatgatgaggttaccgtggaagaagatgaaatggaaggtctcaaacaaaaggaacagaagatcagtggcaaagtggtgaaaaaagatctacaaaattcaaagaaagagtctaatgcagaatcgcaagtcaaggatgacaatcttccttttgtgatagaagcaccaagtaacttgaaagatctatgctccttgctagatggttggtcagaaactgaaataattgagattattagtcgaattcgtacatgcaattcaataaggcttgcagctgaaaatagaaagaagatgcaagtatgtaacttttttttttactgagatcaatatcgtatttatagttctacaaatatttactgatttttttcttaaatatcttacaattcacacggcatttattaaatgtatcctcaagtattgtgatctcttttggcaggttttctatggtgttctcctgcagtactttgcagtattagctactcagagtccagtgagattcaaactaattgacacccttgttaagcctttaattgagatgagtggggagactccatattttgctgccatctgtgcgaggcagcgacttatccacacacgtactcgtctatgtgaagatataaaggtttcaggtctgtgagctgagaacttggacttggtaggaaattggttttattatcaataaactgtgtgatttactgtgattgcttttgaatatatcttataggaaagagctgctggccaagtttgaaaacattacttcttctgcggttatggtctcttatatttccctgctctgacttccgccatgtggtagcaactccaatgcttttgcttatgtgtgaatatttgatgcgatgccccatacaatctggtcgagatgtagccgttggttctttcttgtgttccatggtgcttgtggtatgttctgtaactctaaatcttgttccattaagttcttatatgaatgatgaagaactattagctgaatttcttactcgacatgaatttccttttttctcttcttccagttctgcataataataactctgattgcaggctactaaagagtctaagaaattctgccctgaagctgtcgtttttctgcaatctcttttggtaacatctctgggaggaaacctgggatctgacctacgaaaaaaggtattttttagtttcaggcattgaactttttttttctttttttgctcactgcttgatatcaagcgaccctttgtatagatcaatgatcaatttttggagctcaagacaatggaaccatggcttcatatccatgaaaaagtgcacgaggtgaatccagcgaatatcctggaagtcatatgcatggattctgatgctccttatttctcctctgataatttcaagtgaggatgtgttttctctggcattttgaatattattggtttacttaacacataatcttacactcgtacattttctaacagggctagtgtacttctatctgtggctgaatgtttaaggggatttgttattatacacgaagaactatgttcgttccccgaaattttcctgccaatctcttctttgatgcaagaaattatggataaatcagacttgcctggattgttacaatacattttacatgaagtcattgagttgattaaaaacagaagtgatgaagtccatgcatcaaggcagccactccaaatgcgaaagcagaagcctgaaccaatcaggcagttgaatccgaaatttgaagagaagtatgcattttttggtgttctattctgtgttaacagcatgttgtattcttcttgaagggttttctgttgttcattctttattgactccatttcttctctttctgcagttacattaaaggccttgattatgaccctgatcgggaaagggcacaaatgaagaaaatgaagaaacgccttaagagtgagaagaagggtgcaatgcgcgaactgcgtaaagataattatttcctgtctgctgtgaaagagaaggagaggataaaacaagagcaagagagagctgaaaagtatggaaaagccatggctttccttcaggagcaggaacatgcttttaaatctggacagctagggaagggcagaaaaaggaggcggtaacattttctccatatttagtgtgtgtaaatatattgattatattccccatgctgttcagttcaccatctttcttgggtactggagatttagacacagcgaatggcctttgcatgctccattttaactgcctgttgtaacttctagcttgtggacacaccgaaatacaaaagtagatggtcagaactcccttgttagcaatatggagacggagcgtcacttgcatgaaagctacttggaagaatgtttttgcaatctccccaacaaagcaccaacatggcaatggtttttttatttctcttgtatcgggaaatggattgctctactgtgttatactcctgcaatagcaattttgatgtatcacagccaagagtttttgatgtgttccctttcctttttgcactcgtcagatgtactggaatgtaaaccaatgaaatccttaatgtaacattacttccattttatagccattccttgccatgttgttcactgtttctgaaatatttgctcatattgcaaggaaagcattgtgttcaccagcattacatctaactctattgctgttggtgatgatggtgttctgcatcagaagataaattaggctggtgctttagatctgcccaaatgctgacctgctttgaattgggaattgggatggcttccatgtggagagcaacatcaccatcagcacctgcctagatcttgatgcttacatctgcctaattgcttatcaatcagagaggccacttgtgttgtgaccatccactttgcccattattcagacagtcccactcaattcatggagaagcttaggcgcatgcgcctaatggagccgcatgcatgcatacacgcacttgcattttttctgtgtgcaaagcatgaacaaaagctgctttactgtttgctaatgtgatcatgtcctgcttctgaaggctctagttctgacctaagcctgcattatttgcttttttttatcagtgcttgctgctgcctttttcatgacttgctctctagattagatgtcaccaatcatagcagcaatatgtgcatccaatcaatcatcaccagagccaaaaaagcatcactaagtgatgggcaaagtcatagagatccctaaaggtaagagacattccaaactaactctcatgctgcctatttcttgattcccatttcagctgctcttttttttagccgctcagcggagacgtcagcgccatgtcatcaaccgaggaatcatgttgacgaataacagctaatgtgattgatgacagtgttgcaggttagtcaaggaagttgatttgcttttgatgcatcattatcagaatcaggctaatgtgatattgctttgatgcaatatgtctttgtcagcaaagcttcaggtaagaagataatagcatgcttttgtccactgacttgcatctgcttgccccaccacagaatttgaagccattgctgtcatgaagattccagcttcaggtgagaggtgagctacaataatttgaaagcaatggccaaaattgctgcttttaaaatgaattttctaaggagcaatatttttttgttaatctaacatatttcttataaaacaatatcttccacagttatatttacatgatttatctacatatgtacaatgtggacatggcgaattcgagtatatttacaaatgatgatgatctataaacaacccctacactactattccattcctgcgccactccactggtaagtcttgaacagaatgaaggccctctctgtaacttcctgaattcttgggcctcttcgtcagctaagaattttcagtgcggttttcgggatcggctcatgagatcagcgcatgaacatcccgaaactgtagagagatctcggtcgaaacaggttggcgaagaggaaccatgtgggtgactctttcttctgtggctctgatggctcaggctggcctttcacctgaatgttctggcctatggcttgcctgatggagtctattgtcttctgatcaaccgtccctcctgtggaatcgcgaacatagaatgtgttgacagccatccttcctctcgtgctcacctccgctcttgtgacagtcaggctgttctcgcggaagattcgggtgacctctgacaggaggccgaccttgtcatttgtgcagagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10794 - DNA, 661 bp, Oryza sativa
ccatgagatggacaaatgattaaaatggtttatgttaatggttaatattgttagctgttaatatactttttaaatgtttcgttcaccttaaggacctggatatggtactatgacattatgaagtcatttttctttggataaattcattttgtacctatagattacaggcatttgtctttgctccgtttttgtgtcaacagactttcattgttggctgtggggaaattcacattgatgtattttttattgacgttatgatggtaaagtctgatcagtatttgttgccaggaaaaaccagatgcatatgataaattagtgaaagaaatggttatggatcaacgtgctcgtccatcagacaggacaaaaacaccagaagaaatagctcaggaggaaaaagaacgtcttgagaagttggaggtttgtttcatattatttcagggttgaatgcagttattgtattcttgtttatttaaaatgtcccagtgccacaaattctcctggtggatgcaattgtcttacctaaaacttcttacatcaactttgtcattggatgccatatattctttaacaatttatttatgcaaacactggtgcaccatttgttttgtgatttaatcaagcatctaattaaattttatacatgcaattctatcacatcatg

SEQ ID NO: 10795 - DNA, 522 bp, Oryza sativa
tgtggccaaaagtaatgtgatcctttagggtatgtcttatactacacttaccaacttcttctccctcgttttccaagcacatacaatgtttttggcaaactgctaaaccatgcgttaaagtacttaattaataatgcactaataagccaccccgttttccatgcacggggaagaggttcttaaacccttctcccgaacacaccattacttgtcataattcaagcaaaggcataaaaaaaatatttcaaaatcacttgtcatgtcaaagcatggccattttttagaccacaatcgtagaagtgatcaaaaagctcattctaaggtgactactggttctcattgaactcatgcctgcagtttgcgcacttatagaaaacagtttgcccctcatctgctgaccgtaactgcaattacacatttttcataaagtagttaagcatcaaagctagaaaaaggaaaattaagcttattgaacatcaaatgttcaaggatcgatagctgacctgcttggtgtaatactga

SEQ ID NO: 10796 - DNA, 20047 bp, Oryza sativa
  unsure (1)..(20047): unsure at all n locations
catctccagtgaaaaattttagtcttaataggtaccaaaaaaaaaaaattgagccccactacggttactctctacagttagtagaaaataatctgaactattaatctcatttgatcgaagggtttagatctatttgtactacaaccctaattagcggtagtaaaaatatggagggacattattataaaaaaaagacgcggagaggtatataatcgtcatttagcagtgattaaatctttttcctttatttttttgtttttttgatggaatatgaataatactagcgtaatggatggccacatatcgatcttgccgggaaaaaaataaataataaagttatccctaattactatattatgtactagcgtaatagacaaccacatatcgatctagccggaaaaaaaataaatgataaagttatctctaattattatattatggtatctcttcaaagatggtaaaataactcaatttatagtactctgcttctgctcctcctttgcttaactccggcgacgtttttcttgcttcgtttcatccagggcgtagcgaaccgcggcgcgtcggtgcgtgtcggccgggacaccgagaaggacggcaaaggtaaaggaggcgtcgccattgatcgatgggagaaatttctcctgctatttttgatgttcgcgtgttgattttcggttttggtttggtttgtttcgtcaggttacttcgaggacaggaggccggcgtccaacatggacccgtacctggtgaccgccatgatcgccgagaccaccatcctctgggagcccagccacggccacggccacggccaatccaacggcaagtgaggaggagtcgccnnnnnnnnnnnnnnnnnnnnnnnnnnnnnnnnnnnnnnnnnnntggaaatctgtgtgtgtgtgttctctgacgctggtgctgttagaaacttccaataattcagaaataactgcgatgtgctctcaaatttctcatgaggccatcacctgcagcatctcatgaaatagatctattgcaatgacaataccaatggcaacgcaaaattttatggtacctccagataccatctactctcctcaataatgacaataaaattgtttctctgggttaatcaaacatcgaaaaatgataatgagagagtacagattagaaggtgtgagcgcatacctcaggatctagagttctaattctgattggacctgtggtagagcggacttattgtgattagggtaaccctagtaccctactgtgtggtgggttaggctaccttggacaccccaaaacgacaccacttcagatgtcttcaaacaccatctttactacacttcttacattttcgacattggagagaaacaatttcttgatttttttgtcacttttattgatgtgagccgccaactcaatacatagaggagaaggctaagggcgccagtttggcttgtccaaatgtggcgtcgaccatcccgtaaggcgatggagacggctagaacgggagtggcaaggttcagatccagacgctgagggaaagatggctaggaagctctgatagtggtacggtggcgagcagaaggatgtcaatggtggcttccaccatggtggagcaggagggtaaagttgagaggaaaccctcacaatggttccgataaattgtgtcacttctagggacataactacattatcaagatagggggtgccaagaacttggtcaagaaaattttttagctagagttcatctatttttaccatttatgcaaccttaaattcaaacttagtcaccattatcaacttaaattcagtcaaaaacatagtaaagtaagtgagtggcattcatctttatttcgttctagctccatccctggccactttcataggattttttttaagacgtacataaacttgacttgaagctcacggtagacctagtcaaccagcttgtacttttatgggatgcaacccagaggatcaacctgagcacaacaaacctgaaccaaatcatttggatagagatgcccatagatttgcaaattgtcacttccacatgaactcgaggtagataataccaagccaattaattgttaaatagacttacaagagggcccaaaaaaacaggttaaagaaccgaaaaaaacaagctaacaattgaaacgtatactacggctaatcagtgggcatgatcccatcccgatcttcgcatctggagcttcgatgagattaaccacatcgatatctcctttctcttctaccttgcacacctcgaaacacttcttatgtgcgtaagggacgtaaacactgtccttttccaacccacattcatcagccgcacgtgaagcgccgaagtaggccggagctagcaagaacgcgcggccaccaatgtcgtccacttcatgccactgctgctcggagaaatccattttgtagacgatgaggtcgtagacggtctcgaagtcccggtccagcaacaggcgcaccatgtacaggtcatcctcggcctcgacgaggaaccccagcgcggcacccagcacgccgtacccaccggggagggggtcggcgatcgcgatggagccgaacaccggcgttgtcggcgtcggggtgaattccagcacgccgacgctctcgggcgtggcgttgaagtagaacttgccccggcaagcggcgatcgagcgtatcggcaccttctcgcgctggccctccttgcccgggcggatgtcccactgcgtgccgacgtcgtactcgtgcctcacccacccctcaccctcgccgccgccgccgccgccgccaaaacggcaataccagagtacagtgacatcttcttcagtctcgacgaggagcacgatgcagctttcgctgccgttaggcttgccggagagccggcaggagcaggtgctcggcaattcacggggaagatgaggcagggagatcttgccgtcgggatcctgggggttctgcaggaacgtggaggcgtccgaggccgagcggactaggatccacccctgcggcgtcacccaggcgttgccgttcgtcaggccggggatgtcgacgccgccattgttgtcgatggccgttgcgtccgagatgctgaacagcactggcttgtccgagtcagcgccgtgcttcagggccaggcatggcacgggggcgacgcgcggctcgtccatgcgatctgatctcccaatttccaatgtaacaccccctgttctctatggttaaatagacaaccacatacccaagaaatccgagtcgaagtgggatttcggtcggagtacaaccagatttcgtgtcggtcacggagatccctaagctgcgtcaactgcgacctaatcgtataatctgcctgtgactggggtctggattgtttgtaatcatggatggtcaagaatggcatcccatgagaatgagagatcataactagaaacggcattacagataagcaaaaaaaacatcgatatatcgcttatataaagtaccctcttcagtttcagaactgacaacattatcgccgcacactttaccggacctgcagcagaaacgcagtattggcaagaaaacgagaacagttgatacatacacgtttattcggggagagatgtaaaaaggctatcaaacaggaggccataaagaaagttcatgggtagcctcaaaagcattctagaatggctcttgaaaagtttatgtgatgacggtgggagcagatcggccagtgtactcttgcatctttgacagcttcagtgcaacatcaacctggataaagcagatggtcagatttgctgaattaaagtctgaagaaaaaggtccgcaaacttgctcggaaaacggtccaaaaggcaaagccaatatacagcgcggatgtcttaccagaggagcaagggcatcctgcgaatccctgccggtcttggaagaatccttctcatactgctcgatgtagacacggatagtagcaccaacagagccagttccagagaggcggaacacctagaatttgaggaactaatggtcagttcaccagtatttgttgcactcacactctgcgataaacacccgaatttgcaatgccaaattgtgctacttcatttgctttggttcaagaaacaaaatgaaggatattataaggtcaacaaacaataacagaatgggaccataccagccgggaaccatctccgaagaggtaccggacaccctgatgcttggagacagaaccatcaacaggatccttatactcaaactcatctgcggcaaccacatcagaaacatctgaccgaatctccttgatcaatctgaggatataaggtacagtttagagctagtactgaatgaaaatattttagctaactggaaaaccactaggcagtagcgaccataaaataacattaatgaaatactacagagctgtgcaaagtggcaaagaacaaaacacaacaatcagatgtatgcaaaattattcattcatttaaaatgaaatagactgatttctatagcagctggcgaagtattgatcgctccctaaatcatgggttagtgaacaatgtacgtacttgttaacatcagaaagggacgactgcatgctgacaaggtttgccataagttctttagcagctccagcatcaacattcttcaggaagaaaaaaatggcatggttagcatgttgccaaatgtatatacatacacataaatgtacattgaatatttgtgtaaagtacctcatagtcatatcgtgtataataatggcgaccataagtaccccagtgctggcgaacaatatcttcaacagtaacaagcttatcgcctccaaggttgtccttgttcttgaaagcaagaatagataaccatgctagaacagcccaaataccatctttctcacgaatgtgatcagaacctaaacaacatagtaggtataagcatcctggtgagctagtcatatcctgactgcagtgtgactcattatttaaatgtgatccacttgattttcattgatgcatgatattttacccaaaataagaacattccgttgcgtatggaaacaataaaaggccattgccctattcctttagctaagccaagtttgtggaatatcctaaattctcaataattagaggtgccacatatcaaaatgcatgaagttacatgcattttattcactgctatatgtcattgtgttccatagatcaagttcatagtaattaccagtgccaaagctttcttcaccacaaattgagcacattccagcatccatcaagttcccaaaaaatttccacccagtaggcacctgaaatatggttttcatatgatatgcttgtccggcattttgaaaatcatgtgactgacggtcctaatacttacctcaaagaacttgagattcaaattcttagcgacaacatcaagggcagctgatgtgggcatgctcctgcaattttatcaatagatcaacataaggtagcacagcggtattttacatcctttcattaaaagttctgacttagaagtttactgcaaatatggtcagttaacacctttgatggatgagaattacattattcttgcatattgacataatatcagaaagcaagtgaattgaaacatcaatgccacgatcaaaagaaacgtccagtttctgttcagattcttggatcctagaccagtgacagctataagcagcagacagccgccgatataggtatgtcagatgtcagtcatcttcatccagggttccatctaacagttattgtttgataaaagattcaagaatggatggtaggcagtatggggtctttttttttcatctgtttgttttatttgtgctgttttatcaatcctggatcctttgcttcttcttttttgtagtacaaattctagcaaacactagctacggagtccagtaccgaagaggctagatatcagagcactaacattccaggattttcagcaataaacataaccagtcaatccccatcgggaaattgatcttttctaatatcctaatattagcattgtatgatgaacactgaatttcatgcttgtttggatgcacattcagaatgaaagatgcgatttaccacagtgaatgcagtatgcaacttaaaagcccccattaaaaaaaattgtaaaccagaaaagtgcaggggttatctgcagcttaatatgcaggattacattgtacctggcaactcccttaaggccagaagaaaagtaaggaatcgactgaacagcattggctgcaataatggcaaccgaatctgaaggtgttacgaagaatctagaaggcaaaggacacatcataaatttctcatagcacttatgagtatatacaaaaacttcaagctatctaggctgaagaataccttttacccagaatcatgttgcgatcagcatcaccatcagctgcagcaccaaattctgggggttcagcatttgaggattttccaaggcccatccggtcaacaagttcttttgcataggtgaggttaggatctggatggccccctccaaagtcttcctgtaaaaatacaagtaaagaatgaacaccaatctaaattctattttcaaattgtgatgatagaagaaaacaaattaccttcggaacacagttcaacaatgagctttcagcagcaccaagctcttccacaaagatgcgtgttgcgtaagtcccagcaacaccatggagagcatcataactaaaagtgcaaaccaaaggttcagatgtgcaacaggcagttaatatgaggagagggtgagcatagttcaggataaaagcgagtaccagaatgtaaacttcggagatgccagaagctttttaattgactcaaagtcaaagattgtcctggaattaaatacaaattacaaattaaatcacccatttttcgcaggttcttatgaagctacaaggaaaattcacttattgaaaagaaaacatcgaacaatacatatggaaatagcattcagtaaattcaaatggaagcaacttacttcattaactttatgtaatctatagtagagtcaaaaacatcaacatcaaaagggccttcaggtccactgaaggtagtgacacctacaacagaaatatcgacctgcgatgtgggcaagaataaaggagtgaaacatatatttcaataccctgggagcaaaacaaacaacaaaaactaacaagtcagcgtcaactcttacatctggaaggtcttccgcgatgagatattcagtaattgtcgttgtattagagaagatcttatcagtaaccgattcaggggcaggtccaccattttccatgttatatttgattccgaagtcctgccaagatcaaatgaaaagttgctgataaacacagaaaatcgtgccacttgattagcagcagagatacatcataactgtgatacctcagtaggaccaccagggttgtgactagctgttaaaatgaaggcaccagtagcctttgatccctattttttgatgatttgataaagcaccagtaaggtaatttgttaacacagagaaaataagcagtgagtactaacagtcacactgcaaaaagttaatctttgtaaaataaatcttacatctgcaccaactctttcacggataacagcagatacagctggagtagacatgaggctgttttgtccaacccaaacacgtcttactccattagcggcagccatttttgtaatgatctataccaagcaaaataaatgtcaaatctccaaccacaattcaaagttccaactttcaagagcaatctacaactgagatagattacaaccactaataaataaactacatagttaagaagcactatgcataggcactgcacgatacaaaattgtgtactaggtattatgatcaattttatgatgtcgcatttttgttttggtgtgacttctggtaaacaattgaaaccatttaacttgacacaacatagaaaaatgaacaatatttgacctcaataaacacaatactattactatggtacgtctgcactcaacaatcaacatgtgtcacatgatgtggaggcatgtataactaagcaagacgagtctaatcatgcgtgggttccatcacatagctcgataaatgttgaagtatgtggctatacaaatatttaaagggaaatccgtagaagcaactgcaaatatataacaaaattgacaataaggatcacaaaattgcacaagaaccatgaggcctaatcaatcataaattacctgaacagcatccttcgagaaatagcggccatcaccagacacaacaatggttgcacctgtaagaaaagaaatgatagaaagatatgaaaaatgacaatgaaatatcagaaaatactttaattacggaaagtggtaatagcatttctaacttacaggggatatgcagaaaatggtatgcataaaaccagctccatgataatttatcaaatcagtatggtatctctaaaactagttaactacattattttctttcttaccagatggttaaagttaccacctggaaatggattagggatagcaaattcagtcatatatgtttccagttttcctaaccatattcaaaatatgtacttcaaaacgaaattaaatatttgattatttttcaagaataaagaagggctcagatagattattgaagcaggacaggtgttcatctgataagtagctaaccttttactttgtcggcaggaagggcattaaatgtggattgcacaaagttctggaggtaatgaggctgctggaatacagtaacctggtaacagttacagtagcacagatcaggttgtgagcaatgtgccatacacaacatttcaagcgcaggagttaggcagtttgtgacgttagcttgaaccctaaaaataacaccaactggccaccagatcccatttaataaacttgctcatcaatttctgcactcgtagcagcatgtattaacaacaattttttagcaacggtgagtaagaaccaaattctcctttttcatcctattttaaaatgcacacgaatacaagcttgatccacattttggcctggatccagactcatcagaatagactgggcactgatacatgcaacatgctactaattgggcagcaggcatgcccaatcaaaagcagcgaaacattctagaatcttatggacattcctcacgatgactaacaagctaacaactaacaaatccagagcagcaacaagccggattgagatcctaagccagagggcacacagtcactatctaccttcggtatctgctcgggctcaaatcgctaacaatgagtaaaaataaaaaaaaactactcggcaagatcccgatacaattagccaaagctaatcaatgagagcgaaaaaaaaatctcctgaatcaaatcccacgaacgcatacaattcagatcaatcgaatccggcatcgatccaacgctccagacgagactaactgatccgactggtcgcgggacaaacaaaatcaaccaccgcaacgaggaaccgcacattccagactcgagacggcgagcatcggagtcagtatcagatcccagcccacgccaccattcaggcgagagccgaaaaggcccccgcgccgcgagcaaaccgccgacgagatccgcggcgggaacccggagatcgggacaacctttacccatccaccacgcgtcgcgcctagatccagatcggggccctagtgacgggaaaccggagacaatcggatgaggaggaagaggtggtggtgggatgggaaaccttcttgcggaggccggaggtgccgggcttctggccgtcgaagggcgtggtggccttcttcgtcaccgagaacagcaccatggctgctgttggctcacgccgccgccgccgccgcgcgaggaggaggagtcggtggttgtgagatcgggagcggagtagatgcagcagaagggagtggtggtgcgggggcgagaccaacgagggcgtgtggcggtttatagctggtgcgggagaggatcattccgttgtgccgttttgtttttttatcccttttcttttccgccgcttatatttttggggcggtttttaaagtgtttttttctttcttcagcttattatttctcttatgattatacttaggctacatatttttagcatatgcaaaacgagaaaaatcattagcatatgattaattaaatatttaataattataaacttgaaaaatatatttaattgattttctcttaaaaaagatttaattattttttaaacagtttctgtatagaatttttttttaaaatatgtatcatttaacagcttaaaaacgcactaatggaaaacaggaatattgaagtttgaagttgaagaagagaactagatcttatatgttagaatttgaattttaaaacttaactttatgatattttttaacattttttatttattagcattattttaaatggacacgtatatataaattttgtattaagtcatgcaaacgtaagtgaaacgatgggcttttttttttcttttcctttaccgtggacgtaaagaaatagagaatgccgtggaaaaaactgtgctggtggctggtgccatctgtaccgtttctggcttttaagaggccgtatgttggtgttttccatcgtatccgtgggcagcatatgcactttttgcaatgatttttcagctgattttgtcgattgctaggttttggcagtgattttacttttcataattttgtccgaaaatactggtgtacagccttttcaaaatggtgctcacattttatacatgcatgtcactggggcacgtgcacactttctcatgttattttttgcgcttatttgttgctacctctgtttcaggttataagactttctaagcattgttcacatttatataggtgttaatgaatttagagatataattgtgtatagatttatatatcgttaagttgtcatgttacaacctactcttttttttcatttgtgtggcatgattagcttggaaaatactcctatttcacaattctatggttaccagtttgcaactatatggtggataccgatttacatatagttgatgttctagatgacataagacctaacagtagttaataagaaaaattatggtttacagttgaagttagatacctataaagaaacagtaacattcttccctgttaaagagaactgcacctacttgtgctttgcatctaggagataaggaaaataaacgacggagataagaaaaactaacatgatttgttattcagttaactaactctactgttgcatgttgcaagggagtatttcctccgtcccagaaaataacctaggtgaggatttaacaccatctaaagcaatgaagttggacaacctcatatctagattcgtagttatatatggtgtcaaatcccaacctaatttgacttttttttaatatgatggagtactttttaatatgagcaaattctttttgcatagttattcttgcctagctactctaggtgaaaccatatatcacaaagaacatccaaaatttcaaatttgcctgtgatgtaatagcaaatgtaaatttaaaaaataaatataacgacacattagtagatgaagttgtagatgccccatctttaaaagagagagagagagaagaagaagaagaagaagaagaagaagaagaagaagaagaagaagaagaagaagaagaagcaatattctctcactattaaaagagaaatgcacctacttgtgcttttcatccaggggttaaggaaaataaacaaaggaaacgagtaaagatgatatgatcagcttgagtgtctatagtctctgctgttatatgttgcagggaataattgttaatccgagcaaattcctttttttaataataaaaatggattacatctccggcttctgtcataagacacacagccataaatttaatagtaataaaaaggtaagataaaagtaaatcaaaatgagaaataaggtgatgggacaagtccccaagcaaattcctttttacaaagttattcccgactagctagctagcctagctgaagccagacatctgttgcagcaatcatccaagttgccataatcttgaagctcgcctctacctgtacagtgttagaaaatgtattttttttttaaaaaaactaaggcagcgttcgagagggtgagagagtgagtttgtttgtttcgttttccgcgcgaacgtttcccaaactactaaatggtgcgttttttgtaaaaattttctgtaggaaagttgctttaaaaaatcgtattaatccatttttaaaatttaaaatagttaatactcaattaatcataagctaatagctcacctcgttttgcgtatcttcccaatcaactcaatccccttctcctcaaatacatcctaaatgtagtgacatattagtattcagcaagtttatatgtaccgttgctgtcaaagttccaagataacgacagcattcataatcaaaaccacgcatagaaaggcattgagcaagtatcccaacctcccatcatcacgaaggcaaaatggttaatctccaaaaattagccgctggtttttgttgcctaatcaaacttttcctccgagcattgacgcacatgtaaacaacgtcaaaactagtactccctccatacttataaagtaaagaaaattgtttaggacaacgacacaatcttcaaaatacaacttttaacttcttatttctataaaaaaatatttattgaaaagtgatatatgtatgcttttatgaaagtatttttcaagataaatctatacatataatttttatatttctaaactcaacaacttgagagttattcataatttatattctaaagatttgatttaaatattatcctaaataactttctttattagtatgaagcagtaaaatcaaaagtcatcatccaggttccacttccagagggcagaggcgatccaatcctgtggtcgcgaactccccatctctttccattttccagaggcgttttcccaggtttacacgtggcacaagtgattgggacgttgccctatcaatcgcggcatccgattcggctatggtgggcccagaggccactggctcggctcctcgaggcgcgtggaggcttgacactggatgcaggcccagcctctctgttatcctttcgccaatagttactgggcctcgccagcccagagatggccgcgtgggcctggcccacttagccgtcagcccaaaagatccaatccccggtatacattaatcggagaggaagaaacggatgcgaccgaaacttcgagcggcgcgagggctcccggcgtccgcgccgtccgccgtgagccggtgctgtccacgacgtcgtcttcgtcgtcctcctcttcgccgtcgccggcgagccggccttgcgccatcagctcgctgggggcaccagacctaccaccttggcggggtcctgctcgccgccgctctgccttctttccttttacggtgccgccctctgaatctctgattcagttctacttcttcatcttaggccattattacaagcgttgaagtagtaatttgggttgatctgtatgcaagtgtgttttatttgcatattaatattgggactgttcagtgatatactgatatgctatgctagggacttgtccgttttttttttttttttgaggtttacagatgatgatcaccatgaatccgaacaaggcattagccaatgtttatttgggggttatatctaatgctttttttataatcttctagatgaatatggttataagatgtgcatgaatctgtttctttcattctcataacctggcatctgtatagcagataaaaatctattcccatggtcaattcagaagccctgcaactacaccatctgtccgatgtaagcaaccagttcaatgtgcctttcatacttaaacagctggtaaacgattccactgaactcatcacttatcacttatgactaattaatcaacaaaccaatttactcggttataaatcctttattcatgttacctgcctacatatgaatgtgcaggatgttctacgcagcatattgtcacggttgcattcagagagtcctcgcggatggcctttctttctcgcaggtggcagcagctgtggagatgctgctgtccgaaattggtcttgaaaagaggcaccatgttccagcccaagaatacaagcatgaaacgtacaaggaccaagtttgccaggagagtgaacagtcttctgcggcatctatgttcacctcctaccctgaggaagtttgttgtcaagttcgggctgcgcaggaagcacacctgccatgtcgatgttgatgtcgatggatgggttcgcttctgcgccgcgtcgagagcaaggcacatcgctttcgatttcactcctggagcgaagaacattttcaagggcttgcctgatgacaagtacatcttcccactgcatgttttcagtggcccggacagctccccttctcatgtcagatctcttaacctggcctacgtctgcctgaacacaacaaccactggttttgctggctttgcaaacctcaagaagctcaccctgcacaaagttttgtttttgagtgactcccaatgcctcatgcagtcatgctgccggaatgcactgctcttgagtggctgagcatcatctgctgttcctacaccgagctaaccttgtgcaagccgctgctgcggctgcgttatctttgtttgcactactgcaacctggaaaagattgagctggaagctccaaatctcacatcgtttgacttgatcaatcggccaattccgttggcactaagtgaatctccaaaggtgatgaagtttaaactgctacataagagcgtgcgctatggtgataatctggattacatatgcaccgagcttcctgctgttcttcctggtgtgcagaaactctccattacctcagacactctacatctatgatgaggtttaatttgtctctttctgaaagcaattaaattcattaatcagttagacatctgttcgtcatctcatccataatcgattagactatcatggttgtgtttcagttgaaaaggttcgccaaaacctcagtcagattcatcaatttgaggcatctgaacttgtatttgcctctttatgggaacggcaggtcagttgatgggattcttcgtttggcctacctcttggaggtagctccagttctagaggaattggaactgcacgtgagtggctttaacaacttcataatatgttgacagtttcttaagcatgcattatatgtagacatttttgtggtggcacagcatcatccttgttattttcaattacctacttttctttcattcatctgaaaccaatctttttatttttttccatttcctgtatgtttgttattttcattcatctaaagctacaactacattgcttaaaattggaataccatacgagttggttgattttgatcttatagttgaaaaatacaaaagggtaacaaagtttctatctattggaaattggagactaccatgctttattaccttattatttggtgatacaatacaaatttgtttatatttcgaagcctgttgaattctttattggcataatgttctagaaccattccttcttttaatatttttaagccacaattacaatttgacctttgagcttactttaactgttgttttgtaattacaaagtcatgacaatatggaagtaatttcatatgcatattcaatggtatcatcccatttatgtcacatagcctatatatactatcggattgttttaagtttgagtcaatttcacctaaccccaggtattatgatctaagttacacaaaaccccagagatttcggtacgtggcacataaccccaagtattctggccataaagtttcacaaaaccacactattgatcattttgatattgatttaccatattttttagttctacaataacatattataagttatttatccatcatataaacattagatccatgtaagtaaatgtttttcaaaatttcgatataggagtatgtcaatttggttaacagggtggttttgtgaaactttaggatataatacgtgaggatatgtgcaacgtgccaaaatccatgtggttttgtgcaacttgcattataataatagctggggttttatgaaattcactctttaaattttgaaatatgttggcaccttataaaaattattggcaattgcgatgaccctattcttaagctgcaggtgtacatgctcggctgtgtttgcaatcccatgttcccaacctccctccctcgttttccgcgtgcacgcttttcaaactgctaaacggtgcgttttttgcaaaaagtttctatacgaaagttccttaaaaaaatcatatcaatccattttatgaagaaaattagcaaatacttaattaatcacacgctaatggaccactccgttttccgtgcggagagtttagttcccaccttcccctatccgaacacagtttgaaatagaaaaccgtagggttagagtgatttgatgtatcccagtttctcatcttgaaatctatgattataagagaaaaattttaaaaatagattaaaacaatctgttatataaaatctagtagattaatgaaggtagattcgttaggataacatctgttctgaagacaacatattagtgcattattattattatcattttctaactattgttggtgatgatgttgttgttgcagctgctcataaaacaccaccaacctgattgcaaacactctggttttgacttttgtgtttgctttttttcattccaattattttttccttcttccacaaattcatgcgttccaaacattggatgaattactgacggaaacattatgcgatgagtctcacaagtgcgctgaattgttgcgtgcagtttgacatctctgatttcgtcatcagacaggtgatcagagcggatatgccaccgtatcggcatgataaagctcaggagggtggtcatgtctggagcctgtcattggcaggggctgatagagctagcacactgcattcttcgttgtgctattagacttgactgtatgatcatggatccgatggtaagaattaagggcctcccggtggttgattggttggtggaaagaggccgcaggattgccaaagagcttcttgagagggaggagtctcagggtgttcttagggtgtgtttgaggataaggggctcgaggagattgggaagatacgtaaaacgaggtaagctattagctcatgattaattgagtattaactattttaaatttcaaaaatggattaatatgatttttttaagcaactttcctatagaaaatttttgcaaaaaacgcaccgtttagtagttttggaaatgtgcgcgcggaaaacgaaacaaacaaacatactctctcaccctctcgaacgctgccttactgttctgtgagataaattagggacattcaatttcttgccacttttaagatgtgataattaattatttgccactcgctatctatgacatgcggatcctcatgtgtttatgacatatgggtcaagtggcaaataatttacccactcgtaagagtggtaaatagttaattattccaataaattaagccgcatgaaatatggtttttgacgtcaggttgtcagttcattctccaagttgcgaagtttttgtgtttgactaataatttattatgataatgaaatgatgaaatccaaataaattgcaaaggattaacacgcgtggtgtcctatctgtccaccatggtcctgcactgtacctgtaccgtgcactcgatcgtagtacgtgctagcacaaatgtactccctctgtaacaaaataagttgcagccatgattttccgcgctcaactttaaccactcgtcttatttaattttttttgaaaaaaattaaatacataagtcacgagtaaagtagtattcatgttttatcatcttataacaactaaattgttaattataaaaaaaattcaaataagacggacgatcaaagttaggcgctgaaactcatggctgcacttattttgggacagaggtagtaccacgacaagacgaattgggggaattgaggggtccatttggccggtagcgtcgccgtcgtctagcccgctgccccaatacccgagagattgtgcccagtcacagtggctacggacgtagtacgtactccactaaccacaccagtacaccacaccgtcgtcggtccgtccaccgatgacgggaggatgcaccacccgcaccgtggcagcgagcgcgtcgcgtcgcaacgttgcatcgcggagtcgatcgtgagacgggtgggccaagtagcaacgtgaagtgtgagaaagcgaacaattggttgcagggtttgtcttttttgatttcgaagtaaaaaaccgcttcttattaatgtatactgaaattctatcaaaaactaataaaaacagacgactttagattaacgtagtacgagaatcagctaatactgaccggtttgtgaataacgcttttgtgaaatttcatcagattatgtgaacttgattgggtgcaaggattgcagcatttacggttgacgaatggaggcgcacgcgcacgggcccgaggggtcaaagaagggggcgatacgtcaacaacttctctgactgtacacgttagcaccactgtactgcagctgtaaaagtcttaaatagcctaagtatatattaatttcatgaacggatcaaactactaccagcacaagtgttttctttatagaccagcacaaacggttagaaaactactactactatactacgtatatacaacaacaggtatttcacatgatcaattccacgcgtacgtgttattctctacccaaacataaccaagcagcccgcgcgggcggagcgggagatgacgggtcgtgggcgacggtgggcgggcctgcgcatggcagcggggaggcggtggaatggcgagacgttggcagcagcgtctctttgggggacagcgggtgtcgcagaggacgataacgtcttaactcttaagtgtcgacgaccaatcctcggcaaggagaaggcggatcctacgaaggtggtttcgaggcatcagtgatcctaagaatggcggtggcatgcgaatctgagcagagacctcctcggttgcggtggttgccgccctaggggcagcggtgacctaagtgtcgatgcaaggtggatcaggtgggtggatctcgttggtgacagtggctctaggggcggcaaaggtctgggagtctaggcgaaagatgatatcctcggcgttagtggcagaggattcaaccagagatggtagcggtctaggagtccaagtagcggaggaggattccgacgccggcggcagccctatcgttggcagaggcttaggaatacgacgaaacggaaccataacccttcatcttgtgtctggtcggttagttctgactggatgacgacagataaaggtgggctaaccggcgacgcgtggcattagttcacttaagtgtatgaagatggcaccaatggagtttcgcagtgacaaagcattaggggtggtggtgactagacgacttccactcatcgattttgactgtttcaaaagaagatgtcggaatgcagggatgtgccgaacttgtaggtttttcctttttggttgtgtgttctctttgttgaggtgtgagtccaaatgcttttatatcgttttggctatgtatatctctcgtgatatagaggccagtttaatgaaaatacattatctaaagaaaataggaaaaagtacgaattacccctccccctgaactatcgcggttgaccgaattacccccctgaaccataaaaccggacattcttcacccccaactatgcaaactagacgaattaccccctctcgacccaatccgcggtggttttggtctacgtggcgtcgcgtggcagtccaatcatcattctatttataaaaaaaatgtcgaacccacatgtcatactcttccacttttcctctctctctctcactctctgtttcactcttcctctctctcacgggtgggtcggcggcggcgggggacacggagtgcgcggcgggtgacgcagaggcggcgg

SEQ ID NO: 10797 - DNA, 3818 bp, Oryza sativa
ccccgcgcgccgccggccactgcgcgcttatgacgaggaggagcccgcggtggcggcggtgtcccaccgcgcgtccccgtgcgccaccgccgaggaggagcccgccgcccaccgcgcgtccccgcgcgcccggtcggcctctacctctgtcgccggccgccgtcatcctcgggccccctccgccacctacaacttgctccgccccctgcgcgccgccgtcctcacctcacctcaccgccgccacgctcctccgccgcctccgcctccgcgccgacgtcctgagcgccaacgtatgcgccatcctcgctgactgcccacgctgaccgcccgtccccgcgccgtcctcgccgacagcccacgcccatcgctcgtccttgccatgtgcgtagcgcgagagagaaaagagcgagagaatagaaatagaggaaaaaagtatgataggtgggtcccacattttttattaaataaaatgctgactggattgccacatgtgcgccacgttggacaaaaccgctctggattgggtcgagggggtaatttgtccggtattaaaagtttaggggtaattcggacgaccccgatagttcggggttaattcgtactttttcccaaaaaaaaaaaaaccaagcatccccgtgtacttagcatgtccatttgagatgatggcattagtggcccgtaccgtgcgatgctacattttgtccctgcctccggcggcacttgtcacactcttttcacgcgcgcattcttatatagttgaacctactaatccaaatccaatccaagttgtcacaaaaaaaaaaaacaagttgtcactttgttccgtgccaaattgactggtggaacgccccacggccccagcgaccaaccatcataggtcaagaaaccgtttaacccgcaccctaccaattagcgcgcgcgtacgaacaatcaagaacccagtggcacacgagtacgagtaatctagtaagtacactatggtactcccgatccgcgcgcccgaattaataggctggcagccgtcgccgttcacctcgttggacttggaccgcgtcgtcgtcggcgtctgctgcggcgcaccggcacggcggcacctcgcttagggcacccactataagctctctacaagagatcaatatcagcatatttttctatttagaagatattaaatgaagagatagagcaaagctgtctactaaattagagatagtctatagagaaaaacgaggcaatgcataagagagctatagatacccatgtagatatgctattgaggtggtttactattaatctagtttagaacaccttactttactattacggatgctcttaccgcccatcaattttccgcgccaaccccacgacgccgccgcccgctgccgggcgccggcctcggtggactcgcggcgcgacccaactaaaacggcggcacatggaacaccacgaattgatcgaatggcgaggcgaagcgtggccgcagaggccgaggcgtcgcgtcgcgtcgccgtcgcgctcgcgcaggtgtttggctgtggcctgtggtgcgccgcggtcgccgtcgcggcagattttccacggcctccacgtagaaacccattgattacacactctcccaagtcccaagtgcgtggcgtggtgcagctcctctcgaaatggacggcccattgcggagaacatggccccggactgggcctcttttcccggcacctttttcacggactttctgttattaacaacggcaggatttactcgctactgtagctttcagctggaagtttccaatgcgtaataaacttgactcctatggttgaaatggaatcaatccctccagggaaattgcatccaaattgacactagatttggatagtagtaccacttctcctaccataccccgaatctcccagaccatagtatgctggagccacccaaaaccgtcccgtccatctttgccactagtaaataacgcgcgtttttcttgaagcgttaagttgaaactccgaaacgtcatccacgcagaaggggttgtgtgtactcctacgccgcacggaaacgcaaccacacacttcttcggtcgcgcacctaacaaagtacccgcttctacgtcgtcgagcgtttaatgagtagccctcctcctcggcggcagtgatgacccaatcatccccccgggttcagaagccacgtctcgtcgtgcgtttaagccaagtataaggtagatgtgactaccacctctaaatttatctattttattcactcataaattaagaggcaacacatacaatgtatcacctctaatatacaaataccaatatctctaatactctcacacatttcttgaaatttgtgtggaagttgcctcttaatttaggggtggctcatcttatctctctccacttctctcctccaccttatcacccaatccaatgtagcgtttttagaggcaacatatgagatattatagtacttgccctaaagagaggatattttccactttctctgcgcactatttttaaacggttaaatggtgtattttctaaaaaatattttatagacaattcgtttaaaaacttatattaatcaacttttaaatttaaaataattactacctccgttttaggttataagacgttttaactttgatcaaagtcatactgctctaagtttgataaagtttataggaaaaaatattttcaaccaagataaatttattataaaaatatattaaattattgatttgatgacactaatttagtattatcaatattattatttttttaataaagttagttaaacttagagcagtttgactttaacaaagtcaaaacgttaacctaaaacctcatttttcgtatattccttcccaaacactaaaacgagaaaagtagctcgcggcgttgctgaagtacgtgaacggttcctgcctacccggccgcccaaagaaaaaaaaaatttctgctaatcggctgcgttggtcaacacggaaaacgcaatttcaccggaaaaaccttcaatgcgaggaagaaaaagaaacaaatacactacagtagtagtacgagtaaaatagttctttttttatactgctagtgctgttggtaggagaaaaagaaagatggaactggctgacatgcttgttacagcaggtacaatagcaggtataagccagttataaacatattttaaagagttaaaaaaagaagagaagagcagcgggctacagatctgtagccagctacagcacggactccaagatataatgtgtgtatgacaagtgggaccagatattaatagtatagtaaataactattgtatgaattggctattacattagctataaatgatttggatctagtagtggactatactattaaacttgctcttagagcaaggctaataatacagccgacctgctggctataaggttctttatagccttatcttagcctatccatataatagttagctcttcacaattaatacaggacccacttgtttctctcacagagttttttggttcttgtgtccaagccggctgttagtttacagtccgcttcttctctctctcctctcttctttcctccaactcagcatttaaccggcttatattctacaattatactcgctcttattgccagccagaataataaccgagtgaccggttaacccgggggcgcgggcccacttgtcagcgagccctcccagcacgcgcagcaaggcgcatttgttgtctcggctggatggctggcagagacagtcaatccaacagggcactctcccctaggcgtagcattgccagagtcatcgtacccagtcgcattcccctt

SEQ ID NO: 10798 - DNA, 9852 bp, Oryza sativa
atcccggccacgctccgcaccatgccgcgctcggcgttcctggggacggggttgtgcgggggccccttggggccttgtcccggtgagggtctcgccttccccggctccgggcgaacagccggtgtcgccgactccggcgaacaacggcgacaagggcggaaatgggggtgaaagtggcaagaagagcaagaagctctctggtggcgccattgcaggaatcgccataggctccgccgtgggagccgcgcttctcctgttcctccttatttgcctctgctgcaggtcgggacgcaccaagacgcggtctatggagatgccgccgcctccgtcttcggctcctgccgttgtcgccgcccgccgtaaaccacctgagatgaccagcgccgcggccgtagcacccatggccaccgtgggcaatcctcacgcccctctcggtcagtcgacttcagggaagaagctgatcttcttcgggtctgcggccgcagtggcgcccttcgacctggaggacctgctgcgtgcatccgccgaggtgcttgggaaaggcgcattcgggacgacgtacaaagctgttctgaatccggggcgacggtggcagtgaagaggctcaaggatgtgaccctgaccgagccggagttccgtgaccggattgctgacattggcgagctgcagcacgagttcatcgttccccttcgtgcctattactacagcaaagacgagaagctgctcgtctacgacttcatgcccatgggcagcctctctgcggttttgcatggtgagaacttgacagttgtattttgttgtgattcttaattcacaatgaaatgttattcttgtgtttgttagtactatgatgcattgttatttggtggtgatgataagagtggcgcttgattgttttgtggctattactttttcctttcctcgtttgactattcatctgccggttttagactctactccgattctgtcttctctaggagacttagtcaggctcggtgttgatgtaggttttctttatcatgttggtatccaaagtacctgttgtttattgggtagtgattcttaattgatgttactcattcaggattgactacgatttagtttgtgactgtttcttgattcccccctgttctggttaaacttttcaattgttcatacttttcagaaagttcaaacataattgatgacattgcaatccttgaggtgcagaattggttgtcttattttttttatatgcacaaattccttcaatgtgttgactcagcttggttagtgtgatttttctttacattgcttatagtttctggggatggtacatgattaattaggatggtatctgatgtcttgatatcatgctggaactaatatttgcattttaagttatagccatatagttgaatactaatgttttcatcattactgttgtgactcctgctaatcatgatactggtacttagacttgaggatagaaaacttatctcacaccatctttacttatttgctaagcagggaacagaggttctggccgtacaccgcttaactgggagacgagatcaagcattgcgctggctgcagcccgtggcgtcgagtacattcactcaacaagctcatcagcatcccatggcaacatcaagtcatccaatgtcctcctgaacaagtcgtatcaagcacgtttatcagacaacggactttctgctcttgttggtccatcgtccgcaccatcccgtgccagtggataccgtgctcctgaggttactgatccccggagggtgtcccagaaggcagatgtgtacagctttggtgttctcttgcttgagctgctcacaggcaaggcccccagtcaggccgctcttaacgatgagggtgttgacctgcccaggtgggtgcagtcagttgtccgctcggaatggactgcagaggtgtttgatatggagctcctgaggtatcagaatgttgaggaacagatggttcagctactacagcttgctatagactgcgttgcacaagtcccagatgcccgaccttcaatgccacatgttgttttgcggatcgaggagatcaaaaagtcaagcgaaagattagaaggtagagatccgcagcagcaggcctcaaatctcgaagcgggcgatgatcagacttctaagccagaatccgctgaggggctcaatccttttgccccttgatattgaataacatgatggaggaatcggctaactgctgtagcccacatttggttcatggatttgatgaatcctatcttcaattgagtggactactttcatcttttggcaatattgaatttaccattggtgtcaaccatatggttgtctttcgattgcgcatgatgcttggcaccctctgtgctgtggtaggtattctggtggtgtttagggatcaccaccccaagtttgtgattgctttaatcgatctgcttattctagctgatgattaggttggttctttagctatccatgtaattacaccgcaatctagtgcttggaatttcttgcctgagaatcatatttcatgagttcgctccctgatggagttgttgccgattggcatggccgatgtgattgattgctgggtctttctttggatggtttggtgatctgtaaaacatgcatctcctgtggccgcatctggttgacgccttcggttcgtgaaagcaacgtgctctcgatccggtggcacgggtcttgttttcggcgagatgttttttgaatcgcccctgtttgttggtttcgtcctttgaattcaatctgcctgatacgaatagaaatgtgactgttgggctatcattattgatcatggtccataaatagatgccactgttaccctgtacgtagggtggtccaaaggaaaaatatgtacaggaaacgtactggttgagtgatccaaatgggtcgtgccgtttttggcttgggctacatctcatcaaaccacgatctatagcagtgtttccctagctccgtgccttcgttgcatcagcatccataacaaactctggccatattcgtctcaaaaagaaaaaaaaaaaagaaactggccatattctgaatcagtgtaaacatttagtacttcctccttttcatattataaaactttctagcattcccacattcatatatatgttaacgaatctaaatatatatgtgtagttagatttattaacatctatataaatataaacaatgctagaaagtcttataacctgaaacggaggtagtatgtatcaattgaacctttcatgctctggataacggatgaaactaaagtagaggtagctaggaacatggtaaggcggtttaacctccaaatctgcctttttgtttggtgggagctagagtttctggctagcttttcatttccttcccaacgaaaatgacatctaactttgcttcggtgaggggattctacttttcaccatcctaagcctaatgttagaagggcaaaaaatgaaaaaaaaagaaacagaaagagaattaaagtgtttctatattttctctacgattaccaggcaaacgtttattctttgcttcctaaaataaactaacataatataagataatacacatgttaaaaatttgtaatccgacaatgtgtcacactttgaaacggatctggtgtattttgtgaagccttgaggaaacaagccccggttacgcaggaacaggagcgtgtgattatacaagagacgcatgtgtcgtgcacgaaactgagatccggccttttcaacgggtagccgggtaggccacctacgcgtttttgtcccggtgctagtgctacgcctgcggcacacacctggcgtgagtggcgcgggtggcggcacacaccggcgcgcgcgcgccctccaaatccgaagcgagaaggggggtaaacgacggcggcgcgtcacatggcacgagctagtcccacctggcagggccaccaccaccacgccgccacgcccacgcatcggatcggctcgcgctcatgtgatccatggcccgggaccagagacggacggtcgtacgcacgcatctccggtgcaggagccggatggaaaaggttagtactgccgtgtttagttctaaaataatcctttatatttctagcttttctatcacatcgaaacttttctacacacacaaacttttaatttttccgtcacatcattctaatttcaaccaaatttttaattttggtgtaactaaacataggccccgcgcgttcactttttttttacacgtcgtttggtttgatggcaatgcaaggggctgccacgttgaatgttggatgtgttatagggagtagtagtaggtttttcttaggtgaaaggcaaacacatgctacatcttttggccgcattgttctgtagatacgatatttgatagtgattggggttgaaaacagtcatggctattgatgatcaaccgacgctcgtttctggtttttaccgacgtaaccatatagaaaaggtaaccgagataaaattgaaaatgacactaaaacgtattctaccaaccgtttccatattttacccttttctcatgaagatttaccgattctgtgatatagtaattactgtatcatccgacccgcatctgaccatggctcatctaccaatcgtgtgtctaatttttctccatgcaagctagtttttgtccatgtcggaccaggcaagtaacaactagagaactagtcggacaagggttgtacacaccggtcgtatgtatagccattttcatttttgaaacccctaatagttttgctataaatctgtcgtcaaattttttacttacaatttgacgttttttcaacctaccaattagcacctgattaaggcaaggcactgataaccaagtgaggtattgtacgcatctttttatctttgccactgtatagaacgaaagtgattgaacgataatactacttttaatacaggtgagaaatcttctgtgatgtctatttcgtatgaccagcagtgttttaaaagttacattaaagttacactatagtttatatgtaagttacaatgtaattacactataattgtataaagttatagtcctatataactaaaattatatttgtaaattcagttgatatgacatgtaagtatactgtaattttgataaaaaatattgtgtaagtaaatatgcattcgttattttctttaaaatataaaattacagtcatatataactaaaattatatttataaattcagttgatatgacatgtaattatttaaaatataaaattacagtcctatataactaaaattacatatgtaaatttagttgatatgacatgtaagtacactgtaattttgataaaaatgttgtgtaagtaaatttgtattaattattttattttgtagtccgttggatataaatctaagtatagaaaaaaaatatgggtgatttcttgttaaaaatcacccgacaaatgtataggcagttccatccctaatatctattgtctctgtttgacccatagttttgaggtgcaacaaccgctcaaccaaattcctaatttaattattagctagctgggagaaaatttgtaatttacatactgtaattttaatttgatttggtcatatgcagatatattaaattaaataccatgtgattttataatccaatatttctgacattcattacccgtctccaattgataccgacatgatttcatcactatagtttcatttctgatttttcgatattgttccgttttcagatttatcgttttcgaccatgttttgagagaaaaaataaattatgaaaacggttaaggttgttttctgatgtacatattacagcatacatactagactaactttgaattaagttgtgtattttgttgtaacggattgccacaccgataggtatggctgtcgggttgtgcgggtggcacagaccttattatacatacttcgaaattcaaccaccgaatgacatctacttcctccgtttcacaatataagtcattgtagcatttcccacattcatatttatgttaatgaatctagatagatatatatgtctagattcattatcatcaatataaatgtgaaaaatgctagaatggcttatattgtgaaacggagggagtatacttttaagccagtgctaaacatttggtgtagatctgtaaaactccgagcaattcatacgacaacccctcaacttttgcgaggagccaatgagccactcttttcttttttttttttttggaaagaatacactcctgtccccgatgtagatgaaagatactccattcttgttccatacaaggcttcataatgtttgtgcgattttttcttttcttttcttttaaaaaagaaacctgagaatgatttgtggttcgtacatgtgttggtgattgcaacgggccctgcggtttgagtttgattgggcgtaacaataattcatgtataggcgctggaggaacagtggaaggtgagctagatgccatatgtagcattgtagcgtgtcaagcgtgtcaatgcggcgtcccatcggcatatgcaacttgttacttgtaactgccggagacacatcgacaagctaggcagaaatgtgcgcaaaaatgatcaatcaaaggcggccgatcgaggcatatctgattgctcatacaccaggaaaggtttgcattggttcgtggtaatttgccattgcaaggaatgatttcaatgtgtccttggatatctttgcagtcctataattgctaccgcccttgattggatgatgattctcgaataattgaaaatggcactagcatttaagtttataaacttttaaccgcttctctttttacggtaaaaatttataaatccttaaaatatgttatattatttaagtgtattcatcatagcaatttgtgattcaagcgagacacccatagaaagtgtaagttattcaagaacaggaagtatgatgaaagaaagaaaaaagacacatcggattttagtgggggtaaaaacaagatgggtatttctcgcccaccacccgaccatattattttaagataaatttgtttggattataaattcgggtacttgaatttttatatagttattgaaatcatatccgggtgctttttattgatacgggattgaaagatggtatccgacgggtaaataaatattacccggtaaactatccaaatattgccggttagcaggctttttgtttagtccaaaaaaaagccatagcccacgaaacttacatcaactcataaccaccataaatcaagcacaaaacgggagtgctagtgctaaaactagtaatggtgtgatggagtaatagatattatctatgttgctgttgctatgccttaatctagttgcattagggattgaatggcgattgaaaatttaccgtatatgatcgtccctttgactcaatattcggttaccgatatatttcctccgtcccaaaatgtaagtatttttgaggttggcatgggtattaaaaaagtagatgagaatgactgaagaaggtgtgtgattggttgaaaagagaaagtaggtgaaaaagaatggttgtgattggttgagaggagaaggtaggtaaaaaaatagcttcattttggaacaaagtactggctagaaatagctacattttaggacggaggtagtaatacgtacctgcttgcaattgctacatattcatttcatatttataatcgatattatctgtatttgaatccgtatttaataattacttatgtccgatccaattccgatcataaaatatgggttaagatataagaaggatcgaaacccaacccgattcatccctagtttttataccggtcatccatgtaccttttgagtttcaagtcaactgtagtattattcaaaatagtatcaactcttagatgcttcgttttacgagcgactatgaagatgattagagttgctatcgcctactcacaatcgcagtacgtctcagctcacaggttcagcatgacatccttctctgttagtcacgttgagaatgctagtaaccataatatgcttaaatagagtattaacattgaacatatggagcccagcgtttgacgacatacttcgagctttcagattatttatttatttttccttcaatctctttgactctagtaatattaaacaagtgaacttgcatcagattattcttctttcctccagccaccattctttggaaccttgaccctcgacacccccccaccccccaccaatgttttgaacaaccccaacatctttaaacaaaggaacaaactgaaactactcttgtatttttacttctatcactaacagtattcccacggtctttgaacaatcaagtcaaaaataaagggataaccatcactgccagcctgccatgtcaacatcttctagttcctcctcactagagaaaaagagcctccaaacaaaaaatcatttagcaatttgattggactaacagctactatctccgtcccaagacataaaatgttttaaaattagacatgagtattataaacataggtgaaattaaatatgaaaagattgtgattggtgaggatactaaaaggtaaaagatcgtttacattttgaaacaaattttgaatgctataaattgtaatatttaagcacggaagtagatttaacaaacaaattgtaatattttaaatactaaaagtaaaaggtcgttattgattgagaaatgaatagatatataagttgttatattttaaaacaaaatttgaatgctagaaattgtaatatttaaacacgtacggaagtactcctacttgtcaccacctgtaacctcggccccatgtcacatcagctgaaatattttggtcagtcgtggcttatggaagcttcagattgaccagaaagggagcagaggaaactgtgccgagaaaagaaaaatgcttctgatcgcgagaggttttcaggattaattcatgggaacatggcgtgtgtttcatgatgttcacaagccacccaactgtgacgacgttgctgtgtaaaaaagctactctcgcagtcagcaggcgagaagccgagagcgacactgtctcccttttccagcatgccatattggtctgcgtcaaagtctcaaatatgatctaagcgagaaaaaaaaaactccctttttcacccgattttaaaatacatgtaccatatcctcgctccgatcggattccgggtaaatcggtcagatattatttgatctatttttacccaaatttgtgtgtgtgtgtgtgtgtttgggggagggggggagggggctaataaaatttttttagagtacacggtataacgcagacactcacaacacacgcatactcacccctatgaacacacgcacgcaaaccctacccctatgaacatattcaaaggctgaacgaataaatcctggagattgacgaagtcaccacaggcgcattacaatttttatttgttatagtataatcatttttaattaatcaaagtgagacaatcttagtcaacagtgacaattattcaagaacagagagagtaaacagtgctagtgttgtgctccctctgttcttttatacttcatatttattttgctcgctatatggttagtttgaggcacttttgatgaaaaatttaatgcaatttccatatgagaaatttaaatatcatcagtacatacgttgtcaaaatattgatatattaattgcacgcattctagaatgatgatagggtgaaaaaaagaaaagttgaggggtggaatagtatgggttgaaccatgaaaggtggcgactttagtgacggtctcgcaatcgcaaagatgaagtctcagtttctaccttctcgagaaagacgtactagtactccctcttattcgaaatgtttgac

SEQ ID NO: 10799 - DNA, 7211 bp, Oryza sativa
  unsure (1)..(7211): unsure at all n locations
atgtaaaattatatgcctacataaaaatatatttaacaatgaatcaaatgatagaaaaagaattaataattacttaaattttttgaataagacgaacgatcaaacatgtgctaaaaagtcaacggcgtcaaacatttcgaaacggagggagtatatgataatggagactgatcaattatgtttttggtaatgtcactctgaatttgttgtagctagtactcattttcagtacttacatccaggacctgtcagtgtttacttttcagcaaatggtcccttttcttggacatgatctgctaagcactgtagtttctgtacggtcaattaaactggcctgggagatgtttattgcactgctctggatatctctgatgccacatcagccagcttgtgttacttcagaattcgggatcagaattctgcaagagtgaaacgaacattacggagtatctctgacgctgggtgtttgtctcttgtacagcatgttagtctgaatagtcagctgtttatttattcttttcttgtgggacataagtctgaaactctgaacattttttgagaactgaaactctgaacattgaatttcgtttccatcttctctttactttggaaaaacaaattttcagtctgctttacgagtcaatggtagaatcttctttcatggctgcgatattgatgagggtgtaattctgtagtagtctgcacccacaggccacagtttgcactgcaagtttcattggtttcaaagagcaatgagttgaagtgtagaactccacactactgagagttacataaagttcataatcttctggactttttggctgtgtgcttacgggcagagaccagagatgtaacctatttccattatctaaaaaaaaacataaagttcataataattccctgcatttcaagtaactcgtatgcagaatcacaccgatctcggctcagcatttttggtcttctgaaattggttatttgcatcacacgatgcagagaggccagaagttttactttccacaatctgtcaatctccaaacaaatagtaggaaaaaaaaaagaaaaagaagaagaagaagagtaggccaagccatatcattttgatgctgccgtgtcggcagcctggggtttggccggtggtcgatgaggaaaaagatcgagtcgacgatgattccaatcacattggataggacaggaggcgttgtcatcagctttgcgaagtgcgagttgcaagcagagaaggcatggccatggccatggcagggtaggcacagcctcgctttccttggcttgcgctgtaggcttgtgggcacgcaggagcatgttccctgtaaatgctttgcctttgccttttggtgttcgtctctcttttttttttcccctttcttggacggatgcttttctcatcctgaaacgtcaaggatctctcaacaggaggagggcacggtctcctgcttgtttgcaagaggtgaggttcagcatttgggtgacttcatgaggaggtttctctaatgagtttagctgaatttcgtctggatttggtgttgtgcaagaagtttaaaatcgcctcaaacagcagccgtccggccacagcattcggaagtttatggacctccagcttgcacgtatactaggtgtctaggttaccgggataagtttgtcggcaaaaaagttttgagtgtaattcactgaatttcatagaaaaaaaccaaattcccagttttggagcacctatattttgggtgcagtgataaaaaataaaaagagaggggtatcttgacatcaacaaccaggttagcattctgaagatactgctctccaactagcatgcataccaggtgtctgaagaaaattacaggtctccagacaaactaataattcagactggaacagacaagcagaaagatggtacggatgctttcctgaaacaatggagacatgggttgcaacttgcaagttgcaatcttactgaacgaggggatgaacggtttacacaatgtgcaaattaacgaagttgccgacattttattgaggcgacagcacggtttggatccaatgtagttactgccaaattacaggagatcatgggttctcttttttgcgcctgatgctactcaatttaataatactgtacattgcaattcgcatctcttacatgatgacacacctaagcgatagccctttctgttctactctttgatcttcattgcctgcagaaagaaacagcaactaggttcagaacccaacatgcaacttcagtctagcaagtagcaacctcattgtttcgcttatgctgattataaactgtaactgcttatcagtgcccaaaaaataatttgtgagcgaaacttttatatacgtgtcctcagcgatttaaaaacaaatgctagaaataaactacgataaaaaaaagcactaaaattaactccgaaattaagttttaaaactcaaattttggttgcggtttataagcttaagggaaaacgacgaggctgtagatcaaattcactgaagcagagatatggaaattaccatcatggggttgatggagcctacgattctgaggagcagacatctccttttttaagccgatcaggatgtcttgcattgtatgttctctttgccagttaccaagcatggggaatagacttggttcaacctagaaagtagctccttgtaagtactacgccaataaaatgattcaccaactactttagcttaaaggaaagcaagtggacatgtaccattccagtttcttgattcacacatgacatattgattcgagtctggaatcgaacagtaggtggtctgtctggatagtctgtatcacagaacaacttcaactgatagattcgtccctcatgaacagtctgcaagacaaattgaatgtaaaagatcattcagtttgagcatacagaagcaaatgcagttaatatctactaatgggtgttatacaacatacattaggagggccaatgatagttcctgtccaggaacgcatatatatgtcatcagcatcatccattccatagctcactgtcccatcaccaatgcccttctcacctcgctcaagctcttcaagcagtctaaagtttctgggaactgcagagatgtactcagcacagtaaagaattcaataaatgaattactagatttgttctgtatgcagctactcatgaggcttgaaatcccaaaaaagaataatatttaatctgtttagagaacataaaattggagtgtagtaaccgatccgacaatgttttgcatcaacacaagtcaaaacagctttccagaatgagcacactccattcacgtatttaaattatatttcgaaagtttcctcatgagctgtagcaccaggccattggcatgctcatctatccatgtaataaataacagaagaaccgtgttgtttgaggggaacaaaggcaagtcataactaatgtacagaaaacaatagagaaaatgttatgccacaaatcacaagatttacctattattactagaaggctaactaacataatgtagcaactgcataagcacaaagaaaaaaaatggagttgcaaagcattccttattaaagataattccaatagcatatttagtaatatttaaaatgtttgtgtcagcttattaatatgtagcacatggttcatgctgttcaaacccacatggcattcagtggcggagccacattaagcttgggtggtgcacaggaacccaagcacncannnannnnntnntnnannnnaataaaggcaggatttgtgagttatgaacgctagaatgcacagttccatccaaatcttctaggttttcgaatgtagggcaccaacttgtttcaaaggaagcgttcgccttgatgccattttgcccactaaaatgggatggaccaagtagaaaaaatgccttcaatgtttattttttcagaanaaaggcttccaagttcagatagagatatgataggactgattggcaggactaaagcatccaaattaaataacttgtagccaagagatgaacagaggggcctattatgcagaaacctgttcagcaccagtttcatgtcttacattgttcattgatgagatagagagttatgcatggagtgacaagaaagaaagtttctaaggtcagaactcacaggatctgtatatagtgaattgatttcagttactatcaattatgtatggggtcaagaacaagggaatgtgttctgtagttctgttttgccatggtccatctataggatggctacgataaaaatgcatgtttagggcatgcaaagctgacttagactcctgttcgattgaggtggattatcatattctcatttggttcaactgcttttagatgttcgggtgtttggctaaatgtttttcttttaatttaagatgcaaacggcaatattattgcattcagaaaagatagaacgattgtgaaatacataacagttggataccatgttttgtctaaccttaatttgatttgtaaagaaaatgcaatggttctaagtttacatttctgcaacaattaaaaagataagcacagtgggccttagccagtcattgcattgttgagaattccatgcttaatatttcttttttaactcgagaagtaccaattgggaagcaaagctgcactattgggaaataagaaggccatcttgtgtgaataaatgaagggtctttcctgccattatgaattaacgaaagagcaaattattgactccgaaagtaaactctggtttccgctctagatataacaatatattaacctggtgcatagacctaataagaatcataaaagttgagtcctcccttaacaaaatgcatatgctactaggacagtctttttggtcctcattaaatcctaaagtagttccagtatcattttaggataaaggaatgtatcagtttatagtcatccaaaaaactacagtgcatggatagggtagattcaatatccatttattgagattattatgttccactctaaccttattccatttctgtaaagtactccctccggctattaatatatgacgtttttaatacatattttagtgttaaaaaacgtcatatattaatgactagagggagtactttcaagcaaaatttagaaaagaacacgataaatggtaagataaaataattacaaggcctcggataaagcaaaagatttacgttttttttttcagaattggaaccatttgtaagaagagaaaagaatgccaataaattgagttggatgtcttaggaggacgaatcatcttttagtggaaagaatacgctggaacaattcttattagttggaagtaatattcactttgtattcgcttagaagtctcttttcttaagagtatgaatgacttcctttatttttggttattttgtggcatgctagtcacaacacagtggatcacaaaagtaaaatgcatcaccctggttgtattttaatatcattagtatagggtcttgatgttagcaagtgagtaagcccgcctaggtcttgatgttagcaagtgagtaagcccgcctatggagtttggcgggggctaaggggccctcatggaccccggctagggacttctattttagtactttttggttttgtcaccgcccttgcagtgggttgttttgtggtggtgcaagttcctgtactttttgctgttctttggcgtgtttggatgccttacttcttctactaatgcaatgagcgcatcttgcgtattcaaggaaaaattatcattagggtgtgtttagttcacgccaaaattggaagtttggttgaaattggaatgatgtgacggaaagttggaagtttgtgtgtgtaggaaagttttgatgtgatgaaaaagttggaagtttgaagaaaaaatttagaactaaactcggccttagttgcatattggaaaaaaaaatgtgccaatctacaatttgggttaaaaaaaaaacatgtctatgaacaagtggggtagctgacaagccacagctgtggctgtaaagtattagtaaaccaaattcaaacacatgatcagacttgagtgacttaattgcggattttttattttgcaatgaccaaatatagggatcccctctctctctctctctctctctctctctctctctctctctctctctctctccccccccctatgaagtagcagtattgttcatcttgttatgcaaaaaatacccaaaccaagaaatggtagaaatgccaaaaatactgatattaggatcaaactcaggaactaatgataagacaaacttattgatatgcaataattcgcgattgaagataaacgtgagcaaccaacaaatccagctagtacccctaaatccatcgtttccatccatataaaattgctccaattcttagcttagccacaaaagaacaaacaattgaacaagaattcacagtgctaagagttcggcgaattgggaaccgagagctgagactaccccctcagcattcccctttacagaacaatctaatcccgaagcaatcctaactcctcacgaatctaacaaatcctaattcctcacgaatctacatttgctctcagagtttcttgaatcttgcctacgcgcacgtccagagaaattacgccctaccacacgagaatcagcccctaaaaatcccatcaagaactcaaccaactctcgcgttcttgaccggccgcgaagatccccccaccccacccaaatccaccaccacaaaaccaaaattcggcaagggttccctggctactcaccgacgacgaccccggcggatccctcggaccccatcgcgagcacctcctcctccgccagctccgactcttcgccttgcgattccttccttccttccttccttcctcccgagctcgtgtagtggtagcaaccagccaactactgtactgctgctgctaaaaactgaccccgcgggacaaggaatatcccaatccccagcgtggagtggagtcctctcctctccttgggaggattgcagcaactggagagcggggcccgaggaggaggggaggggagcacgtcgtggggaagaagggcgaggagattttggcgcaaaccgcagcaatcaggagggactgggactggaggacgacgcggcggaccaccggatttgagctttttttttttttcctccaacaattggatgatgagctggttgacttgacaattgccaattaggcaacagtataggctgtc

SEQ ID NO: 10800 - DNA, 14178 bp, Oryza sativa
aaaaaaaagttaagagtttacgtgtgtagaaaagtttttgaatgtaatgtgatgtaatgaaaaagtggaagttagggggaaatttggtgtgaactaaacacacccatagtcactttataaatccgctagttagtttattactctcctcgtcccgaaatataatagattttgcgtggatataacatatcctgcgactgtgaatttggacatactctttgtccaaattcatagtactagaatgtgtcacatccaaccaaaatcccttatatttcgggacagagggagtatcagcctacagcgtaaatttaagagtatcatttcgtaaaaccccatattattatgatccaagttgtacaaaattgcatattttggtatgtgacatataacttaggtattatgatcctaaagtttcataaaaccacaccgttaactaattcgacaacaatcttgtatcaaaattttaaaaggctatacttacaagatggagaaagaaattataaaattaaatatgatcgtagaactcaaaagtatgttagatcaaaatcaaaatgaataatagtgtaattttgtggaactttataaccatgacacctggggttatgtgccacgttttttagataaaaagcatgaaggcccagcttttagtagaaagcagataagattttgccggtaacggtaactggagagcggggcccaaggagaggaggaggggagcacgtcatggggaagaagggcgaggggatagagagagagaaattttggcgcaaaccgcagcaatcaggaggaggactgaaggacgacgcggcggatcaccggatttgagcccctttatttttctccagttggatgatgagttggttgacttgacaattcccaatcgatttagctatatatttatcgacaatgtaaatatggtacaatcgtagtataactaccatgtaactacaatgtaattttgaatcgttcgatttgctttaaaatttgtgcaagggtgataggaaaaaattacaacccacgcacatgtaagggggattcagtaccattaccttcattttcacagtattagcatttcacttaggtcaaaaagttacatgcaagttatactatagttacatataagttacactgtaattacattatgattgtactatatttacatatgtcaaactttttaattaaaatttaatgataaatgtatagctaatcccttgccaattgggcaacagtatagtatcaccctctcaggtgagttcggccctcacaggttttgcaacttctccctccggaatacacaaaacaaaacgatagattagtgtaggattaattaaatattagttagaaattaaaaatgaattaatacaatttttctcataaacttttttaaaaaatatatgtaccgtttaacaattcgataatatgtgtgtaaaaaacgaggtagtagaagttggtaagatagaggaaagaacacagctagtatagtccgctagttagctaccagccattaaatttaaactttaaaagtaaattttaaagtttttttatttttttaacatagcttatttttaagtattagtttataaatcattgataacatagatataaaaattttacttggttgttttgtttatttttttaaggcttatcaatcgtaactgaaacaatcagatttcagactgtaggtttgaacctgctcggtattgtaaaatatttgtaatgtgggaatttttttttctatttcttccggagataaagttatgtaaacgaatttctatggaatacatgcataacgaggtctcggtctgtgagatgagcattactaccgaaaaatcatgatggcactaagaaatatctagctatgtggtcgaatttttttttagcaatgtctagatctttttttttttgggggggggggttctgaacttaccaagtggttcaatttgagctatggaaattttttaggccaatttgccaaggtcacattgttataaaagctataatttagggataatgccttctagttactcctaggtaatttctagttatccagtactccagaatatagtcaaaggggaaaaggggaaaagacataaatgacttttaacaatacttatgtttccaagcaatcttatacagtagaatatggacagttagacaccattcgtaatatatactagttgattccctgcgcgttgctgtgggcttattgagttatttcaaacctgaaaagttagtatgaaccaactgctttttatcactatcaatggtgtcaaaagagactcgtacatttatgtattaaagccttttggtttatgctaagtactaaattcaaaatgacatattagtgtgaattggatttcatgatagtcctggaaaagaactaccacggcaaacaacatactgtagatataaaaaaaatgaaaaatgaattatttgaatatcattgagatagagcatgaactgttgcaaatggaaatatgtataacctgcaatagtgcaatttcatcttgaatataatctgtaaacaatttctgttaactgaaattagccgattgaaatccccatcagtgcatggcatcgttcgtggtgtgtgtccagcagaggtttgcaggaattcggacagacttaacagggccggctcaccaacttggtccttatttctgtgtccagcaaggaagaagatctaacggtgccttgcatctgacaattgattgatcagacggctctaaaatcctgatgatgtggcttaacctggtgctttctttataggagttaatattgtagtgggtaccaactatataggaagaagggattgcaccaaaatcaaatcatgcccatggtcattttaatatgccataatcactgcccataaaacaaaatatctacatggccgtggtaagaggaagggctcttgtatttaaatttattaagacaggggtaaggcttgaagccagatcgaccatcacacaccttgtaataagagtcctaggcttttcttaaaaaaaaaaaagctaaaatatgcaaggtgaatccagataatctacagtgcaaaagcttgattctgcagctcaatggttggtagctcacacacacatagctggctagctaccaccaaatcggagttaaccactcgagacatgcaacggacccatgggatctgagttgacagttgttggtgctaattgctactgctacgaaaatatgtgatgtctttttccattattaccaaccatacattgccgttgtgcgtcgctgtcaggttgacaatgcaaccaagcgcctaaatgcatattccggcaaaaatgggttaaaattcctaggtccattttgatgtcaaaaatgggttaaacatctccatttcttcctccttatatttacttttcaaaaggcgttttgcggcctcctttggaataaaggaattttgcgatatttttgcaagaattgaataatgggaatttcagagggaaggaagaaggttggggaccatgatcatgataactagaaaatcaatgcacaagaacctcctgaaacgttaagcatcatctccttttttttgggctcgaatctcataccaaacatgcaaggacagaaaaagaagacaattcgatccttataatacactgatcttttcttcttcttcttcttcttcttcttcttcatcttcttttggggggaggggagagggggagggggcgattcaatgattttatgagcgtagaaattgcaggttatgtgttggttgtgtcgggtctccagttatttgcaggtttggtgattggtcataattgggtggatatgtttgttgaaattcaatcacaacaaaatcgtgcaggtggagtactggcacaagagagaaatgcaacaagaaactacaaaacaagcgtctagctgtgtgataagaggttggtctcatgctcttcgacagtacaagaactgttaaaactcgaaactcgttacaggttaatcatgtacatataagaactcgacgttgtttagtactaaagtggatggaaccagccactacacgaatacaaaaacttgtaaaatcatagtatattatttgccaagacagatcatagcagaagtacaatactgaagttctttgcgagacatgattttttcttactgaatgcctacactgtaaatattacagatgaaattgtgcagatactagcgtttacagaaatctggctatgcctttttcatgttaatattactagtaccaccagaaaaccatgatgaaatgtcgtcgtcgtcgtcgtcaccagattcaatctgctcaatgcttctcggaatacgaacggggcacgaaggccgattactttcttctgatacttctgttaggagccctttgtttctcctggacatttcgtccttccatttctccctctcaagaggatcttgagacatagcagtcctacccccaatgatgggaaaactttcaaggaacttgtaatccttctttattgggggaatgtttttgtcactgtggtaggccccttcctcctcggagctccagaagtctgaatcttcgtcagacaatggagccttattttgcagaatttgcctcctcgattggatgccatcttggataaatgaaatagcagaatgcttattatcatctaagtcacgttgtgattcaatactgtcttggttgttcaatgattttggtcttttccaaccacatttcaaacagaatgcattcctcttgaagttcaaataattacacctgtcatgaatcaatcgtatagttatcttggaaaattttttatagtaagcagaagataatcatgacactgaaagaccagacaaagccactaacatcattttgttgccaagttctcatattgatactaactattaagagaatgcaaatatgcagtgatatgtaacaaaaatgccactcacgagacacactcccattcccctggattgagttgacggtttgttggtttctcatggcactgaaggcatcttgtattctttgcaaaattcaaaaagttgcacctgaaaatataagatcagtacaggtgcaaaaagaagactattccaactccgagtcaatcttataaactagagatttgtgaaacctcaccttttgcatatccaatcaccctttttgagaggaagatgctcttggttctcatggagcagctgatacctctcttcaaattctccattgcagcgtaaacattttatattctttgcaaagttcaagaagttgcatctgacaataacatatgacattataaagcgtggcattatcacaaaatgtatatgtgattaaaaggctccaacatacttgggacaattccaatcaccctgcttcataggaatagaagattgtccttttggcatacggtgtgtgggcttttcagtgctggaaccaggacccatggaatcgaacccaacaatctcattaagtaggctcttaatggattctttaacggttttgtttagacatgctctgttctccacattgccagtaactgtgtcaagcccataagtcaaaaggatgcgcataacatccacagttcttccaatttcctccttccgagcctttacatatgccctctcgcatccaccccttaaattgcattggctgcagacctgtcagcataagctgatgctggagaaatgctatataacatatagatttataagcagcattaaaatactaattttgtcatcaaactattgtaagcatgcagaagtttcttctctccatttgtgatcctaattataatgttgcaatttttttcataacccaatggtttgaagattttattcagaaatactgctactaggcaattttctattcacaaacattggtaactgacaatttcaaaataaaagtaatagagaaaaatacagtacatgaaaataaataattgtgtatttattagttacctctccttcatcaaggcctacatgagcacgtaatcgcttcccagaattaacaaccttcctgtcaatgctggggcacccataccggagagcaacctggatatcccatcttgatagatgcctgcaacaaaaggggttcagctctatatgcaaggcacatgaatatcatacgccatttagaccacctcgagtgcatcaggctacctgaccaagaaaatgcaactatattgacggggcatttccacaaacacctcgcgtgcgtgcagctaaaccatagccctatcaatgacaatcgcatactcaagtgacaccggcgcaccggaacatccagagcaaagaagcacacacattggcgactcctacgagctgaagcatctcacctgataagctccggccgctctcgcccaaaccggaggcaggcggtgcggataacgttggaatccttggacggcgagccaaccgcgccgccggcgaacacggaggcgtcgaggtggcccctctgaaggaggagctccatcagcgccacccactccggccacgggtgcgcgatatccacggccaccggcgagcgcgcgcgctcgccaccttttggctcctctcttgtttccggtgacggtggctgtcggccgggctcacggccatccaaactcttgagcgaagaaaggcgagcctcgggtcccgcgggccggcgggctgaggtgggagaaccgccggagcgcccccgcggcggcggcggcggggccaacgcggtggcgcatcgcttgaaacttgcgcaaaagcaagcagccgtaaagccgtggacttgctggaaatggaaaattccaaccggttccaggacccggcccggttgagaaaactggcccaaccgggcccagttcagtacaaatagtttgggccgacaatagattttatcattgggctttttggcaccaattttgctatatattttgcgacaaatttcgagaatacttgtcctcgggcgatcgggcggggggagcaaaaatcgggcgctccccccacccccgcccccgcaggcagtgatgtcgttgggccccaccacaatacctgcccccacctgcaacaaatcaaccacatattttggaaatcctctattaagggaatttgattttttttttgttccacaaaaaatgtttcaccgagtgtactcacaatgttttactatgtatagatctaatgttgtagtgaactgaaatctttcattgcaacaaaaaaaacccacatattttggaaaccccctattaagggaattcgttttattttttgttccaccgaaaaatgtttcacctagtgtagttataatgttttactatgtatggattaaatgttgcagtgaactgaaacaatctttcgctatttgctgaaacattgttttcatataaggtgaaacaacactcaatttaaacgagtgaaatattttcgatctacttagtgaaacaattccgatataccaggtgtaacatcgtgcaacatttaaaaataattcaataataagctaaaaaaaatttcgtcggaatatatccatgtgtggtcttgtttttaagatttaattgcaacaaatttaatggtgcaatcagataatgatttggataagtaatttaagagataaatcagtttaaagaagtttgcatgacatcatcgcccgatttttctccaaatgatcgggcacctgagccgtagaggttcccaacaaattttctcttaaaaatttgacagatgtaattacagtacaatcatagtgtaattacactgttatcagggttatggataccacatacctaatagtagttgactaaatctcagcaggacccaccacttaccatgtcatatacggaaacaacctgcgaatataggaggagttccggataaggaaagacaaccagagttctatatggaaacgacaaagactactcggattgtatccatactggtttccctagttctacttggataaggggacataaatacaaggccccttaggaggagagggggacatcgacgacacacccaccacaatctacgggacaacagaggccacaacatacaaactaacatacgccaagacaagacgctggatatcgactttagagataagcacggctagtcccctacggtgtctccggatactgttaggagagacatagcgttatctctgatctcgccgagcacgaactcgaggaggaagactaccctgttgtcgactacgagtcagagcttcagaccgccatgtcgacaaacacttatataagctaccccaaatattgtaccggtgtgattatggtgaataagagcaatatcggcttcggccaacagaatgtagggttattacctgaccattcaagggcccgaacctgtataaaaatccctgtctctatcttttacctcagtctcgcgtatatcctagtaccaacgatccccatactatgcaaataccggaatcgcgacatcaaacgtcgacaactataacttgcatataattacacactttcaagaatctccccgtaacatgttttttgggtaaaatgaaggtcgtgggaacaaatcctctcacatatgtgtgctgtgattttttttcttcttcatcagaacaaatcttataatagatctaatgattcaaaattacatggaacttatatacaagttactgtgttatatacaagttatagtgtaattacactatgattgtactataattacatctgtcaaatttttaggagaaaatttgttgacaaatgtataggtgatcccttttggcacaacttcaactccaggtttttcttgagctgggaatttctagttacagacattgttgaagttggagatgggtgcaggttaagattgttagtaacacattgtgtatttatttcggactgaaataagagaattttgtagtttaagccactttagtttagtttataaaccctattttctataaggacgacttgtgcttgtattttttattgcacacgactttccctgtgtagaaatatcaagaagttggagacatcagacgtgctaaaacaaggcctaagttttcatttggataaaggcagatttttttttcttgttatgcaagtgcaaggtaggccacctaatatttgtgagaacagcaaaaaatccgtgcactgaaacggttttgaaactgccataacgtaagtagcatttgcgaagttattgtagcttgtttgtcacaattcacaattagagattcaaatggtctctcagaaaaaaccctacttatccaaatggcatgccaccaaggcaccaatgtttaacaaaattatcgtttggtacaaatgacattaagccatgaaattagcaagtggcagacacagttatggtcatgactcatcaaccactgattgaaaaggcaatacatgttcccttgcttggatcttcagaagaacagtcaatagcccagctgcccccaaacacaagcagcatatggaaacatcggctacaaaaggttctagtactagattcacaatcttgagcacaatagtggtactcatttctacactagtttttctcctaaagtgcgtcatacctactgtcaacaaaacaaaaggggcccttccaccttccagtgcgctaggcaaacatcatcgtcgtctctgaacgacatagaagacctcagaatgctcggcacttcagcttgtccatgagaaggtgcgcaacagactcgtaaccttgctcccgcgctgttgttaagggatccaaaaatagataggatttaggaccatcaagaacaacatgtatcatggtagaattagcattgacagtatggataagcctcatatatcaagttgtggacgcagaattaccgtcgtatatggcaattccagttggggataacttcctctttttcaagcagatggagctgcatagtttttatgaaaaatcgagcaagtgagcatagtcatacattccttcagtttgatattgggatgaaatatcaaagctttgtaagaatcatatacctgttacatatccagaatttcttggtacccttctcctcaatacagtgagggcacatccagttcttgttcttcctgacctcatccatgtctgataccacatctcaaaatcagaagctttaccaacacaataagctgaccaacaacaatggcatttcttgacagcatgaagcttaccttccccatacctcactttcaggcaagcacggcacagtattccataagaagaatggcaagaggagcaatccgtcttccctgtcaaagattgacacagaaaaggagttgactattgcaatcaagctgcacataataattgacaccaaaaaattgacctttttactgcttcttttttacctatgcaaggctggttcaggtctccttccccgcagcgcttgcagccctcctcgccgcacaatttcttctgcctaagatcacacgagaagagactttctcaacaaatcatacgaaaactatgaagaaattttctcaacaagtcacagtatgaaaactatggtacctagcattcttgattaagaacaagatgaggagcactaatcggtcgtaaatgttgacagtggggagaatctacctgcagaaatggcagcaaatcccaagaacagggtcgtacacggcgcccctccccttgctgtcacacctccgctcctgcaggatccgcaccctctccttgtcgatcaccaccatcgccttcttctcttcttgctcctcctcctcctcctcctcctctgcttcctccgcggcaaacttactcaaagatcctaagagagagagagcacaagaatttgttcccatctcaggcagccagatgccatggagattcagcatttcagcgaacgcggcagcgagagggaccaacctttcagagccagcgccttgtgctccgtcgtctgcccgttaagccggccggaacgggggggacccgacgcggatccggccggcgccgcggcggcgatggcgaccaatcggccggagcggcggagcggggtgaggacacgcggcggcttggggttcctcctcggggttgtgccaccgatcccggcgcggcggctggctgctgccgaggcggacgcggaggcggaggcgatggcactgaactccccggcgcagcggcgcaggccgagcatctccatccgtgcctgcggggactcgcccaagaatcagcgcggcgggcgagccattgccatcgcgtccgcgcgcgagagattcctcatccagagaggaaacccgaaagttgatgatcgaggagaaggatgcttaccaggttctcggagatgcgggcgtcgcggacgctctcgtagtcggacttgccgccgagactccccatggcggtggcggcgctcttcggttcggtggcggggcggcttccggagattttgctgcggttgtcgtggtggcttcgcgtggctggttagtttgaatgctactacgatatagagtaacggctagtttttgtgtctgtgtgttcaccggcgaaatgtggtcaccggccgtgtcatggtgataagtgatgacaaatttttcagctgctcttcagtttattaatccctcgttataattcgttttaactttcatcaaagttaaactactttaaatttaattaagtttgtagataaatattgtaatatttacgacatcaaattagtttctttaaatcaataattgaatatatttttataatatatttgtcttgagttaaaaatattacatttttttctacaaaactaatcaaacttggaactgtttgattttaaccaaagtcaaaatgacttataatctgaaacagggagagtaaacacaatcaaattttaaattctaacttgaaagttgtttttaatatttgttttcatcataatttatttttcaatattggatttcaagtcattaagaacacatatataaaatatgaattcatataattaaattttagttagaaataagtgtcacaatattacaattatttgtgggcgaaacgatgaataatgttgtctttattcttttttttcaatatgatgtttttcttttacccattttaccccatacaagcttgatagaaattagaaatatatatagtgataaggtaactgaataatttttgtgaagagaaaaattactactagtacccatatggtggatcaatactatggagtactacttaggctgcgttcgatctctttgtttttgagagagatttttgacacacgtaaaacgaaaaatcccattagcacgtgattaattaagattaataactatttgaatcttttaaataacttctatatagaatttttttaaaaaaacatatcatttaacagtttgaaaaacaacgaggaagttaaagtttcaagttgagaaataggagtataacttagccttactagtatctgggacaatagtacactggtacggatggattattggagcctctgtatattaacattcaatcgagttgatcgtgaggtcgaattggaataaaatttaaccatcttctagttcatttacactctaatttcaatatagttcatttacactctaaaatttctatgcaacaatcttttatttacagcaaggcaaacaacctgcccggttacacatgtttgtcctaccatcaccgtcttcttcatggtcactcagaaatatctccacgagctcatcccactcgctcctcgtcgacgacgattcgctgcgcaatgatgatgtcgtcgaagttctagggctactgaacggtgacgaggaggagagggtgtcgtcttcttgtggattccctgcactgagcttttggtggtctgcgagtgattccgtttctttcactctgagcatcttttgctgggatgggggtagtgtcaattcttcttgctccattaactgattggcaaccagaacatgcaggacagcaaacgaaagaaaagaaaaaaaggaacatgcgaagaaattaaacatcaggtaaaatgattaatgaaatcatgttgctaaggatgaacaacaacttggtaaagaaagccatgcaacatgttggttataccactttttctcctactctatacaatgaaacgggtattgtcttgtgccgattcgtaaaaagggaagaaagaataattgatcggttacaaagagggataatttttttttactattgacaggcaggcatgtgcaaagacgaaattactcacatccaaagccttttgagcctccttttcgatccaaataatcccgtggtcagaagtggcgttgcatgacaacaccacatgctcaaatctgccctctgctggcactgccgttctgacctgcggcggaagtctcccacatctgcatagcagccaatgtggatacaatgccaattaaaatcaagtgtaaatataacagctaatcttcggaagcttctaactaatgtctaatgccatactagcacacaaggattttgtttttttaattttaaaaaagttttaatttttggaattttggcccttaacctgcagttctccctctccacgatatgaaagactcttcctggagcgtagagtttagatgcatccttaagcttctcttctgacacaaacgtgtctctcatgcaaatgaaacacagcaggcacggcaaactgcaatgcaagaaacagaaaaaatggtgaatcacttgttctaaaaaaattggtgaatcaacagctggaacaaccagtaatcaacgccgttggaacacatggataacaagagtatttttagctgttttaattaccagaaaattgatccgaagatgtgttgcagaggcgctggagttcttggcaagaaatcgtcctgcatccaaattcaagaattgagtgtgcgattcgaattccaaaatcattgcaacgaaatgaatcgaggtcggattccgttcttattgcagaatgttcgataaacaatgctagaaatggacgcgatatcagctaaggggaaagaggcaacaatgttgttgggaggctaggcttgcctgtagcacgacggagtggacgacgtcggcgtactcgacggcgagaccgagcgacatgcaccgcggcggcgccatcgcgtagcacctcacgtcgccgcggcggaggccgagccgctccagccagcacctcaccgccacgacggccgcgagcgcggcgaccccggcgccgagcgagtggccgacgaacacgagcctgcaccccgccggcccggcctcccgcaccatccgccggatcgcggggccctcccggtcgagcagccacacggcggcgcggaggagcccgcggtgcgcgtgcccgcccgc

SEQ ID NO: 10801 - DNA, 24401 bp, Oryza sativa
  unsure (1)..(24401): unsure at all n locations
caagccgacggcaagttgaggaattcaaaaactctcgacttctggaagggagaaatcaaggtttgacatttgacattcgttgaatttttatcgtcattttgaaagtaaaatcgcacgactatacggttttgttcctcaggcttaaagatcaaaaaatttatcaatatttttgtcgaaaattaaaacaagatggaacagtcgtatacgtgtgtatcaaatactcccactacagttatgaggctcgagatgcaaacatatgttgggcgaacgtttctattaaaattaggcctttagattcacaattttttcttcaaactttcaacttttccatcacatcaaaaccaaatgtttggatacatgcatggagcattaaatgtggaaaaaaaaccaattacataatttacatgtaaatcacgagacaaatcttctgagcctaattacgacatgatttgacaatgtgatgctacagtaaaaatttactaatgacggtttaattaagcttaataaattcatctcgcggtttacagacagaatctgtaatttgttttgttattaatctacgtttaatactttaaatgtgtgtctgtatacttaaaaaagccttaggcagatgagtctattcaccttcgctgacctcgcccttagatcactagttcagtttcatagaaagtagttcagtttttattcattatacatcctccgttcaaaaataggtttagtttgtagacgtgactatctcgaaggatagttaaatgtaaactgcattcatgttttcttaggtcatgtttggtcatggagtaatctattaatccctccattttagtcacttttaatccttaagaatctaaatagggatgactaaaagggattaaaggtgtatattggaactaaaatctattagaccctcttagaggtatttataaggactaaaatgataaccactctcttttttctccctcggtctacgtgcttttagtcctttttactgaagttcctagatcaaaacagtaagggacaagtttaatatccagggactaaatgatctaaacatggccttacttatgggcttcattattggccatcgggcaaccaaatccacagagcttggctaaggccctgtttagtttacaaagaaaaacttttcaccctatcatatcgaattttggacacatatatggagtattaaatatagaaaaaataataattacacagattgcgtgtaaattgcgagacgaattttttaagcctaactgcgccataatttagcaatgtggtgctacagtaaacatttactagtggcggattaattaggcttaataaattcgtcttgcagtttacagacggaatctgtaatttgttttgttattatactatgtttaatactttaaatatgtgttcgtatatatgatatgacacttaaaaacttttcaccttgaaataaacatggcctaaccaaactatccatgcagaatctagcatatctagaatctagtataacctctgatattatggaagggaataaatttcattatgctcaactcttgacagaattgagttggtaaatatcaaagaaaaaaaatcaagtcctaattgttttctcaagcttatcaaagaccaattttgttccaagaagatagcaattgcatcaatgcacatgttatagatcatttttacagagaaatggcaaagattttagagtgatttatgcaagccatatctacaaagatcatttattttctattcatgtttacaaggttacctagatgtatttctcctttggtcagatgcatgcaagttgagatcaaaaggaagcacatggttggcacctccttggaaatcacctccaggaagctcacggttggcacctccatggagatcacctccaacctggtcatcctcctgatcagccgctgctgtttcttcagccactgcttcattgaggtttaggtatagcatgttcatctccatcatctaatgctatatttagatctaaagccatggatgtgtttttgcagagttatgaagggataaagtgggagggaaacttgtgtttttgcagagttatgaagtgataaagtgggagggaaacttcagatttgaaacttgtagggtttgttgtggtggggtgtgctaaatttgtattacatcccgccaataaagtggcgcttaactcttcattcaaattatttggcaccttggcgccctgtatctccatgtgtgtttgagtatggagtactaattatattttattaatgtgtggcagtagtaatactttatttgtaactaataattggatgtactagtactaaggttagtttagtcttttactctttattctaaaactaccttgggcttccagaatcccttcttcctgggacggagggagtagatctcagctcacaccggttcaccttagcaaaattaaaataattttcagatctactagaaaagtaaaagagaaattctctctttccaaattcaaaccatggaccgggaatctttgactctcccagaccgggccctgagctgagcatcagcagcaccactgcaccagtgaacaggctgactagcacaggctaccagcagcatggcacaatggcagcatctcgaatcctcgatgctggaaaccagaaactcccccggcccccacgccggaacagcaaacccactcgtcaggtctctctcaatcccgtccacacagcataccgacgaattgtcccgagttggattcaaatgtacatttcgaactataccctttcaaatgtatcatattttattcaatattactactactctgtcgttttagatttttgacattgtaatagagtatgattgacaatttgaattatatagagaagctgaaaatatttaaaaaaaacatgatccaatttaagagctagaaattgtaagagaagttaccattactagaaactcacttacaatttaaagcatgatccaatttaaagcgtacatattttatgtgatgtataactatacaatctatttagaaaataactgaaaattacaagctgaggaaccattttttttcatgtttttagaggctatagctacctaccaaaccagctagcttttagaatcttcgtctcctcaaacatgatccatatctgacagaagagtccattaaccctatcgggccacatgccatcatctctctcctcccccttcttcctcctccctctctctccattatctctccctttgtctccccttttccacctttggccgtatgcgaggagcagggctggagcagcggcggcggcgcaggtgtgcgaggttgggaggagccccctacccagcatctcagagagcagcgcgagtgtggcgagctggagactgtgggaggtgtggacgtggatggcggagctgtagaacatggtggttgggtccagcgtgaggcggaggagcgtgatggcgaggtcaagtaggccggatgcagcatacgtgtgctgcggacgaaagtccaccggctgctccaactcctgccccttgcagacggtcgaagaggagagagaggaaggaggaaagaggagagagaggatgatatgtgggtcctattttttttgaatgacaaatggatcccacatatatatttttttaattataatagaaccaaagcgccatgtcgacgccacagactaggtcaatactaccacgttagtgaaaacgccctccaaaactgccgagagagttaaactgcacctgttttaatagttgggggtcgagatatcctgtattatgtttcaaggatacgaatcagatttggtcactagttaagtccatgttcggttaatgcataagagtgagagattggaagtgatttattccacggctttttttttacaacagacaactttcattacccaacctgataaccaagccaaaaacatttattctacacctattgtgatgtggaataattctcctcaaacctctccagtccccttcaactccctccaaaccaaacaaggccgaagggagtcaaagtggacttatttccccgctgcaacgaaccccctctcctccggcccaccaaagccaccacactccctcgctgaccccagtggagctgctgtagcattagcatagccagtagcactgtagctgacccactactgccccagtcaagccgcggtctctctctcgtaccgtcccacccagaggcccgagccgtgagccgcaagggaaggggatgaggagggagagcacgcgccgcgcgccccgaccgaccggccgagtcctcctcctcctcggctcctctcctctctcctctctctacatctgcggccttgtccccactaccacgctctccctctctctctctctctctccttggggactcgcagtctcgctcgctcggacgcccccaccacctgttcgaccgaacgcctccccggcgggcggcgaggagatggtgttcaaggggaggttcttctcgtcccggcacaagtcgtcggagtcgtcgagccccacggacgggagcaacagcccgcggacgcccacctccgcgccgcccgcggcggggtcgccggcggcggggtcgtcgtcgtcgtcgtcccagatccgacaagaagaagcccaaatcggagacccccaggaaggcgcgacaaggctcttcggcggctccgcgtccgggtccgccgcctccaagggcggcgcgggggcggcgcctgcgtcggcctcgtcgagcccgtcggcgacgggaggaaggccgccgcggcgcagcttcgggatgggggcgcgggcggggcgtcggcggcggcgctgtcgcccatcctggcgtcctcgctgggcctcaaccggattaagacgagatccgggcccctgccgcaggaggggcaccgcatcgctgccgcgctcgggagcagtaatctatcgcgtgggcaggcgcaggcggacccgtcggctgcatcggctggcggcggcggcggcggcgggaggaaggctgaaagctcatgggcagattcgaccagtggcagccgggggaaagggaaagcggccgaacatccagcgcggggcgccacagcaacgagcctggaaggaaagagctctgcaaaaggttgttgatcctgcaagctgaacatcctttaaacttgttttccaggtttttgcatcatgatcctgcaagccggctacaggtttttggaagatagggggattagcttatcattgccaagctcttgcattgatagtaaggggagaacagcattaagcaattcaattcaagctcccttcagagcttaccgtgtcgacggtagttgttaaaaacagtaaaaacataataatttcaacttagatgtgttgagttataaggagattggcgcccatgattttcattttgccgcatggtgtctagatgctaaacttggaaccaccggtgctaacgtaagaatgattcttaccatttaagtaaggaatgcccgcctagttattaaaaggtgtagacaatttaaattcaaagctagtaattggttgctatttttagcagttgatcataagctattcctgcgatttcatgattgaagttaatgtaattgtgcgcacagcttctaattctatatacacagctcattggatatatgactggagtgaggtgttcatttgacttgtggcagattacttacttaaatacctgtttatgtctatcggagctatatccttcagtttaatttgctagttcttaaaaaaaacgaacttcttggagtccgcagcaaactctgtagtagtttgctgagaaatgttttactataaagattcatattgttgctacaactggctgaatttattctataatatgtgcttccggtgtttaatagtttctgctcctctcatatgaaaatgcatttctttttgtagccttgtccatagcacattctactttatcccatataacaatagctaacaatgtataatctgtgtgtctttttgtaacttgaaaatctgatatgtgtgtgcccaatctatctcatacacagttaaaccgaatgcattgcggaaccattctggagatttgaggactccaactcacataccagataatgtggtactgatgcttctacaagcccatttcacatttttaaattaaacaagcaatgacaaaaccatcttttgctcttttcttactcctcctatctgtactgtcatcttaatccacagtgtgcatatgatccctgtgaaacaccaaaggaatcggaatctccacgctttaaggccatcatgcaggctaccagtgctccaaggaagagagtccctgcagatataaaaagtttttcgcatgagttgaactccaagggggtccgaccattccctttttggaagcctcggggcatttacaacttgaaggtattctcaattcatggtcttcgtggatagtgattaatgaccttcatattgctatttatggagcaaaattaatcttgttttctgtcatcaacacaggaggtgttaaaagttattcaggtgagatttgagaaagcaaaggaggaggtaaattcagatttggcagtatttgcaggagacttggttggtgtaatggaaaagtacgcagattctcatcctgagtggaaggaaactttggaagatttgctcatacttgcacgtagctgctgtgtaatgacaccgggggagttttggcttcaatgtgaaggcatagtgcaagatttagatgatcatcgtcaggagctcccaatgggtgtgctgaagaaactgtacactcggatgctttttatccttacgagatgtacaagattgcttcaatttcacaaagagagtggctttgcggaggatgaagttgttatggatcaacgtgataagatcatacaatctgctgataggcagatattggctcaaccaggtgatgacactacaaccagaggcagcaaaagtgatgtacgaaaatcgtacagtcaagagcaacataatttaaaatggaagagaagccaggagataaagcctgttaagtttctttcaccgcttgatacaacagatgttaaaaaggaggttgagtctccaaccagggagcgtatatcttcctggaaaccttttccatcacctgtcccaaaaccccctaaagaccctacccctattaaagaggaatcacctaataagaaaacagatacaccccctgcagttagtagccaggctgaattgaacagtccagtggaatctacatcacatcaatctcttcctcccaagcatcaacacaaaacttcatggggtcactggtctgaccagccaaatatttctgaagaaggttcaataatgtgtcgcatatgtgaagaatatgtccctactcattatgtagaaaatcactcagcaatatgtgcaagtgctgacagatgtgatcaaaaaggtgtaagcgttgatgaacgtctaattagagttgctgaagcacttgaaaagttggtagaatcttatacacaaaaagaccttccaaatgctgttggcagtccagatgttgcaaaagtatcaaattcaagcatcaatgaagaatctgatggcccctctccaaaactctctgattggtctagaagaggctcagctgatatgcttgactacctccaggaggctgatagcactatttcactggatgacataaaaaaccttccttccatgacatgtaagactcgttttgggccaaaatctgatcatggaatggctacatcttcagcaggaagtatgacccctagatctccactaacaactccaagatctaatcacatagacatgcttttagctggccgaagtgcaattaatgagagcgatgatcttcctcaggtaagctctctcaatcacacatacatatattagatagttgattattttgctaggctaaactatagaaaatagtcggtgtttatttttgtacaaggtacaatgtgcaaagtgagcaaagctatggccatggtaaaatattttgtttgtttatgaaaatttagtttctcttgtgcagaatacgtttgttgaaaaggaatggtaataatgccactatttttccaatcaaccactgtgtcatgcgtatatatgatggttgggtggctggaacgaatgtgccatgtatgattgtgggcttagctgccactgccacacgttagatgtcgggccggattggttcagctttgctgctgctgcacagccgcagcactatagcagcttcatcacaaaacctgttattggtactgtagttacagctgcagctgcagcaagctataccaatcaagcccttcattagagatgctgttagttggttagtttgctttgttaccaagtatacctagagatggtgctgattagatggcatctactatctccaatgtcttagctgcacctttgggagctcaaggggatttgttttcttttaagaattaagcaagaagaaagattaaaaagttcactcctgtcatgtttacctccctttccaagcggactccccccttcacactggtcctcagtgtggtatttaccatataataatctaggttaggatcactatgcatcatctaccagtagtaaatgattttgtaatgtaatataatgcaagaagtgctgattaacagtgtccttcaatctgtgcagattgttgaacttgctgatattgcgcggtgcattgcaactactcctctagatgaagaaagggcactctccctattggttacctgcatagaagatctgcaagaaattgtcaatcgtaggaagcatgaggctctcacggtgcagacatttggcacacgtatagaaaaactccaccggtgagtctctgctgagttcactacacaagtggcttatcttagttgacattatactaaataagcacatgaaaataattcttgcaggtcacttttagcacttatattagtttccatttgtaatttcccttcacatttatataatttcttagggagaagtacctactgctttgtgattcggttgatatggacaaagttgattcagcgagtactgtaatggatgaagaagatgatgttgtccgtagcttacgagctagtcctgttcacccagtcaaggatcgtacttcgattgatgacttcgaaatcattaaacctatcagccgtggagcatttggacgtgttttcttggccaagaaaagaactacaggagacctctttgctataaaggtatttgttgccatatatttgttcccttatgtacccagacttgctttccttggttgtacctgtaatgttgtaggcattcttgaccaaaaaccaaaaatattgctatatgactatctttcagacgcaaaccagaattttagcatgcaaaaaaggggaaaggaaattgcttttgatgtaaatatgttgacttgccagtcttcttccccaaaactcaataaaacacactcaagaatatttgttcttgtcgatactcggcggtagttttgttcagttgataacccctgccattgtgatattattgcaatgatactttagaaagggccttgaggtttttcgtacatttatgcatacctttctaaacaacacatttctatgagaaccaccagctggaagtcattcattatttattatcaaggaccccttgtgatcaacatgacatggtcaaattattggattgaaaacttttgcaaaagaaaggaaatacctgtggaccttcaatgttcagagaaggaagattagagagatggtatttctcgcgtttgcttttttaatttgctcccagtttgactagttgaccacaaaaaagattaacaccttgatgtttatagtacacatcttcatatttgtagtacacctcttcatatttatagtactgtagtacactatccatactacaaaaacctggctgtaccacttgttccgctggttcatttggtacatgtggtcaatgttacgaattatatcacttgttctaaaattcattcgagaaagaaactgcactcgatttcattagttaggcatcccttgttttttaatcaaatctgcgtcttgttagataagtaacttatgtgattacaggatatgttaaaattatatgactgtttgcttttaaaaagttaactaatatggagtcggttccaatgggatccatttagttgctcccgttaaatcattatgctgttttggcactatcacattttggttcgataccctaccaaaagtttggtaatgccgtatctttggcaacttttggcactatcacattttggtagggtagagttggtaggtttggtttggtgccaatttgtgccaacaagagacaaatatatgggcaatgccaaagttttggtagtggcaaaattttgatggtgtgtttgcctgtttggtttggtagtttttgttttctagactatggtgtagactggacatgatattggactctaagtagttatttttacctgcattagtctccttgatagtcatagcttacttataaaaatgggatcagaatgacagtggagcggcccatcatgttcatgctttacttgtgacaacttgaccatcataggttttagattgaagtgactttagttcacatgaatgatgaattgactcctcacaaaaaaggaagtaatgataaattggtatagtaattttggttttgctgagcacacaacaccttgcctctgctcagcatgatagctctaagatgtaaagcaatagtttgggggcttgactgctaaactccctttattattagcttttgtttttcggtttgggatggatggggcatccatgtggtctaacaatagttgcttacttttgaaacaggtattaaggaaggcagatatgattcggaaaaatgctgttgagagtatattggctgaacgtgatatcttgattacagtgaggaatccttttgtggtgagtgaacttgcaaatgcgacccttcatcattgaaagctatactgtggttctgaattggttatgttcttttaaggttcgtttcttctattcttttacctcccgggaaaatttgtatctagtcatggagtacctgaatggaggggacctgtattctctactgagaaatttagggtgcttggatgaagatgttgctcgtatataccttgcagaagttgtaagtttcttttactaacaatttatttcttccattttcacttttcctttgtctgataatcattttattctgcaggtgctagctttggaatatttgcactctatgcacatagttcatagagatcttaaacctgacaacttattgatagctcatgacgggcatataaaggtatttatgtgtgcgcatgatcgttaagttttctctccatttttcttgttttatgttcaatgttagatactccctccttccaaaagtctaagtcctatttctttttgcaccaagaccaatatgtagttaactcattcatcatgtgacaaaaccaatgaacatgcaacctataaagtactaaaatgacttcttgggttccgataaaaaaattaatatagcatataatgactacaaataggacttagacttttggaaaaaccaaagaatgaaataggacttagacttttggaaggagggagtacatgataaactaaaaaatcattcacatgcctctcaaaggtaagcgcttttctgttctctgatgactagaagatatattcctatttttggttccagcaaccaaatgagatagtgatgtagcagttcatagcaattgccacaatggcatcatctagtgagagataaaataaacacatatcctatgagagttctgaggagaatcagtttttggagttttgaaactttttgaggtttcaaactgtgttgtatcaatgtcacgagttagcaaattggaaggaggaactcggcgaagattgtatttgaaagaggtgatcggacgtggccctggacctcgacggcgcggcggtgccgtgatccgcgacgcgcccttgaggcaggaacaatgaaatgagattgatctcaaattctgcttgcattaatcaacttccttacagcttaatatacccatctaagagataagatcataacaaatcatagggctaaactaacaaaccaatttagctaagaaaaaggatgctaacaaactactgttccgtatcttgctgtcgtcgccggcgccggacttagtgagtagtgacgtccccacatgacaatcaggcaatgcataaaaactttcatgtcatgacatgttggtttccacataaatcaaatatatgctgatttcagctagctcttttctaattaagtgaatccatatcttaatgaattgatgataatgctacacatatttccttctgagttttcatttcatttaacctgtaattcagcaataaatattgttttcgttctttttcgaatatgttcctttttaatgccttctatatgtcctgcttatcaatcttaattctccagttgacagattttgggttgtccaaggttggtctgatcaacagcacggatgatctatctggtcctgctgttagcgggtcttcgttgtatggagatgatgaacctcagatgagcgaatttgaggaaatggatcaccgagcacggagacaaaagcgctctgctgtcggaactcctgattatttagcaccggaaatccttttggggacaggacatggtaaaatgcccgacatagttttctttcaacctctgcattgtcttctcgttttgactctcttgagtactgattgtccttgcaggtactagtgctgattggtggtctgtgggtgttatactttttgaattaattgttggaatacctccattcaacgcagaacacccccaggtatcagactttcatgtactgaatatttctctgccatttatgtgacgttgagtaaagttctttcattaagcatgcaaagctcccgttcagatctcttgagaatatgagagaaagaggtcttctagaaaatacatgggttttggtctgctagaaaacacatgggttttcatctatttaatgcaaaatgtcgctatataagtcaatgttgttttttgctgtattgaaactgtggcaacttgacattcttgttgtatttggtgtagacaattttcgacaacattctgaaccgcaaaataccttggccacatgtcccagaagagatgagttctgaagctcaggatctaattgacaagtaagaaatgtttcgagtattctgaatacacagtaactcatgtttcagtcttacaggattgcatgttactatttcttgcttccaagttttaatgtgatagatgattatgctagattgcacagcttttacgtcacttttagggtcaatggaccaattatataataaattgttgtctttatactgcattttcctttgtgttatcccaatgacaagcatgaaatttctatactaaagtcaatagggtttttgccatgatcatcaccatcaataacaattgaagtgagctccctcatttgtactgtaaaatcaccacccaaaagttgctcgtatcagcattgtgaattaatgtacgtcagattgttagctgtattattcaggttccaaataacacaaatgaatgttggggttaattaggattttgggtcaaactaggcagggacacatctgctctaaaatattacattttcttgcttgataacttggtactcgctatattttatattgccataggtcagtccctatcttttttccagtttcagcttatagggtaacagtagcacactgctatattatatgtgttcagttgtgttctatggtttatagcatctgtttgctcaaaggtagaactattcaatatgatttgtatttttggaatctttacgcatgcaatttaagcatattattacaatactccctatctacttcatgctcaatttcaaaatcctttgtgaagtttattgtggttatgttttttatgtaactaatgtgatattatgactgctttacccagattattgacagaagaccctcaccaacggctaggtgcaaatggcgcctctgaggtattttgacttttgagggttttagaaaccttcatccgttgtatggattattcaaaacttcttatgatacataaatgattgatgcttataatcctattcccttcaggttaagcagcatcaattttttaaagacattagctgggatacccttgctaggcaaaaggtgggatatggttaactatttattctttaaacatagttgcatctccattgtaaaggtgtaccgaggataacacggaatcatatgcaggctgcctttgtcccctcctcagatagtgcatttgacacgagctacttcaccagccgttattcttggaatccatcggacgaaaacatctatgaagcatacgaatttgaggattccagtgataatggaagccttagtggcagcagtagctgtgtgagcaatcaccaagatgatatggtatgaatcatcagcatttatataagtagaggaaaagaaaactacaatttgtttgtctgcctttttattcttcagtcattttactaaacaattgtgcaaattgtgcaaatagggggatgagtctagtggcttcactgagtttgaatctagctcaaatgtcaactattctttcagcaatttctcattcaaggtaatcctacagtttcacatatttatatccttaaaataattgaagcatgatggtgttatcacggtggataacctattcctttttttctttacaatttctcagtcaaagtaagcctacggcttcacagtccacctattttgtttcatgttcataatgtgattgattgaagcatgagtaaccatgatggatccttttttaaaatgaacgtgtaatgtgtaatgcatgtccttcacttacgggcagaaaagtttacccacagctccttacatttcccttgtatttactcacgaacaggtcctcagtatttgcattaccaagcagtaataacacctttttcagttacaatatgcttcaaatcatagtagtcacatctctacttcgctagacacagtactgtaatatagctcaaaccattggaataacttcgctagatatttaatgctattggtatgaatcatactagtaatccgtcagtcaacttatatgctcacaacttcacaagcacgtgctttgtaaaatgtagtttgatgattcccttgaatgtggcaaaattgttccacacagtaaacgatagtacaatgttcattataaaatagcacctagatccttgtgatacataatctaaaaatccactgaatattttatcactgatggctcactgacatgtgggccagcgagacaatgagtggaaaaaaggaattgggcaaagtgtcgacaaagacaaaccaaagttcttagtgtctagcagtccaacaaaacaaatacatattcttttttattctcattaaatttgtgattgtcacgtttcattgacagtatcaatccttaaaagtaggggtagaaaacttattgttagcccatttgtgcctatattctgcacaccgttctaacttcttttgctgcagaatctatcacaacttgtctctatcaattacgatttgctcaccaaaggattgaaggatgatccaccaacgaaatctgagacgtagcagttcgtgttatatcggaatttattcatttgaagtaaccaaacaatttacaaggtgctcgcgtggtgtagatcttgtacatgtaagtatttccagttcttctatgagcagtcaaatgtcatattgtgatgctgtttcatggtttaatccagtagtaactacaaatgttgcagatgaaagtgtgaggcatgggcttgttcctattgaggttgttcctacatttcgcggagccgagtacagttttgatgttgcttgttttcgaacaattcccgtgtcatcatcgatgaaacatccttgaccataagttggaatgcgtcacctaggagcgctgtttttttcccttctcttaccgcacttcatcggccttgggtgccaccaagatttggtcaaggttactgtatgcaaatagaacccttgaagatgtagatggtctgagcaatttttcattgtggcatgtgattgggaatgaccgaatgaagttcctgtcatctcggaggtatccctgtactcggaactatcaacacttcaaaataccattcactgggtataaatctggttaaatagcagtgctcaaattttctcggggcaagtatactgctctgtttggttcgcttggttagtcaatggattcactgtatctttaccaatcgagggaactcgggagactgcgcggtcttgagttcttttctcgtagagaatggtgaatgcctaagttttgcagtggaggtggctattacgtctaatttcattcctgttaacaaccaataaattatgaggtaatatgtataatgtaggtttgctactactccctctgtcatataataatataagggattttgagtttttgcttgcaacgtttgacaacttgtcttatttaaatttttttgaaattattaattattttatttgtgacttacttgattatctaaagtactttaagcacaatttttcgttttttatatttgcaaaaagaatttaaataaaacaagtggttaaacgttgcaagtaaaaaactgacatacaaccccttgcctctaaggcctttcacagtgaccatccacgtaggagattctcatacacgtacacaaatgctgggtctcgcgatgcatttcgcatccctacggcaatctgaaatgagtatgcctcgccaaaattttagtgtacaagtgttcattttgcggaccttgtgttcgtttcggatggttgggaaccaaactcctccgcgcgaaaaacatagcaatcaattagcacgtgattatttagttattagtttttttaaaaaaatagaataatatgattttttttaaacaactttcatatagaaacttttaaaaaaaacgcaccaaaatagcagtttgaaaagcgtgcgcgcggaaaacgagaaataggagttgggaaaaggggaacaaactgagcaaaggatttcaaatccttctgaattctgatcacgcatgagcatgactgctcatctgacctctttggctctttaccacaatcagctttagctaatactactccctccgttccaaaataagtgcaattttatactattcacgtttaatgtttaaccgtttgccttatttaaattttttttataattagtatttttattgctattagatgataaaacatgaatagtactttgtgactaaatatttttaaaattttcaaataagacggacggtcaaatattgggcacgaatatcaatggctgcacttattttgggacggaggtagcacgagtgctcggcacggcatgagcaaccagaacgtgaaccaaacaagctgcagtctcgagctcaagaacaagatagccagaaattcatatagaccattagaccaggaattgggactgcgaatttgtcccagcttcatctcgaactagttaagaaaaaattctccttaaaaaaactaatcactggatttgataacttggtcataacctgaaagtcccaacagaaaatgatttgaaacgacaacagaaaacctctcaagatgagctcttaccgggagtcacagcgctactgatacgcacccatttatcgcaaaatttggaatcctggtgctgacaagagtacacccctcaaaccatacgagcctttcttatacaccttttcatttttgcagttagcaaacaatgccatatctcctagaagctgaacatgtatgatttatggaacaggttgaaatggcataggttgagggcataaaggatttgagggaagtaagagagctcatatgagcaccgtaaggtccaaaatgcagtttcaggttaataatctttagaaaacagaaacacttcggttatgtgcaattagcacccgcgaaaaacagcatgattgaggattggacatgtggcccaaagtaatgtgattctttagggtatgttctatactacactttaccaacttcttctccctcgttttccaagcacatacaatgtttttggcaaactgctaaaccatgcgttaaagtacttaattaataatgcactaataagccaccccgttttccatgcacggggaagaggttcctaaacccttctcccgaacacaccattacttgtcataattcaagcaaaggcataaaaaaaatatttcaaaatcacttgtcatgtcaaagcatggccattttttagaccacaatcgtagaagtgatcaaaaagctcattctaaggtgactactggttctcattgaactcatgcctgcagtttgcgcacttatagaaaacagtttgcccctcatctgctgaccgtaactgcaattacacatttttcataaagtagttaagcatcaaagctagaaaaaggaaaattaagcttattgaacatcaaatgttcaaggatcgatagctgacctgcttggtgtaatactgaagttcaggatttttgcatttttcacactctttatttacctaatgcagaaaaggatttatgaatatgtgcagaactacaaaatactatcagactatatattgatgaaaaagcttaacttactgtagctctttcgacaattacgtcttcctccttcagtgttgtttcaagaatcacatatggatcaagttttagctctcttctaatatcctgtcaacagcatgcaaaatgtcaactacatataaatagccatggaaatcttctttcatatctgatataaatggttgggacaagattcaagaaaccgcacagttcattaaaaaggcaggacctgtggtccataaaattaaaatgttcatttggcaccttttaggtgctatgtctttgttaagtactagaagtgtacaagtatggagcataggacttaatcagagactcagagtagcctacaaatgccaagccagaaaatcactatacatcttaccttgctgctccataagatgtttgcctacaactcatactattccattaccacagttgattcatgcatgtgaaagcatgaggatattgccatttgagtcatctcagcacataaaataaaatctcagaccaatactccctccgtttcaaaatataaggatttctaggattcaaatgttgtaccacaatataagcatttctgcactgattcccatcacttcaatgatcgcagagccaatcagatgcttcagaagggaatctaagaaaatcaaagttaaaaattgacaactgcaatgaataaagaaaaaaaaaatcttttgacctaatcttagtagagtacttgctaaacaacctagaaatccttatattttggaacagagggagtagctcccaagagatgcattgcattatcccaaggaaggcagcatggatatttgtaaaactaaaaatctactaaagtgcactgccatgtagattcaataatcaccaagccattcctctatatgaaatacgatactgaagcacgacacagtgaaaccgtccttttacctaaaccacaagactggattgctccaccgcacaaccatatatactcctcgcgtaaatcaaactaaactatatctcctaggattactacactgaatgaatcgcattatggattttagatacttgaggggaaacaaaatcggtcgcgactgaaacagacgagcccagggtttcgcgcgagctagagggtagagcaatcggccgcacctcagccgtgaccgtgtaccgcgtctccttcccttcgatatctgcgccgtaaaaaaagagaacgaaggcatcagccgcaagaagaacacagcccagggctttgcagggagagagatggggaagacgacgacctttggccttgcgcttgaagccgcaaagggggcaagaggcggagcggacggagtcgaatttgaggagggtgccgcacacgccgcagaagaggaagtcccgcgcctgccagaaggccatgccgccgccgccgccgtcgccggcgaagtgttccttctcctctagtctgtggttggctggcgatggtggcttgggccgatcaaaacggcaggcgtgttttagggttttttttttctaggtgggctcatgggatgggctgatgggcctacgaactcttgtttttctcgccgaatccttttgggaaaagtacaccgaaggtccctcaacttgtcaacgggataaaaaaacatcttaaccgcaaaaccagatatacagggtctcttaactgtacagaaccagaggtgcttcggcggttttgatcccggatttggcctacgtggtggctgagttagcgtgggacccacgtgggtcccacatgtcagtatatcttttccctcctctcccttttctgctgtttctctctctcacacactcttctctccgacggccgacgatgcagcacggaagaaggggagggtgcgaaaagggcaagccgccgccgccgggtgaacccggtggcgggctcgtcctccccgatcacactctccggcatggggaaaggatggcgcaggcggcggaccgcgcgggagaccagcggcaggcggtcgtggatgcggcgctcacccggggctgggctgcccgcgcggtcgtggttgncggcgggtaaggtgttgncgccgagtgcacccgggaatcgatggagcaaaggcggcggcggtcgtggtccgcgagtccatgcagctgcgttcgttctgggggattggattcggtcgtcagctgcgttcgttgctttgatcgaaccaaggccacgcgattccgttccgatcgacttgttccatttcatctactgtctcaatcagttcagttgttgaggcgcatttgatttttgatttgggtcgaaaatttgatggctcaatctgatctgagttttgggatggatggatggatggatgcgtgcagggcaacggaggacagggagaggaggagatggttgagccaggggagcgcgggagggggagtggcggcctcctccggggtcgccgtcaacatcaccaccgggcccatgacggagacggaggacgacatggccgtcgccgaggaggaggaggtggtggcggcgtcggcggagacggaggagcacgtgcagcgcatcctcctcgccattgacgccttcactcgccaggtccacctctcttcattcaatgatttcgctatttgtcattctgaattttttatcgatcgatgagattgcaatgccaatgcaggtgtcggagatgctggaagcggggcatgagctggtcaagaacctcgccgccgacttcaaggatcgcctctgctcgtaagaccaccaatcataagcatggccatggacacacacacccgctaataaaataattggtttggttggttgcttgatgacgagcagcataatcaatcgatgcaatctggtttggttgtgaatttggcgtgtgcaggatccacaaagagaagaaaaggtggagaggtgggaagactagatccgggagctgcgcgcccgtgacgtcgccaatgagcaggcacgcttccttcgccgncaccgctctcgtctgccgacgtcgtatcgttccagcccgccgatgccgcaccgatctcgcccgccgacgccgacttttcagaaccgtgctcgcccgacaccgtcaacgtttcgactgctctggccgccaatctggtgcggcgacggcgcccggttgaagaggtgccccttgggccggcctgcgccgttggcttcgggcgggttggccagtcgccagaagataagagaagagtgagagagagagagagaggagaaagggagagggtgatgacgtgcccagctgatatgtggggtccacgtaggtcccacgctgactcagccgtcaagtagactaaaacacggataaaaaccgcggaagggcctctgatgactagttttgtatagttaacggacccagcatatttggttttacggttcaaggatgttttgtatcccattgccaagttgagggaccttcggtgtactttttccaatccttttctcgcgcagaacgcggcccactgaagtaatggactgcacgttaaataaatctctttttatctttttacatgcgcatagttgtttaaaaaaatgaagaaaataaccccagtaaataagcgcatcatttttatactgcatcgggaaaatgagttattctaatttgtgacagaattagcatttgtttccaataaatgagtagaagcatttatttggaaagagcaaacggggatttaaaaaaaatgaaatgactaaagttttttttataataatacgcacatgtaacatggatatgcgttctctaacacattctttgcataatagacaaagactaaccataaatccctaatccctaatgtgagtaaaatactattaaaaacgcaaattgtgtgcgagtatctatatataaaacggtatgaacagagttgaaaaggtctaaagatgttcttacacttggcatgaacattcaaggttttagttatagtaaatatcatggacattcggctacctatatcatgtttggtatagattcatatctcagatccacagaaaaaaataagtttgcatgttatagatatttaaaattttaaatttcatttgaaatgaaagcagaatgttttattcaaatgttatcaacgtaatcatagttctagatctatggatttattaagttagatcaagttttatagtagaggcagtgatcagctcttatttatcgatattatatactcttaaatttaaaaactaacatatacagtatattgcctgtaggacactagtcccaatatatttttcaccaatcaatttatctctttctctattatttttagagtttctatggaggttgttccttgcataagaagtggatactctagtcatctctctattctttttctctcctccacgttattatctaagtttacatgatatattgggcttgtgtttagaggcttctagtacttgctcttaggaaaatctaactcaaaatttttttgaatttaaagctgtacaaagagagcaccagttaccgcaaattatgagcctccgctgatcaaagtaaataggcactcaaacgatattgaccccttcagagcttaaaagtttttttaataaagaaaccagagattaaataaaatccactattagccaaactagtaacaaaaaaaggatcaaccagctgttgctaccacgcaacaccaccaccgttacaagtcacgtgaaaacgaccgccaaactcgccagcatctgatgagactatcctttgcccagttgacactttcacaaaccacaaaccagatgcgaccatacgagccaattagccaaaccactttaccactcaaacaatgcttatcactgtatatattaatcctactagtatactaatcaccagctcactgaaccgagccggccgaaccagcccgatcagaccggagtaagaccggagactaagaccggactgagagggtatgtttgcagaagttttcgtagctgcagtttcttctaaaatcctcagctgctagaggctctcttaaacaatttaggttcttatttagattttaagaaattatagttgtagaattcataaaatgaattagaaactagaagaagctgagtttcctagcttatccaaattattaccaactactacatccgtcatattttaaatgcaaccataagtttccgtacctaactttttataattagtatttttattattataagataataaaatatgaatagtactttatgcatgacttatgtttttaatttttttaaaaaataaataagacaagcgatcaaagctaggtacaagactgcacgacaaaggagcttctcattagctgtttttttctctcttttaaattgagttttttttagtacatagggagtagaatttaagcttgcgaatagactaaggggctgtttgggagagaggggctaaactctctctctctctctctaaaaaaaaaagaagttcctatcccaaacaccccctaaaccggaccggagtcacaggaggagtagagcgtgcagccgcgaccggtcgtccggcccggtaccacccgacagattccttgtctaaactgtacttgcattccattcccccccacatccacaagaccacaaccacaaccccccttctcctctcagatccgcgtcgcggcggccccaaatcccacacgcgcacagcgcagcaccaacgccggaaggagacagcgcccctcgcccccgccaccccaaccctacgagagggagggagccagccagccagccagccaggcatggccacctccacttccactggccaccgcgccgccgacctcgtcctcccctcctaccccgaggcacgctctctttctaaaccctagctgttcctggccagatgcccagatctgtggcggaattgaccgggtttcttgggttgccttctccttctctttgctgcagatg

SEQ ID NO: 10802 - DNA, 1911 bp, Oryza sativa
cagttcgtggtgttgctgctacccttttgtcgccggagcagcctttgcttcccggtggtgtatcctgtatctgttgtcacgcacgcccagaaattgcaatgcaatttttagttgatcgttttgattcgggggagatactgtccgggtttgtgcttcttgtttcagtgtatgactgtattgatcattgatcattttagcttctgcctagatcttttgacattgtagtggttgatttcaagcaagaactgcaaaggactcactgcttccctgttgtttgctgttgttcctgctgcaaaattgatgatggtcaatgctcattgtcttcagcttgatccataaggatgatcaatgcccatcgtcttcagcttgatccctcctatggaataaggattttcggaggattttctcacgggaattgaactagttccggtgaaaatcctgtacagttactagctttcaaaggtgacccgagttttgttgatgaagtgtcccaatatcgttgcttagcgtgtcttgagctgtcaatctattcgtttcgtctcctggtagaaatgtctgagctgttggcgtgtgaagttacagtgtgatgaaccgcggatgttacagttggactgtcgaaagacctgaacgcaatctgcagcatcaatctgataaattcggacagacttacggacaagaacacgaccgaaatcgcggtcactcgctcgctcacctgctcggcgaccaatttttccacgcaaatttcctgtaccacagacgatgcggagaatctgagaatgcgatgtctctctctcttttgcttttggaccgaaactgagcgatcagcctgctgacgcggagaaagaaagaaggcctccttccatccacgacgacaacgaggaggatctcaatcagtttctccaatctccaccggataagatgcataacaatggtgatgatgatgatcaaagttgttgtgtgctcatgtgctgccgggtgatggcgacactgaagacgaggtcctaggttcgtcatgggcgtgccttcacgcagcagcagcagctgtcgcaggtggaggtaggtagggtccctgggcactcggggggcatcacacattcacggggtctgtctcacgcttgcctgtcaggctgtcacgcaaaaaaaaaaactaagatatatctccgttttaaaataaattaaactaaggatatatcaatatttgttatactttctctatttcaaaaaataagtatttatagggttaatatagatattaagaaaatatgtaagaatgattagaggaagggtgtaattggttaagaagataaaaatgggtgaaagaaaatggttgtgactggttgataggaggagatatgtggagaaatatctttattttgcgacaaggtactgtcatataaataacacattatttattttagtgtagtttatttcggaacggatggatggagtgctgggcaaaatctgttccagctgttgattacactacttgattgtgtttagctgataagttctctcagggattagtcatcagtgagtgcttcttgctgtgggtaggtgacttttgtttatggtgaagtcgtagcagcctttggaaacgggcgaagtttgttgggaattttcagcggtgtttggctgcattcacaggctgttacgtgcccacgtccatgttcctgccgtttcaggagggggcatgtgttcagaacgcttctcctgggcagtactccgccgctggattaggctgcgttcggaagcctggcttcccaacctgatgcgttcatcgaaccgtccattagcgtgtggttaattaagtatttgttaattttttaaaaaacgaatcaatatgattttttaagcaactttcgtattgaagctttttttaaaaaaaacaccgtttagcagtttgaaaagcat

SEQ ID NO: 10803 - DNA, 8552 bp, Oryza sativa
  unsure (1)..(8552): unsure at all n locations
nnnnnnnnnnnnnnnnnnnnnnnnnnnnnnnnnnnnnnnnnnnnnnnnnnnnnnnnnatactgtaaaagggtattgatggttatcgtttttatgtaattgattaacttcaataaaatttgttattatgtaaaaaatatttaatgttgtcaatttcttttcttgttgagtcgtcgatagtcttggttgtgaagggttgaaggaccatagcatattatgtgctatgaagtgagtgtttcgagagcctgaaagtttcagtattagagtgagatttcattgatcgaggcgcgaaaaccagacgggatttgaaatccaatattcgagtttagatgacttctttgcttacaatggattggatcgaggggggtaacttatccggtattaaaagttcatggtgagagatatctggtttttgagtttagggggtaattcggtcaaccacgatagtacggggtgggtgagggggtaattcgtactctttccaaagctaattgaccagacgcggtttttgacttttttcactatttttttagtttagaaattaaatattctcatctccaatttcagttgatagtttttttaaatttgagttgaatattttgaattttggtatgaaagttttcaaattttatttgaacgttctgaattttaagatgaaagtttttaattttgatttaaaagttttcatacctgagttgatatttttcaaatattgatctgattttgtttcaaatccaaaaagctttcaaaattttagttaaaagtttttaaatttgagttaaggtttaaaatcttcacttgaaagtttttaaaactaagttaaaagttttaaatcttgacttgcaatttttttaaacctaaggcctagtttagttcccaacttttttcttcaaacttccaacttttacatcacatcaaaactttctacacataaactttcaactttttcatcacatcgttccaattttagcttattatatatatatatatatatatatatatatatatatatatatatatgtatgtatgtatgtatgtatgtatgtatgtatgtatggtccaaacttcaaagagagcagcatgcaatcaattgctaaagttgggaagttagttttcttgacgttgggacgtttgaacctccgtcacgacgcaaaacaacatgtctaattaaagtcactaatcctaatcctctacactgaagctttggtgtaccatcaaaaatctgtcttaagaaatcattgacacaacagaagcatagggtgtttgcttaatttctactatactttcctaactttttaaaagcagctattcaatcatgccatggtttaatatttactatcttgcctaagacgtggccactctttaaacaaaattttggcaagatggtgggcttatttagtttgctaccatgacaaaatattagcaatgtcaacacatgcaaatttcagtactgccaatttgtttttatctactaattgaatatatatgttttgctacggataaaagaaaatacattacaatattttctaaaataaatttttcatgaaatgtgttactcattccttttctataggaaatattccccttattttgattttatatatggatattgtcaacgggggatacccgtagaccagataaatagggtattagggtatgttggtacgatgatctatacgatacgacattaaaatagacaaaatacaatgattatattggttaaggcccctcgtaaaataataaccctaattcagtttatatgggattgatatggaagaccacagaatacagagagaacatacgaactcgttgagaccgacgagaccctagtcgagattgttcgatgagatctcccggcggcttcagcttgggtccttcggcttcgaaaactatggtcggcgtgttggcgctatgattcgataatccagaacccctccaggggtatgccttttataccgtggattgccttagtctccaagttgaactcggaaacaatgaaccctgcacgatatagaatagtcctagtccttcccgagtaggactctagtagtctccagctcataaggatatttcctataatattttatatatgtccttatcgcatatagaaacatatcttgggatatgaggtataccgatctaatatacttggttaattgtaggatacgagatatgtcttatccgtaatcctgacagatattcatttagatttgattgtttcttaatattaatacatttaataaagggtattttgtaaaatttataatgagagtaggtgatgtggcaagttcactacgagcactaacttttttaaaaaagcaatatagacatgtgttattggaacactttaatagcaaaccaaacactaaccaaagtgctttttaataggaactaaagtacttttaaggtatcaataatttggtaaggcatatatttttttgaaacacagtacaaacacaagcatttataacgtgcacacggcactcaccttacctttatgagcacctccgaaagattgggtcggtaagattgacgaagtcaccacgagcatttcattgttggcgggttcattatctatcactggaaaataataactagccataattataagcactaacgtcaagactaggacttaaacttagggggttggttttaccacaagaaatttagccggttgaactacaataatatcaaatcaaaatgggccaactacactaatatcaaatcaaaatgggccaactacgctgatatcaaatcaaaatgggcgtctggccaatttgattgatacaacaagcattcttttcatccaaaaataaatcaacataggttcaaagtggtatttcacctgataccaacatactgagtgacattttatccggtgcatcatattgagtggcattttatcgaatccccacgtatagagtggcatattgtccgttctctcggttctggtgtttaggaaaacagggaaatgcatccgccgttgattgcaccttgaacggctaagatcggaagtgactgcttaagtggcaatctcacaaccatgccatcctctctctctctctcctccctccaccccgccccagatccagcgcctcccctttcctccgctcgtctccgcctccggggctaggggttcgcctccgccgccgcgcccgccgtcgccggagacgacgatcaggggcgggagggccaagcgaagatgctgaccaagttcgagacgaagagcaaccgggtgaaggggctgagctttcacccgcggcggccatggatcctggccagcctccacagcggggtgatccagatgtgggactaccgcatgggcaccctcctcgaccgcttcgacgagcacgacggccccgtacgcggcgttcacttccacgccacgcagccgctctttgtctccggaggtgagtagacccgctagatctctctccctcgcggggcggcgggcatgggcttcgtggcgtgttgcttgtttcgctcggatcctgccctggatcggaggacgtctcgaggcctctagttgtctctgtgatccgattagatcgcgtttgatttggagtggtggttggttgtcaaggatcctggttggtgggttgggttagtcggatctagtgcttgcgagctttatcatatctgcttacgctgaactgttcggtggattgttggtttgtaaccttcaggggccatttggttcatgtttatgaccagcaggatggcaggatctccatcgattttacaatcttttcaaacatgagagtcgatctatagctttaactgaagagtagcagcttccatggttgtatttctgataccatagcaatggtggggttggcaatcatggaacatttggattgttggaacttgaaactaagtcacacaccagtttcatctgtattgttggcataacagtggcccatatgatttggaactgtcataaaataagatcgaacaactcctgaactcttctaagttttccgtgatgcattgcaggtgatgattacaagattaaggtatggaattacaagacacaccgttgcctcttcacgcttcatggccaccttgactacattcgcacggtgcaattccaccacgagtgcccgtggatcgtaagtgccagtgatgaccagacaatccggatctggaactggcagtcacgcacatgtgtggctgtgctcactgggcataaccattatgtcatgtgtgcatctttccaccctaaggaggatctggttgtttcagcatctcttgatcagactgtccgtgtctgggatattagtgctttgaggaagaagtcagtgtcacctgcggatgacatcctgcgtctcacccagatgaacacagatctgtttggaggtgttgacgcggttgtaaaatatgtgttggaagggcatgatcgtggggtcaactgggcttcatttcatcccacgttgccactaattgtttctggggcagatgatcggcaagtgaagatatggagaatgaatggtaatactgctactacatccttttttttccttagataaacaacttcattatttttgtttgcatccatcatttttcatagaacagagctacagaattatgcatctgcttttattatgaattattttgtgttccttgatttgtctttctttgacagaagaactaattagcgtttcccccatgtctacattaatctgaactaacttgtcagcaaacaagcagaatgcaagagatgtttccagttagtaaactagtgccagtaggactaaaggtggttattgttgctgtatagcactttacttttctgtatattgttcaaacttaaaaaaaataaaaagtatatgcatgccagcaatcaaaatatttgaactagctaaataaccatgcattgctacttgcaacaggcaagatgaattgtacatgtgctaatattgtttgaaacaaatgaattatgactttttcattcaacacacccttcatctttgttattctaggtacaagtagcactaatgatttttacattactctacatatatatgtgtcagttttaccaccgtagacctttctgtgataaacttgatttagagatgagaataagatattaacaaactaaagaacttcaaggaagtaaaaaagatgtgctgcaaactttgtggggtgtggaacattcacttccactatcaccattgcattatttaaagggataataggtgatgcaatctaaatgtgctgttttttgacagacaccaaggcttgggaagttgatactttgcgggggcacatgaataacgtgtcctgtgtgatgttccatgcaaagcaagacatcatagtgtccaactcagaggacaaaagcattcgcatctgggatgccacaaagcgaaccggtattcaaacgttcaggcgggagcatgatcgtttctggattctttctgctcaccctgagatgaatcttcttgccgctggtcatgacagtggtatgattgtgtttaaattggagagggaacgtccagctttctctgtgagtggagatactgttttctatgtgaaggaccgttttcttcgtttttttgaattcaccacacagaaggaagttcagcttgctccaataagaagacctggatcagtgagcttgaaccagtcacccaagacactatcttacagtccaactgaaaatgctgtcctgatttgctctgatgtggatggaggctcatacgaactctacattgttcccaaggattctgctggcagggctgactatttgcaggatgcaaagaagggggctggtgggtcagctgttttcgtggcacgcaacaggtttgcagtccttgagaagagtagcaatcaagttttggtgaagaatcttaagaatgaaatcgtaaagaaaagccctcttcctattgccacggatgcaatttattatgctgggactggtaacttgctgtgcaaagccgaagaccgagtgaccatctttgatctgcagcaaaggttaattcttggtgagctccaggcaccttctgttaaatatgttgtttggtctagtgatatggaatctgtcgcactgctgagcaagcatgcagtggttatagcaaacaagaagctcgtccatcgctgtacactgcacgaaaccattcgtgtgaaaagtggtgcctgggatgagaatggtgtgtttatttacactaccctgaatcatatcaagtattgccttcccaatggagatagtgggattattaaaaccctcgatgttcctatatacataacaagggttattgggaacaatatattctgtctagatcgtgatggtaagaacaagctggtcacagttgatgcatctgagtacattttcaagctggcccttctacgcaaacggtatgatcatgtgatgagtatgatcaagaattcccagctgtgtgggcaagctgtgatttcttatttacaacagaaaggctttccagaagttgccctccactttgtgaaagatgagaagacaagatttaaccttgctcttgagagtggtaacatccaaatcgcagttgcttctgcaaaagagattgatgacaaggatcactggtacaggttgggaattgaggccctgaggcagggaaatgttggtattgtggaatatgcataccaacgtacgaagaattttgagaggcttgctttcctatatcttattactggttacatggacaaggtggggttcatgtgcaaaattgctggacagaacaataacctgatgggtcaattccacaatgctctgtatcttggtgatgcgttgaagagagttgagatcctagagaatgctggacagctacctcttgcttatattactgctaccacccatgggctcacagaaattgctgataggcttgccgctgagctgggtgaaaatattccttctcttcctgaaggaaaagctcgctctcttttgatcccccctgctcctcttacagccagtggtgattggccattgcttcgggtgatgcatggtatctttgagggtggactggatgctactgggaaggctgaacttgaggaagacgatgaagctgctggtgctgactggggtgatgagggcctggatattgttgatgcaagcgaagcgatggcgaatggtggtgacggttttgatgctgaggagggtgaagcaaatgaggaggatggcgaggaaggtggttgggacctagaagatctggaacttccgcctgaagcagagaccccaaaaaatgctggcaatgcacgctcagcggtcttcgttgctcctccaccaggcatgcctgtcagcctgatttggactcagaaatcttctcttgctggggagcatgcagcagcagggaactttgacactgcaatgaggttgcttagtcgccagttgggcataaaaaactttgctcccctcaagcccctgtttgttgatctgcacatgggcagccactcatatcttcatgcacttgcaactgcccccataataccagtcgctgttgagaaaggttggagcgagtctgcaagtcctaacgtgagaggccctcctgcacttgttttcaccttcccacaaatggaagacagactcaaggctgcctataaggccaccacagatggtaagttcccagaagccctgaggcagttccttagcatcttgcataccatccctcttatcgtggtagactcgaggagggaagtggatgaagtgaaagagttgatcgagattgtgagggagtatgttcttggcctgaggatggaacttaagaggaaggagttgagagatgatgtcaaccgccaacaagaattggctgcttatttcactaactgcaagcttcagagagttcatatgaggcttgtgcttggaagcgctatgggtctgtgctacaagcaaaagaacttcgctactgcagagcactttgcaaggatgcttctggagaacaaccctaatgaggcccaggcaaggagggctcgacaggtgcagcagcagtgcagtggcaagaaggatagctctgagctgaactatgactacagaaatccatttgttgtctgtggcgccacatatgttccaatctaccgtggccagaaggatgtttcctgcccgtactgtggatcccggtttgttccttcgatcgaagggcagctttgtaccatatgtgagcttgccgtggttggtgcagatgcttcaggcctcgtctgctcgcccacacagttgagataagtggtgctaaggtagagctcccccattttcttttagtctcttaaaattctagggattctctatctcacattttagctgcatgtttactgattgaggagtgtatacatggtcgtgtttttgtatcttctccccctcatttccctcgatttttgtttgccttgaggcagctgttacacttgtcatatatggacttttgatcatctcatggtggcctatgcgcctacccctggacaattgatgtaccaatattactttcactcttggaaattttttgtcgtggtgttactttcattgtcatcctattgagctactttctcgcattattttgttcattctgttgcttgtgattgtcaccgtccacgcttgctt

SEQ ID NO: 10804 - DNA, 2199 bp, Oryza sativa
gtcgcgccggggggacggctaaaaaaaatgctgaccaagttcgagacgaagagcaaccgggtgaaggggctgagcttccacccgcggcggccatggatcctggccagcctccacagcggggtgatccagatgtgggactaccgcatgggcaccctcctcgaccgcttcgacgagcacgacggccccgtccgcggcgtccacttccacgccacgcagccgctcttcgtctccggaggtaaacatcgattcctccctgcctagatctcgcccgcctcgagcattttttttttcgctgtggtggttcgccgctcgcggggtcgggtgtggcgtcgacgcgtgtttggtcggatcctcctcctcggatttggaggacgtctcgcgtggccgttagatttccgcgtgatccatttcatggtgcaatgaggacactcgaggtagataccacgcgtacgtggtttgcgattagatcgcgtttcgtgtacagtggtggttgtgcaagtgatcctcgttggttggatctggtgctggttctattctcttagcttaagatgaactgtttggtgaattgttagtttgaaaccttcatgtgacattttgtttctatttatgaccgggatctccatcgattttgcaatccttccgtagaagagatatgataggaagtagaatgagtcgatgtgtagccctcaaccagagagaatcagcttttgtagtgtgaatctgatacaagtagcaagttagcgatggcaaggtgccatcatggacctttggaatttgttgaaacctggactttgggatctgttgaaacttgaaacgaagtcatactggtgtccggtcgtattgctcggtggactaatatgattgggatgcggaatggttgaacttctgaactattctaagatttctgtgatgcattgcaggtgatgattacaagattaaggtgtggaattacaagacacaccgctgcctcttcacacttcacgggcaccttgactatattcgcaccgtgcaattccaccacgaatacccatggatagtaagtgctagtgatgaccagacaatccggatctggaactggcagtcacgcacatgtgtagctgtgctgactggacataaccactatgtcatgtgcgcatcattccatcccaaggaggacctggttgtgtcagcatcactggatcagactgtccgtgtttgggatattggtgctttgaggaagaagacggtgtcacctgcagatgacatcctgcgtctcacccagatgaacacagatctgtttggaggtgttgatgcagttgtaaaatatgtgttggaagggcatgaccgtggggtgaactgggcatcatttcaccccacattgccactcattgtttccggggcagatgaccgacaagtgaagctatggagaatgaatggtaatactgctacaaggccttaaacttttctattaccattttccatggataaacgcttgcatatttgtgtttttattcatttgtccttccatatattattactacaaactatggatttgattttattatgaattccttttgttttcttcaatttatcatactttcacagaagtagtaattaccgaacaagctgaatgcaagaaacatgcttcacaattactcaattagtaactagctcctgacctctagtttgtcactttggttggaatgaaaggtggtcattcttgttgcatagcacttcattcttctgcatattgctagactggccaaacacaaaactatatgcatatgcagcaaaccgctattgaggtatttgaattaatgtaatctaaatgtgctatttttttggacagacacgaaggcttgggaagttgatactttgcggggacacatgaataatgtgtcatgcgtgatgttccatgctaagcaagacatcattgtgtccaactcagaggacaaaagcattcgcatctgggatgccacaaagcgaaccggtattcaaacgttcaggcgggaacatgatcgtttctggattctttctgctcaccctgagatgaatcttcttgccgctggtcatgacagtggtatgattgtgtttaaattggagagggaacgtccagctttctctgtgagtggagatactgttttctatgtgaaggaccgttttcttcgtttttttgaattcaccacacagaaggaagttcagcttgctccaataataaga

SEQ ID NO: 10805 - DNA, 717 bp, Oryza sativa
  unsure (1)..(717): unsure at all n locations
atggagatagtgaaattattaaaaccctcgatgttcctatatacataacaagggttattgggaacaatatattctgtctagatcgtgatggtaagaacaagctggtcacagttgatgcatctgagtacattttcaagctggcccttctacgcaaacggtatgatcatgtgatgagtatgatcaagaattcccagctgtgtgggcaagctgtgatttcttatttacaacagaaaggctttccagaagttgccctccactttgtgaaagatgagaagacaagatttaaccttgctcttgagagtggtaacatccaaatcgcagttgcttctgcaaaagagattgatgacaaggatcactggtacaggttgggaattgaggccctgaggcagggaaatgttggtattgtggaatatgcataccaacgtacgaagaattttgagaggcttgctttcctatatcttattactggttacatggacaaggtgggtttcatgtgcaaaattgctggacagaacaataacctgatgggtcaattccacaatgctctgtatcttggtgatgcgttgaagagagttgagatcctagagaatgctggacagctacctcttgcttatattactgctaccacccatgggctcacagaaattgctgatatnnnnnnnnnnnnnnnnnnnnnnnnnnnnnnnnnnnnnnnnnnnnnnnnnnnnnnnnnnnnnn

SEQ ID NO: 10806 - DNA, 523 bp, Oryza sativa
attgttaatccgagcaaattcctttttttaataataaaaatggattacatctccggcttctgtcataagacacacagccataaatttaatagtaataaaaaggtaagataaaagtaaatcaaaatgagaaataaggtgatgggacaagtccccaagcaaattcctttttacaaagttattcccgactagctagctagcctagctgaagccagacatctgttgcagcaatcatccaagttgccataatcttgaagctcgcctctacctgtacagtgttagaaaatgtattttttttttaaaaaaactaaggcagcgttcgaaagggtgagagagtgagtttgtttgtttcgttttccgcgcgaacgtttcccaaactactaaatggtgcgttttttgtaaaattttctgtaggaaagttgctttaaaaaatcgtattaatccatttttaaaatttaaaatagttaatactcaattaatcataagctaatagctcacctcgttttgcgtatcttcccaatcaact

SEQ ID NO: 10807 - DNA, 437 bp, Oryza sativa
ttatttgtgacttacttgattatctaaagtactttaagcacaatttttcgttttttatatttgcaaaaagaatttaaataaaacaagtggttaaacgttgcaagtaaaaaactgacatacaaccccttgcctctaaggcctttcacagtgaccatccacgtaggagattctcatacacgtacacaaatgctgggtctcgcgatgcatttcgcatccctacggcaatctgaaatgagtatgcctcgccaaaattttagtgtacaagtgttcattttgcggaccttgtgttcgtttcggatggttgggaaccaaactcctccgcgcgaaaaacatagcaatcaattagcacgtgattatttagttattaggttttttaaaaaaatagaataatatgattttttttaaacaacttttatatagaaacttttaaaaaaaac

SEQ ID NO: 10808 - DNA, 620 bp, Oryza sativa
atctagtgcttgcgagctttatcatatctgcttacgctgaactgttcggtggattgttggtttgtaaccttcaggggccatttggttcatgtttatgaccagcaggatggcaggatctccatcgattttacaatcttttcaaacatgagagtcgatctatagctttaactgaagagtagcagcttccatggttgtatttctgataccatagcaatggtggggttggcaatcatggaacatttggattgttggaacttgaaactaagtcacacaccagtttcatctgtattgttggcataacagtggcccatatgatttggaactgtcataaaataagatcgaacaactcctgaactcttctaagttttccgtgatgcattgcaggtgatgattacaagattaaggtatggaattacaagacacaccgttgcctcttcacgcttcatggccaccttgactacattcgcacggtgcaattccaccacgagtgcccgtggatcgtaagtgccagtgatgaccagacaatccggatctggaactggcagtcacgcacatgtgtggctgtgctcactgggcataaccattatgtcatgtgtgcatctttaccacccttaggagga

SEQ ID NO: 10809 - DNA, 799 bp, Oryza sativa
gattatgaactttatgtaactctcagtagtgtgaagttctacacttcaactcattgctctttggaaccaatgaaacttgcagtgcaaactgtggcctgtgggtgcagactactacagaattacaccctcatcaatatcgcagccatgaaagaagattctaccattgactcgtaaagcagactgaaaatttgtttttccaaagtaaagagaagatggaaacgaaattcaatgttcagagtttcagttctcaaaaaatgttcagagtttcagacttatgtaccccaagaaaagaataaataaacagctgactattcagactaacatgctgtacaagagacaaacacccagcgtcagagatactccgtaatgttcgtttcactcttgcagaattctgatcccgaattctgaagtaacacaagctggctgatgtggcatcagagatatccagagcagtgcaataaacatctcccaggccagtttaattgaccgtacagaaactacagtgcttagcagatcatgtccaagaaaagggaccatttgctgaaaagtaaacactgacaggtcctggatgtaagtactgaaaatgagtactagctacaacaaattcagagtgacattaccaaaaacataattgatcagtctccattatcatatactccctccgtttcgaaatgtttgacgccgttgactttttagcacatgtttgatcgttcgtcttattcaaaaaatttaagtaaaaattaattctttttctatcatttgattcattgtggggatcctctagagtcgacctgcaggc

SEQ ID NO: 10810 - DNA, 4955 bp, Oryza sativa
ccctatgctctctgttctccccgattctgatcgcttgcgcctctgtgccacctgattctgatctgtccctgttcttcccctatgctgctctctgttctcctcgattctattctgatctgtcccttcccctatgctctctgttctccccgattctgatcgcttgcgcctatgtgccacccgattctgatctgtccctgttcttcccctatgttgctctctgttctcctcgattctatgattctgatcgcttgcgcccgttcttcccctatgctctctgttctccccgattctgatcgcttgcgcctctgtgccacccgattctgatctgtccctgttcttcccctatgctgctctctgttctcctcgattctatgattctgatcgcttgagcctctgtgctgctctctgttctccccgattctgatcgctagtgctgtccctgttcttcccctatgctctctgttctccccgattctgatcgcttgcgcctctgtgccacccgattctgatctgtccctgttcttcccctatgctgctctctgttctcctcgattctatgattctgatcgcttgcgcctctgtgctgctctctgttctccccgattctgatcgctttcgcctctgttcaccccgattctgatcgcttgcgcctctgtgccacccgatgattctgatcgcttgcgcctctgtgctgctctctgttctccccgattctgatcgctttcggctctgttcaccccgattctgatcgcttgcgcctctgtgccacccgattgtgctgctctctgtgtgccacccgattgtggctgctctctgttctccccgattctgatcgcttgcgcctctgtgccacccgattctgatcgcttgcgcctctgtgccagacaatctacccagtgctgtctgatcgcttgcgcctctgtgccacccgattgtgctgctctctgttctccccgattctgatcgcttgcgcctctgtgccacccgatgattctgatcgcttgctgctctctgttctccctgattctgatcgcttgcgcctctgtgccacccgattcttttgatcgcttgcgcctctgtgccacccctgtgctgctctctgttctccccgattctgatcgcttgcgcctctgtgccacccgattcttctgatcgcttgcgcctctgtgccacccgattctgattgcttgcgcctctgtgccagacaatctccccagtgctgtccctattcttcccctgtgctctctgttctccccagtgttgtccctgttcttcccttgtgttctccccagtgctgtccctgttcttcccctgtgctgctctctgttctccccgattctgatcgcttgcgcctctgttcttcccctgtgctgctctctgttctccccgattctgatcgcttgcgcctctgtgccagacaatctcccctgtgctgctctctgttctccctagtgctgtccttgttcttcccctgtgttgctctctgttctccctgattctgatcgcttgtccctgttcttcccctgtgctgctctctgttcttcccgattctgatcgcttgcgcctctgtgccagtgttgtccctgttctttccctgtgctgctctctgttctccccgattctgatcgcttgtgcctctgtgccagtgctgtccctgttctccccctgtgctgctctctattctccccagtgcttatcgcttgcgcctctgtgccgttctccccctgtgctgctctctgttctccccgattctgatcgcttgcgcctctgtgccagtgctgtccctgttctccccctgtgctgctctctgttctgccagtgatgtccctgttctccccctgtgctgctctctgttctccccgattctgatcgcttgcgcctctgtgctagtgctgctctctgttctccccggttctgatcgcttgcgcgcacaagtcattgggacgagcagggcctctgaaaccacaccctcaaaccacaccctcgcctgagatctgcacgggataggcggggcgggtgattagttctgatcgcttgcgcgcacaagtgtccctggttctgatcgcttgcgcctctgtgccagtgctgctctctgttctccccggttctgatcgcttgcacgcacaagtcattgggacgagcagggccttcgaaaccacaccctcaaaccacacccttgcctgagatctgcacgggataggcgggtgatcagttctgatcgcttgcgcgcacaagtcattgggacgagcagggcctccgaaaccacaccctcgccaccctcgcctgagatctgcacgggataggcgggtgatcaggtttttcattgggatgagcagggcctccaaaaccacaccctcgcctgagatctcctacacgaacaatctccattgctggttaaccatctctctgtgcctgtgctgctctctgttctccccggttctgatcgcttgcgcgcacaagtcattgggacgagcagggcctccgaaaccacaccctcaaaccacaccctcgcctgagatctgcacgggataggcgggtgatcaggtttttcattgggacaagcagggcctccgagaccacaccctcgcctgagatctgcacgggataggcgggtgatcaggtttttggggagtgctttcgcatgactgctctcttctccgtctttgtcgtcgttcggttccatctgcatcgcgcaatgtctactggtggcggttctgatcgcttgcgcgcacaagtcattgggacgagcaaggccttcgaaaccacaccctcgcctgagatctgcacgggataggcgggtgatcaggtttttggggagtgctttcgcatgactgctctcttctccgtctttgtcgtcgttcggttccatctgcatcgcgcaatgtctactggtggcggttctgatcgcttgcgcgcacaagtcattgggacgagcaaggccttcgaaaccacaccctcgcctgagatctgcacgggataggcgggtgatcaggttattggggagtgctttcgcacgactgctctcttctccgtcttcgtcgtcgttcggttccatctgcatcgtgcaatgtctactggtggtggtgattccggagactgatctcttctccgtcttcgtcgtcgttcggttccatctgcatcgcgcaatgtctactggtggtggtgcttccggagcggcaggaggtggtgcgccaggaactggaggcgcaccaatcgacaacaccaacggaggcaattctgcctcacaatccagcggagagactttcacagggtataacatccttctgctacctttcattttgttaaatctgtcagtcgcaatgttattgcgttgtctcattgatgatgcttattttaccttaagcatgtccataaccatggttatgtttagttttatcactagatcatttcacactgtgtatgccatgtttattgtcttaatattttggaataaaaaataccaatttatgaccatattttcaacaatagctatagtttaaaccttgtaaagaactgcatttgtaattattggaactataattcatcaacgagcatagacggatccaacatgagtatcagcctatcaggggctcgaggccttgctggatccgcatgaagcgcatgaagagatggggaggggggaagaggtagagaaaaaaagagaggttgagacttgagaaatgatgctaaaatctcagaaataattatcctacattcaaattatgcagcaaccctacatccaaatgtcccacggtttagccacgataaatcattactcatttcggtctcacaacacagccaaaagccttgcaaatggaaataaaaaggaatccttaattatattatgaattatagcacggaaaataaaaaaacttgagtttgtattaggagttaagcttgtaattaaggggcaatgtggaacctatgaatttttaggaacgatcttaatttccaaaacaattgttatatgttagatattattctaaagcgaaattgtatttactatattgttcttgtgtctgttttcgaaaaaaaggtatatttttcccttatagaatgtattaaccctcaaaatattcaatcaatttgcatcgttataatccggaccctccaaggtcaacatgacaacatgtagttgttcttgctctaataatgtgcacaaagttttggaccttcagtgtgggtactttttttttcactttgttgggataaccatagatagatatgatccatcatcaatccaagaatttgctaaaatttttgggtaaaatacaattttggacgaatggaaaaaaatattcggctaccttcagaacataagatttttttaaattagattataaagaaaccaaacttcttcgtgtaatttgtaagataacgccatattcgcacttttatcaaattcaaacactaaattcctatacgccaatatcaaaattgaaatcttaaaacttagggcacgttcttttcagcttttgattttggctttttagctgcacgcaaaataaaaaaaacataattagcatatgattaactgagtgttaattattaaaaactaaaaaaacgatttatttaaattttaaagcaaaatttctcacaaaatacaatgtttagaagtttaaaaaacatgttaacgaaatatgagaaatagctaagctcaattagcctttttagaatgtgttcttaattttgaacttgattttttttttcatcatagtctctttttaaccgttgatgtttaagtatcgaaaaacacgtgtttttaaccatagattattctcttattgctaatataatgtgcctacactgtttgggcgtatgattagcaaattaccgtctgatagcagactattttcttcgtcgcgaaaaaaccaaactagctcgatgggggaaaacttttaggtttagttgttagatcagatatatacatatatttaaatattaaatatggccta

SEQ ID NO: 10811 - DNA, 24858 bp, Oryza sativa
gtcaaggcaaatcccccgatactgactgctcccctatgtgctcgacgactgtttggcactcgaattctgacaattctggctgctgtttgcttcaccaggtggcgctgcgagcggcggaggtggtgtccaagatcggcgcgtttgggctgaaggtgttcctggacgagcagagggggcagtcgtcgtcggcggtgcggcgcgcgagggcggtggagctgcggaccatactcaccaggctcggcccgacgttcgtcaagattgggcaggggctgtccacgcggcccgacctctgcccacccgagtacctcgaggagctctccgagctgcaggtggccgatcttgcttgcccttctctcgttcgaagcatactcgtctgattcaaacttagtagtaaggcattcaattctattccagcatttggccaatgtggcatgctcatgttcaaagatggagtgtccctgcaatttcttgcctgtttagtggacagtaattcgttcaagaacgtttcacctatagattcttgccactagtagtgtagtgcttattgttttgaagtaaatgacgtcagcttgagcttaccatttaagatgtgtcctgataactgggggatagcttccatttttggtttatgttatatctccaattggtttacatgtaaactgtcttgcaggattcgcttcccacgtttccggatgaagaggcatttgcatgtatcgagagggagcttggctttcctcttgattcaatctactcaacaatatcaccttccccaattgctgctgcaagtttaggtcaagtttataaggcacggttaaaatactctgggcaactggtagctgtcaaggtgcaaaggcctggtattgaggatattatagggcttgatttttatctactgaggggccttggatatctaataaataaatatgtcgactttatatccagtgatgttgttgctctcatggatgaatttgctcgaagagtttaccaagagcttaattatgtccaggtacaattttattgttcttttgaacctttttgcacataatctgatcaatatctgcagtatacatgtatgccactacttttcctactgatggatgttacactgtacctgtgaataacagggtttgtactttcagcatgagttctatggggcattgaaattccgaaatttcgtaacattttttttgaacgaatcggcacttagagtgcgccaatttcattgaataaagcaggaggaaaactgtacaaaagggaaaattaaggtaaaatctgtgccaggcgtttagcttctgctaggacccaagtctggaacactctctggttcctctctttccatatttcccaagtcattagaagtagttgggtgtgaactcccttcctaggcgtaccagcgcatgttgctagcgctgtccaccaagaatggattgaagtagcggggtaccatttcgtaacattttaaattcaaacaagaaagatatcaaacttacattgcaaactcttccagtgaatgcttcactgaattagcttacacgctcagttgcttaatctgtagaatttttgtttttttgaacgggatagctggagagctgcttattttaattaagaggaaaggaaataatataaagtttttacagaggtgttgtacaaagtaccagagctttgtagaattatttcctgttggttcatctacttgatggtagtgaaaactttgaatgcaggaaggccaaaatgcaagaaggtttaagaagttatatgctgacaagcaagatgtgctggtccctgatatattttgggactacacaagtgcaaaggttctgacaatggagtggattgagggtgtaaagttaaaccagcaagcagctattgaaaaacaaggtttgaaggttctggatttggtgaacattggtattcagtgcagcttaaggcaactattggagtacggttactttcatgctgatcctcatcctggtaacatattggcaacacctgaagggaagcttgcctttcttgattttggtatgatgagtgagaccccagaggatgcaagagtagccatcataggccatgttgttcacatggtcaatagggactatgaagcgatggctcgtgattattatgctctcgattttttggaacctgatgtagatgtctccccaattgtccctgctcttaagagtttctttgatgatgctctgaactcaacagtaagtgagctaaacttcaaaaccatagttgatggcttaggcgctgttctctaccagtacccatttaatggtatgttttcctgttgtcagatgctagttctcacttgtatgctaattctgctcatgtaatgatacaacttgtctatttattcttaactagtaccggcatactacgcattgatactgcgatcgctcactgtactggaaggtttagcactctatgctgatcccaattttaaggtgctcgctgcctcgtacccttactttgcgaaaaggctactcactgatcccaatccatatctcagagatgctttaattgagctactattcaaggatggaaaattcaggcaagtttatgtcctcatgaagtagttaatgaggagttttgactactcttgtcagtaattgcatcttgtactgattattctactgctatttaaccctagtattgcttctatacagatggaataggcttgaaaatcttcttgttcaagggagccaagatagagagtttgcagcaaaagatgctttgcaaccagttctaaagcttctacttggtcctgatggggaggaattgcgagtcctagttgtgaaagaagcggttcgtgtcacagaagccatcacttttggaacgctgattgattcgtataatgcagctccagaatttcttaaaccattaatatccagtggtaatccagccggaccgttcaagataagcgacactgaaagggaacaaatgattgagctgcgggacagggttttcagaatatggggccttctgagatcctcggatggctttgacccaaccatcttgcaaccaattgtgcaggtatacttcagcttcatttctcagtacgtgtgaatgtgtgattcaacctctatgaagaaatattttagctgataccatggagcaattttgatattcattcaggtgctacaagagccagaggcccgcgttcttggctcccgggttgcaggaggtgttacgcagcgcctcgcggcccgcctgttgcagcagctgctgagaactccacctgctccaggatctccttagcagataagacatgtaaattcacacggtactttccacaggaaagagaaaaggaaatgtaattcggaaatcaagtataaagttgatttcttcattcatgccggataaaaagatcccctagatgtttgtagattgttctcaaagcctggaaaattttgggtctacgaaaatcagaaactcttctccactgaagccactagggtttgccaaaccgagttgggaacccactcacttctttttccgcgcgcacgcttttcaaacggttaagcggtgtattttttgaaaaaaaattctatatgaaagtggcttaaaaaattatattgatctatttttcaaaaaaatagctaatacttaattaattatgtgttaataggccgctccgttttttgtgtaggagggacaagttctcagcaatagaagattaatagtaaaccacttcaatggtatgtctacatgggtatctatagctctctaatccattttctcgtttttctcattagactatctccaggttagtagatagctttgctctctttctcttcatttaatctcttccaagtaggaaaatatgctgacatggatcttttgtagagaggctataaataaccgggtgccctaaacgtgtttctcactctcctgcatagaatcaacgtgattctttctctgctgcactgctgtccattcactaaaagagctgcagcttgtgtacaggtgtttagtagaagagtaaatttcagaaaactgcaacttaatacagtttttttgaaatttgctcttagtagtatttcgtgttatcgcatttgtatgcatttacaggtacatgcctcagattagctaacgcccttctatgatgaggaaaggtaattttcggcctctgaatctacagaaaaacagcgattaatctctcaaaagaagagtatgtaaacgacagcacgttccaacttccaagctcatttctgacgcaagctctgagcaaaataagaaccggcgaaagcaacattgttgggctggtcgcccatcgtttctgaacacctcgcgatacaactgcacgaggcacaccagttttctcttccgtctttccgacggcgcctccatactccataggctgctgcctgctgctgatctgaattctgtctgatgcaccgcacccaccctcccgcagcggcattatctgaatctgagtagtcaagctgctcaactgaaaagtggaagcagccaaagcaggataagatttctgagagcaagtttaatagtgtagtccactacaggctccaaatcatttataaccaatgtaatagtcaattcatacaatagttgtttactataccattaatatttggtcccacctgtcatacacacgttatgtcttggagtccgtgttgcagctggctacagatctgtagcccgctgctcttctctctcttcttttatctctttaaaatatgtttatagctggcttaggcctcctttaatggttgagctagtgcactagctcatgcttgtccacctcatacaagagatagcaaaaagtctacctctccaatagattatctcatagcatattgtttaaaatgctttgggtttcacaattcctctcacattttctttaggagcttagctcttgaagaagatatagtgcattctctctccttatcttctctctcttccacatcatataaaagctgatatggagatttataagctagctgactcatccttgttggaggagcccttatagcctgctattgtacctgctatgattaatactagtactgtcacttacctctccgttaaaagggacagatataggttggtattttttttcttgacggaggaagtactcgaatctcaaatctcagttaggcccgggtaattctgctatagaaaagaaacaattaacaaaatgctgagatgaatgaatgttcaggcgaaaattaatccacaatgttctcgcaaaagaaatataattaattcacaatgtaataggacggacacgtcatgacagaagaagcatctgttgaagcgttcacgagacagatgccgcataaacaagtgagacatgccacccacgcgtccatctaatctaatctaaccaccctgcacgaatcgcgacgcacccccctgcgaagcattccgttccaagcgggcaagcgctatatatcgccgcggcgtcatctcgacaaggcacctgccactcgcccactcctcctcctcccccatcctccagtgctacggtgtcacgcagccatggcgctccgcacgctggcctcgaggaaaaccctagccgccgcggcgctgccgctggctgcggcggcggcggcgaggggtgtgacgaccgtcgcgctcccggacctcccctacgactacggcgcgctggagccggccatctccggggagatcatgcgcctgcaccaccagaagcaccacgccacctacgtcgccaactacaacaaggccctcgagcagctcgacgccgccgtcgccaagggcgacgcccccgccatcgtgcacctccagagcgccatcaagttcaacggcggaggtgaggccaagtcccgccccccttaccccttcctcgcatacggctttctttctttctttttcttcgtcctgttcatcgcgggcgatgcgggcggcgggggatctgaggaattgggtggggtatttgtgtgctattgtggctgatctggattggtctggacgggagaggcagtgtgctcccccaaatggagaatcggattgggttgggggttttaggatcctcccatttctaggggtttaggtggttctggttttattatcggccgcgaatttaggtttaatactgtgttgtagtggtctggtacatacactattttttaaaacagttgagacatgtgttaactgcgtgggtgttttgagtataaaatttgaacaattttggtgcttgttatccacagttaggcgttagctgtcttgattgtcatttggttcaggtagtgattagttggtgtgcctttgattcctgcaaaatttgagctgttttatattaatttcctgtgtttgagaggggctcagtctaactggtcaggtagcgatccattgttgtaattttgctatccagtgcttctctaatttgatcaggcagttggatgaatgggtgatctgttaagcttcatttctaggtgaaagttctgtatgcggtaatgtactttgggctcgaatttgaacaattttgatgcatgttctctgcacttagctatcctgattgtcagttggttgtgcttttaaggatttgttcgcctaagataggatttgagtagattcagcattgggttcttgggcttgtgccatagtttattttaatctagctttcaacttttgaaggccctctttgttttatgttctagacatatctagtgtttgatggggtgtattgtcatcgcagaagttcgaactgcattgaattttgtgcttgtacaccctttaatttaaagggtatgttatgttatctcccatctcaatgccagaaattttcctgtctcctgtaaaaatttgagttgttttatgttaatttcctgtctttgagatgaactcagtctgattggtcagttagtgatccattattgtaattttgagatccatcgcttctttaatttgatcatgcacttggagaatggttgatgtattaagcttcatttctatatgaccagatgcgtttctactaaattagacagcaccatgatgcatccatgagctgctgatttattgagctcaggttgagctgcctttgagttggttccacagttgccaatttctctaataaaaatatatagagacaaattagtggtccccttttactatctcttcagaaaattttatttaactttgaagaaatagtttggtagtttcacttatattcatatgttggatgataatatacatgataaattggcgtaaggttcacaatttcacattacaccaaactatcagggtgtgtttggataatgggaaatggggagtgggattaggattgggaaatcaatgaagggttaggattaaatggaactggaagaatgaatggttaggatttaaagatgcatttttgtgggtgggaaatcatttccctatcccattagccaaacactccgtcaaagggaacagcaggtggtatggtagtaaagaggtatcctcaggacagggctacgttgttccagctgggacccaagctgccgcccactcccaacgctcctgtaggatggagctgctgtgtttgtgttattgtgtgagcgcggaattgaagagactagtgttcctttcttctagagcctccaaaaaatcaggatgggtgtgacttttgccagctcttagctaaattcttgcacttggatagacaccactgcaagaggaaccaaagccaaatcttccgagcatagacacaagaaataagcaaatggtcggcacacccctcctgaccatgaagcagaaggcttagtgggtgtccattcactgccggagcatctcatctgttgtctagattcattgatttgcaataaaaaaaatttctagagtaatttattgcgatttcgttgctctcagatatctactctattcgttacaacaaagatattttcagtaatgcctttgtattaactgtgctgcaagccatgtcaatcattcgatctctgggattaacctcaagcctatcagcgtaattatccagtccatacaacttgctccatttctttcttcctccacttactttttttctactggatctccaatcaccgaattaatgaaaatattgggtgttttacaggagggtggtggtgatccaccacatgcaaaacttggctgggccattgatgaggattttggttcatttgaggcacttgtaaagaagatgagtgcagaaggtgctgctttacaaggatctggatgggtggtatgtacaccatgcattgctttatccattgatgtgtcatcctgttcagtctgaagaaatgtattgttcatttattatatttattttctcgtacagtggctagctttggataaagaggcaaagaagctttcagtggaaacaactgctaaccaggtgaaagttcttaactctttgtagattatattatttgcgcataataacaggatgtcctataccatgcagtctactcttgaacaacaacagttcaattcagtagattcttatcatttttgtcatgttttcaatgtctgttgagatagtgataaaaaacacttctgtaagatcaagggatggggattagcaatatggtacatcaatggttactgcagaaacacatcgttagaaacatatgcaataattttggtacattgggcaaggaaactgttattggatgcatgttcattgttctgataaaaaatggtaccgatcaatatgctagtggcttgctaaaatatgttactgcagtttagttaacatgtactgttgaaacaataccttgttcagcagtcctgcaattggatttcaagagttaagagcaaggacactatattttgtttaataagttgttatgacatggtacttaaaattaatgtgttttaccagtataagatgtattgtcttctgaacatactattttctaacatcctgtaaacttttatgaagtatctatgaattttcattgtttaatgaattctgaatatgactgttctaagtacatggcaagagtttgctgttctcatagttcagtttttgctttggctaatgtgttgagcaatatgaaattgtagccctactttctaaaggaaagaatacattttttttagcatcctacatggtgatttgataatagggcacagctgacttcttgcaatttgcaggaccctctggtaacgaagggggccaacttggttcctttgttgggaattgatgtctgggagcatgcgtactacctgcaggtaatctcatgctgttgtgggggtcagaggcacactcattgtttagttgctcttattctgctgttggttattattcctaatggcatgttgtaatttgcttatgttgttagtgttgctagcgccacatatgatgtgttcattgatcacaaattcacacttgaatgagttggacaacttattccccttgtagcatttgcactacgaagctattgcctttttttttaagataatggaaagaatcctgggctttacttcaaagaagctacaaccacttattacataattcactgaatgaagctactgcttgaaaatacggttcccattgttttccacaagacctaacaggagcagagtagaatgatatcacattgtttcatgggttatgtctcaaaagatcagagaaaatttaggagtagtaggatgtgactaggcatcgaatacgcatgtgcatgaatacaaaatgtgagtaccattgaagattactagtattgtacgttctgaacttctgatgtagtacatagtctgactatagaaggaatagttacctctggctgtttaacaacttacaacatcgtgcacacccaacttatttgtgcttcgaatttcaacctttgctattgctaaacagtcttcattgatttccgtggttgcagtacaagaatgtcaggccagactacctgagcaacatctggaaggtgatgaactggaaatacgcaggggaggtgtacgaaaatgcgactgcttgatgttgtctgaaggcaacgctcatggttttttttcacctagtactgccatggatctttgtatgcaataaaaatgggcctattgcacttctggaccttgtgtacattgcgtagaggtggactaatgcataacataatatgcctgagattttcttcttgtgctgctttcctgcatttctttgctcctggtgtttcactgcccatgcatttactactgcgccggtactgcctttctgtgccaattcccgttctcaaagcgaatgaataattctgtgctgatatactacctccgtttcaaaatatagtgacttttagctatgaatctggacacataattgttcagattcatagttaaaaatacttatattttaggattgcttatattttgggacggagggagggagtaatgatgtaatttaggaagaacactcgtacatatggaacgcatgcagttctttgtaaatttacaagaatagtctcgtggaacgcaagtaatggatcaaccaaaatactaatccccctcgtacctcagcacagtcctcatcgcctggtgtacatgcgtgcatctttcatataatcgcggaaaagccacgacacttgtttttaagtgctcaagttgtataaaagttggatgtgagcgatatcttttgtaatatttagaatattatctaaaaacaatatgtttaaatgtatgttggggaataatttcatcagattatattttaaccatatttaataaatatattcgaacataaatttttatcggtcaattttcttgtttctgactttatttgcttgggtgcgtgctgaagaatgtggtgttcttatctccgattctctttcacaaattttaaccatcatttttttttattttacatagatcaagacgaattgtatgattgtttccggtgtgttttttcaaaaaaaaagagcagtttttcttttcatttcgtaaatttcagtcactttttaaaaacaaaaaagtactccatacagcttaattttggaaaattcaaagttcagcataattacaaaaaagcttaggacaaacgactcgcccttgcgattttgcgaatgataaacgaacggtttcatttcacagacgcttcacttcgctcagctgtagtagacatcgagtttgagtcggactccgactccgagtcccattcggtacccctccatccataaatctcgtttcgtcctcgcccgccgcctccgcttcccattcccgccgcccgcttcctccacctgatccttcgccctcgattcgctgcacttgatccgccgctgcgccgcctctcgattcgatccatctctgtgccctagctaccctcgcagcagagtccactccacccgaggtgcgacatggccgtcgggatggcgcctcctcctcccacggccgccgcgctgccgtcccgccgccgcctcagggagcggatccagtcggagcgccaggtggtcggcggcctcctcaagaaggcggaggccttggtggcccgcgccaaggaggacgtccatggcgggcgcgccgcggcggcgcactccgaggcctgcgctctccctcgccgcggccgtttcttgcgtcgtccggaggcccgaccggaggcggaggccaccgccgcgatggacggggctgcctctccccgcaagaagaggcggaaggcggcgacctccgcgagctcgatcgtggaggtggaggtgatcgagccgaccatgcccaaggcgcagagggaccgcctctacggcctcctctcctcgctgtcggcggagatgccattgccgccgcacatcgtggccttgatgcagagccagtgctgctgcgtcgtggaccctaatggcgaagagatggatgtggaccttggctccgcgaaggatgctgccttgttccagttgctgaacctgctcgaggaattcgctcaacagcagaccaccaagattcagccacggctggcggaggagcaagaaccgcccaagatcgaggcacccgacgccaccagccgctcgtcgtcgatctgccaactgatggaggacggcgaggtcgccgatgagggcgcggacatggacatggacatctgcggcggcgtctctcccctggtagtggacaaggttcagttctcgccgcttccgaagcaagaagaggatgatgagttgatcaacaccagcggcggcggcggcttctctctccaatcgccgcctgccaagcaacaagaggaagaattcgtccgcgatgcctcccctgttgcagttgacaagttccctcaaactgaatctcctagctcgagcactggctcctcttctggatcgtcatcatcttcatcttcgagcggtggctcatctggatcatcctgcagcggttgctcctcttcaggcagcgactctaacgatgacggagacagtgcgagcagccgccctgataactctgaacttcccactgaagctgcagcgaagccattggagcagcagcaggtcacagtctgcggcggcgtctctcccctgatcgatgagttctcgccgcttccgaagcaacaagaggatgacgagttgatcgacgtcactggcggcgtctcccctgtatcagtcaacaagttcccagattctcctcgctcgagcagcagtggctcttcctcctcttccagcagcggttcgtcctcctcctcgtcggaaagtgactcagacgacgacggcgacagtgcgagcagcaagccagacaccgcagatcatcccactgaagctgaggcgccgaagcttcagccattggagcaacatgaggtcgcggagcaagacaagaagctgatcgccgagagagcagcatctccgaacaccgagatgcaggagctgatcgccagggcccaggagaggcagaaactccggcttgagctcgagaggaagacggcgcgcgagctcgagaggaagatggcgcgcgagcagctgcaggagatggagaggacggcacggccggtctacgacagcatcgaccccagtgtcatgaagcagctcgggatctccggcgatgcgcagtacatcgtcagcccggtgaaatctcggcacagcctgcatcggcgcggcggcggcggcctgctacagaagctcggcttcttcctcaaagaatagcatgatccatcatcaatggtgtctgtaaagctctgtaggtttcttgtcacattgggatcatatgctctgagcctctgacaatgatctcatcagttgcttgctctcaagcctttgatgtacttaaaaccattgattagcttgcagctaagttatgctgtacatgtgtcttgtattatatctgattatatgaaattatgaatcgtcttaaacaactgtactgtttctgccttatttcaagtgtatgcttagtcttctgttcatgaatgataacagttgcacatgttgttagtttatctgaaacaagcaaagcgacagcatcaacgaagtagtcttttttttttttggtgagatttacctttggaaaaggtaagagaaactgatttataagatatatctggtgcaaaattgaagatcaggaacaatgtttgtacatggtaagcacccttgagtttccaagagtgatgctactaacctcttaacaaacagaaaaacaaagagaaacaactaatagtgctaaaatgcctcaacaacacagctgacattgctgcctcccacttgcaaagtaacaaagcaaaaattgctgcctgtgtagtgcaggatagatgggtgaacctatttcagattacttcttgtgtgagagctctccactagttttgggaagcaaatgctcacaggaaaccttgatgggctgctcatcccaaatatacttgtgtgctcttcaactgcaacgatcttgtctgcttcgtcaaccacataggccataggttgctgttatcgcaaattccggatctcctgcgcgacgtctaagcaacactcaatgggacagttggtcttgattgcattggcgcctatatgtgatctacaagcagcatacccttcctgctcacacattcagagggtgctcagatagtcagattgcaaaggtataccaatatatgcttattaaaaagtcaaaaggttaattaaagatgcttcattaggtaaatacttattaagaagaactgactgatacatatcacataagaagcaaaaattaagaaaagatgggtgctgagttagctaggaatttgcatgttaactgaacattgatattacagacaagcgaaatacctttcgcagcgagtttatgagggtgccaagtggtggagagtttacttttgcacggctagcaatctagaaccacatgcaacaaattagttttgctggaagatttctgatagtaagcttgaatggtacattacatatttctgaacaagttaataaggaactgcaaaatatacctcatcaagtctgatatatccagggggcaaccttgagtcgctttcctcaatcattgtgtcaagaagtttttctaatgagacaccattctcaattgtgtttgcccatccccattctgttgccaagcttaacatttcagttaggaaggtggtatcatggagaggacctgtccaaagtggtcctacaccagtgatcgattcgggatcctgtaaaagaaaatgtaaccacataatagcacagttccttacccaagtatttaacagtaagaatggcttgatgagatttcttgcgtatggcatacagttctcaacttaggtgatgaacttatgtgatggagacatattcattagtagcatgtggcatatggttctcaacttattaaatgggcatgtttgtatgctagcaaagtgataatatttggtttattacctttggggtgttctattggaaacaaagtagtcagataaccttttgtattgtgctaacatactctaatagcccttacttaaccttaagaagtattgatctacttttcagacctgctaaaaatatttaatatggtccaacacttgctaactatatcatagcaaagcctgggttggcagctatggctgatctgggagtatccactacccagtaagcctgactctagagtgaatcatgtatccgggagctttaccactccaagcgatcacacatgatttgatttcaacaaagaaatctttcgcatcaatacagtaaaaaaaatgggacaaactatgatttgcttatgatgcctttcacattattataccaccacagactcgtgtacctacaattttgtctgcacaaccacaagtaatctgccccaactcatcaaatccaaaagtccgtgactggccacaacttttgcaatggcaaatgaaaccataattactgccaaaatagaaatagttagcaactacccattgtatggactaactgttcatatcgtcatagaatgaccagtaacaaaagaacaatgactaacctgatgccatcttgttttccattatgtaactgtaccatgactcgaaaaatagggccatgatatgcatagtatgagaacaatggagtaatgtgaaatcccagaatagcagcttcccgtgcagcaccacctataagcattcgcaaaccgacctcattcggatatggcactggacgtatatatgctccatatgatgacaaagagctaaagaaaacataatgttacaaggttcacatgaaagaagcatggatgctataatgcccactacaaaacaaacctggtcaagttcaacacagaaaaactaatctgtagtgtagcctagtgtgcattacaaaaggaattgactattacaacaggagcattggcacaccaccaaagaaatagtgatatgcatgtacgaagtgcacactgtcatactcaacaatctaatttgaattcactgtttctaattatactacaaacagaattactgatttgatgttcatactcattctaaaatctgctttctaacttcgctcacaccgtttgtccatctgacatggattttcctaggtaaacatatgtttcatgctctctaataattgacattatttgccatacgttatttagcagtttctagtacacctactgaacaactaaaaggccagcatttgaacatgtaaaactatgtacattttcagaatacaaagattacaaccgtcagttgagctataagaagcaattcaatgcagaagtgtagcagacactccagtttcaattgagcaaatattaatcaacataatctgaacacaataaacagaacaattctaataattgacaaaagatagaaatgcttgatgaattagcacaagctttaagaagctaaggcgaaggcattacaaattggatgatactacccgagatgtgtcatgccgaaatggaccacggactcaccttcttgagccataccctctcgcggaccgccaatccgtagatgtcagatacagtaggcccccaattctgagcgccagcaacgccgccctgatgtacgcggcgtcgccgccgaacgagtccacgtcgatgacgtcgaagtactcgcggcggaggtagcgctccgagagcagccgggtggcgtcgaggtgcgacaccgcccacctcctgtccggcgcccgctcgaagcgggagaggttgccgacgatgacggggcggagcgcctcggaggcgtcgttggcccagacgaagtcggcgccgacctgcgccaggtagcggagcgcgcggacgccgcagccgcacatggcgtcgaggcagaggaacggggcggaggggccggcggcgcggcggtggagggtgcccgcgaggaccgcgaggtcgcggcccgcggcgctgtcgctgcggtagaatgcggagcccgggtcgaaggtgaccccgcgctcggagtgcgcgcaggcgggtggctccgcgctgcgccggcggtggcggtggcggccaggttggagtgaaaaggggagcgctctggggaacgagagcgccgctgccgctgccgcggcggcggagatggccatggcgacgggaagagaacagcagaatggtttggattggggtacagggcgtacagccgttcgggttcacttcagcgaggccgacatttcgtgtgaattgttttttcctgagttacgggtgtaatttttgtagcattgcacgtccttaaagaggaagtcattaataagataagtccttaaaaatgagagagtatatatacgagggatctgtttgacaggattttaaggacttgtttaacttctaaatttagttttaagtgttgagtctcgagtgaagttgtgaaagcgctctacccaactccgttcctattttaaattgagctaaaactgtttagctgagctttaactccaagagaagaggagctgaaactggagcctgagcctggagctgtacctaacagtccataacttctaaatttaactttaaaagctacagtgaagttgtaaagcagtttcacctctttaatttattttgtgatagcacttcaaccagctttactcttattttttatggagaaaaattgtttgtctagagtttacctctaagagagatggagctggaactatgtaacataggttctaattctttcactaatcttaactttattaggagagatagagctggaactctgtaaaaataggttttgattctttcactaatcttaagagcatcaccaagagcatcccgaaattctgtcctcaacatttcagttatgggaattctaaacaagatttgaggtgttaaaatttttattcctccaacagattagctataattggtttcctaaaaacaaaaaagtaggcccttagaaaacttccaacagaaatcagctagtttccacccctcgctctcacgagatcacgcttgcgcacgtgccccttcgtcgcccctctcacgcagtaccatgccggcagatcaacccgaccggtacacgtgcacccccagttttcaacatgtacaccagcaattccagcaggcaggaaagcaccaactagcagcaagcacgactagcaattgcagcaggcagcaaatcaccaagtaagcagaacatcagcaagaaatctgcagcagcaagcagctcccatagaaagtaggaagcagcaacagcagcaagaaccagctgcatccatcaactccagcatcaagtttgacaacagcaacaaatcatatccctatatacttctgtaaactatattctatacatacccctatatgcttttgtatatgaaatgcacaaatcatatccctgaatccttacattaatttctgaattgtcaggataacatatatcagaagtagtttggatttacaaagttcagcccagaaagttaaaagagcatatttttttcttattgcctcctatgcaggcagcaagcagcaagcagccacagcaatacatagcaccaaattcactatgaatacatgctcatttctgaaaacatgtccaactactgttatttatgaaaatgcaagctctaacagatagcacaggtggttcatacaatttctgaattgtataaatttgacactactgtccaaattcaaatatatacagttcatatcagccctgacatcatagtttatgaataacatataacacaagtgggttagataatttctgaattatataaatttgacactataattttctctctgttcacagtaagaacagaacacctgaacattgagctttttgcagacttattacaaactacagatataaaaaagggcaacttttccatttcatacacttatcgctattgatttgtaataatttataattgattactgctaacttgctaagctagcaaatttcattattaattgattatcaatgtggagttcagatgtaccacttaaccacaaacatcagattcggcagcaggataagataatgcacaattacaatagacttgagatgcaacaatgatccagaatcggggacaggacttattgaaattgcttccacgaaggaactcttcttcaccaacaaaccaagccatggacaaaatggcgctggaagcgttgtgggagatgggatccagtgattgcctgggcacctgctggtacatggcctctgtcgcctgaacaccggaagtcgacgattggccaggaggcagagcacgggccgattcacaacgtatcatggttgcgctctaaatcgaggcggcggtggtggttgggggagcggcgatggctgtcctcctccagccatcggtggaatgcggtcgacgcgcgataccatgcaccgctccctggaagaaagccgacgcccggcaaccatggggaagcacctgctgcattccgatctgttgcgaggaagaggacgccgtcggtagatgaggtcgccaagaggagctgcgtgggaacgtttcaccaagcgcgcgcgagatagccgcgggcaaaggattgggagcgaaatcgatttgctagaattggagaacgaaaaaccaggacttgggtaccagaaggattgggagagctggtagggaatctgttggaagcaatctttgatcaaaaatccccaaaataccacatagggaatgatatcaaaatgctgttggtgatgctctaactttattacgaagtaacaaaggtacatagcataactgttactcactggatcaatattcatattatcttgataaacttagcaaaaattgctacatgaatttatgtaatttactggtagacatcataaaaatatgtaacggctgaaagacgtttaaaaaactggtaatttaatagaggacactttcagctcaattggcgagagaaattcttcaaagatacatttgtttggcaagtgggattgggaaataatatcccaccctccaaaggacaatattgcatcctaaccatccattcttcacacctcatttaatcctagccattcatccatttccctttctcaatcccacctctcatatcccatttgccaaacacagtgttagggtgaaaagcttttcagctaagactggaacgaggatggaatataatgtatgctaggtgatgtacttggggtgatagtaaatttagatttgcataatttctaaatttttactctaacgtcatgtttgaaatatgtggccttaagggcattctcaactttcttaagaatttatcaatctaactgagccgaaagtgttctctagcaattaccagtttttttaggatgtctttcaaccgtgacacgtttttttatgtatatcagcaaattacataaattttaagtatcttgtagcaaaatttgcctaaaaattactgttattagaagtcgtgccttatacaattgcatgattgcataatataaccgagaataaattttacaatgaaaactctcaatgacttgcaagcctatcttcagtaaatttagatcaaattttaaaatcatgctacatacatataattatgaagttatgccttatagactatggtaaagtagtactccctccgtttcataatataagttattctagtattttccataatcatattgatgctaatgaatctagacatatatatctatctagattcattaacatcaatatgaatgtggaaaatactaaaataatttacattgtgaaacggatgaagtattcatatattaatgactcaactgcaaactccataaaagttactttaaacactctcttcaacccaccaccttcacgacaaaatgccaagcttaaagtctaagttggcccaacttctagaacagcccaagcctgctcatcttaatccaatcccttcggaggaattcattcaaaagcctaggcaagccatgtgatacacacggaataaataattaggactaaggttacggtctcaaattctcaattccacagttgtatatgacggacgacacactagcctgtggtcaactttgttcgtcgttgtgctccttctgctcccatcccgtccagagacgacggccggccagcctgaggtcgattcgaacagctaaagcacgagcactgctatggccggccacgggcgtcggtgagcgatggcggcatcgacgattactctcatctgctggtttatatcctgtaagctccctctgctcctctttctcaactccggccgtctgctctccgccaatgtagcctactctttccttatcatatcagaataaacaaaactagtagtagtactctgtctaaatttgtactcccataatattttgaatattggaccaccttttattactaagctttcactttgaactacccctttacctatgttttcagtttggactagttaatatttcctttttgttgcactctagaccaccttctctcttcatctccttcaccctgtcttctcccaaactccgatcaccaaactcctccatcagttgtaggctttattttggcaatggctcttagcagcagtcgggcttggtgagtgaggcacactcatgtactcagtggtcgattagaggaagcgaagtaaggcaaggcagtggctcttggtaatgatgaaggcagcagagagcaagaggccaataaaattattcttttgttgcctccccttggtgttaccttcgcttgattcctcttctatttccattcgaattatttctgcaaattttccaccagaccgatatcaggcgcgctgagacaggtgccaaaatcaagatcattggacgagctatccggctttacctccatcttcaccagcccttggtcgtgctaagctagcccatcacgatatcggcagcaataaagatagagctcaagcgtgtacaatgccggcaacgtgctcaagcatgacttctgccgctgctgtccgtagttgcaggagtggggaggtcaggattctcatgtgatcgatctccggcagtagagtgaagagaaagagggagggagctagaggaacaagaagcctaaattgaaacattttgggaaaaatacctagtccaaggtgaaaagcttagtttatccctagtccaagatgcaagactggttaaaaaatgtgtctcaaagtgcaatttactctaatatttttttatggagggagaatcccaccaataatactctttcagaaagtgttcggatttatttgaactgattgtgctgagttatttgtagcaactagaacaatgcctctttttttttcagttgcagcagatctcaaataaacattatacatactaaattctaaaagtagctattattgtttgaatcccccaaattcgaaatactgcatgcaaaatggaaaagattaaacagctatatcaatgaggattaatacacatagtagttatatagttcagtattgtcgctccattcctatcaaggcatcaaccccggagttgtttctcaaaattgatacctccatggacgactagaatgtcatgtttggctgaccaatttgagtaactcataggatgaaaatggttcccaaaataatgtagaagcatatatttgcaattagggataaataactgtcgctacctctgattccaactgtagatcatcttagagaagtactcacaagaattaagaaagtgtagaaataaataatgttgctgtccagcaataactacacaataaacaaagggcatttttaccaaactggaaatttcgtggtgttacaaaataggacatgaggcatatcaaattgaacagcaccgatatgagtagctgcaaactatcagttttccatatgctgatatacaaatgcttccaattggacaaattaacttcaagttatgcacttatgctatattgtaggttctttttgtctactctttctgcatcatttgaagtactttcagaatgtccagatttctaatgtttctgagatattattttaatatgaacaacactagtagcatatttctaatgaagaaacaaactggctttgaacacacaaatgcttgttacaggctagcagtgttggatgaaacaaatgatcttcttgcataatatctcttggattgattatcttgagtaaacactggtttcatacaggactgcagaaactgaattgagcattgtcgaaacttgaaacgcatgtaaagatggcagcgttgatccaactatggaatgattgggagttacaggtgctggtgcttttaagcttcatgttgcaagtgttcgtcttcttttccggtggtcttcgacagcgcagcaccaactcgtcattgaggattctggtttggttagcatatttggtggctgatttcattgcagtctatgcccttgggcaactatcacggcaaaaaacagatgcaagtgaagctgggcaacctcacaagtttgcattcttctggacgcctttccttctcattcatcttggtgggcaggacacaatcactgcgttctctgtcgaggacaatgaactgtggctcaggcatctgctcaatcttctagtccaagtttgcttggccttgtatgtgttttggaaatcagcagcaggcaatcagtttgtagtctcagccatctttgcttttatttcaggaatcatcaagtatggggagagaacatgggcactcaagagtgcgagccagaaatcccttagacgctcaaccgatggaggagtagtaggtcaatttcctgaactagaagactatcaagagttgggatacaaaactatggtcatgtttgctctgtctagctcaccagttgtgagaaacctacttgttggacgcaagattgatcaaatggaagaaagggtacgtcatgcattttcaggtcgactgtatagtcaagtttcagaaaacgcgcaacttgtgttcaagattctagagatcgagctgggaatgatgtatgacaacctctacactaaggcgagagtgattcgtacatggactggcgccatactccgattcatcacctgcatctccctgatggttgcatttgtgctctttctgacagggaacaagaagtggcaccatagcagagttgatgttgccataacctatgcattgttcattggagcactctgtttggaggtctgtgcgatcttcttcatggtgatgatgtcgccatggacatgggcatccttgcaatattggaagtaccataggctcgcagatgcagcttggtatgttttcaagagcctacagacggagtctatgtcatggtggtcgaattccttggggcaatacaatttcctcagttcctgcttctctgacaatgtgtttgggaaggtgatgagccttgttggagcaaaggaattttggaggaactttcggtactctcagcgtgtgggcgtcaaagcagagatgaagaagctcgtctttgaagccaagtgccttgccgagatcttcggtgcaagccagacatcaagtgtcgatgcggatccaaattcaggcgtcggttcagcactggacataatcctgcgggaacagttcgaggtggccatcctctcgctacacgtctacaccgacatattcttgcaccgatgcatgaatcccacaagtgctgatagctgcgacgctaccagggagagacggcatctgatggatgcgtgcaggacaatatctgagtacatgtgctacctattggtcgtccatcctgaaatgcttcctgtcagtggcagtgtgcgtgatgttctagataaggcttcagaaaccgttgccaaggtcagctctggagctgctgcaagcaagggcagagtcagtgtcgtcctggagaaactggctacagaccgtgacctgaatgacttgtctgatcccatcaccctcgctgggtttgtcttcaggggccacaaggaagaggctgtgcattgtcatgaatcactgcaagttcttgcgcgcgcgtgggttggggttctcctctatgcagccggcaagtcccgtggcgagaaccatgcaaggcagctcagcatgggtggggagtttctcagttttgtgtggctgcacatggcgcattgttcactaggagacatgggcacatttgaggttgagctagttcgaccgagcgcggtgaatgagggcgggcgtaagatgtttgtatggggctatcagcgtcctcggtgacacaccaccct

SEQ ID NO: 10812 - DNA, 9301 bp, Oryza sativa
aatcaaaccaattaagaattcatattctcccatcgaaccccccctttctttataaagggaaactcatggacgttttatcaaccataaaaaaaatatcattatggttgtcaaatgatcatggtttttccctttataaagtatggaatgaatttcaaaattcatattaacgaagggtggataattccaatggaaaatcaaaaaattcaaaaggatgtaaatgtaagttctcaagactaccttacattccacttgattaacgtagaacccaaaatgcaagaactagttgcagcagaaactaaaaaagccagggcaaaacttcaacgagaaatcgtagccattattaaaaatgctggatatcatcgtgaagcgacgcaaatgaaagctatgtttaatctgtaatttctctcatcatttacttcaaaaaaactccctttatctatttggataaaaggagtttttttgttaagcgcaaatagttttttgaatataaagattttttaaaaaaagattatttataactaacacttgtttaataatgttaatctattataaaaaagggtgataatttgtcaaaaaactcctataaatatttaaaatatgtagcattacttcttgtcatatttcaattactgtatttaggaattcccgattctgtgaagcctgtgttggtttatgagtacattatatttttcggattagcttatttatttgctattcttcaagatttttttaatccaaggaaaaaaacagatctattattacgtgtagctatcatcatcagtttaattgtcttggctattacatctatctactataaagccacgttctcaattgctttttctgtaataatgtttattgcgttcagtttttcattatatgtaacaattaagctaaacaaaaaaaacaagcaaaaggattaataccttttgcttgttttttaaaattaatggtacgaatattttgtttgtgttgagtaagtaatattgttaccactcgcacctacatactccactaagtctgtagttgttaaaatgtgagtaccattacgcttcgcacaatcgtttaaaacggattgtaactggtttttattcggattttttaagaacattgcaacaaatccagttatcgtaataccaaagccaacaacttccaaaacttttgccatttttggtgcaatatatttagcaaaagccgttgctactaaggctacgcccaccgaagcaatgcctaaccctaaatcatctggactgattttactgttttctttgtgtgccgcagcgaggaaactttgtactgttacaacctctgtttctcgtcttaccacttttgatgttgccattatatatatcccccctatgttgtatgaatttgttagagttgaacaacctaacactctataaaggggactttcaatttgatttaacaactttttttaaaaaaagttttattcacgttcatacattttaggtttacataacattagaaaaaggcaggaacagctaaaatcaatgctgttcctgcctaggcggagccaagtatttcggtgtccccataaaaaagtacatttctacaggttttctatacaaacatttattcgtttctatatgttttctacatagagtatccagtcattctagttctttcaatcgtctcataatagttgcttcagaaacatctagtattcgcgcaatttctcgattacttttcccagtatcctttaaatgcatcaatttcaattcattgatggttaatttaggacgaccatttggatttccaccttgccatttctcatcatttttttcatctttattatttttaaaaaatctttttagcaatactctccctccactaagtgcgtcttaactctaaattttaagttttgacgcacaaaatatcaaccttcagatattttgtaggactcaataatatctaaaagattagggaattcaaatattcaacaagaaaaaaggaaatggagagtgcaattgtttagaagttgcaaacaaaacagatgaatcagtatagaagtaacctggttatttttgagtggtaaatggcctgattttagcgaaaaatcgtaggaagaaaacaggaagaacataacaaatgttctttagaaaaaaggaaatacagggaagaaaataggaagaatcgcactttttcatggggacaccgaaatactaggctctgcctagtctatcaccccaagtgatagcagatttcccttatgctctttcagtaaatagcgttattctaggagcaacttttgatgacagagatataatcaagctatttaccactcaaaaataatcttgctacttctatgttgattcatcttcagtagcatctaagcgtttttgtttttgtcatagataaaaatacacgccaaaagaaaacctttaccaaaactctcaataatggtaacattagtaaaaaaaagaggtttttatgttgaaaaaaatagtaagtctgcttgcttttcctatttttgcactaggctttttatctactgcacctagtgcgtttgcagaaactgatgagttaggttatgaatatacaacgaaaaaagcaagtgaaatcgattttgcagacggagacttttacatagtattactttcaggtgatgccaatagtgaagacgctacttatgctgtatatgaaaacagtgaagtagaaaagtatgaagaagatttacttgctgatggacaattggataatcatgaaacccaaaatctattaaactctgtaacacctttcgcatccctacctaccaaattttctgaatactatagtggttctcaatggatttcaagagatgagggaccatctttatctcttaaccctttaaaaccagcatatgactcacccccaggaatggcacaagcacatttacaaaaatacagatgggatgtagtctactctaaacatagtggagatgcaaaatggaataatacagccagtatgaaagcacaattacattgtcatgctgatacaattaaaggtttaaaaaatccttggaatatagaaccttggcgtacaacaaccaattatcatgaagtagttgcaaaagcttgtaatccgaaaaataagtaaaaaaaaaagcctaattcttttgaaaagaactgggctttttttaactttttcaaaaccactaaatttatgtgaactttttcagacgtgttgtataaataaatccatttaatatacatagtaacaaaataattataaacataattaaagaaatactatcttcaccctcacttatttcgtcgcctacatagccggctattattacagtaatagctgaaactgcaatagttactaaagaaaataaacctaatgtaataccattaataatttgggtagattttttttgtacaaaaataaaaaacgtaattaaaagtgatgaaatggtgaaaatagcaagaataatgtgtataaaatcataaatttgtaaacttaccataaaattacctcctttccaaatattataacgttttatggtgttttaaagtttctccattttgaaccatagacagatatcagttggatacgtgcaaaaccacacatggaacagccgcaaaacacaatacatcttttctccaaaagcaaaccatacaaagaacccccctctaccttgtgcagaaggtaaaagggggttacgtaccctagtataccattccattaccacgatagcccaaaattttatacatgccccatacataataagttgacataataaccaaaaaaggcagtaacgatgaagggcaaacccttgtcgttactgccttttcatttaaatcacaaattattgtatatgcagcattttatacatggttgatttaacagcattttggctaataaaccaccattgtaacatgcataaaatactgtataaagttactctttttatttattttgagttacttattttatttaaagttactctttttatttattttgagttacttattttatttaaagttaccctttttatttattttgagttacttatttagactctgtgtatcttcgttcaaagtttttcaaattatttcacgtaaaaaaagcgagcgatttttctctgcctttgcatcaaattgttcccaatcatccttcgtgagtgttagagagacttttttagtgatccctatacttggacgtcccacagatcttttcttactaaataaagccattttacaggattcacaatacgtcactggtacatcattaacataaataattgcgacattcatgccactaccacaacgttcgcagacagactctttacgtttattcatataatcacccctttaagttactcttaattctatattttgagtaacttaaaattattccttatatccagccttaaatttactcacccatgtagcgcatagccaaagcccatcgattcttgccatgccctaattctgaatgaatttgatccattgctctttttgctgttgtatacagttgcttatcacgctcacttaaaatgccatagtctgcagcacgtcccatttttctattttctaacacacggttcatcatctgtttctgttgattgttcattattcgattcattcgattacgagcataggtatgtctaaaaccatgacaaccacgtccagcttgttctactccactctttttacatgctacgtttaccccatctcttaccgtagagtaagatacgttcactatccgttcttctggaggtttgtcagctatccaactttctagtttcttttctaagtgttgcggcacattaagttgtcggaaacgccccccctttgttattcctgaaccattagaaatcgccaaacaccagccagtgcctttgtcattgggaataaaatgttctactcgtacattgacagcctctttcacacgcaaacccatttcatgcattaaatcaactgcctttgtgacctcctcagagcaattctcccgaattaattgcacttcattttccgtataagaacgatttttagcatcagagcctgtcagaggcttttctaagcgcctttccggacaaaaccttattgaagtaaagagatgatccgaaaaacgcttagaacgctctttaaaccctttttctaataaccgaagagatgtttcaacatttactcgatgtccttgagaaacgcccttttcactcaaatgggcaaggtatgatacataatgcctttcattcagttcacagatagactttattccatgttcactacggcaccatttcacaaaattttgagcatcagacatcgtgttggtcatctgctttatagagtgaataccactagttcctgcttttttcgcatcacgttttgattcaccaattttatctattgtctgcagtgactcttttacctcacgaacaatggatgtgcgtcctcgtctcgccattgtactcctccttttcttctcacttcaaagtccgtttgccctagctttgctcgggcgctccaccttaggagatccgttgtctacgccaacagacctcctaaggtgtcggatgcatttgtgctccgatatgtattcgattatcaatgtgcatacttcaactttccgcgctttgttatcggagtgcgccatataatctccgcccgtttttgcgctgggagcgcaaatggatttgctagcaaatccactatggcagcttaacgctgcaagcaatctacggattgctctttttacaatcacgttgtgatggccctttttctacatcctcctcctttttttgttttttctttttcatttttagacgcaaaaaaaagcacgtctgcttaccctccttgtggtagtgacctacttatccttaaaaatatttaatttttttgtattagccgattgctctaatggggtgtactctcccaaatacaaaatcattcttcccgtttttttattattcagggcatatttcaccctacccattcttacagcaacctgaattactgtttcaattcagcccaaaagctcgtcattgttcactcaacttcctcaccgtatggttgggaagaaaaaataaaataattatatgcttttagcctagcagaatcatcaataaaataaaagcatttcatttttgtagagcgaagacattttataggacctatgagaccaatcgaaagatcatttattgggtaatggttcatctcgattggtctcagaaattgaaaaaaccctcaaatgaaacaattaatttaaaaaaatgaacaacaaactagaggttcggtattaaccaatcctcttttaattaaatactacttaacatagccaatattcgctcacgttcttgtgcaaagcaggctttcttttcttctgttaattcttcttcttgttcatgacgagtcgcaaaccatgcaggcacgacttctacttttctagttttctctttttctggttctgcagatgaattcgaaaccgttaaatcgttgattttgttgcgaataaccgcacttaataaagctaatcgatttgttttgacgtattgatcgttcgctgaaatggctgcatctaatgattgatacataatcgtttctaattgcacgtgagacagggttaacttgtcctctgctttaatcttttttaatgaaccataaataacccctataaatgatttaaagccttctaaagagcctgtacgggcttgatagagattttttaaacgattataaagattatttttcttatcagacgactgcttagtagacgtctttatatcttttattattttaatttggttattatagttaaaatctgaatttgggccatttaacgttgatataacagcgttttgagccaaatcctgatgtttattttgatgtttatttggttgtttaaattcatctttaacgatggcaatttcataagaattaagatgataaacttcacttaaaatgctttcaaaattcacatgttgcacgtccaagatgacacgacaaccactattcgttttccctgatctgtttctagacaagataaatagcttggattgctccatatacttaaaagctgttgaaattgtatttaatccaacctctaatttttcgctcagatgctctcggcttactttgataataccgttatttgtaagatcataaatcattttttctaacactctatgtactttcccaccaggataaattccttgggttgctagtacttcttctaattgctgcaggcgttcttctttgagttgtcgattccctttttgattgccgtatgtaataaatgtttggactgcttggtttggtgtagtttttagtttatttttcatggtagttgctccttttttgaagcaaaaaagcgtttcacatcgtgtcttctgacgatgcaaaacgctttagattataaaataatcctcaatgacatagtaattaactgttgaccattattaaaattcttaatagaatgacctatagatactttgtatctctataacaattaaaaacagtcatttcacgataagctgcatcgtatctgtatcatacgataaagcgattaacaaaggacggcaatccgatgttagtcactgtggaatggcttttttacgttcgatttagttattttcaccatacgctaaagttagcaacttgtaaatatattctatgactattagtttctattagtttattgaatagagccatgacgcttgaaaaattctagtagtgcaacctcgactaactgcgatttttttatatttaactcatctgcgacacgatctacttctgccactaactcctctgaaatgtaatacgttttattttttctacttctcgtatttaatttcgcaatctcattaaaaattggtaactgttcatgtggctcctcttgctgaatgcgttcttgaatcatcttttttaacacatgaaactcgttttctgacaggccaatggcattcagaacctctaggtcttgctgtctattagtttctattagttcattattaggagtagtgacggctacctctttattagtttctattagttcattattagtttttattagctctttattaacttctattagttttctattcactttaggagtttgccttggtgatactgcttttaactgtgccaatgcttcattaaaagtcatatctttatccggaaaattagcgtcacgttgccatttatgttgcgatttattatagacgggccctaatgaattaaatacttctcgtatggttgtatcacgtgtatttaaaacctttctaagctcttttaacgattttttactcgcaataagctcagaaacgttgttgtcttttgtcagctcccacatactattcactctcctaatagtttctaatatattagtttatattagttaactaataatactattacttttctccaggtaactgtacaaatgctgcccatttccggagaaaaaagagtggagcgtttttatataattttttcattttcaataagttcgaagaacgaaggtacttttctaaattgttttgttttaacaaccctaatgatcattaacgaaatttcctgttccaaatccatcctattttgaaaactggtctgatgtaaaactgatttaattttaggctgcaacatatctagaacctcctgttggaatgccgtacttcttaattcacttaattcatttattggcatcaacatcacctcgattttttggaatactcctgcctaattttttgaaaagcctggtttttagctttattgacagcttgttttgaaatacctagtttttttgaaatttcttcttccgttagattatctacaaaaatagaatgcagaatatatttcttttttggtcctaatttcgaaacaatattataaagttgcttgtcctcgaaaattacttccaaatgagcgaagtcagaatgtatccattcagaatcatcatcaatactttcatctggaattaaatcgatgaatttgttctcaccctcattaatgtcattatctaatgttaactgattaacttggttaatatgacggatttgtttgtcatatctttgagattcaaaatacaaaacatgggaaaaataactaagtaattgaatttttctaacgtggattttgaataatttttcaatagtgtctctcgtatgagtggtaggattctctaaataacttttataaagcttacttactttttcatcttctaaaaaagattttaatagacgattttgaaccaaaaaaatcaactcctatataaaaacagaaacatatgttctattttatagcaaaaaaaagagaaattacatccatcattgtgttcattttacatttcaacatcgcaaaatagc

SEQ ID NO: 10813 - DNA, 1745 bp, Oryza sativa
cagatgaaaaagtacggccaaaagatttttctatgtaatgttaataataaataaagaagtatttattggtaaaacttgttaatattgttataaaaatgtattgaagttggttgttgcgcaatttcatatgttaagtgagataatattttgtaccttattcgacgtattagtactcggataatttatataggcctatcgcagtctaggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaaacatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggaatcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcatcccatgaagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcaagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttagcatcgatcaccgcataggcagagaggacgctggcaccaaggtggtagtaggtatacacaagaatcgctacgccagtttggatcctcaacaccccggcgtctagccattgacgaaagctggtcggatttgtaatgaagcaagtggggaagagagtactgaatgtgactgagttctgaaagattgtgaggcctcactcgttaaggcgacttatatagacgcaaaaaatcgagtgatacccttgacatgtgaacgtggtggggtatggtgggtacgcctgattggcgccgaaagatacatgcatgatcggcgccgaaagttacattggtcgtatgtgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaaaagaagactgctctactggccctgccccgcgccgcgaccacgcttggtcctccgggcctgtgctcgcacgtggtcctgggagtaggtga

SEQ ID NO: 10814 - DNA, 5971 bp, Oryza sativa
  unsure (1)..(5971): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttgtgtgcgttaggactctcactggtgatgtttgaaatatatgaagatgaagatgaagatgaagtccttgcaacgagaaagccgttaacgtcttcttttttgcgaggtttttttttttgaaacaggaaagcaacgcttcaccccttctccattatcggaaaaggaacagtgacaattcattatacgagctactaagaaaaaaaaaacaaatgcaggggaatggaaccccaccaagcattgtcatcatctcttgaataaacctttttccttggcaaactaatggatctagactatcacaaagatctactgaaaactaagtactcattgaactactagtgaaatctgggatttcagcttccataaagcagcaggggttcttgatcactccatcatgtgcgtcaggcatcttcaagtcttcctgtcccaaccttccaaccgtgcttcgagttgtagacatcatttgccacaccggccccttagcagctccaccccccagagtaagcttcttgtgtttggtccctgtttctgtaacaccacccaggagacaatcaaagagcagatataatgtcccacagaactgctgccaccccaacagcaaccatgcttttcatggacaatacaggaacagctgttctattgtttcatcagcctgacaaaatagacacattctaaacttctaacacctttttaggttaaaagcaccaaaaaggtgttaaaagtttagaattgacccaaatcaaaagcactattaactagtacattccatacaaactttgccaagggacaatacaggaacagctgttctattgtttcatcagcctgacaaaatagacacattttatctcttcctttccaccctctcttaagcaaattatctttggtggagacacttttattcagagtcagccaaataaataccacttttgcaggaattttgaatttccagattttttcctattagggcactttatttgttgaatctgcagcgctctatagaaagatttcacaaaaaagccttttcttcctatccagttcccagaccaaactatctttctgattattcaaagtgatgttcatgaaattctttttcaaattttgctaggaaatttatttttttccctccatctttcttctaaaactcagcacatccaacgttctctcgaaacttttgctactgtgacattcttagtcatagccacattatacaggttagcatatttaacagcaaaaggttccttcccgttccatctgtactcccgaaagagagtgttttctccattaccaatttcttttgaacaggattttaagaaatcatctctcacttgcattaaaccctgccaaaagatagaatcaccattgctgagttttttttttttgtgtctcaatgttgtgtgatataaatattttgctttaaacaaatcctaccatgacccttcttcagtctcaagtttccaaagccatttaccaagtagtgatttattcattagttccaaatcaaggattcctagtccattcaggtcttgaggtttacacattttcggccattgaactaaatgctactttttaagggcatccacaatgttggtaaaaagttagccttaagcaattaatgttgtacagtaaaacaccttaagcattgtgcaagcacaccataagaaccatagagcaaaaagaagccttaagcttacggtgcggcaacaagctaataaaatatgcagtgaacagaagatggaagacttttcattgcgccaagtgtttcacgaaaggagtgagtagtgatattttttcccctcgatgggacctagtgggccccaccttattttctctccgtgacacaagcattgtaggcatggaaacaactgctgcttactgtggtgggtcccactcttatgtttcatgtaacctttaacattggcgttgccctaatgccatgatcttcctgccttagaaacctatacctgaactagtcaatttttttcttaaccccttgaggtagaagataaaaggacatcataaaagtgggaatactactcagactagaatttaattattagtgtgagtctcccacaatagcaagtagtttccccttccaacaaccaagtctaccttccactttatttttagtggatttccaatccttattatgttttcttttgcaagtatccctaagtattcttttgcaagccattagcataagtttagttgacttttaattattacaaacttaaaaaatagatttatttgatattttaaagtaacttttatatagaaagtccttataagaaacacattgtttaacggtttaaaaaacgtgctaataaaaactaaggtaaaatatgtatcttaattaaaaaagaacgggcctagtcatacgcacgctagtttcaacggtaccccccccccccctcttataaatacttcgtatttacttggacaagatttaaatttttataactagtttattagaataaatataaaaataagttcacgatattatcatactagttaatttcaaggtaaatctatgtgttatattttttttacttagcatttgataagttatcgacagtcaaaatttttaaaagtttgtttttactagagggagtagtagtactttgttaaacagtaactaattattggattctgcgtttaatccggtattatatacaatacagagaaagtagttaagagtctccagtagacattccaagttccaactccaaggaactggatcttttcatcaatcatcaatgccacacgccagtagggtacgccgatcaaaagcctatacaagactgcaacaaattaagttggtgatgcaactaacaaacaatcacaagcaagaaatcttacggtgaataatttccaagtgaatgagagcgataagaaagagggattttcttgattcgcacggtgatggcaaaatggcaattcctttcttgatggctggtagacttcatggattgaggcatcgagctgatgcagctgggcctacattgcccccatttaggcctagtcatcgaggggtcgcaggcctccattttcgctgggctggtaaccaggctctgctagctctggcacattttgttgggaataagtatactttaactctctcaattatagctccaatctgtttcgtaccccttaaccgcaatgttagatatcttgaccctcatctattaaaacatgtgcaaaatgattccctcggtgattttcgctgtggcatccacatatcgcatcgacttagtctttatgatatgatgtgacattacagtaacaaaaatagtaaaaataatgcatgggacctacgggtcagtgaccactacttttcatctttcctcccctttctcctccctctccctccacctcttctctctttctcactctctgtgctgaaatcattcaggcaaggagaggcaggagaggatgacagtgacgacgccgacgagctcaagcaggggacggcggtcgaccacttaggcaggccaagagctgggcagcatcatggccctaggcggagccgtctcccattcccgagcagcgatgctggctaaggaggccaccttcgcctcctgggtcgtgggcggcgcagactaacgctgactaggaagaaggtactcaggttgaggagggagctgacgagggtgcgatggtggtgctggaggtagtcaaaggatactatgtcggggatgagatggaactggagatggatgttgggcgccgctcctcctctccattgataggagacaagaaagaagcttatgccaccgacggcatcgattgcctaccttcggcaccccctctttgttgtcgtttgtctccccaaccaccaccaactggtcttcccttgttgtcatcctctcccacctcttcttctccacctccccgcggggatcccatccttctcgtcgcttccgagggctctccaaccattgtcgcctcactttcctcgagcacgctagcaagctttgccctcattcaggtggaggtgggagggtgccgtggggagatccgagaggacgccgtgggcggggaatgctgcccaagggtgagactgacgacgccttgcgctagacgcctagacttgagctccctgtcgtcgtcttcccctgcctccccgcttggttgattccaatcgcctcccactcttctttcgctagccgccgcatctagtcgtaccgatgcttgtcatgtctccgtcatcccggccagagagagagaggtggagggagagagtgaagagaaatgggaagaaaagaggaaagcaagttgtaaatgttcagtaggtcccacgcattattattggtttttttaattgtaatgtcacgtcggatcacatgacaccacgtcattgaaaaccacctcaaaacccccaccagccatcaggggagtaatttggaatcggtttttaatagttattgaggtcaagatatttggtactgtagttggggatatgaatcagactggagctataattaagggagtcaaatgaacttattccttttgttggagctctctcaccctttcggcccaacgattcgacagcggacaatgcacatagcccaactcctccttgtcgcaggcgttttgtttggtcagttttgctaaaaattgtacagaacttgccaatattttggtagtggtaagatttgccgttgcaaaatttttagtaaggtgtgattgtttggtctggcaccatttttttttgtatttgtttgagccctttgtttggttttcttgccaaaacattggcatagccatttttattaagtagcaaattaaatactatcctaatttattgatattaatcaattttttggcacggatagctggggcataaccaaacaagcttatctgatttacgctaataagatgatatgttacaatatgataaaataggtttctctaatcgccgtgttaagtaaatgtttttaagcctaccgagcaacaagccacaaattatatttatttataagaaaaaaaaacctagattcatgcatcagttgtggtcggatagctacttttcccgttcttttttttccccaacggtcgaaccattgccgacgttttatatagagaagttgtcccatttcaaaaaagaaaatgagaccaaactttacagtacatagttaattagagaaaattgtgcgaaaaccacaactaaaacaaacagaaactgataaacctaaactacaacccaggttcaatacttagcaaacgctattcaccacaagatttgcaaaaccaagtagtaagctagaagatcaaataagccccacccccccccccggcgcacgagcagatatatagtgttaattatcatcatcacaccattgttgatgtaaaaacacgaggcctgggagatgcacttaactccagtgcaggtccaaaagcttgcatttaggtgtgtgatcgtgccagttgatttgatcctgcaagtaacaagaaataaagacaaaaaaaaccgcggttaaatccataaacgatagccgatcggctagttgccgatgacatatcatttatttttgagccgatgtcatatgtgaatcgatcggcaatcatgaataaataagaaataactaaatctatcggctgtagatattaacaatatataatctttatgtcgatatatacttaaatcaagtgattgggatagatcggtcaccatgctgagacagtataaatcacttagatcgaaatatatattaacaacaagattatatatgttcatagcatagccgatcagatagatctagcatgtatcggctaatactccgatactactctatattaagatattaaagcaagtggaatata

SEQ ID NO: 10815 - DNA, 5587 bp, Oryza sativa
attttttttcttttttttttagatgtgaatctgtgatgtatttttgtgtgagatgtgaatctgtgatgaattttttagaatcctgtgatgtaatttttttaagagtttgtgatatatttggagatgatttgtttgaggatttggagatgttctgtaatatgtgatgatttggatatgggatgggattgtgtgaaatcaatattcaatattaaaagcagaaaaaaaagaaaaaatatctttcgtcccggttggtgttatcaaccgggactaaagatgctcccatctttagtcccggttggtaacaccaaccgggactaaagattgatttttagtcccggttatttgaaccgggactaaagatagcgatctttagtcccggattcgtagtcccggttggaaaaccgggactacaggggggttatgaaccgggactagaaagcatttctccaccagtgtaaatatacttaaatgcaacaagatcttaatataaagggcatatttaacatgtcaatcaagcatataggataaaagtagttaaatcaggtaagatcggctgaaaccccgattctacactaatcgacaaccaaaagcaggctagagattgagattctaatcacgacttataagatcaaactcaactgatgcagctacaagtatgaaaagaagaacaatatctagacaatcaagccgctggttatttcatagagtggtggatatcctatataatttaagtcaacgttggtatttaacctgatcggctgccttctagtagcagacgttagccgattggaggttaaataatgatattgccagagattatacagaatatatgataactcgacaaattacataaacaagattagagtatcataaagatggaagcactaatcccgagaacgcaagtcgccataacaagttttacctcttagttgaagatcgaaaccgatgcagctcaacccgaaagcaagaactcgtcgaaacaaaacgaaagtaaaagggtggcgatgcgccgaaattgtattgaatgtgtgttattgtattacatggggctcggggtctatttatacccgagattacaaaatatgtccgtgtcggacacgactcttctctctaacaaactccaagataccataagtctttgcggcagacttttgcctaaacatatctctaaagaaattacatgaaatatcctaattaatagatacaattgccttctcaggactcaatccatgcacggcaatatcctcatgaagcatattaactcaacccgacaacatgtaccacgtcacattgtcggtatcggctgaatcggccaacctagtccgactcgaactctgccgatcctagtcatagccgattcggactttagccgatcctcgctctgtttccggaacaatttccatcttgaattctgcttcgatcctatcttcatctctgatacttggattaccaaatttggtcgttaacaaccatcatgtgcgaacaccagggttaggaaagccctgtcgactaacaagcttgctacccagccctagagaaaaactcaaagggtaaggtcctacttgagtcattgttgccaagcacgcacctgttggaaatttagtcataattaggtatattttaatccaataattcggcatatttgccaagctcgcaagcgaaccgtttcccatctacaaggaggaacctctcccgacctgataagaagaaaacagggaaatgtcagcacacacatgaatattagcaccagtataaacccaccaatcaagtgagtgaaaaacagagaaaactgtaggtaaaaatttaccataccccaatgtttctccgccctcgctaataaccatgtttgcagacttcttgtccttacgctcaggacaattcttgacccaatgcccaggcttaccgcacacaaagcagtcgctctttgcctttcccttgcctttcttcttaaaattagttgtagccttgggtttgacgtcaggtttgactttcttcttgttgttgtaggatgcatgagggttcgtcttttgcaccaaattggcggtagaacctccctcgatcactttgccccgattgtcctttgccctccccttctcctcaacacccaaaaagccaatgaggtcagtaacactgaacccttgtcttttatgttttagagaagtagcaaagtccgaacaagaaggtggcaatttggcaataatgccttccgccacaaacttgtccggcaactcgcagttgttattctcaagttcctttgccagcatctgaatctcatgagcctattctactacagtatggtcatcgaccatcttgtagtcatagaactgctccatgatatatagctcgctgccggcatcggaaagtccgaacttggcctcaagagcatcccacatgttcttccccaaaggcatgtgcatatagacgtccactatgttatcggtgagcacactgatcaatgctccacagaacaagcaatccgcagcctcgaacttagcctcctcctcaggcgagagaggcggtttgggcatcttgccccgtgaaacaaataagcattgcattgccgtcaaccacaatagtacacgtgctttccatcttttataatttgaaccatcgaaagcgtctggttttagtgatgcagcaaatccaactactgaaaaagacctatcaagtttttggattgttgaaaatttcatcataattcggcatattttaattcaaaatattaaaacaataaacatgacatttgcaatatgagtagatctagtgacagtgctagatgtaaaaaacttgagcatgcttaatataaaataagcatcaacatttacagagtaacgcaatgctaccattgtgaagaatattagcaaagaaacatctaatagaatcgggagaatgaaagtataccccgagaacgtcccaccgctagattttgagacagtattgcctccattgatgtcgttcacctcctagtatccaatatccgtcgacatgttggtgaaggcaccgatgcagcagcagtagccgcgaagaacaggagcagtcgtgcttgaagcgctacccaaaaacttgatcgcccgcctacccgtgcaggttctcaagcggacgaagttccggaggcacctgctcgtcccgtacacctatgcaagcaggtgaagagaaccggggaaggattctgcaacacatgaacagaggaggaggaactcgaagtgcaagaaacatcaggaagaacggagcttctattcgtctgttgtccgtctgtggagtttatatgcgagcacgggagtaacgtgcagatcatcaaccgcggtgtttaatttggtaaccgacgcgctcgttaatatggaatcaattcacggcgtttaattccgtaaacgacggaatcaattcatgacatttaattctgtaactgacgcattcgttaatacagaatcaattctccgtgtttattaccgtctgctacaaaacgagagagagcagcagcagcagcagccgcttgcctgcctcgcctcgccccgccacgccgcgcgcgtggttgttcgcccaccatctcaaccggtcaacagagactcttcattagctccgtatttaagttgatacctcttcacttagattttcaagatgatattattacccataacacttaatgtgggacaataaaatttattaggatttaattgggtctagcccattaatctcctgcatggcagctccatttttactcaaagtaaaatttttactctacatatgtaaaatctaagagtaaaaagtgtactaggggtaaggtgaacgtaacctagaggtcaatttttcgatcgtatggtagttccatgtttacactacattattatgtggtttacactgtattttcaataataaaacaagaaacttatgacatcagtaatactacggggtggagcctttggtcagtagatgcagcgaatcgttgctagaacagtgcacaattatgaatttggtcaattagaattctcagcatgtgaaatgcatgcatatcaagtgatacactaatcagtgcagcgagatataaggtacaccgataattgggactaactgtttgattcacatctagactgatcatctacagtgttgtagacaagccagatcaaacttaattagctagtaatatatatgttctgggatatattcacccacttccatctctcaaatgccacacatatgacatatctgtaagaactaacaaagtgacatatacacctctacaaaattcaaattctaactagattcttttcagcgaagtacgggtcgagtgtagacttcaattttttcgggtagatagaccataaataacatcatttgttttttttcctccctccgttcctttatacttgtcaccaaatactattcacatttaaactctaaacatttatattttttgcagaaattttctaaatatctaaaaagatttcatattatcaaagaatacttcctccctcgcacattacttgtcattctgggttgtatagcattgattaagatttgggaaaaaaaagattatagtgccttttactaaataatttacggttaggaaaattaggatggaaagatggttgagggcatgatagagagaaatttacatgaaatgtgattgatgagataaatagtactccggtaattgagtgttctaaaagttacaacttacaagtaatttccgataacttttaaaatttacgaaaacaactattttagaactgagagagcattacatactaaggctgagttcgtttgagtgagttcccaactcactcccctcgttttccgtgtgcacgatttttcaaattgctaaacggtgtgttttttaaaaaaaaaaattctatacgaaagatgcttaaaaatcatattgatctaattaatcacgctctaatggattgatctgttttctgtgcgggagagatttgctcccagctataagtaacgaacacagcctaaacatattaaattttcttcataagtatgggtcaaaggtgacaattacttcctccacctaatataaagaattttggattgatgtgacacttcctattactaagaatctggacaagagcctgtccagattcacaatactaaaaagtgttacatctctctaaaatctcttatattttgggatggataaagtatccaagaactggggtagtttttttagcacgttctatatatttgagaagtgagagtgaaacattcagcgtccttttccaacggagcggctgcacatcacgacaggaggattgatggacagagaggacgggaagcaaggtctttcccacgaaaaagatctctgaaagaggagctcaggctgctcagccaataaaccaatgttgcggtcatcacgtgtccaagtgttgctgtcgtacacataccttctatgcgtgtatttcttttcgtccttagaactgttattcttccatacatactagcaatagggctaaaacttctagtcgccatatatttgtatcctggtatatccgtgagtaatatctttactcagggcgtcaggtctaccattgtatgaaaggatatttactattaagcactaccgtgtttgcattatatatat

SEQ ID NO: 10816 - DNA, 29354 bp, Oryza sativa
  unsure (1)..(29354): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattaggattaactgatccctgtcaaacaagcacatatgaaacaaggaaatgcttaattattccaaaaaaagataaaatccttagatgattctgccaaataaacaaaccccaaatctagcaagcaaagcaatctgacaccaagatcagcccaagagcaaatcagaccgggttaattttccccttccccctcctccccatagaagatcaatttggtggtcgaatcttagagctcttgtcgatctctctcataagcgagtaaggtatgacggcagccaacatggtgggcatttggtatggtgatctgaaacgagaagactctcaagcaaccgaacattttaatgttgaatcacaagggttaggaagggtgtacgcaccgtccgttctaaatctccatcaaacatacgagatctgccattaggtgtctagccgcatccacatagggctcaaatattcgttaattggtgctacctatgatttgagatggatatggtatggctatatgatgtcattatttgtattacttttaatttagacatataaaccccaaccctatgaactttacaataccatttaaattacatcataagatagtttggacggtggttttgcatattttgatgcttaaacagacagttttaagtaaagaatatacatatgtactacctccgtttcaaaatgtttgacgccgttgactttttaagcacatgtttgaccgttcgtcttattcaaaaaatttaaatagttattaatttttttcctatcatttgattcattgttaaatatatttttatgtaggcatataattttacatatttcacaaaagtttttgaataagacgaacagtcaaacatgtgctaaaaagtcaacggtatcaaacattttgaaacggagggagtatatatcatcaatctttagttcttaatttatgctccataaaaatgtcatactagctggtatttgtttttaactgagagcaaacatagggtaaaaatatgaatttaagtgaagatttttaatatatatgtctaataatttaacatatataaaatttagataaaaaaccattttgcaaaaccattttacatggtcatataaatggtattataaaatttaggagctagatgtccagttttaaaatttaggatactgtgatgtgagagtagctcatggttaggttccttctggtggaaccagcccaccaaggttcaggttctagacttggcatagatatgtcggcccaacaatcttccgaaggtgctcatagaaggtatggtgtgtgtacgttcataggggtaagtgtgcatgtgttgtgagcatctgcgtttgtactaatttcgaaattcgagaaaaaattgaattgtcgcccatgattcttattggccatgatgattctgatatccgaaaatgctctcagcagcctccaagtgccaattcctgaaattctgaaagattttacacatgttctaaacttctgaagttctggaggggaataagagattattgtttacttctgaaagtcatgtaactgatggtgaaaaatacaacacagagtatagtataatagtatattgttttaataaaacagagtatataggtttgatgttcatcgtgtgttcattcagtttcaaaattatgtcgagatgtgtttagtggaaatagcttccttttctcaacattgtcagcatccttctggtgttttacacttgtcaggacccaaagtttagaaatggaaaacattaggagtcatcaggattcagagaagttcagaaattttttttgtaacagagtgaagtctgcaggcattgtattggttgagtaatttcacttgtaggacatcttacggccgaggggacaaggaagaccatagagatcgtgcggctggagttcttttcagtaatcactgttattaatcatttgtcttttactttttaggcgcaagattataattatgaatagaatttacttcttgttaaatgtgattatgctgttaacactttaaataggggcaatttcgttcttacctctacttttatggctaatattggttttgcccttattctttagggttttcgtttttgccccagtttatttgttttgaaacgaaactaagttttacccctactttaaatgggcatgttaacggtgttaaatctttgaaaaaaagacatccatactatcagtgtgttgttgcacatgttccccctttttttcattagttctatatttaccctatagctgcatcttgcaattttcgtaaatcaaaaacttttacaaatataacaattttgaataatatcaaaaaatattgtttcaaaatttgacacacaaatgtgataaatctagataaatgtcgaacaaaaaatgacaaaatttggcgaaaaaaaagaagggttatatagcaagctacaagtcgtcgctgcctcctggccgggccagtgggccgttgctgccgtcaaccctggccgggccaccgccatcgattcctctccaagttgagttgccaccgccgcctcctccccacgttgagctgccgccgtcgccccctggccgggccgccaccgtcaccttctccccatgccgagtcgccaccgccgcctcctcccagcgtcgagctgccaccgtcgtcacccgctggctgggctgccgccgtcgcctcctctccgtgctgagctactgccgcctgactgggatgtcgtcgtcgcctcttcactctcgcagagtcgctgctgccgcctccaagctccctgcccgccaccaccttcaagcctcctctcagccgccacctaaccccctccccatcgtcgcctccaagcctcctcacccacgccgccacgccctctccccatgcagggcaggaggggtctgcgccgaggcgccacctgctgatgcctgctcaccgccacccgccgacgcccgctcatcaccgcctgctgcgctacccgatgccgctggatggggttttcgtgagaggctggaatagtttcccctattagatattttcttttctttctctatttatttaataccataagtccagtcccactcacttccgtctaaaccaggggcaaacggctctttcggtttaaaaacgtgggggcaaaaacgaaaaccctaaaatgtaggggcaaaatcaatattggacttcaaaactaaggtagaaaccttatggtgtttcgagaatagtttcaaaaattgaattatcgttcatgattcttattggcaatgatgattctgatttctgaaaggtgaaaaatgctctccgcagcctccaattgccaattcttgaacttctgaaggattttacaaatgtcatgttcttctgattcttcagaagaggaataaagctgaggaacacaggggtaactaaggaaggaaaacagagtattgtttacttctgaaaaccatgaagatgaaggtgaaaaaacagagtaacacgattttaatgaaacagagtacctctccgagaacatatagatttgatgttgtcatgttgagcgtgtgtttaatcaatttcgaaatgtttcaagattttgtgttttgataataatattttctcttgttctcaaccttgtcagcagccttatggtgttatagcattgtcaggccccaaagttcagaaatggaaaccattcagagtcaccagaattcagaaaagtacacaacattcttgtaacagagtgaagtctgcaagcattgtaccagttcagcaatttaacttcaaagacatctgacgtccgagaggacaaggaagagatgccatagagatagagatcgtgctgctggagttctgcctggaatagttcttttcagtaatcactgctattaatcatttgcctcttacatttttggcgcaagattaaaaaattatgaacagagtttacttctgattaaatgtgatgatactgtaaacacttgaaattatgttaatgtaatgaagcaactatgtatgacaaacacgaaatttcaaatagacaggttacaattttttcatgaaaacttttgtcgatgttgacaaatagcgagggacctgaaaaaccggaagtatcagaactgaaaaactggccgattgctttgccgtcggcgaggccgcggcacgtggaggtcgccaacgccgaggagtcgatgggccttacagtgacggcataaatccgattgatcttcgcccatctaacaaaatctcagcctgcctccgatgcatggaagcccattaaaaaaaataggaatccaccaacacacatccactccccacttgcgctccttgcggcgccgtcgtcggcggcgccgccccgccatcgatggacctagcagcggcgggggatggtgcgtttcgtcgccgtcgtggggtcgagcagggagtggaagcggacctccattgttagcgcaatcgtctccgaggtctcgggcgacgagcagttcgatctatttgtgaccgagaaataggagctcgaaaagccatggcggcgctgtcgagcaatgcccccaaccctggctctctccggccgcaaggtagcctttccttcgacctgagcttatttcccttggggccttgctcgattgtgctgcacctccttagatattcccatgcataatcccttttctctctttccgctaaattgtactgactgatctgcttgtgctagttggtactgctactgacgatgttggaataccatagctgtaataatgccttaagtttgtcattgaattaagctattagtgtgtggcatcttctgcatctgatgttcaatttcctcaggtagcagctatcatgtcatctgaagttcagtttgcaaaagatgaggagaataaacttgatgcaagtcacttggcacaagtgctgctaagcaagggatacgaggaacactgcagtcagcccagtacaatgtatagccatttttttttactggaattagatgttggaagcatggtcatctcatctggctaggatctacaggactccaatactgcacatatatgatccaggaaccagcactgaatcgaagcaggcctccaattgtacactcctctccaaggtctctggctggttgtcgggcaactcccccaatcccgaaaccctctccctgttactccccttccatttcagcttaaaatgggagaacctggcgttactagattgtgcacacgtaatgttaaattcggtaatatctcatatataacataatcctttttctctctgctgaatacttgaatttggtaatgtttaaattacttcaatattgattattctgctgatgccaactggtactgaactactgatcattttggaagccatgactgttttttttttttgcaaagataaaaaatggcaggagctcttcctattcaattaagaagaatagaaagaagcatacatagaactatatatgatcactttccttagatacattctatcaggacccaatttaggtatccatggaatagtcttctatcttctttgcactgtccctctcacaatgcatactaccaatcttttttggacagattgtggaagacaatttgccatgtatgaatgaagaattgacactgtttggctaagtgagtcatagtctcattctccatgatacacaaagcgagcaagatgagttacatggccatcccatgagggatgaggccatgacggtaatgcctcagttttattagtgaattgaattagtgtgggtaccggttcttctgcctgagatgttcaggttgttcagatactaataattatctttttagtttactttgttacccttaatttgcgtttatgcttgtttaattgtagatagtacttcagtttgcagaagatgatcagatcaaacttgttgtaagttactcgacacaagtgccgctgacaagaaagtagagagtaaagaaacaggccagacgggagagtgtactccagtacggtgtaaagccaccgttgggcgctggagatgacacatcttgctggactggagatgatccatttgcagaagtggagatgacacatcttgctggagatggcctgtacacaagaagcctactgagtttttagaaaattgtggcgtggtgtaatattttgctgctcgcttcagattgcatttaatcagatgcaaaggaatcatattgttaatcggctgtgcaggaatctgtctcttgttatattggagcctgcaaaaggtggttgtaaagtcttggggatagcattttttgttttgtacaaccttcagtaaaatatgtaagatgtaattgtcagtatacatcctgatacggtggtacctgacataaattaggggaacagcagctattttgtatcagctggcatgtcggtttctgtaatttgatgcaagaaaagtgccagggtgccagtgggcagtggcagtcatgttatacagtgcaagtaacaggacatgatgtgaaatgggttgttctatgttctctaagcttgtatcatgcatgtgccatcccatccactgaggtcaaagttcttttgtgttgagtgataactgatgatgagctgttgcatgttatcactttcagtcaataattcagtaacaatggtgcattgtcataagcattgctcatggtgaatctgaaattgctcagtctggagcctgttgccaaatcttgaagtagtgtgacaaatcaatgagcttcattaaaagtgcaccactaaagaagtgtgacaaatcaatgaactgaataaggaatatattcattgaagttgaacagcaaccttgccatccatggcgcccagccgcccagcacttggcttcctctccaaccgtgcatctttgctccaatcccccaattgctctcacctgacaacaccaccgcatcgacgacggccacaagctcgcaatcacacgcacaaatcacaacacaacaaggaagagatcagacataaaaaaaagttgattattttattattgcaaaatcaatgattaaatacaacaatgtaactaatgaataatgattaatttctattctacaatgaataattagctttacagctgcaactacagtactacactaaacgtacaactacaaatctaattatctatctacaaatcacagagatgggaaaagtcttcgactttgattagagacttggactcccatgccgttgcttgttgctgttcaagcgctggatttcttcttcttgttgcagaggcgctcgtgcaccaccccgcgcagatcatcgtcgatcttctcccagacggcggccggcagcgtggcgcaatctgtccacagcccgggatgcacgtacgcctggcgacacagggtgtgggccatcgagttgccctcccgatatatgtgtcgcacctcgacgtccgcgaagcagcggagcaggtccaggatttcctcgtgcatcgccgccgggatcctcgtctgcgtctcctcgccgcggatgagctgaaccagcaccaggtcgtcgccctcgacgacaagccgctcgacgaagcacgccagcgcgagcctcagcccccggatcatcgcacgggcctccaccacgccaaccgtccagtgctccgtgatctccgcgaaggcgagcaccacgccaccgtcgcagccgcggatcacgccgccgatgctcgctcgccgggatccgtcgtcatacacgctgccatcaaagttgagtttgcaccacccccccggcggcgcccaccatctgacgatcacccggctcggcttaaatggcggcgaggacggggacagcggagtggagcagcggggaaccggtggtggcgaaggaaagatcgacggcaagaaagccaaaccaccgccgccgccgcgaccgtcatcagggacccggagcctcccgccgtccacgcacatcctctgcccctcgacactgctcctctgccgctttccgttccccttcttggccaagaagaaggcctcgtcgccgcggccgtgatccgcgagaagattccacggcggcggcgcgctcaggggatccgcctcgaggatgtcgccgccgagcgggaggggctggccctggaggcgccggagcaggcagcggccgacgagctcgtcgtcgctgggatcgagcttgaggcccgggaggagcccatccgcgccagccgcagccgccgccatcgccaccggatcgcctgaggatttctagggttttggtggagagaaagcgtgggcgcgtgggtgagaggagatgatcagatgaggagaggaagcgtgcgtgtggatcgtctgagcgaggcgggatttgaacttatagaaggcggtgacgtcagcgcgagtcagcgttgtctgcacgcgctcttcctcccgcaggagcaacggttgagggtcgtttaacgttattgacttcgaatttggcacttgtttcgatttagttccaaattccaaaaatttgagctatcgctctattgctcatgctatgtatttttactgctcatggtgaattgatgattctaaaactatgtgcagcctccaggtgcaaatccctgaatttttcattttttgaaggattttggcattttccccatgtcttggacttctgaaggatttacctgagggacattgggttaactaaatggaggaaagcagggtattgtttacttctaaaaacaggggaactgaaggggaagaacaaataacagagtatatttgatgattttttttttgggaatatctcttcaagaatatacagatttgatgttgagagtgtgttcgttcaatttcaaaaatatttccagatgttgtgtttgagaataggttttcttgttctcaacattgtcagcagttttctttgttttacccttgtcaggaggacccattgttcagaaatggaaatattcatccgtcagaaattcagaattcagagaagttcagaaatattttgtatgggttgagggaacattgtagttgtaaacctgaaagtgttctgtttagagcctgtcgtcaattcttgaagagttatatccatgctgagtaaacctgaaggagcaaaacatgctagagttctttattttcaattcaagtagcacaatgttgtgctatcactgtcaggacaatgggccactgaactaactgtttgcttcagaatagtgtaagtattaacaactgtactctgttctcttgggattagttttaggatatttgtgactttccaatcatatagagttagcacttcattgaacgaaaggaaaattttcattgaatatgtacgactcaagaagtttgacaaagcaatgaattaaatagggaatatatttcgttgaacaggaatataagatttcagtgtaacagtgtttatgagcagtcggtacagataatataagcttacaatagtgtcagttacattgaatccaaccaatcaacagcaatctcagataataaatcatgttttacatacgcttaattacatgtaattcaactaatcaaccggccattccaggacaaaactatactatgtctcgcttctgcattgccagtctaacactacagactgctacagagcacaatgttcagtgctgatatcttgctatcttcaggacactagcctgccgacagatagatcaaacagctgagagcctcatcaatgctatctggagattcaaaactagacaacgccggtgcttcatcatagcttcaggcatcaaccagtaaagaggaataagcatcatcagaacttttttgtgatgacaaaagaagagtttcattctcaagaggctccatcaaacacatcgcaaagccacagcaagagaggtttccattccagtgtcagatcgatacaaatttcatacacaagaggattccatttcagaatccagatcgacacatatttcatacaccagaaaggcagaaaaatacttcttcattaacttccggattgatacagatttcgtacaccacaaaggttggaaaagacttctttattattttccagattgatatagatttcatacaacagaaagatagaaaaaaggacatcattaacatttctttatctacttccaataagatggaaattcaagacagggattgataatttgacagagctaacagttgctaaacatcctatgagtaaaactggtgtttttttcactctactcatggccgctgatcgaactcttccaacgccggctgcatcttctccacccttgcctcgtctgatcgaactcttccaacgccaactgcatcttctccacccttgccacctgcaaacaactcgtagacaacaagcagcaaaagaaaatacattatgtaaataattgaaccagtggatgcagaaatcgtggacctagttggcgacaactgatggcggcggcaaggaggcccagacgcggcggcggtcgtcctccgcttctccctccacagcttctgccgccgtcctcttcctaccaccaccgccgccgccgcatctcccgcttggacgcggccctcgctccaggacacggcagaaccagtcgaactcgtcagcactgacgaacaggcggtaatcgatggcaatgaggaagcgccgttcgaggccggccatctccctcgcgcggatcgccgcatccgagctggtctcgaacaccacagtccacctcgtcgggagcctgtcgatgggcccaccaaacttggcgcccacgaagatcgcgacggcgacgaggcggtgcgcggtggaaggatcgacgaggatccccgcctcccgcgcggcgccgctgcgtatgaaccggaacaggtagatcccggcgagcacgtagcacgcgtcctggatctcgatcacgtggcggacgctctcccgctggatgaaggtgtggatgcgctccaggaacacaccgatccggacgatgggcgtcgtgccgccgcggaaggcgcggatgaggtcggagtcggcgtcggcgtcggcggcggcggcgtggcggagggcttcggcctccacgagcgcggcgaggagggaaagggatcgagggatcccgcgctcgtcgtcgcggaggacggcgtgatcgccgttgtcgggtgccacggcgtctgcagcggccatggcggcggaagggtctcgcggaaagggacggatcaagattgctagggtttggcgcgcgggaggggattagggggtttcaggctggaggatttgatagaagaaaggaggatcgtgcgcatacagtacttttatacgtatcattatagatgcccaaatgggccgcccagcccgccacgacccaggcacgaccgggcctggccgaggtcagtcgggcgtgctgtgtcggaaaaagtacaccgaaggtccctcaacttgtgatcaagttacgaaatcgtcctcgaaccgcaaaaccggatatatgatatccctcaacttacaaaaccgttcactttagattcttaggtggttttcatctcgattttatctgacgtggcagctgagttagcgtgggacccatgttggccccaatgtcagggtgtccatgtcaccccctctctctttccctcttctctcccttccccctctctctctctcacctctctgcgcaggcgtcggcgggcggcgacgggcaaagcagcagtggtaagggcagcaacgacgtcatccacggccggccgcggcggcgccgccttcgcctgcgccgtgacggggcgtaagaggtcgatgaagacgacccgagaaggcgggtgagcacgcgacggccgacgaaggggagcggagcggccgcgagcgtgcagcgggcgggcgggcggtggagcagaatgtctgcagcggcaggcgagcgcgcggccagtggagcggagcggcggttgaagcaaagccggcccctttttggtggagcagggtcgtgagcgcgcggcggcaggtgaagtggagcagaacggcggcgggcaagccagccgccggaccttttcctctccgagcacatgaccatgccaacggtgcagaacgcggtggcgaagaagcccatgactagctacatctccatcactagcgcatacgtgacggtgcggccgccgccgacggcgtgcttgtaggcgagctcgacaagcgataggatgagtccgtgcgtacagagtggcgacgccgagggtgaggaagaagcccatccagtaattcccggtggtcaccctagcgcgtcgtcgtcgtcgggtctgaacttttcctttcctgccctactcaacaacactgaactctgaatctctctctctctttctgcttgatctgctgctgctaccaccacttcctatagatggccaaaaggcccgcatggcccggcccggcccaggcacggcccaccagccatcgggccagcacggcccgatcggcacttcatgccggcccatgggctgcgcctcccgcccaagcacggcccaccagccatcgggccgtgtcgggccggcccgaaggcgcgagtggcccatcgtgccattttctaaataagtctattttttgtccctcctctttgggctgtgacatatatatagcgaaaataagtttattttctgtccctcctctttgggctgtgacatatatatagtgaaaataagtctattttccatccctcctctttgggctgacatatatatagctaaaataagtctattttacatccctattctttcgaccgtggcatacaatatgtctatttttactcctcattgtttatgtctcgggcctggcctgtggcccatcgtgccgtgccggtggagaggcccaggcacggcccggtggtcgggccgggccggtacgggcccgacccctgacgggccgtgccgtgcttgggccgggccaaaacgccgtgccgtcgggcctcgggccttttggccatctataccacttcccaacgtctccagcgtgctcaccgtcgatagcagcagccctagcttccccgcgcagtagatctccacccgcgtgttgcccccctccttcctttccacctctaactgcacctcacaaactccattaatcccatcatcctcctcattatctagtaacagcaacaacaattaatggatgcagctatgtactttgggtgtgttcctggccagcatctcattggggttgagctccctgaagacgctgagcaccccgggcatctcctgctgctccggccggcctcgacgcgccccgccacgcctcgccttgccggtctagagaagactgagagagagtaggaagaaagagaagaggggaaaagagaggtgatgacgtgtcaccttgacatgtgggacccatgcaggcccacgcttactcagctgccacgtcggacaaaaccggggtaaaaaccgcctaaggacccaaagtgatccggttttgtaaattgagggatgatatatatccggttttgcggttcaaggacgatttcgtaactcgatgacaagttgagggaccttcggtgtactttttcctgctgtgtctgcccacaggctgcagccatggtccatgcacggcccaataagtatcgggccgtgccgggccggcccgaaggcacaacagcccattgtgcttctctataaataagtctaattcatctcccttatctctttggaataagtccactttaactctcttaaaagtgacccaaatctaatgcatgaccctgaaccacaaaatcagatatcttgacccctaaactgttaaaactggtacaatttaactccctcggcggttttggtgagcagtttcgctgacgtggagcaccacgtggtgatgttgacctggtcttcgtcctacgtggcattgacgtggcatttacgtgtcattaaaatttaaaaaatatatgggcccacttgtcattcacacaaaaaaaaattatgggacccactaaccggtggggccccacatgtcagtatatcacttcctcatcctcccgacctccccctctctctcccttatctctcactcccttttttgttcatgagccccagctcgccgtgccccatgccgtcgtcgtcgagcagtcagctctccagcatcgagaacgccggcgcgggcccggcgccgccggtggccatcttgctcacttgatccgtagcagagcccatcttatccatcctagaaaacaaagccaacgcttcctggtagcgtccaactcgatgatagcaagcaaccatgcttgatgagcatattgtgtctgggcaagtaatcccatcaagcaccttgcgagcattgggcacatcaccacatttggcatacatgtccaccaacgccgcttcgcagaaggcactggaactgaacccgctctttgaccacattgcaatgcacctgccttgccgtaagcaagaacacccagcctggcggcgccaccaccgctctggctcgccgacgcggacgccgcgccctagccggagcactgtggctgatgctgcgtcgtcgccatcgtggaggtcgaccccgacgcctcggggcccttgacgccgtcgccgccgcccggccgcatcaagccctgcagcagacgcgtgatgttgtccgcgctcgacgcgtacgccgccgccgagcctgatgtcgtcgccccggcgccgcgcacgcgggctccgttttggccgtcggagaggggtcgaggtcgagcgagagcgcgtcgcgcagcgcctgccgcgccgtgtggatgtccgtctgcagccgccgctcccactgccccttaggtgcggcggtgaccttcatgcttttcccgcagccatcgccgcccgctgccgccactatggacgccgccgccgttgtcgccgccgctgccgccggcgaccccagcttgccgaatggggagggagagagaaggggaggatgaagaagggagaaagaagtgggtcctacaatttttttttaatgacaaatgggctcaacatattttttttaattctaatgacaccacgcgccgcgtcacgtcaacaccatgtaggacgaagaccaagtcaacatcgccatgtaacgtgccacgtcagcaaaactgctcaccaaaaccgccgagggagtcaaattgtaccgattttaagagtttagaggttaagatatctagttttacgatttagggttatggattagattcacgtcacttttaagggagtcaaagtggacttattccgtgtcttatatggctgcaacaagtctattttgtatccctcatttctttggacaatgtcttataaggctgcattaagtctattttttggtccctcaactatttttctttgatcatgccgtgccgttgcttagattacacggatcctattctccgtgtaatatgaacttcgggaaaaaattatcttgcctactttgtgaatgttatgtgcttgcccttgtgcttttcaataccctacatggtttagtatgtatcatgttgattggataggcctaaaattccatcagatttgaagttgtcattcaaatttgcttgaacaccggaagttctttgtcaataaccctagaagttcctggttacctgagctgccagtaagttacagaccctattgaaattaacttctacgattgtttttagtatttttcaaaaacgcctattcacctctcactaggtgacatctacgagctttcacgctgcaccgaatgctcgaccccgatcagatccgggcggggatgccagatctagccgcacgggcatcggatctgatcgaggcggtgccaaatccaccgacaccatgccggagctcgctggcggcttcgtaagctccacatcgtccctcccgcgccagagacaaagggtcgtcggtttttagccctgccactgccatcccgacttgccactcagttttctaggcgacgagctctagcggtggcgaggtggggagaagggtgagggtggcggtggggatagctagggtttcgccccgacccacccgcgtgttttctagttttcaaatgtaaatatcctagtattacaggagtaatggagaactgctagctctgttttgcagctgctagtgctcgcatgttggtatcttcaacgcttatcttttgctatcttcaggacacgagcctaccggctttggtgaagtcgattcagctaagcacctcatcaattccctctgtaaatcagacaacaccggcgattcgcagatgctgcaccagatgactcgtgaagatcttgttcatattcctctggatgagagacgaacaggtcgggcaagtcgaagattttgttcatattcctttgcccaattggcagtcagccagtgcccccctgccacgcgagcggagacgcacgcagcgagtactcgatcggccgccgcgcgaaccgaggaccccacgaagatctgctgccttttccaccggctttggacggtagaacgcgtacgttcggcggggccggccgtccagtgtgcgctgtctcgcctcgcgcgttccagctgcttcattaaacttagtactagatatataccggttaatgaactaaattctgctgttattttagtttaaaactatgtaattgtttaatattttactaattgtagttattgggcccttttttagccatcgggctgttcttttgggccaaaaggtcaatggcaaacccgctcggtgggtccaggctgcccacgagctgtccgacgtcgtctccttccgtaccacttcacaccacgctgagtcgctgaccgtcttttgttatcctacctggccaccacaggtgatcgaccggtgcccgcgttaactccgaaccaccctttcggctcgccgtaccccgatcgtcaacgaaccgcgaaaataccgcgtcaatccttcgagctacctaaagatagtagcctgtgtctgcccattcaaaggttgccggtgccgcgcgcattccctccttttgttcagttgcacagataaaaacggacacggtcacgcgtacacacacgccacggccccattcccctcctttccagttcgatcgagccaacgatttcacgatttcccaaccgtgcggcgtgcgcgcacccggggcacgatcgtgcgcggctgcgcgcgcgcgggccggccaattggcaggcagccgctagctccccgcgcggtagcggagacgtgtacgcagcgagcgcgcgcgcgggcggtgcggctcagccggccggagtgtggcggccggccccgcgccttttccaccggctaatttggaccaacgcgtggaacgcgatacgtttgtacaccggtgacttccagtgtgcgcggctcttctctcgtctcgcacgtccagtcgtccacctgcttcccttgacctttttgcttgcgtgcccaccgactcctacacgtgggacccccggccggtagtcaaacactagtagaagacgcgagtgtgttttgctgttaaagcctccaattaacttcttttttgtggggggagacagcacggttatcttgttttcctccgaaagttaggcacgctctttctgagcaaataatcccgaaatggaaggaggctgctacaaaaatccccacacatgtcccaattggcccagactcaacgaactcatgcatgcagaaatataatactccctccagtatactacaacatcctcaagcaagcaaccaaagtctacagtccacaagtccatagtccataagtccacagagatagccatcgatcacatgatgatgatatcgttaacaagtcaatacgtgagaacattccgacccccttccacctcagcctcctcctttgaccctctccactactccacacaccacactcgccaccaccaccaccgctatatatatatgagccaacgcgcgccatctccacccaaccaaaccatctgctcgaactcctcctcctcctcctcctcacgcaagcttcctctcgatcgtcttcgttttcttggtcgtcgtcgtcgtcgtcgtcgtcgcaggcgaaactatggcatcccggagcagcagcagccggagccgtgccgtcgccatgtggctcgtggcgctcatggtggtcttcctggtcgccggaccgcagccggcgtccgcggcgcggccgctccggccggccggctggaacgcgcctagcatcgacggggagggccactacgcgtccggcgtcgtcgacaagtacgcgccgcttctgctctccatgctgccgaggggccccgtgacgccgtccggccccagcggcggcaccaacggcgacggcaactgaggaatggaagccatggaaaagcgcccgattggagatcgaggtgcagagggagatctgctggttcaattcataaatcatagatgccacggataccagcctttttcttaatttctttctttattttttttttcgtgatgtacaaaatatatagaaaattggtagaatacacatactcatagtcatagggcagggtgtatatatacgatatatatactgttatacatattcttttgtttgtcaattgtcatagtatattttgctgtgacaccgttatataaaagagggtttacgtttaatgagaagatcacagtaaatatacgtacgtgccagtgttcaccgtgccatgaattttttgtctctgtctgtacctgtgaatctgttattaaaatatccaattgtgtacattatttatgtctcgaactggcaagcagtatcaactatcaagagcacaagtcgatcgtgtgggcttgagccatatgccggtgagaatcatgtagtttgcagaggttgagagagggtacgtatggaggattggaggcgatcagagaggaagaattcggaagatttaatttcagactaaaatggagttgaatttggggaggagagatgaaaaggaaggaggctgttcgcctttgatctcatctgttcgttgaattgttcgcctagtgttgatggctcctttagaccttggctccttctgtgtgggagcttcttcttttatttttaaaaaaactcatcatttatttaatataggaggttacatacaacgtacataagtgaacgtcacatatcaaagatagagatcttaatttgcctacactagaacaggtagattcacatacaacataattgttgaaagacccctcaaaaataaacaagttacactgatgttctgaaaataagcaaagaaagaactccaaaagaaaatcgaaaagcaatctagtccttgcttcacttcttccaatccgatgaccaagacgatgaagctgacggtgatgacaacgaggaggttgactgcagaagataccatcgtgccacaaacccaacaggggcctctcacaagtggtggttgaagtgaacacgataaaaaagagatcagtctaacctagaaaaatgcaccgccagagacaaggaagtacaccaaatcgacaatagcaaactcaccgaagatgatttgaacggctagcgacacctcgtcactgtgggggaagatgacctccaaccaaaggacatatatgctatgtgttgacccaaaaccagtgaagaacctggtagtgtccttttggatggcgcaagccagagcaagctctcgatttggagctcaagccatctatggaagcaggcagccaagacgaaaaagatggatgttggcatcttcattgagctattcaagaaatgggaagaagaaaacctagtacaagatactcgatttacaacatgataaatctaagtacaggataaacccaacggctcaccggaacccccccccctccctttccctcgcctgtgaccgctcaccgacagagagaggataagttcaagccctgtcttgtataggagctacagctctcttttttctttaaagaggagctacagctaatactattctctatatattaaaatacttattattataatgtttaatgttgttttgaaataatcatcactgtcacattccaaaacacttttgattaaaatctttcctcactaccccttgtcattttgtcaaaatatccacacctcactataatccatacccttagccgaagaaagtactattatacttatgtagttaggctgcgttcttttataagtaaaatgcatatttttatcttgattttcattaacacatattttaaattgttaaacagtgtgtttcgtgctaaaatcttttattagaagttactttaaaatatcaaataaatttatttttaaagttgtaataattaaaactcaatcaatcatgcacttatgactttttttttgttttgcatgctactataacttaatctcattcaacagttcttaatagagatacctcggtaatttactatagcttttaagctttatattttgtttgaatgtagttagaacaataaataatttgaaaaggagggagtacgtcggatgggccagtcgagtcatcaattctacatggttcaatctttttcgctggaacactgcaggcagcccagcagacaaaggatgcaagtatggcctggtttagttcccattttttttttaaacttccaactttttcatcacatcaaaattttcctacacacgcaaacttccaactttttcgtcacatcgttccaatttcaatcaaactactaattttagcgtgaactaaacacaccctatgtgacgttaggaagctctgccggcggcaccagggagtgctctcgctcaagatgttagcagcgcacctacctcccctgtcccctcctctgttttgaaaatggaagagtacaattagcaaaatttgaaatgtttttggaaaacttgacttcattcgcaacctccaatcaagtagtcttagaccctatttagatgggactaaaacttttaagtcccggtcacatcggatgtttggacactaattataaatattaaacgtagactattaataaaacccatccataatcttggactaattcacgagacgaatctattgagcctaattaattcatgattagcctatgtgatgctacagtaaacattctctaattatagattaattaggcttaaaaaatttgtctggcaaattagctttcatttatataattagttttgtaagtagtctatatttaacactctaaattaatgtctaaatacagagattaaagttaaatctctggatccaaacaccaccttacttgtttggtcaatttgcaacaggagtgattaattaacttgcacttatcttattatagagtactccctttatgttaataatatttgtattttggacaaaattgatgttaaattttaatttttttactataaataatttctaaaatatttgtcataaaagtatgggaaccatatacataaattagtgttaaaatattttgatacaattatatatttgttgatatttctatatatgttataaaaagtagttatcaaagttgtctttttaaaaccatatccttatctaaaatgataattattactaacctagaggcaatactaattgcagtgctgtccacctatattaatctaaccattttattaaactaaaccgacaggacaactatcaattattattattccaactaacgccaaaataaaaagttagcacttccttgttgtaccataaggagcacccaaattatcacatctataccacatctgttatttcgccttagtatttaccattattaatcatttttattgattacattttagaggcgaatgacaaagttatccctagcattccctttaaatcttctgaagatgaagataaagattaagtatttcacgtaaaacaaggtggtaataacgtgtgattaattgagttttaattattacaaacttgaaaaatggattaatatgatattttagagcaactttcatatagaaagttttcgcacggaatgtatcgtttaatagtttgaaaagcatgccacgagaatctaaaatttcatcctgcctctacataagaaacgaacggggcctcactttccatcctcctctgtcacactcttttgctctgatgttgatcctggctgtcgtctctccctgtgcgtctggctactggcatcaccacacttccctagtactgtataattaaaattgcatatatttgtttatttaaggatggaggagacggatgaagagttttaggtcaatggtgtcactgtcaactctcatcaacaatcatgtcttcaagtgaaccattaatgcatatcgacagtaaaaaaaaataaatgagaaattaagttttcttttaaaaaatcgtttcatcgtatcaataccatttgtctaattggtaaattaaattgtaaagcactacattaaaattagtgctacataaacatgtgtatatagcaacatcactatttttttaagggtgaaccttacactgtggaaggagattaggggcttgtttgatgaaacttttagcagctgcaacttctttggaatcaaaagatctcaagaagttgtaactccaataaatgaactagaagccttctccacgtattctgatggttagcagcacccagcctgctatgcaccataacaaagaacatccctcgagggcacaaaatatatagaaatagtgccaaaccaaagcaaagtacttcatattagagaaattgatcaagtgcccaactcaacggataggtgggactaaaatactcgcttatccattctactgaaatctttctgggcacgctggatttggaatgaacacaaaaatgcatccttcttctgggacagtcagctcggagtacactgggattccctagtagcatttctccctgacctgcagaatcttacgacaattaaggtgggagatgttaggcacacttctttttggcatgatctttggtaccgggagaacaccatggctgaaaattatggcccctctactcgcactctgtggacaaacatgctttcagtgtagcaggcgatgtctaggaagttgagaaatcaatttgtgtcaaggctctcgatgatggctgaagatcagttgctccaactagggcttttactccaagatcagatcttgacatcacaattagatatcagggacatgaatggagcaacaggtctgctgcagaccaaacaaatttactacgccgtgtgcgatgacatagacctgtgcagctgtgcaacaactggaagttcatttgggagaataaagcaccttcgaaagtgcagctcttcgcatggctcctagccaaggaaagactccctaccaagctaaacctcaacaagaagaaaatagtacaattgccactatgtgacctttgcaatggggcagatgagacagtttaacacattatgtatccagtgcccctttacaattgctctctgtagactgatcagtgttcagatcaacattttgactgtcaagaacatggcggatttgctgctcccactgcaaattccgatcaaacactactgggtcttcttccttctatgcttttggggcctttggaaccatcgacatgatgtggtactccgtggaaaaataacatatctacgcaggttgatcgtgaggtgcatcgacgacgctactctttggactgagcggctaatcgtggaggatatgaatgctttttcagcttggaaagaaatcatctcttcctccctttgatctcttgatttgtaatgaaacctgaactttacctcccttgcaatgaaaatacaggtgaggcagttctccccccggtgaactttcttaaaaaagataaaaaaaaataaagatacaaattggatatggaattgggggctccgacgtgtaaggaaatacaaacctagctacttccatgactgtgtttcactttatcacatgttgaaacaagacgacgtcagtctagacttgaatcaaatagcttgagttttagacttccaatagctaatttgttagctgttgtcgggctatccatgtccaaatgggctagcttgtctagctaaagtgtaaagcaatttatagactagtgtcacaaggaaagacttgttggtgtcactcgtgggactatctacttgggccaaggcagaagttattggtgtcttatatatgacacatgcccttgtatattggatctcacctttgactcacaacctgtaactgcccacgggctcaagatgctctattgcctctaatttttagaccaggtgtatggatgaaaatggtacggaaatttttttgaccataccgatgccgttttcattaaaaaaaatcgatatcatttttgattgtttctgactgtaaaatttagttttctaatgtttgtatgtgtcatattgaagttgctactaaatatatagttaaattcataaatgtagaaccgtttctataagactaataaaaattgtatcgtttccttgttcccccattcaatccttgcatgttgggcatcacaaaattgacaacactgccagctttatgcagctgcacaacaacagcttcatggtgcaatttctctttttttcagatcatagtactccctgagttgagaacttgtcttgccaattattgttttgaacatcaaaagaggcaacactattaaagtctgatgcaaagtagagtggagatatagctagccctatccaggtaggcatagcataatctttgctggagtcctggagctagcgcaatagagcttgcactagccagttcatgcaccttcctgtacttaacgaaatacccggatggatgcaccttactgtttgttacgcgaggcagatgatgggacatccagacagacagctgagagaacatctttaacaaaccatcgcccctccatttatatctgtgctagtgactaaaattaattaaaggcaaaaatttacggacataaatcaaatttatgttcattttctaaaatattattaacatatccatacattgtaacggactagacccatataattgagtcgattaggaatggactggagggtgaattgagaataaagcactggatcatgcaattattgcgcacactatatatgtgggaagcagcatacaaacaggttgcatgagcagtgagaagagatggaagtacgacgactcaacttttataatagtaaagatactaaaaagttaaaaatatccaggtgttggatataggtataccaagcgcattttttttctttcgcgggagaacaatatgcacactctgcctatgacattagttaatgatattaattcccatagtttcatggagtgatatcagcaatgttccctatcaataaagggaaatttcactatgcgtggtagttcgaaaggagcggaatattccccaactttgctgtaaagttgtagctaggttttaaaaggaaaagacccatgagatcataagggtgctctaaaaaaggcagggtaatgagtaggacagagtagtagagataggtttaacataacgaaagtgcaaacctggcactattctttagcaccgtacaagttcgcgagcccagaacacaaccaatgcataagtttctaaagtctaaacaatcatatcgctttctttccctttgtacatacaacaatcaaggcaatgcatatacaatttggcccaaattaacttgatttatctgggcaactttgacaagtaaaaaacctttgtgctgttttccatgtgtgtaccatttgtatttcttaaatgctaaagaaatttgccctgatcattgcaaccgcaactacattagtacaattgctatgatgatgatgctgaggccggtacaggcttaattgggtcctttcttggtgtcacaatctgcagagtgtttcagagcaactcaccatttcatcattgttcatcagctcagaaattcttctgctatactcacccacttgccaatttgccattgccaacaccttacaaagagaggcactcctccattgcaatgctccatggtagctagctagctgcacaccacaaggcttagaaagagtgtgtgagtgagagactgagagatgagcagccatgagaggttcaggctgtcccatctcatgccaaactcatggttctacaagctgagggacatgaagaggcccaggccaacatcaagccggatgatcaccgcagcagatcatgcagcaagaagctccaggagatcgtcgtcgtcgtcaagcagcatccaccactactacctccatggacatggaaccaccactcccaagcctctcccgttgtcaccgccgcgacgatcctactacccctacctggaacgagccaagcagatgccactgatggagaaggaatctcagctcatctcccactcccctctccaccaaagaatccccgccacagccattcccggagaccaccacgacggcgagtttcaagacttgcagctacgtcctatacgcacgaggccaccgtcggcggcggcggcgtcggccgagccgaggaggacggcgagcgggagcggcacgtgcccgagctcgccgaggatgaggagcaggaggctgcacgttctcggcggctgcgagtgtagggctggtagtggtcgccggaggagcggcggcggtgggttcgcggtggtgaaggcgtcggcggagccggcgagggacttccgggagagcatggtggagatggtggtcgggaacgggatgcggtcgccggaggatttgctggagctgctcgagtgctacctgtcgctcaacgcgcgggagcaccacggcgtgatcatggaggcgttcaggggcgtctgggttgagatcgtcgctgatgctgattgttgcgttgggttgtgagctatattgattctgtttttgtatagttggattgatcgaatcgattgagctgtaaatggatatattgtgccgttaatttttggtgttaatgaatcaagctggcatatgtacaatgttttgtcctgtaattaaatcgaggtattcaagggctatgcagggaaactctagacttcacgcttagttttgacagttagccatgccaaattaaacgaccgaattttttttccaaacaaattcttcaaatagctgcataatcataagcttgggaaattcacaaagaatacatgtcgctgatgattatttgtttgtgaacagtgactcgtgagaacaacgtagctacgtagctatgcgggacggatccgttagtaaggtaagacgtttgtggtgactttgttaatcttaaaatagggtgtgtttataaaaatgagtctgcgtgtatgcgtgtatatatatgagtatacatgttttcaaaatatctatggaagccatcgtttgacttattttaagcatataagcgcaacagcatatttacaaacaaaaaataatttttaaataaaacttttatatacgtgttcttagcgatctaaaagaaaaggctgaaaaataaacttcgatgaaaaaaaccttaaaatcaacttcaagtttaaggttaaaaatttaaattttggctgataagcataaacataaacataagtaaaaaagatgagtctgtatgtctttgacactagattgattggacaaccaagtacaattggtaccggcttggtatgggtttatcaaccaacacggtactggacacgttctttgccattggctttatgtaaggaggggtgaaatattagagataatcccttatatgccattgaaaattggtctgatcccttatatgtcactaaaaattggctcttcccttatatgccattggtctaaatttgcgcatcctctcatgctactaccgtcagttgaccgtgtgttgaacgttagctttcaagtaaaaaagacatatttgccctctctgagttgttaggcatgccctataatcaaaagggtaaatatgccttttttccttaagaattaacggtcaatacacagtcaactgacgggagtgacatgagagggtgtgcaaatttggattaatggcatataagggaagagccaattttcaatggcatataaaaggatcagaccaattttcagtggcatataagggattctctcgaaatattaagttggatatggatattgtcagataacaaatcacttatcctgtaacatattctatattattttcttcaaaatggattcatgaacgaatatccatttgtattttcaattgatagatattaaatatagacaaacaattaaagtgttaaaagagattcatcaaggaaaaaatatacgatattatcaagttaatcaatcttttattatggttgttggtgaatttataatatatttttaagtatgtttcataatatgggacataccggctataaaactcttattgtattttaacccatatttcttaacggattcggattaaaactcggataataacgaatatcctactttctcttctatattattttccttagagttggatcaggtgggtggtcaagaaatatccgttccgttttcgatcctgtaatggtaaatttgtgcctgttcttttctccaacaaagttagataaacttttggatgctcgtggcatgcttttcaaactgctaaacgatatatttcgtgcgaaaactttctatatgaaagttattctaaaatataagattaatccatttttcaagtttgtaataattcaaactcaattaatcacacgttattatcacctcgttttgcgtaaaacacttaatctttatcttcatcttcaggagattcaaacacctatattttccattttagcctcctttaactgcgacgttggtctcgcaagagtcccactgccgaacccagctacgtgtcgcccaacgcctctacctagtctctagatttttcacttttgatgctttaaaaaacttattctacaaataaaccccttaaaaacttattttaggaatgaacccttttcacggcgcattaacaacattggcgtcgtcctccttcaaataagtgacttagcatttagtgagggcaaggggaaccgtggcaacgtcattagcgttgtcacgttggaccatgacgctgttaatattagcgtcatcaaaatgatcaatttcttcgaataagtttttaggtatctattcgtggaataattagttttctaattggataaaaggtgaaaaatccacgccagttcctcctccctttctccaagcgccaccgaccaccgcccctcgccaggaatgtcaccgccaccgacaaggacgaggcaccgcgggaggatctccggcccgaatctcgccgtgcgccccaactttaggccagcggcagatctggtcccgctggatccggcctccgtagtccacagcctcgccgcggacggcatctcctcgccggagtcgctctcgttgctccctcaccagccgccaccctgcagcgcttccccccaacatcgacagcaacaaagctccctga

SEQ ID NO: 10817 - DNA, 1034 bp, Oryza sativa
acgcagcggcgccgcgcgggaggcggggatcctcgtcgatccttccaccgcgcaccgcctcgtcgccgtcgcgatcttcgtgggcgccaagtttggtgggcccatcgacaggctcccgacgaggtggactgtggtgttcgagaccagctcggatgcggcgatccgcgcgagggagatggccggcctcgaacggcgcttcctcattgccatcgattaccgcctgttcgtccgtgctgacgagttcgactggttctgccgtgtcctggagcgagggccacgtccaagcgggaaatgcggcggcggcggtggtggcaggaaaaggacggcggcggaagctgtggagggagaagcggaggacgaccaccgccgcgtccgggcctccctgccgccgccatctgtcgtcgccaactaggtccacgatttatgcatccacaggttcaattatatttacttaatgtattttcttttgctgcttcttgtctatcagttgtttgcaggtggctagggtggagaagatgcagttggcgttggaagagttcgatcagactaggcaagggtggagaagatgcagccggcgttggaagagttcgatcagcggccatcgtcggagtagagtgaaaaaaaaaaccagttttaatcgtaggatgtttagcaactgttaactcttgtcaaattctatcaatccttgtgtcttggatttccatcttattggaagtagataaagaaatgttaatgaagtccctttttctacctttctggtgtatgaaatctatatcaatctggaagttaataaagaagtctttttctgcctttgtggtgtatgaaatatgtatcaatctggattctgaagtggaagcctctggtgtatgaaatttgtatcaatctagaattgaaacgtctcttgctgtggctttgctctcttgctgtggctttgcgatgtgatgtgtttgatggagcctcttgagaatgaaactctacttctgtcatcataaaaaatttctgatgatgcttattcctttttactggttgatgcc

SEQ ID NO: 10818 - DNA, 14280 bp, Oryza sativa
aagctgttttgatctgtctgtccgcaggttaagtgtccagaagatagcaagatatcagcactgaacattgtgctttgcagcagtctatagtggcagactagcagtgcacaagcgagatatggtactatacttttgtcctggaatggccggttgattagttgaattgattgtaattaagcgtatgtaaaatatgtgatttattatctgagattgctgttgattggttagattcaatgtaactagcactattgtaagcttatgttatctgtactgaaagctaataaatactgttacactgaaatcttatattccttggaatggccggttgattagttgaattgcatgtaattaagcgtatgtaaaacatatgatttattatctgagattactgttgattggttggattgaatgcaactggcactattgtaagcttatattatctgtaccgaatgctcataaatactgttacactgaaatcttatattcctgttcaacgaatacattccctattcgattcattgcttttgtcaaacttcttgagtcgtacacattcaatgaaaaattttctttcgttcaatgaagtgctaactctctatgattggaaagtcacaaatatcccaaaactaatcgcaagagaacagagtacagttgttaatactgatatggtactagttagttcagtggcccagtgtcctgatagcacaacattgcgctatttgaattgaaaatgagggactctagcatattatgatccttcaggtttacttaacatggatataattcttcaagattcaagatttgataacagggtccaatcagagcactttcagacttccagtgttgccatgagcaatgcttataagcgtgcacccttgttactgaattattcactgaagtgctgacatacaacagaaggcttatcatcaaatcattttagacttaatggatgacacatcatatgagccctgaaaatacagaacaaaaatcacatcctcttacttgcactgaagtttccaaatgccacctataagacgaatgccacttcaccctggcactttttttgcatcaaattacaaaacaaacatgctaacagctgaaaaacagacccgcagtttccccattattatgcaagatagtaggatatgtactgacaagtacatcttagattatatttacatgtctgtcctgaagacgaacagaatgattccttcaaaactgattcattgcaaaaatgaagtcaagtgcacttgctgcttgttgcaacagatatgagcagaagtccggtggtggtggatcctaggcaggtgaactctccagtctgcttctctggccatagtagctaaaagagtggtgctaaactattggcaagagtggaaactgttgcggttaagaaattgcctcgtacctcttgctaccagcgcacttgttccgtgtgacttccaccaagtttcatatcccattatgtattacaaactgaagtagtatttacaattgaacaaacataaaagcaaattaagagtaagcaaatcgacagaaaaacgttattactatatgaaaaagctgatcatctcaagcagaaaaaagtcatatcctcactggccattagttcgattcactgacaaaactgaggtcatcggatagctcatatagaaaatatttaagcattatagcgctttcaggttcatgtccacagtttaaaattttattgtgagaaaacaaaaaaatcctaagacttcttggttcatcagatgtccttaaatcaagaattttattgtgagaaaacaaaaaaaatcctaaaacaaaaaaatttaatgtttctcagattccccgctatttgtcaacatcaataaaaatttaagaaaaaaatgtaatatgcctgtttgagatttcttggttcgattatgaattgtaatctcacgcatataccataaaatatatgattaatgtatacagtgattaccgacaagaactacacacaatctctaggccatctcttccttgtcctcttgttcatcagatgtcctaaagtgaaattgctcaaccggtacagtgctggcagccttcactatgttacgaaaatctttctgaactctgaattctgatgagtgtgaatggtttcaaatttctaaattttgtgtcctacaggtgccttcgggcttcactctattacaaaagtatttctgaacttctctgaattctgatggctgagtatttccatttcagaacaggacgcgagtaaaatcattcagaactgtagggtagcacttcactcttgtttatcttctccgaacagccagcacggcactccaggtctgtcatgaaacggctgttttgctttgatctgagatatataattgaattctttttgggacaattccgagggtaggatagggcctaatggagccaaacggttggattcatcccttgttgcttcattacaataacccttatttaaagtgttaacagcatcatcacatttaacaagaagtaaattctattcataattttaatcttgcgcctaaaaagtagaagacaaatgattaataacagtgattactgaaaagaactccagcagcacggtctctatggcatgtcttccttgtcccctcggcagtaagatgtcctacaagtgaaattactcaaccagtacaatgcctgcagacttcacggtgttacaaaaaaattttctgaacttctctgaatcctgatgagtgatgactcctaatgttttccatttctgaactttggggtcctgacaagtgtaaaacaccagaaggatgctgacaatgttgagaaaaggaagctatttcccctaagaacatctttgacataatttcgaaactgaatgaacacacgatcaacatcaaatctacatactctattttattaaaaccatctattatactatactctgtgttgtatttttcaccatcagttacatgattttcagaagtaaacaatactcattttccatccttcagttaccccagtgtccccaggccttaggtttattcccctccaaaacttcagaagttcagcacatgtgtaaaatctttcagaatttcaggaattggcacttggaggctgcggagagcattttcagatatcagaatcatcatggccaaagaatcatgagcgataattcaatttctgctcgaatttcgaaattaatccgaacaagttccaaaatcaagtcatttgccgttaaacctgaaccattgctcgcgcgtggtggcaacgcagtctcacgctgacgtcaccgccttccatcaattcaaatcccgccgccttaccaaggggatccacgcgcaccgctctttctttcgctcctcgtctcctctcgcccacgcttccttccccccaaaaccctagaaatcctcaggcgccgcgcgcgatccagacagcaatggcggcggcggatgggctcctcccgggcctcaagttcgatcccagcgaccacgacctcgtcggaaggtacctgctccggcgcctccagggccagcccctcccgctcgacggcgtcatcctcgaggcggatcccctgagcgcgccgccgtggaagcttctcgcggatcacggccgcggcgacgaggccttcttcttcgcggaggcgcatgccaagaatgggaaggggaagcggcagaagcgcaccgttgagggcggcggattctggcaggggcagcccacgtgcgttgacggcgagaggctttgcgtccccgacgacggcgtcggcagcggcggcggcggcggcggcttgcagatcgcgtggcgcaagtacgtgctcagcttcttcgcgaacggagagaggggcaagttcggatgggtgatgcacgagtacccggtgacggcgccggatggcctcgcctcgtcccaattgcggctgtatcgcgtccgattcagcggctacggcaagaagcgcaagaggaagccccaatgtccgggagcccacggcgacgacgacggcgagctacaatgcgcgccgcccccgcgccccatggcgaagacggctctgctcgaggagcgtgggccactgccccatcccgttcttggccctgcatcggtggtggatcagtgcaccgatcagggctcatccggcgtgatcgacgattcttcgctggtgtttcgtgatcttcccgacctgattgacctgccagttgcggaggaagcagatgccagccatggtgcagagactgctctgctcaacgagcacctgccgctgccgccgccacagttgttcgttccccctactgcagtgccgctggacctcgccgatgactctaatggcgccgatcagaactcctatggcatgatgggcgacgatcagctgctgcttcctgaccttcccgggacaatcaatgacgacatgccagacctgttcgtctcccaagcagaggaagccagtgcagtgcccgcgatcagctaccactcgtcgggcttcatgggcaacgaggttgcggcattgtctgattttgagttgccggagagctattcctcatctgatgccatggacggcgaggcgctggcattgtcgaattacgagtttccagagagcttcgaggaggatctgagctgcatcgacttcgccactgccaacgcgagcagcctcggcttcccaatggacggataccccatggacgagctgttcgatgatatgcctgaccagggctcttccggcgcgatggacgattcatcggtggtgttccgtgatcttcccggcctgatcaacctgccagccgcagaggaagcagatgccatcggcgatgcagagactgctctgctcagggatctcgccgatgactctaatggcaccgatcgaaactcctatggcgtgatgggcgacgatcaggatcggctgctgcttcctgaaattcctcggagaatcgacatgcccgacttgttcgtctctcaagcagaggaagccggtctcggtggcggtgcagcgctggactcctcatcgggcgccatggacggcgaggcgctggcattgtccgactttgagtttcccgagagcgtcgaggaggtgctgagctgcatggacttcagcacggtcgacatgagcttcttggacgtccccattgacgagctgctagatgatctgcccgcagactgagactaggcgtcatggagttggcaagtgatcaacagatattgcccttgtagttgcaggaagagatttcttcagagattttcttctctagtgcagaggcgagatgttcaggagttttgtccaggaacaacttgtatttattactagttgattagctgattgaatgtaattaagcatatgcggaacatgtgatttattagttgaggtatttgttgattagttgaattcaatgtaagtaacattattgtaagtaatatcactattcaatgaatatataatccttattcaattcattgctttgtcaaactttgggtggtgtatattcaataaagttgtttcttccacatttcatgatgtggaaagacagaacagaacagaacagagtacaacattgtgctgtttgaaatgaaaacaagtatcttcatccttcaggtttaatcagcattggtataatccttcaagaatggacagcaggctccaaaaacatcattttcagatttaacatgagcaatgcttatgaccatgcaccattgttactgaattattgactgaaagtgataacatgtaacagctcatcatcagttcatcactcaacacaaaagattttttaccacagtggatgacacatgatataagctcagagaacatagaacagccatttcagataacatgagtgccactggcaccctgtcacttttcttgcatcaatttacagaacatgctagcagctgcaaaacagcgctgcagctccctaattcatgtcaagtaccaggatgtatacttacaattacatcttacattacatgaaaatgcatcctggcccgaagctacctgtctgtgagcggttgatcttcatcaccagggattggaaagtcaacattaatccagctcctcatcaaccgccaaaccgcgattgtaaaattacaggccacgaacaggtggtggcagtcctcattatctcgctggcagagtggacagacttcatcgtggggccagtttctcttcgccagattgtctgccgttaggcatcttcctttcagggctagtcacatgaaaaaacagactctcaatggtgctctggagtctggagtgcctcagcatctctccataagggcagtcctctttggccatgaagaaaagatcatatgccgaggcagccgagaattgccctatctccagtcagtttcaatctgattgcatctgcattaggctgtagagccacatcatgaacctcgtcccaaagctgaaagaagtcacccaaggcttcattgaacaaggaaccctgcaaatctcgcacccatctatgattaaccatggcctgggcgaccgacaacctggagtgtcctacataggagtacaggataggccacctccaggcgaagcaaccatttcccgtccaatttgtcgtccagtatctgttatcagctccatcaccgatgatatattcagccactgatctgaaaatgccatctacatcatctcccatccgatatgccaccatggtccagggcctctccttctgtgctcaaccgattaacagtatgattcctttgaaactgattaactgcaatctaaagcgagcagcaaaatactacactgccacaattttctaaaaactcagttgggttattgtctacaagccaactccagcaagatgtgtcacctccacttacgcaaacgggtcatatatgtcctagagtttcgacgagcctagccagcagttgttttacattgtactggggtactctccagtccagccttgtttctctactctctactatcttgccagcagcacttgtgccgagtgacttacaccaagtttgatatgaacatcttctgcaaactgaagtactatctacagaatacaattaaagaaacattaaagcagattgatggtaacaatgtaaattaaaaaaaaatattagtctctgaacaaactgagcatcttaggcagaagaagccataccctcaaaattcaattcactgataaaaatgaggttaaccttcatgggatggccatgtaattcatcttgctcacttgtggatcatggaggatgagactacaatccatttagccaaaaagtgtaaattcttcattcatacatggaaaattggttgctcatgatttggccttgatggatagattcaactggcacaatctgtccaaaaaagaaatggcattatacactgggaggggggcaatccaaggagatagaagactaatccatggatacctataattatgtcctgataaaatgtatctaagaaaatgaatcataactagttctagcaattttattactgttagttgtggcatccatttcatccaaattgtaactgagaacctctatgagtgcttctttctattcttcttaattgaataagcagaaattcttgactgtaaattttatctttggagaagattacagccatggtttccaaaatgataagttgttcagtactaacaggcatcagcagagttaattaatattgaagtaatttgaacatcaccaaattcaagtattcaacagagagaagaggatcatgtatgagataatactgaagtcaacatgagtagtgcacaatctaggaaggtaaggtcttcccatggtaaactgagatggaagggaagctaacagccagaaagctccaggatattggggtcggattgctcaacaagccatcggagaccttgtagaggcctgtgccactggagacctgcttccagtcagtgctggctcctggatcatatatgcagagcggttatacatataattccagcagtggctgtacatcgtactgggttactcaccctccaatgtacctcgcgccccttgttagcatcatttgtgccaagtgacttcgaccaagtttaatcttttcatcttttgcaaaatgaagtactacctagaaatctaaaattaaacaaacatgaaagcaaagttatctgaagaaactaaacatcacatgcagaagatgccccaccccattagtgattagtccaattcaatgataaaactgaggcactacatttatggttttccaacatcgtcaggacctgcaccaattagcatcagcagattcgttagactcgttaaagtgaggccaaattcagcagagagaaaaagatcacgcatggaggaactagtgcacaatcgagcaaggcctccatggtaataaataggggaggttaccttgctgtgacgccggggttggggggcattgctcgttcgcccacgggttccgccatggctgttcgagctccaatttctcggtcacaaatagatcgaagcgcttgtcgcccgagaccttggagacgactgcggcaatggagatccgcttccaggccgtgcccccccacgacggcgacaaagcacaccattcccgccgccgatatgtcgatgtgccgcgggtcgtggctcctcgccggaccatgctggagccctcccagcgactcagggagatcggagatggagtggtgcggcggacgacggcgcggcggccactggccggtggggagtagtccaaacagagaacagacaggctgagattctgtttatgtgggctcggcacgatttgattaggagaaagtccattattagtcatttaactataaaaaaacgtccaaatatcctctgaactttaaatgaaagcacattcagtattctaatgtttcttaaggaaacatagtacaaacatagatactcacaacacacgtacaattacccttataaatgtacacacatcataccccttacgagtatctccgaaaaactattaggccgacatattgtctcaaatctagatcctgaatctgggtgggctaggaaccagaagaaacagtatactaaattttaaaaccagacaccctaaactttataataccattcatatgacccctaaaatggttttttatctaatttgtaaaacgttaaattattagacatatatgttaaaaatcttcacttaaatacttttttttaccctatgtttgctctcacttgaaaacgaataccaactagtatgatatttttatggagcataaattaagaactaaagattgatgatatatatatatatatatatatgttatattctttattcaaaaactgtctgtttaagcatcaaaatatgcaaaaccaccgtccaaaaccatcttatgatgtaatttaaacggtattgtaaagttcatagggttggggattataagtctatttaaaagtaatataaataatagagaaaaatacaaattactcctgaacaattgcgacagtatgaattaccccaccgaaccacaaaaccagatatatcacaccctcaactattaatactggacatataacccccctcaacattgtttttgaccggttttgacttcaacttgtacacgtggcgccaacgtggcaatccagttagaaaataaataaataacccctgggcccacctgtcataaccctttatcaacccaaccccccctctctctcgccgtctcgcacacacgctaggacgaccggctgcggaggaggcgcacacgctcgggcggccggcggcagaggcggagctcgcccgggagtccggcggcggaggcggagattgcccaagtggtgggctgctgaggtggaactcgcccgggcggccggtggcggaggcggaggtgagtggtggcggaggcggtggtgagcagtggcggtgttggtgctgcgcacgatagagtactcacgctctgaggaagctggaggccctcctcgccgcgtccaccgcctgcccttcccaccgcgcccaccagccaccctcccccgccgagaccttgtctgtccagaccaccgccgacgtcgccgccttctctgcctggactgctgccgctgccttctccgccccgaccactgtcgctgcactgcaggaaaggggagggagtcggaacagaaggaaaggggaaagggatgagcggcggtcatcggcactcctatgcagctccatctcgtgcatcgccgtcgtggacacggccatcgacaccctcgccacttcgctgccctcctcacccaccacgacgccctcagcctccagtgcgactccctcagcggcgacgccgtgctcccgtcgcgccagtcgcccgctctccgccacgcccgccacccgccgcgcccatctccggccacctagtcgtcgctcccagcgacatctgaaagagacagacgttgagaggaagggaaaggggaaagagagaggtgggtcccaccatgttttatttgttttggctgacaagtgggtcccatatcttttttatttgttttgctgactagagtgccatgtatgcatccacgtaggatcaaaactgccctggatcgacctagggggtaattcatccggtttgtaaagtttagggttaaaaataaatggtattggagtttaggggggtaactcaaacgaccgcgatttttcagggggcaattcatactttttcctaaataataacatcatatagccataccatatccatctcaaatcacaggtagcaccaattaacgaatatttgagccctacgtgggtgcggctagagacacaatggcagatctggtatgtttgagggagatttagaacgaacggtgtgtacacccttcctaacccttgtgattcaaccttaaaatgctcggttgctttagagtcttctcgcttcatatcaccgtaccaaacgcccaccttgttggctgccgtcataccttactcgcttacaagagagatcgacaagagctctaagattcgaccaccaaatcaatcttctatggggaggagggggggagagtgaagatgcacttaaacccctagtgggttttggtgattaatgacaaggtggttaaaggggactaacgtgtttatcaagtttattcacaggagtttagtcccaaagcaagttgtgatggctaagaatgcaaggagaccccccaatttgaatgttcctaagtgcgaaaaacatcgaaggtgattagactaggtttttctctttcgaaattgagtttaggaaaaacagtactattaagaggggtttcaagtgtggttccagggtatacaaagtgctcttagtcatatccatgagtctaaaggtttttggaactttctttttttttcttggaaatgattttcctcgggacagagagggctactcggaggttctggccggaacttccgggcaccgaagtttagctagatttttcctaagtgctaaccggaagttcctggcacttttgcccggaacctcctggcaggtttccagttcaatcttgtgagtaacggctagatgacgtcacctagccgttatatatatggatttcgtccccaggtcaccctttggccattccacttcagttctttcatgttctagggttttctagccactcccaagcttcctttgcttcctccactcaaatctatagcctatcttgggagattgagagattagattagagtgtaggagtgttttggagatggcttgaaaattatgttttgttgagcactttggatactttgtgggctgtcacttgggcttattactcttggagatcttcttctagatggttaggtgttgcccgtgagcttccaaagatcttgtggatgtccctggaaagtttgtgaaggatttcctcaccttcgcaaggaaacgaggtaagtgagtaaagattcttgtgctgagttttcagaggttgtcctaggtagagcaacttacacttgtggtcttttctagaaggaattgtgagttggatcttggtggtcactcaattctagaaaatgacctagaagtgttgagttgaaggctgtggacttcttctgggatctttgcataagtgaggcaaggggttaatcgagacccggctctttgagcacctctacggagagtaggatccgtgtgatccgaacttcgggaaaaaatcgcctttgtctctctcgtgcatgatctgtgtttgaatctgctggtatcttgtgatttacatcttgtgcaaccttgtgcctgattgtctatagctaggacctgttttgcttccccaaattttgattttctctgttgcccgaaagttcctggctcaagaactccggaagttccgggctgctcatctctgccaggaagttccggtgttcttcaccaggaggttccgggcactgttaatttaaccgctgcgattgttgagaaaatttcaggaaagcctattcaccccccctctaggctacatctctacgcgttcaattggtatcaaagcaaggtgctcttgattcaagcttcaccgctttgagcgatccacgatgttggacttagggggaaaggacggggaaattggaaatgaagatggagcgagcagcaagggaactccatctcccaagggagccactataccttttgattacaggaaacttaccattccctctcacaactttgtctccgtaccttccgggcgtgctcctcaatttgatgggacacattacgccgcttggaagcacaagatgaagttgcatctaatctctttgcatccaagtatttggaaagttgtgtgtacaggtattgacgtacctcatgaggacatggagctcacttcggagaaagaacaactcatccaccgcaatgctcaagcttccaatgcaattctctccgccttgagtccggaggaattcgacaaggttgatggactagaggaggccaaggagatatgagatactttgcaattggctcatgagggatcacccgccgttcgtgaggcaaagattgaattattggaaggaaggctaggaagatttgtgatggatgacaacgagacaccacaagagatgtatgataggatgatgatccttgtcaacaagattaaaggacttgggagtgaggacatgacaaatcactttgttgtcaagagacttctccgtgcttttggtccaagaaatcccactcttgtttcaatgatacacgaaaggaaagacttcaagaggctcaccccaagtgacattcttggaagaattgtgtctcataagatgcaagaagaggaagctcgtgaagtgagacaaatggtgaagaatgccgccatgatcaaaaatcaagaagttgctttgaaggcaaaacaagaagaagagtcaagtggtgaagaaagtgaagatgaagaaatggcttttattgtcaagagattcaagcactttcttcgcaagagtggctatggcaaagggaggaaggttgatgacaagggaaagaggcaatcaaagagagcgtgcttcaattgtggcgaatttggccatttcattgccgattgtcccaagtcaaatgaagctaaggctaagggaggcaagaagaagctggaacgtgctcatgtggcggaggcacacatggcggaagtgtggtactccggagatgaagaagatcccgaagtcaagcccaagcccaagtcaaaagacaaggttgaaggagaaggtggtgttgctactgtcaccttcaagtcatcctcttcaagcaaggagcgtctcttcaacaacttgagtgatgacgacgacgactcctaccactactcttgcttcatggcccaaggccgcaaggtgatgactcaaaagccctctcacacttctcttgatgttgagtctagtgatgaggaaagtgataatgaattagatgatgtgcttaagagctttagcaaacccgctatgcaacacttggctaagttaatgagagctttggatagtacagaacaattactcgtaagacaagaagaattgcttattcttgagaagaaaagaaatcttgccttagaggagagcttagctaaagaaagtgctaaaaataaacaactagctaatgagcttaattttgctaatggttctttagctagccttagagatgtcaatgagactcttcaagagaaatttgcttgtttagacaaaagtcataaagttcaaattgacactctttggaatagtacctctcaaccaaatgtggtttctaattcctctaacccttctactagcaatggttgtgctaggtgttacaatattgatttgaactcttatgctactaatattgtggagatgcaagctcttaagaaagagaatgaaaggttgggcacattggtgaaatatggatgcatgaagacataccattcaaaagatgccctttacaagaccatcaccgctcatcctaacaaggatggacacgg

SEQ ID NO: 10819 - DNA, 20043 bp, Oryza sativa
  unsure (1)..(20043): unsure at all n locations
gagcataatgctagaaggttctggcaagatggtctttactatgattcatatgtaattttcaaaaattcagagggcaaagtggttgcttattttaatgggaattacaatgatgaatatcgcacttgtgtgtgggtgccaaaggctttggtaactaacatcaagggacccaaacttagacaaatttgggttcctaaatcccaagcttgatttcttttgtaggcatactcctccggtggttcaagttgggttgtggacagtggttgcaccaatcatatgactggagagaggagtatgtttacaagtcttgatgaggagaacggaactcgtgagaatattgtgtttggagatgatggtaaaggaaaggtaatgagtctaggtaaaattgccatctccaataatcaatctctctctaatgttcttcttgtcaattcattaagctacaatttattatccgtttctcaattatgtaagttgggttacaattgcttgtttaccgatgaggatgtgaccgtctttagaagggatgactcctccgtagcattcaaaggcaagttaaagggtgatctctatcttgtcgatttcgatgtggatagagtgaatccggaagcttgtttgattgctaaatcctccatgggttggctatggcatcgtagactagcccatgttggaatgcggaatttggcaactcttctaaagggggaacacatcctcaggctcactaatgtcacatttgagaaagatcgtgtgtgtagtgcttgccaggccgggaaacaagttgggaatccacatcctatcaagaacatcatgactacaacacgtcctcttgagcttctacatatggatttattcgggcccatggtgtacataagtattggaggtaacaagtatgattttttcattgttgatgatttttcccgcttcacttgggtgtattttctccatgacaagagtgaggctcaagatgtcttcaagcgcttcgccaagcaagcccaaaacctctatgatctcaccatcaagagggtgcgaagcgacaatggaggagaattcaagaacactcaagtggaggaattccttgatgaagtgggaatcaagcatgagttctccgccccatatgatcctcctcaaaatggcattgttgagaggaagaaccgaactcttattgaagccgcaagatcaatgcttgatgagtacaagacttcggatattttttgggcggaggccgtgagtaccgcatgtcatgccatcaaccgcttgtacctccacaagatcttaaagaaaacttcatatgagctcttgagtggtaagaaacctaatgtttcatattttcgtgtctttgggagcaaatgctttattttgagtaagagacctcgctcatctaagttttcacctaaggtggatgagggattcttacttggctatgaatcaaatgcacatgcctatcgtgtcttcaacaaaacctccggtattgttgaagtcactagggatgtgacatttgatgaatctaatggcttccaaggagagcaagttgttgtacatgttgtaagtgacgtggatccaagtcaagctataggtactaaggctattggagacatacgaccagtcgagacgcaggatgaccaagaagacagggatcaaccttcgtcatcgacatccaatagccctaaattgagtcaagtgtcagtcgacccggaagttccgggaccagatggtcggaacctccggacctctccaggccaggaagttccgggtccatctgccaggaagttccgggcagaggacagtcaaggcgtgcctatggcacaagtggatgggattgatgccgagggcactgtagagcatcctgatcaggctcaggtcccctcggtgcaccatccaagaatacatcacactgtccaaagagatcatcccgtcgacaacatacttggtgacataagaaagggggtaactactcgttctcgtgtcgctagcttttgtcaacactattcgtttgtctcttctttggaatcaaccagggttgaagatgcacttggtgatccggattgggtgatggctatgtaagaggaattgaataacttcactcgcaatcaagtatggacgttggtggagagatccaaccaaaatgtcatcggcactaagtggatcttccgcaacaagcaagatgaacatggagtggttgtaaggaacaaagcccggttagttgcgcaagggttcacccaagtcgagggtctcgattttggtgaaaccttcgcacccgttgctcgccttgagtcaattcgaatccttttagcctatgccgctcaccataatttcaggttattccaaatggatgtcaagagtgcctttctcaatggacctatctcggagttggtctttgtggagcaaccaccggggttcgaggatccaaagttgccaaatcatgtgtacaagctccacaaggcgctctacgggctcaaacaagcccctagggcttggtatgaatgtctccgagattttcttttgaaaaatggttttgaaattggaaaggcggatactactctcttcactaaaaaatttaagagtgatttattcatatgccaaatttatgtcgatgacataatatttggttctactaatgcctctttttgtgaagaatttagtagtatcatgactaaaaggttcgagatgtctatgatgggtgagttgaccttcttccttgggctacaagtgaaacaagctcaagagggtactttcatctctcaaaccaagtacgtgaaggacattctcaagaagtttgggatggaagatgccaaacccatcaagacgcccatgcctactaatggccacctagacctcgacgataatggtaaatgtgtggaccaaaaggtatatcgctccatgataggatccttgctttacttatgtgcatctcgtcccgatatcatgtttagtgtatgcatgtgtgctcgctttcaagcggagcctaaagagtgccatttgattgccgtcaagagaattctaagatatttagtccatactcctaatcttggcttgtggtatcctaagggttgtgactttgagcttttgggctattctgattcggattacgccgggtgtaaggttgatagaaaaagcacaaccgggacttgccaatttcttgggcggtcccttgtttcttggtcctccaagtagcaaaattccattgctttatccaccgccgaagccgaatatgtcgccgccggttcttgttgtgcccaactcctttggatgaaacaaaccctaaaagactttggctacaacttcaccaagatctcactcctatgtgacaatgagagtgccatcaaaatagccaataatcccgttcaacattctcgaaccaaacacatagatattcgccaccactttttgagagatcatgagaccaaaggagacatatgccttacccatgtgagaaccgagacccaattagccgacattttcaccaagcctttagatgagaaaagattttgcgagcttaggagtgagctcaatatcttagattctcgcatcattaggtgatgggtgattggctaatttatagtcaaacatatgtcactaaaatgtaaattagaaaaaaatgagcttttgtgtcttgagatcacttcttgtatagaagatggtcttgataccaggaataaagcttaaacattccccttttatccaaaaacccttttgtgaaaatttttgcaaaatcctttgtgtgccttttattgcgaaaatttgggttttatttccttcttgtgatgtattgtgaccatagttatgtaatgttatttgttggctggtcatatacatcataagtctcttcatgtccatagttcctaattttccttcgttgaattctcatcacctccttgtttttgggcctgactgccctttatctgtctggccggaagttccgggcctccctgtccagaacctccgggtgtcggggagtttttactctcagggggagttagaaaccctagtctctctcctcatttctactccctccccgacgccagccctagccgccgctacagtgcccctagtggcgatttccttttccacccgtgaaaatttgattcttcttcgtggaatcaaccacattggtggctaggaggatcttcccgcgatagttctgcgatttcctctctcaaggtagcactttttgattccctctctcggttcattgtgtttttatcccgatctctaaatctgtgaacctagggagaaaaccacttggatagtcttgtttctgctaccttgtagatcactgatctataggatttgttcacatgcactagctatttttgagaccactgttctttatttttgccggccggaagttccggtgttcttacacccggaacctccgggcgctgtccagccagccagccactcttgattctctcatttttttacctaactactgcactccaatttattgattcctgttgcagtaagcactataacttgtgagaaaagatagaaagtttctcaggatgtgtccggtgatgagagtcctcctattcgttttcctcgtggtcgtttgggaaaagagaaagtggttgaaggtggcagtggcagcggcactcgtacctctcccaggtttagaaggcaaaccagcaatcgcccagttcaaattcgagatgttgacagtggtcagggtagtgatgctccttcttcaagaggtcgtgggagaggtggtggtcgctcttctggggctggaagggcttctcatgatttccctgttgggtctcgtgagaatctcgttcggctctacaagactattggttttgacaccactcctatgcaccacattgggagacccaagtccaactaccttcatcagcttgccaagtgccgaaggggccgattgattgatccagagacacagcctgaggagtcacaggatccacgtttcagaaccttaactcagttggattggtacaactcagtgattatggctagagacaatctagtggttgagatgaagtggattgattggacttacatgaggaagaaaaacaatgaagtgttcaatcaagcaatgcaagtttgccacaacaagaatcttggggatattcttgccttggagtatgattggaatgaggaggtcattgcacagttctatgcgacagctttctttggttctacaaggaagggaactccttatgtaaaatggatgactgagggtgttaggcacaagatttccatagcacagtttgctgagatattgggcttggaggatgaggatctcaataggcctaatattcatagtgaagcacccctccccttgatcaagaccaagttcatgtatactaagaatgctcctagaacttgtatgggacctactcatggtttgcatccaaactacaaggtgttgtactccatctttcgttggtctttgcttccaaaggttggagatgccactgctttgccttccaaacatgctcatcttctcagtcgcatgcgctacaatcagcctcctttcagtgtgaagttgatttggtatgagattgccaacaccattcttgagcctaagcgaggttgcatctatgctccattcattatgaagatgattgagtcagtcaccggggtgttctacatcaaagatgggcgccacaatccttttcgtcctcgtgttccaccatcctcttcttcagtggcacctagatccatcccctctacctcggctggtccttcttctagtgctccaccgccatcctcgagctcttctcccatcaagaaggcacttcaggcaatcttctgtatgtgtgctaagactgcaaagaaagtgaagaagatagaaaggcgtcagaaggaagatagaagagaggctgggaaagaagtgtcagatgattctgaagatgaggtctatgtggatccttttgaggcttatgaggcagcccgtaatgttgccggtgaaggtccatccacctatttcaatgaagagtcttcccaatcagatgatgatgatgatgatgatgatgatgaggatgacattgacgcagctgctgagtatgttcctactgatgttgaggaagctgttgacaccgctgcacaatccgatgagtctcatctctccggcgataccgagattgttccctcagatggagatggagatgagtgatcctcttcttctcttcatggtttcttgctttttggtgccttgatgccaaagggggagaaattgtgaattgaagggggtcatttaatcattttttgctgccttgactgttgtctagtcatttggccggaagttccgggtcctgtgatccggaagttccggccaggcagattccctccctattatctatctctctatggacatgtaatcatattctctattggttggaagtaatgactgttagatgctttatcatcctttatgtcagcaagttagaccatatggatgttgcattttgatgtgatgatgtaatcttttcatctttttgagtgattgccatgtcatctagtttttcaatttgcatcactctttatttaagctctctcatctgcatcttatttgtttaaggatagtgtgaagttacctttgagctttccttcgtttttatgcatattgtatttcatctcattttattatatgcatatctttagggggagcttcatacttctctcatcattccaaatttaaattctattatctttttgtgtgctttaaccatgttgtcatcaatcaccaaaaagggggagattgaagatgcacttaaacccctagtgggttttggtgattaatgacaaggtggttaaaggggactaacgtgtttatcaagtttattcacaggagtttagtcccaaagcaagttgtgatggctaagaatgcaaggagaccccccaatttgaatgttcctaagtgcgaaaaacatcgaaggtgattagactaggtttttctctttcgaaattgagtttaggaaaaaccgtactattaagaggggtttcaagtgtggttccagggtatacaaagtgctcttagtcatatccatgagtctaaaggtttttggaactttctttttttttcttggaaatgattttccccgggacagagaggcctatccggaggttctggccggaacctctggacaccaaagtttattttctccccgggacagagagggctacccggaggttctggccggaacttccgggcaccgaagtttagctagatttttcctaagtgctgcccggaagttcctggcacttttgcccggaacctcctagcaggtttccagttcaatcttgtgagtaacggctagatgacgtcacctagccattatatatatggattttgtccctaggtcaccctttggccattccacttcagttctttcatgttctagggttttctagccactcccaagcttcctttgcttcctccactcaaatctacagcctatcttatagattgagagattagattagagtgtaggagtgttttggagatggcttgaagattatgtttgtttgagcactttggatactttgtgggctgtcacttgggcttattactcttggagatcttcttctagatggttaggtgttgcccgtgagcttccaaagatcttgtggatgtcccgggaaagtttgtgaaggatttcctcaccttcgcaaggaaacgaggtaagtgagtaaagattcttgtgctgagttttcagaggttgtcctaggtagagcaacttgcacttgtggtcttttctagaaggaattgtgagttggatcttggtggtcactcaattctagaaaatgacctagaagtgttgagttgaaggctgtggacttcttctgggatctttgcataagtgaggcaaggggttaatcgagacccggctctttgagcacctcaacagagagtaggatccgtgtgatccgaacttcgggaaaaaatcgcctttgtctctcttgtgcatgatctgtgtttgaatctgctggtatcttgtgatttacatcttgtgcaaccttgtgcctgattgtctatagctaggacctgttttgcttccccaaattttgattttctctgttgcccgaaagttcctggctcaagaactccggaagttccgggctgctcatctctgccaggaagtttcggtgttcttcaccaggaggttccgggcactgttaatttaaccgctgcgattgttgagaaaatttcagggaagcctattcacccccctctaggctacatctctgcgcgttcagagaggagaattaaccatgtctgatttcttcttgggctgatcttggtgccagattgatttgctggggattgttttttttggcaaaatcatgtaaggattttatgttcttttggaataattaagcatttccttgtttcatatgtgcttgtttgacatggagtttatcttaataagcatgtcaagagattgaaggttcaactagatttgtttgggattttagtagcagaacggagcttgaaagtccccctttttttttgacaaattggcccttatgaaaaacttattgcgaaactaacccgcacaaaaaacttcaaccaaaaataggtcgcgggctcagcgccaagcaccctggcgctgaggttggccacatccgcaccaaccgcttcggcgctgagctgagcactgccagtgtggcagcccagccgctcccccacacggacgtggcagcgacctcagcgctaggcccgttggcgctgagctagcggcatatatgtcgtggccgggccgccccagcccgaccctaccttttttttcccagagaagctagggttcttcgccccccgcgtcgccctctctcctcccctccaaaaataccctcaaatccacctcaaatcgaggctatttagtgggcattgctttggatattggtttgcaaggtaaatcccctccaaaaaccctaatttccccaatgtttccctcattttttagagtattttggttgaaatcgtgggttgttaaatattgctcggggtgtggtgttgattagggaatatgggtaagggtgcaacgttatagttgtatattgatgttagtatagaggattcatattgtttttgtaagttatgcactattttgctaagggtgaagttgagatggatgtgtagagccgttgtattgtgaatattttggggattcatattgattaatgttgatattgaatggcatagatcgtaggaacattgtgaccggtggttagtcgttagaatttcaaaaatcttttccttaggtctggggtacccatgtcatgtttctatttttatagtgacatatattgatttacttaaacgtcgtaggaatggctgaggattagctcgtcaagtcatcgaatttttcagaaacaccactcacctctagataattaggtatgccacgtcatttgttttttttccaaaaaacccccctgcacttcctattaattgtgcgcccgttcccgccgctatcgtctgttcgatcacgcgcgagggactatctggctgtccacgtgtcccagcgtggctgctcttccaccatcgtgagatcattggatcaggaacggatgccctggatttgccaagaaccctagccacctcagcctccttccctcgacctcgcgcggctctcttctcgctcgccccgcctcgccctcctctcctcacgcgtgtcgcctcctcactctcctctcgccgccggtgcatgttggtatttcttacgatcacagacaaaatctgcaagcgcacggatataccgatgtagcacttcccctatggagtattccaagggtatcgaatccaagggaacgtgtgtggtcagatctttctccggttcatccaaggacaccaagcaaatgataggccaggatagagaggatttactagtgagaaacagtgtctagggaaagcttaactttaatcctaatgcaatacttcaggcactggcaacccgttgttcccagatgttgctctactacgtacccggacagggaagacttaagtaatctcgagggctgtcactacctctacacccacctcaaacgtactatgggatacgcagcaattactagataacaattacctaaacaccacgtctaagcaattactatctactttagtgtttataactcaccaaagtaatcactatattttagttgattatagtgaacaataatcccgtatgctatttaggaactaaccaagagataattcccacaagataaatctaaattactcaagaagaatattatattaaattcagagtaataaacagaataaaagaaataggagaagattaccgacaactccggaattcttccgactccttctactctactctcgtcctattctagtatacaatatagtacaatagagcctcttataattcagctcaagcttggaagtaagtgatatgatgtctttatataggggtaggtatgacggttggcgaaggggaaatgtccgaagtgccccacaaccgccatcagggagtgatctgggacgtccatgccaaaccccaggatcaacggtgatcagggaggttcggccgaaccaggccgaacctaggctgggccctcctggcctggccttcggtcagtggactccctgaaccttcctctatccatttctcggaattttgggttaattcattgatgtttcgatgaagttcataactcatccttgtatggatacatatttctcctcactttagtctgattttcctcccaacttcaaggtttatcacctacatacaaatatacaccaatactatggaatatgtgagattaagcacctatcactatgttggatgttttattatccaaactttatgcaaatgttggcggtatagaatcgatatttaacagccgccaacagtgcaccgccccctctttccccagtcaggctgtctcatctgccagcgggaaggccgggggtgttgaatccggcgaccccctcctcttcgcaggcggatccggctgcccggacgaaagtgtcgtgagccaccgctatcatcttctccaccccgcttggtgtagtgccagatccgctgggaggctgtcgatccggcgcttggtctcccctcgatggatccggccgctcagtgccttggaagcgagggagcaagccactgccaccaccatcttctcctctccttctccgcacgtccaactcccctctctccctctcagcctacctcctctgctcgcgtgcgccgtcgccgccgcatctcccttctcctctaccatgctgctaccaccgcttcttctcaatgagccgccgaatctccaagaaagaaggcaagggccgccgaatccggtgaccccagtctcctcgctgncggatctggcgtcaagaaaagtacaaagtcgtcggcgccttttctcctctttcatccctgccacgccattgcctccttctccgttaacttctccaccacgatcagtgcgttgcgcgcggccatgccctgttctcttcattcctcgcgcacaccgtcaccgccgtaacatcaccgtccttctcgtccctcgcgccctcctccagcctaacatgacttggtttgccagcgcatacgagcggacaggaganatcgatataagtcacaacctaaaaaggagagaggacaactagacttatttaaaaaaaaaaaagcactacaggctgtcgtattcccgtgccttcggggtggcccagcacggcccgaccggccgacccttattgggttgcgcctgagccgtaaggggagcacgtgggctgggcccgaccgatctcgggtcgtggcggactgggcggcccattagaaaagtacagtatgcgcacgattttttttcggttttagatttttttttaatatttacagaaataatctatcgaccaaaaaaattgcagaaatagcccctgccgcccacctctggggcggcaagctgacgtggcaaacgggggaggaacgggcggtgacggagggagggttttttcaggaaaacccttgccgccctctgatggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatacattatatttttagggttttagttgtactaatctagaagtgcgtattgtagatatcggtaactacgtagatctgctagtttggaattaatacattaccgttgcattggcttacacaaaaagatattacgttgtagatgtttattgcatgaaagagtaatatgatctagttatttcgttgacagatatgtcgaacaaacaaatattccaagtttaccatggatgtcacgtcctgataaattcatcccgaaataaaaatcattctctaaaaggaataatagaattaattaaaattcgaaaagaaattggcaatcactaaaatacatacaagaaaaattcgaatgtggttcggagaatttttgttaaattctccgtggtctaacaagagccctcaaattttacttgaattttcagagcgccggaaataattattaagcaacaaaaacaattatcaaagtttactaaaaagaaaaactaaaaataaatcctccttcctcctttgggccaagcccagccaaagtctccctctcctccctctctttccctcctctcccaggcctctcctctccctcccggcccactcttcccctccccctctcggcccactccctcctcccactccctcctgggctgcctctccctcctctcctcctgggccggccgcccggcccaagccgcgcccaagccaggccgagccgagccagccgtgcacacgcgcgccgcgcgtgcgctgactgcgcgcccgaccgcgtggggcccacgcgccggtcgtctccttcctcccgcccggctcctctcactcccgtgaaaccctagctcgctccctcctccaaatccgcctcattcaaaccggggattcccaaattaagtgggggttttaatccccattaattcctcttcaattccccccaattttccccttgaatggcgcccccaatcgtcgggaacggacgcgtctttcccggccgccttccatggccgccggccgtgtttcccgtcgccgttccgccctctcccatgcccggcttgcttccctccgctataaaatggaaccccctccgtgcgttctctcgttttagccccttcccgagctcccccgtggccgcaccacctctccctgccttctccttctctctctccggtgccggccgggcttcagccgcctttccctcctcgcccgagcgccgtccggtcgcgccgtcaccgcccttggcctcgcagctgcctcctctccccctgtcagccctccgtttcacgcggaaatcaccggagacgtgtcctcgccggcaaaacagtggcgttgccgccactgtactgcctccagccacccctgccgcgccgctcaggtgcgggccggctgcgccgtctcctccctcggcgtcgccgcgtcgacctccaccccggcctgccctcggtttcaccggaacgccgtcgcccacgtcggtctcgccctccgcctcgccggagttcctccggcagccccgtccgccgtgcctgtgcgccggccgacgtcgccatctccacctccagcatcgcagcggcaaggtcgccctcggcctcgcctcccctccatccgaaccctgccggtgttcgttatcgtcgtctccgttcgtcctcgtcgacgactcctccggtcggtcgttcctcctcgccggctcgtcgtctcgctgcgccgcctccgttgtcggattcgcagcggcgtgttccacgccgtcctcgtcttcgtgcagccgctgtaggctgcccacgtcgcctcctcgccggccccggtcgtcgtcgtcgtcgccctctcgtcgttcccggtcatcgtggcgttcgtccctccgtcaagccgttctcgttcgtcgtcctcgcttcgtcaagtgccgcagccccatcatcgtcttcgtcctcgcctccgcgttgtcaagcctcgtgccggccgagtctcgccttcgttcaaggatcgccgccgaagtcgttccctcgccgtccgtctccgccgcgcccgttcgtcgttgtctttcccatgcctcgtcgcatggtggtaaggatctctcctctcgctgccccgtcctcgtcctttcggtgtcgcccgtgcccgttgtgcggttgtcgaccccggtacccgtgtaccggtgtcggtagtcgttcgcttgtgcgtgtggtgaccgtgttagtgtgcacgctcggtagccacgtggtttccacgtgtgcagcccatgcggtgtctagtggagtccgtttgtcggccactcgcctcggttcacacgcgggatccgcttccgtcgacccgtggactgtctctgtgtactcggtctaccgtggtcccttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgaactctgaatcgacccgttcaagtctcctaatgtttgttataacctaaagaaccgtgtgctttctttttatgtattgttatcgcttctttataggcttgtagctttgcttgtgtgcttcgcgtagcttctgtcgttccggaggttccagaagcgtggttcgcggtcgtcgccgaaggttcggaaggccgttctctcggagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctagggggctcaatcctgcctgcctgtcccgggggttccggccgtaggtagggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatagttggcctgggttggcttgggacgagctgggacccagggtcgggttgccagttcggtctgaatcatcgtaggccttgggttaaggcaggttcgtgcgggttcacgaccttgattaataatactgtgtagctttaggatcgtctttttaaaatggctttgggcaactaagtgacttttaaatgctgtttactgcaaaacttaacccctattattaaccccttgtacccccttgcattaatcatgcatctgccggtgtgacttgctgagtactgtggttgtactcattcttgctcaatctttcccccccttcagtaagagaagcttcggagaagatgtcttaggtggagtcctggcttataccccagttgagcacctgtgaagatggagccgtaggcccgcaagtccgctgctgtttatttttgtttgtcaggcctgaagtgcctttgtaataatgtatatattatcgatatattaaagatgtgccttttgtatcatgtttgtttggtgtaccccggcttttcctgggacggggattaatacactagcgttcgggaaaaggcaattttctcgatcgcgacaatggaccaggaaacgtccgttacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagatgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggaggattctaacaacgagcgtgtagaggaaggtgattcgtcagatgatgagatggatattaatccagcagaatgggctagtgaggatttttctggactgatcgtctctgaagaggatagtgtgagatgggagtacaaagaaaatgaggttattcagggagcgatttatagtagagcagaagatatgaaggaggcggtaaaacattttgcagtgtcacttcatagagagtttagggttgccaagtcgaaccggtcgcaatatgaagttcggtgtgttaaggaaaaagatggttgtccctggagagtgcacgcgtataaggggaaatggaaggattattggacagtgtcagttgttaccaagcagacatgttttctacctggtgttcagaaataccacaggaacattacatgtgcatttgttgcatctgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcattcttagctctacatgcatgcaagatggcattcgtgaactgtcgtcctgttctctgcattgataggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtatgcctgatacatgataggcacgctggcattctgcgagcgataggagagttgcagtttgggagtatggaacgaggataccccggtgtttgggaagatgtacagagtaggtggtgcatgagacatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcctaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtctgtggactgccactagttggcatagtggagttcattttacatgggacatgcaggtattttagggatcggatccaggcagttcttccctctatgccgaacaacagcattttgtttggagctttcaggcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtatgttctcaaagacgacggcacatgtcattgctcttgtgcaaagccgaagctgctccacaggccatgcacccatgtcattgctgccgcagcggagtgtggcataccagatacagtatatgtgtcacagtacttcagtaagcaagcaatatatcatacatggagcggtgagatttatgggttcggcatagctggggagttcacagagactaacgatgaagtactcaatattcctgacccatcgaagctccgaagcaaggctggaaggagaaggactcgtcgcatccgcaacgatatggacgagtcggaggctggcagggtgaagcgttgcagcaaatgcgatgaacatgggcacacctacaagcattgtcaaagacaaggagaaaccaagtgcggcggagccaggactatcaggatcaacagcagatggagctcgccctacgggtgaaggcactacctccactcgaccacgtcctaggcgtcgtcgtgccacgtctggatacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttatgtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaacgcgtatgattttattactatttcataattttgcaagttatcttttgttttacattactattttttgaattgttctaacacgaaacactatatttttcagagatagcacgtcaggatacacctcagttgttggacccggcgatagatcaccgacaccggtctcaccttactgcggtgcagggggctcagcttgggacgtttcgggcacggacgtgcggtgagctactcacggttcacgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgcccttgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatc

SEQ ID NO: 10820 - DNA, 1477 bp, Oryza sativa
actgccattatttttgatacactttgccaaatcaaacagatttcaaataaaacatttattgctaatcaatatgttatccaccaaaataatagctcgagatataattcttaatcatacatgatcctaaatcaaataaaattcaaagaaaatatccctctgatctgtgcaatcccacctccaacaccactaaagtactataagaatcaccccccagagcacaagcctgtaccacaatacctttgttcttcctaaaaattcttctacacacaataattccatcatcagcacaaatggatgaacaaggagaaaaaaggtaatctctcccctatgatatgaatagaagtgttacttcctacatctacatatttgccatacttaagtttcttgtttcacatgcttacagtagtctttccattctctacatatttgtacatattcaaatgttgttattcttctttaggaactgtaacccacaatctagtcacaccacctacctgcaagcaatttccgtcgttactgcatccaaatcgtcaactgtttatgtttctatccaagggaaatcagccgctgacgacctatcctatttcaagtcaactcaaactcacactgtttcctacatgaagaataaaattcctcacatagatgtcttcctcacagaacaagacttcaaaaataatgagatttagtgcttctgacattgcgtgttagttatttctaccatacattactattacctcactacaatttgctgcaatctaatgaagataatttacttatatatatgcatacgttcttctcaacttatgaaatccaatcctcaggttaatggttctaggctaagaattgcttgatctatcctgtaacgctaacaaataatactcactgcaagttttatgatatgcccgcagcaacgcgcggggtatcaactagttcactcaaatcctaccaccacaattaccatcaaactcgatccgacgggcgcaatgccaccaccatcaaagaatttccaatgcaacggcttcaagaagattatgacatcttgaatatcacaattgctattcgagacatatagactacaaggttttcattcggaagattccaccgcttagcacaaatgtaagaagagcgtcgtgtcatcaccttcaggaagttatgttgtgggcacaaacatcatcgagagagttgttattcttgaatatctgatttttctctagagattgggcagctgacaactcaacgtagtgtttcttattgttagctaagaaaaacttctttgttttcaattttctcaaatgtgtgctcgtggtgtgagctttggtcagatctagttaatcaatatttgtagagtaaatttcacatatgatacaagttgcagaaaagcacaaacattttaacaattggcactcaagtacatatattttggtagtgtaatttgacaaaaccacactatcaatgaatggattcacctgtgagatga

SEQ ID NO: 10821 - DNA, 31408 bp, Oryza sativa
  unsure (1)..(31408): unsure at all n locations
aactacactaacaaaacatatgtacttaagcgtcaagtgtcaaagtgtgtggttttctgtaacttggaccacagaacgtgtaattttgtgaaatttactcatatctgtttacttttctcaacgaggagattggtagctccacggataatatgcttttttttttaattttgttgtaaaagtcacaaatgatataaatttagaagttttactcccaagttatttttgattgcttcattcctacctctcaaatcaaccgatcagcgcgtgagaccttgtgtactgagtttcaaaagttcacaagctggatgatcaaattttattcgtaaagttgactgcaatagttttgtatagatcttaactaaaattctttcagatcaatgtgattcacgcagtattattttggcccatacctaatccgtaaaattaacggcagggattgtccgtggtttacagtcggaagaactgatatgtggacgtaggctatgcacgtctcgaatttcaaccattcagtgggagctagcatatcattttggtagactttaaaatcccctccggtgaattaggcttgggaaaagtccaccacctcaatccctaaccaagatcgccagatcggccaccgccgcccgcgactcccccgcccatcgccatgtccgactccaaccccggcgcggcgaaccctgccctggggccggacgccgacgcggcggccggcgagggccttgagctggcgcagttcgcggcggggtgcttctggagcgtggagctgacgtaccagcgtctcccgggcgtggcgcgcacggaggtgggctactcgcagggccaccgccacgagccgacctaccgcgacgtctgcggcggcggcacggggcacgccgaggtggtgcgcgtgcactacgaccccaaggcctgcccctacgaggtcctcctcgacgtcttctgggccaagcacaaccccaccacgctcaacagacaggtgcgttcgcgtcgttcgctcgtagtagggggattagggagccattcctcctgcgccggcggcgccgccgcacgcgtgtgccggcgggcggtgccgatgcggcggcgacttcttcgctggcgtcgcaggaggttcagtgaacctggctcggtttttgtttagtgttgactttgctctgccgcggaagttgtggtctctcactgggagtattttggaccgttaaacagatcagaaaatatgcggttttaaacacacctacgtggccatcatccgtgattagttgcgttgagatttttcacgccattcttggtgcagtacggtactcccagaacccagcaacggttgatggaagagaaagataaactcaactcgctaagatttatttttgtgaagaaactagcgggctcctttcaaaaaaagaaagaaagaaagaaactagtgcgcaattgtgtgaaatagatgcgatcaaactactggcattgtgaaatgagaatcacatttgatatgattgtggaaagtaattttgacatgaagctagtattggccttactatccaaaaactgcaatccggtggtaattctacccaataccactataccagtaggaaagaacatttaacttcatgccagattatgtaactgagaagtgagtcagtgaagactgatatattgagccgatcgagttcatcagctagctgtgcagcctgtgctgctatcagttttccacgagactaataactaagcatatcgtcctggtttttacccctgctaattaaccccggcgaacttatgcacgcgcaatgtatggcagggcaacgacgtcgggacgcagtaccggtcgggcatctactactacacggcggagcaggagaaggcggcgcgggattcgctggcggagaagcagaaggagtggaaggagaggatcgtgacggagatcctcccggcgacgaggttctaccccgccgaggagtaccaccagcgctacctcgagaagggcggccagtccgccaagaagagctgcaacgaccccatccgttgctacggctgacgccgccgccgccgacgccgccccgagcggcactcgccggaccgtgcgctcgatttgccggcgttccattgcacatttgcaggtgtgcatgtttactgtagtaataactaccggtatcgtaaactcgtcaaaggaacctgcaaattctaagtcgcggtgtacgcgattgtgccattgaaagtttgaaactgtgggagtatatatatctgtgttacaataaacgcactgcttgtcaaggtgcagtatagttatgctgtatttgcttcattacctgatcatcgacgcacgcgttatttccttttgtgggattaactaatgatgtacattttcagctggttgttgagtcagttagcagccataaaatagggccatttgaatcacaggatttatttagaaatttcatagaattcaaattctatagaaaatttttctatttggccctttgattcaaaggattgaagctttccaaatcctatgaaattcctatggaatggcacattgcatgtggattttgaaggaaatttagtaagagctctaaactcttggaaaattttctttgaatctatctctctcatctgattcctgcgtttttccgtgttttgcgatcatctgttttacacttcaatttctgtcagaatcatgtgtttttcctattcctttattttttctaccatgcaattcaaaggggcccgtcagccgaattgaggtggcgatggaccagaggcagactgtagttggcaaacattttttcagccacgtgtgctggtgaaaaggtgaacgttcgtagaacgatttgtcgcgcgacgaccagtggccacgttcgtcgaggtatcaaactgtactgatctcgaatttaatagccaaacttgactggcaaatctccaaatctcgcgcggcgctcctctccagtccacggtccagtcgctctcgctccccggaaccaggcgagcgatggccggcggcgacctgcgcagcctcgtcgccgtgtgcgccgcggtgaccgcggccatgtggtgcgcccgcttcgccgcgcgccgcctccgccccggcctgccccgcctcgccgcgttcgtcccggtgctcgccgtcctcccgttcctcccgctcgccttccgcgcgctccacccgcgcgccatctcagggttcttcctcgcctggctcgcggagttcaagctgctgctcctcgcctcggggcagggcccgctcgacccgtccctcccgctccccgccttcgtcgccatcgccaccttccccgtcaggcagcgtgatcccaccaagaacgccccgggatcccgccttggccccgtgacctccggcgtgatggcccgcctgctagcggccatcgtgtcgctgtaccggtacaaggagcggatgaacccgtacgccctgctcgtcctctactcgctgcacgtgtacctcgcgctggagctcgtcctggcgtgcgcggcggcggcggtgcgcgcggtgatggggatggatctggagccgcagttcgacaggccctacctgtcagcgcacctgcgggacttctggggacggaggtggaacctctcggtgccggcggtgctccgcccgtgcgtcagccaccccgtgcgcgcgcgcgtcggcgagggagccgccggcttcgcggcgggggtcctcgccgcgttcttcgtctcgggcgtcatgcacgagctgatgttctactacatcacgctgcggccgccgacgggggaggcgaccgcgttcttcacgctgcacggggcgctcgccgtggcggaggggtggtgggcggcgcgcgaggggtggccccggccgccgcgccccgtcgcgaccgcgctgacgctggcgctcgtcatgtccacggggttctggctcttcttcccgccgatcacgagggccggcgccgacaaggtggtgatcgccgagagcgaggcggtcgtcgcgttcgtgcgggacaccggcatctgggcggccgcctccgtccactcggctttgagtcttctttgaccggccgctcgcgcgtactgtagtagtagtttgatatgatgggtccatctccccatcaaaatccaactctacgaatactccagcaagagagtggatcagacaactggtgtctgtcatggggtcccctattcatcctatgttgtcctgattctctgacatgtttgtattggatccattttaaggaagggatcccagtgcatgtttgtctgttcgcttgttaataagatcacgcgtgcaacccggaaaagctaacgcgggcgtgcccgttggcggcgagtgtttccaataatttagcctaattaactaagtggttagtagataataacggtaattaagatatgattttcttttttccggaagattttttctactaaccgattgaaaactttcaagttagatttgaaaacttttgaagtcaaattttaaaaactttcaaaactcaatttgaaaattttcaactcgaaatttaaatgtgtaagacaaattttgaaaactttcaactcatatttaaaaactttcaactcagatttgaaaactttcaactcgagatctgaaaactttcaagttcaaatttgaaaaattttaaaattaagatttgaaaaaaatgaaaactttcgactcagatttaaaaactttcaacttgagatttgaaaacttttgactccgattcgaaaattttcaactcaaatttgaaaattttcgactcagattcgaaaactttccactcaaattcgaaaactttcaactcgagattcgaaaactttcaaatcagatttaaaaattttcaagttaaaatttaaaaacttcccaactcaaaacatttttgaaaaaaataagtgtgctaaagattaaaaaaaagtaatcagaaaaaaacgaaaaaaacgcaaaagaaaaggaaaaaacaaatcgcgaaaaaaaaagaaaaaatggctgatgggccgggaggcccgggagcagctggcgcgcgcgccaactagcaatcccctgtgcaaccagggccatatgggagaattgtttggaggctctgtgccaaacgtaaaattttaggcccttagatttcagaattgtaattctaatttgagtcattatttaacttttacaagagtttgcctacatctaaggcttccgtatctacatccaaccattttcagaccaagacgtgggagtattgtttttctcccatatctccatacagagctaatgagttttacagttgtgctctcctcttggtctcggtgcatagaccaaatatgctgatcaaacttgaatggattgagtatatgttggtggttatggtgtataataacaaatagctacattttataggtatctctcgctaaagatcaacttttgcagtgttcaaaaaactaaaaccataaagtcccactatcctgtaataaaatttgtctaaataattttggtaccgagcatgtgaactgagaatgatggtagtgcgtttcatgagccggatagcgatttcggaccaaaccccattctgttgagggcgacttggatcgcgaataactctggttttctgttaccaacggactacagtgatatccaccggcggcacttggatttggcggtgacgccatggagaaagaatatatcactttcaagtgagagaacggagttaaacactgcagcacattttgttcgcttgataacatgggctgtagtgagcagtggattgtaccatcggcccatggtttgcatcaccgggatgctttaatttgttccacggcgactcggcgagcgcccaatttatcaaagaaaacttgacgagttgattggcaaattcagcaattccccgtctcgtgccaatctgttctttccgtcgcgccccatcgaccggaccccgatgatggccggcggcgacctgcgcagcctgttggccgtcgttgccgcggtggccgcggccatgtcgtacgttcgcttcgtggcgcgccgcctccggcctggcctgccccgcctcgccgcgttcgtgccgctgctcgccgtcctccccgtcatcccgctcgcgttccgcgcgctccatctccgcgtcacctccgggttcttcctcggatggctcgcggagttcaagctgctgctccttgcctcggggcatggcccgctcgacacgtccctcccgcttgccgccttcgtcgccatcgcctccttgcccgtcaggcgacgcgcgcagcgcgattccgagaacgccccgcgcccgggccttggcctcgtcaccttcgccgtgatggccgcgctgctcgccaccatcgtgtcggtctacccccacaaggagcggatgaacgagtacgtcctgctgatgctgtactcgctgcacgtctacctcgcgctggagctcgtcctggcgttcgccccggcggcggcgcgcgcggtgatggggatggacttagagccgcagttcgaccggccctacctgtcggcgagcctgcgggagttctggggcaggcggtggaacctgtcggtgcccgcgctgctccgccagtgcgtgagccgccccgtgcgcgcgcgcgtaggcggcggcgtcgccggcgtccccgcgggggtgctcgcggcgttcctcgtctcggggatcatgcacgaggcggtgatctactacgccacgctgcggccgccgacgggggagccgaccgcgttcttcgcgctgcacggggcgtgcgcggtggcgaaggggtggtttgctgcgcacaaggggtggccgcggccgccgcgcgccgttgcgaccgccctgacgctggcgttcatcctagcgacggggttttggctcatcgtcccgccgatcacgaggaccgggactgacagggtggtgatcgcggagagcgaggccatggtcgcgttcgttcgggacgccggaagctggcccgccgcatccgtccgatcggctttgaccggccactcctagtttgattacgacgggtcactggcgcatctctcgttcagttcacggtacaaatttgtatattgatttttcgttagatttggagctacagatttttcatgtagctttagatttatgtatatagaaagaaaaaaattatttgattagtgctgctaaatttaaaattagaaattcatgatgaattaatacaaagttatactcgttctatattctcagtcgtagttttgcatgattataaactggatcatcctagcatgaattttgcttatattgatccattcaaccgttccattgctcgaccatgtatgcaacgcaatgattcgtgtggtggactacgccatcacttcacatgggactaaggcacggcgatctgccgtgctggagcttgatcaggttgtagtacgtcccggcgcggccgacggcgaggagctcgtggtgcctccctctctccgccaccctcccgtccttcaccaccgcgatcgtgtcggacttctccaccgtcgagaggcggtgcgccaccacgacgcacgtcctcccccgcagcatccggtccacggcgtcctgcaccagcctctccgacgcggcgtccagcgcgcttgtcgcctcgtccagcagcaggatcctcgcgtccttcagcaccgcccgcgccagcgcgatccgctgcctctgcccccccgacagctgcgcgccgcgctccccgacgcgcgtgtcgtacccgcgctccatggcgctgatgaacccgtgggcgttggcgagcgccgcggcgcgggccacctcgtcctcggtggcgtgctcttcggcggcgccgtacgctatgttgtcgcgtatcgtcccggagaagagcgtcggctcctggctgacgagcgccacctgcgaccggaggcgtgcaaggctgtagctcctgatgtcctcgccgtcgaccaggaccgagcccctctgcgcgtcgtagaaccgctcgatcagcccgatcaccgtcgacttgccggacccgctcggcccgacgagcgccaccgtcttccccgcgccgatctcgaggctgaatccggcgagcacggccacctccggccgcgtcgggtagctgaagtgcacgttcttgaactcgatcgcgccttttatctccttccgtttcttcttcttcctctcgttgtcgttgtcgtcgtccttgatcgtcggttcacggtccagcgtgtcgaggacggagcgcaccgcgtcgccgccttgcgccaagtccgacgtcaagctcccggcgtcggcgatgacccttcccatggtcatgagcatgaagaacacctggaacaggtgcgtgggagtgatgagccccttggccatgagcttgcctccgtaccagagagcgaccgccatgctgccggtgttgctgaactggcacaggcacaggcagaagccggagaaccacgagtgcgccacgttgtccttcttggggccttgttgcgcggcctcgtacaggcggagcatccgccgctgcgacgagaacgcggtgatcgtccggtggttcaccacggcctcgctggcgagctggctcccctgcacctgcgccttcttggccttcttggacatggcagccatgagcaccttcttgaagtagaagctcgcgatgatcagcggctgcatggccatcatcaccgtggcgaggcgccacgacacggcgagcgcgagcgagaagcccagcgacgccgtggcgcccgcctggaccagcaggcacatgcggtcgccgacgagggagcggaccttgctcgactgtgtcgccagccgcgcgcacaccgcggcgctcgagttctcgtcctcgtcgaaccacccgacctcgaaggagaggatcttggcgagcatctggccccggacacgctccgtcaggcgctcgcccatcaccgcgaagttgtagtgctgcacgatgttcgccgtgatgcagacgacggcgatgccaaggaagaggaagtagtacaacctggtcttggaacggatctggccatcgtcggcgaggaaataaacctccggcaacgagcctaggctgtacgagtacagcggcagcaccgcgccgaagacgacggcgccaacgcacccaagcaacgcctgcttccactccggccggttcatcttcagcaggcgaagcttcgagggcttcctggagcgcgccacaccgtggtccacgagcttcctcccaatctccgtcgagtgttcgaccgagcagaacgacggcgcggggctaggacggtgctcggtggcgctgaccgccgacataatctccacgctgcggaacgacaccatctcgctctccaccacatccacggcgcggtggcgctcctccctcgccgccacgggtggcgccttctgcaggtgcaccatcctggcgtacacgccgccttcacccccgtcgtccatccccaagagctcgtcgtgcgtgccggcctccacgacgcggccagcgtcgagcaccgcaatcgtgtccgccttgcggagcgtcgagaggcggtgcgctacgatcacggtggtccggcccacggacgcccggtccagcgcgtcctgcaccgtccgctccgactcggcgtcgagcgcgctcgtcgcctcgtccagcagcaggatcctcgggtcccggacgagcgctcgagcaatggcgatgcgctgcttctgccctcccgacagctgcgtcccgaactgaccaacctgcaccggagaaaaaaaaaatacaccataagattcagcgtgctgtagcatgcactgtaaaaattgctgttgcttgtgtacatgagtttcgtatccatggggcaacttgacgatgaactcgtgggcattggccatcttcgccgcggcgacgacttgcttcaacgaggccgtctcgtcgccgaacagtatgttctccctaatggaggtcgcaaacagtacaggctcttggctcactagccctatctggctcctaagccactccacattgagcgtgtcaatgccatggtcgtccatcgatatctccccggagtccgggctgtagaacctctgcagcagcgagatcacggtggacttcccggacccgctgccgccgacgagaccgacggtggcgccctcagagatggtcaggttgaagccgttgagcaccagcgtgtccggcctcgacgggtacgagaagtgcacgtctttgaacacgatctcgcccctgatcctttccatggtggctcccttcttctccgccccttcgagcggtgggagcatttcgatcatttcttgcatccggctcgccgccgccgtcgcgtcaatgaagtaccggaggttcggcagcgccatcatgatcgacctgacattagcaacaacagcacgaacgtacattatcggtaaaaatgtcacttgttttgaaatggagggtgtgtttgtaatttgaatgcttacattcccgccaaaacgatgcagatggaggcgacgaacacgtggccgccctgggcgtgcaggtggatgacgaggaggctgccgatccacgacaagaaggaccagacggcgtagatgacgcccatgctcccgatcacggcgcccttgatgagcccctgcctgacgccgagcgccgcgctccgcgccaccgcgccgcggaaccgctccaccgtccgccgctcagcggtgtacgacgccaccgtccggatggacgacaccgcctgctgcgctatcccgcccgcctcctcgtacgccgcgcgggcctccccggccgccgcggccatgcgcccggcgaggagcacgctcggcgtgacgaagaggaggagcgtgaacgggaggcccgccagcgcgagccgccacgcgaacacgaacgacacggccagcgcgccgaagaagagcgtcgcgttggccaggaccatggggagcttctcgccgaggaagtcctggatggcgtcggcgtcgtcggagacggtggagatgacgcggaacgtggtggcctgggcctgggcctgcggcgacgacggcgaggagggcgcggcgtcgaagaacgccacctcctggctcaggacggcctccaggtacagcctcctcatctttgacgcctgccgttccgccgttctcgtccagcacagaccctctgaagatcaccaaccaacattcatgttctccatgatcgtccaaagaaaattctcaccgatcaaacactacttctgattttttatcactgatcactaatttgtttgattcaaagttgctcacctaggaaggagcaggcacccactgcaacggcgacgtacagtaaccgaagcgcaaactgcaatgcagcttacgcgcaagaataagattcaggaaaggagttgcatatggaaacgtaaatggatggcacgattgatcaccttgtcgacggcgccggagctgaaggcgctccgggcactgccggcgccgccggcgccgccgtagctgttgacgatgtcgccgagcaccagcattgacagcggctgcatcatgccatcgccgaagctgcccagaacgcccagcgccatcaggcaccggtcgtgcgcgtcggcgtagcgaaccagccgcaggaacgacggcttctccttgtcgcccatcgggcctagtttccaagcgaactaaccgattgcgttcgaagcttaaccaaaatttctctactattaatcagctaactgccacttagtcattggctgtctgtcgtccaattagacggattaatccgagcttgtcacgtagcctgctgtcagagaaggcctttcgagtgaggaatataccaatcatatcgaaatctggtgagtacttccgttttgtcccgaacgatgcagccaagccagttcaaataacagtagagaagaatatgttatactccctccgtcctaaaaaaaaaagcaaacattggatttctcttatatgaaaattttttataatttgtattttcattgttgttagatgataaaacatgattaatattttatgcgtgacttgtctttttaatttttttcataattttttcaaataagacagacggtcaaacgttggacacggaaaccagggtttgtctttttttttttggatggagggagtacgatcgtagagtagatacccatagccattagcgtgtgtttatagcccctgcttgcagttaatttggtttgtatattccgccggccttggcgctagcttttgctcgtagtctttttcttcgcaaatctgatatacgaagtgcagctgttcccttccaagttccaacaaaaggggatcgagaagaagcgctggcgtttcactctcatcatcctaacttgcagttggcacacgtaaaaagggtgcgtgccaaatgccacgctgatatataactttcactaccccgcccccatgtcaccaccattcacaatcctctcgtacgtaacattaccaaccaggacgctggtcgcccacacgtacctggccaaagctgctcccttccttgtttcatcgatagccaaagtccctttcggcagcgtggtccgccagaatctgcgttacctgacctcatactttcacaggttcacagcccccggtgcagcgtccatcacccactgcagccgagtgccatgtgcgcaggagagccatttttggggcagtaaaggtatcacgtccgaggcgcaccccggctgcaatggctgcatcttcctggctattcatcagtggcgtgtgctcgtacgagcgacctcgctctgtctgcagcctgccggtcgctcgttttccggcccgtttttcgccgcaccccgcaacgccccgcacagaaagcgccgcggcgcgggcctcgcgttacggggaaagcgagcggttggttggccttggcggcctactggctacacgcgctacgccggcgaatttgtgaccctagtgggtacggtgtgggttgggtttggccacacgaattatcgttgtttgccttgcctaccgccgtcgcgcccagcaccgcatgcccgcggtgtcgcagccgggatgcgggaaagtttcgtggagaacgcattgagacgttttgcatcgttcacgagtccctcgctctatccgatatatagccgtaggcatacgcgatgggcaaatgcatatgctactacttccatcccaaaatgtgtttacgattagatttgacactatctaaggacaccatgtaacgatttatcgggaatttgtttggaaatcgtcgggatggaacacatttgtccacatataatgatgcatcgatgaatgttgctcgttcttgcgagacccgttttcgccgaggtcaaatcctctttagaaaacaaggagacacgaaaggtaaccaccctacggcgcctttctttcatctcgagtccaatccaacgccacccacatctattcgacgcacgctatatatgtttgtatcaaactgtggacaatgcgattgactgaagtctgaaaatatgcatcatgattacattgtccgttttctacaaactttgttacgtgactccttcaattgaagaacccatcgttttcccacacaaccaatgtagtactagtgccacccaaaaagacccgccccaatcatgcacgccctggcagggtgacacaagtgaccagcggagccgtgtcacctgatcagaaaaaccaaccaatccatgccatctcgagctcacgaccacttcatctgacaaccaccagcagcaggcagcatgcacgaaacgcggcatattatcattggcagtactacgaatccatatgatgcaacaaaaaaaagcgagacgtgctcttttggatcgtcttgatcgcccaaccacggcaggccaggtgttctgctgttggcctacctaggctgcaccaaacgagcaaagcaaacaaacgcacatgtgcgcgtggttgcccactgcaattgaagcggacaccaccgaagatggcttcgtgcggtgctgcctgtggtggctgcacacaagttttcaggtccctactcgatgcggtccttgaccctgctcgcgagcgcgccacgtacacctggaggctgggacgccgtggagacacggatcattcgattccgtggtgccacaacccgacagggccacaatgccatattgccatccaaggaaatcacaacccaacacggtgataccgacggccattaggctgctgcgtgccttgagctttgcatgctttttagggtctatttaaaaaatatagcttattctacaatcttctgctcttaaaaactcttctcaagcagttcagattttcatacagattttaaaaatatgcagttgtaggattcagaaaataagctagaatatagaaatgagaaacctagcttttctatattttcaccagctaaattctcaccaagtgtttctcggaatattaagccttccaaacagtatcttagtgaccagttggcagttgcttgcgatttggcaataatttatgccccaagacgccgttaggagatacgtaaatgtcgttgcaggacaggttcctttgcttgagcgaacatgaaacgaacatttcgaatgattggttgcattttcgctcgatcctcttgcctctggtcgcttttatcacctttgcgctagtaaaagagtgaacagtgcaaagcatatcaacaacgcttggagacgaagcatgtagatggatccaggctttccagttcgatctgtgtctctgcccccagttcttgcgtatgtcacgctcacgcaagaactaactgatcctgatgatacgctcgtatagtgccctaatcctgctcaagaagacaaccggtctttgaatttagtggccgtgttatctgttatgttatctgctgttgctgcttatctcgtcgctgagcatgtgcctgtcgccgtcgtcactgctcacctcgtggcactccttgctgattgcactgtggattttgtctgcagattttcttagcgtgacgctgatgttactgtgcagattaaaaaaaaaacactgtgtagttgctcgacgttgcgatcagcttgatatcatccatttccaatttgctgcttcttgagtaaacaagcgcaataggctgctcaatatcttccaatggcatcgacttgacactgatccattgatcgcctgttcatttcattgagttaactcattggcaactcttcttttttttcttttcggtgttaatttcaaacctactagaaatctccaatttgtctgcgtgtatgtaatgattctgttcaaaaattgttcatgtcacgctctgaattttgaaacccacccctgcgaggtaaaggaaaggctgaggagcatgccaaaagtgaaaaatgacaacagattagtttatgttgcattctccagaagggaacatatattctttgctgcttctccactcaaatcacatccctgacgaccgtgaaatctttttggcaaatctccactaaacacacccattgtttgacaaatctgctctgcaaatacagaacattttgagatccgagctgaataagctatcaagatggtagtcgtagaatcatattctagggtggctatggagctggcaatgggaccagaaagcacactgcacacatacccgtaacacaggcctgcttaaatcctgcttaattttggcgtaaagtgaagcaatgagagagagagagagagagagagagagagagagagagagagagagagtagttagggagcagcgattaggatatgatcctcatttgacattctatatattgcattgctttacatgtagcccccatgctcttttttgcaccatatatattcggttgagatttgtccaacctcttataagtcataattagcttttcctttactgcattaagtgttgtaagataatgttgtctaagtagtccactcttggcatcacatgcatgttggatcaaatggaggtagcttttgcagtatctcgttactagcaacatatactagttactcaaaaactttatataacatgatctactctctactttgctaatagtacaatcttgtctctcttacatgatcagccagtaagagcatttgtcctcagattgtttttctcaaggacgcttgtccttacctcctgccgtttcctccacagcagatttgcaagattttgttctccaatttgcagcagccttcgttctctgatgagcttgcatgttggataaaaaaataatactttctgcaaaatgagtatagctcaactgattaagttttttttaatagaacaagttcacttcaagttttagattgacatggatactcatatttgcggctatttattctttcagtgacagacaacatacccatcaacagcgagacatttatttcgttaatctctagatgtatcggtccaatctttccgagatgttcataatgataggacgcacgtctatatgtttatagtgtatgcgtatttgtgagcgtctatatttatattatgttttttgaaaaatatatcactatctgaccactaagctcaaccagtaccacacgctggttcagttatcactgaaaatttcgaaacgcttctttcagagccaaattgacaatgcgtggcagtggaccaacccacattgaattgtactatactccttcaaagttcacactaacacacaacacaggagaagatggacgtgtcaatttacggatccataggtgaagccataaaacgcatgcggctcacgtttcaagtcccgatacagtttgccacgttgaaacaaaaaccggtggttccatccgacgtaaacataacatcttacccatgccgttactggagccgagatgtcagtcacgttacggtcgtactcgatcgtacatgttttgcacgcatatttcttcagcgtatggtcctgacgcgaaccacttgccgaaccgtcacttcggagtccctactgttcatcgagagagagcctctcgtgtgcacgcacaaatggaattgcacagggctaattggcacttgacactttggtacaggccgcgatgtccaaagcaaaaggtaccatacattttagtgttaaattcatagcctcgtttgatggaaaaaatcacatcggtcccgattaattcatcaggttagaatgtagtatgaaaattccggggaggcagtcgaggcactaatcctggaccaaacgtgatctgtacactttgtaagtgtacagcaagcatcacgatctgagattgagaagctggtgtagaagttgatcacatcacacttatttcttcatttttcttttttttttttttgcaaagatcacacgttgacgcagcggcgattccaaccgggtggatcggacgacgtcgaccgaccgtaaggcggggcgggctcgcgccatcgaccgcacaccggtgcccccgacacctccgccccgggctgtccactcgaaccgagcgcgtaccgacaggtcacatcggggccatcctgaccgtccagtctcccacccgtacatgtgccggacaatccccagtcgtcagatggaggaagccgacccaagcctgcgcgtacaaataccccctcctcgcactcgaaccaactcctccattccacggagtcgcggccgctgtcacagtgggtggtggtgtctcctgatgcggcttctcccgcggctttgcatggccaccggcgacagcgcggcagccgccggcgagggagacagcagcaatagcggcagtaagcagcaggcagcggcggtgtcgtcctcctcgtcgactgtctcgacgtcgtcttccgccgcggcggccgcggtgtcggaggcgtcgtcgtcgatgtccctcccttcgctgccgtcgctgtcggatgtgacgggtagcatgagcgcaagcctcgccgcatcgttcgcccatgttactactctgtgccctctgtccacggcggcggcggcggcatcggctgccgccgtcgcggcggcggactactcggttcacggcggtggtggtctcgtcgtcgtcgtcgccaggccggcggctgtggtcctccacgacgtgttcaccatggaggcgacctccacctccgacatggcggatgatacttcggcggccgggtcggtcaagtgcgtggcgcaccttcatggcggcaaggccgccgtgacggggcaccaggacgggaggctgcggctgtggcggatgtcctcccgcgcgcccgaccggctccgcctcgccgccgcgctccccaccgtctccgaccggctccgccggttccccgtcccgtccaaccacgtcaccgtccgccgccaccaccgtcggctctggatagagcacgccgacgccgtgtccggcgtcgcggcctccgccgacggccgcctcctcttctccgtctcctgggacaagacgctcaaggtgtgggccgtcccgtccctccgctgcctccagtcgctgccggcgcacgacgacgccgtcaacgccgtcgccgtcgcgcacgacggcacggtctacaccgcctccgccgacaggcgcgtccgcgtctgggcgccccgggcgccggcggccgggccagacagggcctcgcgccgcccgggcaagaagcccgcctaccacctggtggccaccctgtcccgccacgcggcggcggtcaacgccgtcgccgtcgggtgcggcggccaggtgctctactccggcggcaacgaccgctgcgtcgtagtgtgggagcgggaggacagcgcgagccacatggtcgcggtcggcgcgctgcgcgggcaccgcagggcggtgctctccgtcgcgtgcgcggccggggacgccgccgacggcgcgctggtggtcagcggggcggcggaccagacggtccgcgcctggcggcgcggcgcggacgggcgcgggtactattgcgtcgcggtgatcgacgggcacgggagcgcggtcaggtcggtcgcggcggcgctcgtgacggcgcagaagaagcgtcgcgccgacgacgacggcggcgacgaggagtggagggtttgcagcgccagttttgacggcgaggtgcggctctggtcgctgcgggttgcggcggcatcgtagcaaggtcccggtttggcacgatttttgacgtagaaaagtgtgcgtttttttcttctttttctgttcgtttttggactcacggaagtttgacttgtttgagaatggagatactcctgcctttgtgtatatacgggagaggggagtctctacggtccactatatttttggactttccaaaagctgcttattagtagtgatttcaaatttgcttacatttttcttcagggagtgtacatttcaggtgtctggatttttcaaaagatacagttacatttctcatccttggatggtactaataatcttatggttctcataaatccccaaatgattgaaaaataaattattctaacatataaaaatttacaaatgacacgaaacaaacttataattaataaaactttacaaaactacgtgcaaaagctcttaagtagtgatttcaaatttgcttacattttcctacagggagtggacatttcaggcgtctggatttttcaaaaatacagttacatttctcatccttggatgatactaataatcttatggttctcataaattcccaaatgattgaacaataaattattctaacatgtaaaaatttacaaatgacatgaaacaaacttataattaataaaattttacagaagtacatgaaaaaaaccaaatacataaaaataaagtaaaaccatatataacaagaaaatcacagtaaagtgaaataaaattgcagcaattttagggtttagcaatgtcgtgcaattttaattgaaagaaatttttataactttcataagtctaaaatcttgtaaatcaattgtctttatgtgtgtggagattatgggtaccccatacccacacgacatggttatcagactagttataggggatagtttagatctatggaatatgtaacggatcataacttgggtattacgttttcttgtatattacggaatggcgtaaagttttggtttgataatagatttaggaagccgatatcgtattagttaaggtttctgtcttgtaatcctgtcccccatcctatataaggcaggcaagaggccctctagggcatgagattcacaactagatcgtcaaatcaatactacacttggtggattcaaatccccaaacaggagtagagtattatgagagggttgatgagagggtctgaacctgtctagatcttgtctccacatctatccacttttagatctcgtgcgctatcccgtttatattgccgaaatcctgttttgacaatgtgttttttttttttgcctttctttgtgtgctacaacaatagctgtgttatctactttgacaaatataagaccagaagaatagcgagaaagacccacctaattggttcatcagcgttaggctggtgtcctgttctgatctgtaactttccaaaaggaaaagaagctcttcaattgtcgtctctcactctagcttggctatcaagtgtcaaaatcgacatgaatggctcagtaaaaagaagtcaagaaacaatctatccattcaatttctcttcaggctgggctactgtcaaagcagataggagaatgtctgacataactatcatccacagaatacaaccaaattaccaaaatgaagtaactgaccgttcattttgcaccacgataaactccaaatctgacgccaatcgccgatctgccaatggataataattgcacatatagtttgtagtttgtgggcaacgcagcattgcagctgcatgcctgtaaagcgggcgtgtatcgctggggatttggagttggagatgagatcgatcgatctggagcaagcaaagcagcagagaggaagtgcaggctcgatcgctttcatgctggcgtgatcggattgggatcgacgtgagcgtgacgaaccaaaccctaccgatctcgctggatacaatgataagattctgtgcgcctctgtcctgcagacgagttggccacgcactgcaatgatccatgcacttagcagatgattatgactaggttttagctaatctgatgcttaatcccttttttgggtctgcactgttgctgattcgcacgatccgatgctagaccgatttatcatggtacctgctacacccttttgatttttgactcatgctctgtcagtgttaaggcctaacatatgtaaacattgcctgccagctcttgcctgctgctgcttgtcgtgtgtaacctgaatagcactgctgtctggcttttagccatgtcaatagctttaagcaaccgacctcactagcaagggcccgctggttacctttggagagatgcgatgcgagtgaaggactgttgtaaactgtccttgaactgaacattttgctgttccttcggttctgtttctgtgcatgatgaagccgagcagcaagggggtatctgctgcagccttttccccggagatattttagcaaaaaggcaggccaggggttggtggtgcctccatgagctgaacggcaaaccgacacacgccgataaacacaatatctatccattcgattgtatacggcagcttatatccgataagcacttgtattatagtattctagagctaagcttaatcaacccatgttgtagcagtagtatatctgtacacatcacccttgaggatttaaaaatcagtgtaaagtaatcccacttggcgcgcggtcgcagataacacgagcctcgcagttgattcgcccggtggcgcgaggcgtgcgtggagcgagctacatccagggtttacaaaatcatacagtcactatggttatcatatgtgatgttttttttttcagtttttaaaccatcacacggtttgataaatcctagctacactgctagtacatgatgacaggcgtgagagtaaggtagaatgaattattccctgtattttataataagtaactttgacccgacgtgaatatgtgatatatctagtattataaacttaaacaataaatctgttacattgaatcaatattttttttatttgatgatgagtgtgaatatcgagtactatgttacatccaattaaaactttttatattttaagatgaaaggagcaacgagtcagcgcgagtcgcgctaatgatccggcagcgttggcgcgcggtggtggcggaggagcagcagctcgatctcgaccgattagttaatcgcgacactgactcacgtctgcctcagcgcgccgccatcttcttttaatcacgtagccacgtaggtaggcttcgctagctcgaggagtcaaatgcaatttatgtagctggtgggatactagcagcaggttaggaggagattcattcttttttttttttactttttttgtaagggaatggattgttaatgtgggattcaactggtggtgcgtgcattggcacgtcccctgattatgcaggtcgtgtatagaaatatttcaggagaggtcctcatcgtggagtatttgaccagcaaatgtgacaatgtgaaaagatgatgcagctgactgtatcgtccaagtgtaagtcagcgtggcaggctggaataacctggttagtacaaagaaatgccatggatcaggtagggtaggagtatgtcataaacaagtggcaaaaccattgttctgccacccatagtttcaaattttcaatcaacgggaggaagttttaggtgcatgaacgaggcaccacgtattacactagtatttactactcgtacactgagattgtgcattttgtttccatctactagtacatatatactagtgtatgaattgacgtgtagtgtacttgtatacagtgtggcacatggagcctattaagtcttggaatattctggcattgttagcttcgtcaacacagcaaatggatcaactagcaagtcggcacagtacctagctgctcacaagtcagcacagtgagctactccaacaatggacatcctattgagtattgtcacagctcacaacgaacacagagattaagcatgcgacgtgatgtgatggcaaataatactcagtccgtagtcctaaaatctaaaaaactacgggcggagctagaacaaaatgaatgattccattcatttgttactttgatttgaatcttgatacgagtatctaaatttaaactgacaggatatataaacatatggtgaaaatagataaattataactaatttttcttttcaaccgggttcccggacaccccctaactatacatagctccgcgcctataaaaaaactaatccttcgttagttttaaaatattgctatatatagtatatgtatgtgatgtgatattttctagtaaaatgaaagaaatattacatcatatattaggtacatagtagtaataatattttaggacaaaacaaggtataactaaatttgtatcaaattcgattcgagattgttatattttaaaattgaaggagttcatatttagttcctgaatataatttgcattttcataaggaactcgtgatacagtacatagtagcggtttcccttaggccccgtttagttcccacacaaaaattttacaccctgtcatatcaaacatttgaacacctgcatgaagtattaaatataggctaaaaaataactaattacatagattgcgactaatttgcgagacaaatctttaagcctaattactccatgatttgataatgtagtgctaaagtaaacatttgctaatgacggattaattatgcttaataaattcgtctcgttgtttactgacggattctgtaattagtttttttattagtgcccgaacactccatgcgacacctatataataatcgatgtgacacgctaaaactttacacccctagatctgaacacccccttactcgttttttgtttgtcccctacacacggttggtgcctcttggcctgatcgattgtcttgcactctttgctgcggctgcggcgctggaattgatcagctcatgctcatctggtatttttgcggagcaagactctgaattgattttatgataatatttcaagggtacaaaaagaaaataattaagcagcacaaagttgatattttaaatactatttctaagaaacttacatataaaaaaaaatgcggacaccattctgtgacaaataatctataccggcggggccaaagctgctgaattggcagtagagctcctgtccaatttctgattgtaccttgatggacggatctatattgtggcgatgaaccaaacaaatccgacccgtacgcgtggcggtggcggtcggtgcacgcctctcctcaccccctgcacgctgcatttttcagcaggtccacggcgtgacagtctaacagacattggcacagaagcttccacccgccaagccccatgattggatggagcgagccggccagatattccgcttccagaaccttcacccacagaaacagatcatgctcctgcagtagctaggcgacgggagaagaagaagaaaaagtcattaaagaattgaagcgatcgatcgcgtttggtcaactgtcaccagtgctagccctgccccaggaagcagacaaggggagaaggagaggaggccccatgacggcgacgaagaagacgatgatgatattgataggataagagaggggccctatgcttaagtcgaacgcatatggacgcatggcacgctgttgttcggatctcgcaaaacgatcaaggagcagatctgacctgcgaaatggatgcgtcttagctacctgttctgcttgtcaagttgtcatgttgtatctccaaagtccaaaccaaaatgcactcgaaatagtgatcgcaatttgcaagcatggagacgaatggcttttagaaatcacaagagagagagagaggtcgcacggtttgggggaagtggtttctgaacagtgaacaatgtatagtacataatttgtttggacttttgactccaggaaagtttcattctttaatgaaaccctccacaccaaagaaaaaaaaggaaaagaaaacgaggaaggacgcaaggtttcttaaacaatcttcagaagttggcgagagaaactgaaaagcggtgggaaacagggaaaggggaagcagatgatttagaacagttttgctccttcaaaggggaggagttcgttcacggcgatgatagtcccctgaaaaggtcgttctctgccttttctccgaccatcctgactcacctgccattaaggaagcaagcaggcagcttaatcacgaaattagtagtataccaaggatgttcaatcacgcaagattaaacaatcctgaagttaatcagggcaatgctggccatcttcaaacagattaaatacgagcccctttacgacatgcgagcatgatatgggatgaccagaggaaacttgcagccatcgtctaggcgagttggtgattgacttgccagttcaatcaacaatttgcttttccattcaaaaaagaaagaaatgaaccaaaaaagctttacctttcctgcaaggtaaaccatctcgcgtcagcttggcggctagcaagggagaaaatggagggaaaaggctcgaagaggcctattagtagaatttatagcccaaaataaaacccaattcagtaaagggatcacctgaaacgggcccaccaaggccccccttgaaaccccttcccgccatttacttgccctaatcccctccccctcccggcgttttcccgctcgcggcccgggcgaaacggaagccacccgcgatggagaacgaggcggcgcgcggcggcgagaccttcgatccggtgagctcccccctccttttgatcggaataaatccagttttggggttgatgcggtacgttgacggggcttgttttggggatctgggggcaggatctgatccgtgccatcttcaagctggtgtgaagccgccggggcaaaagggccgccgccggcggcaatgccggcgacgaggtcatcgaggtcgaggtgattccttgatctggtcccagatccttgcctccaaatgattgttttctgtggccgttcttctttcagctactcctaatctgtttcagattactcttctttctgttgtgtatgtactctggtctgaatgtttccttctctaattgacagcctgccccggagacatcaaggaggaatcgtagtgccactggtaaatcaccttctgctacagtaaaacatgcgatttatgcgttttgctttgttacatctgattagtctccttagccactggtaggaactaggaataagcttgaccatgcacatctgttggtagtattcggtgctgttaaatggcagcaggttatcaacactagtggcagcatcagaagtttttacatttcttgcaattgccttttggagctgaatctcatcagtatcaactttgctaaattctcttattactagtaactattactttggagtttgggtaactttacagtgatgtttacctccgtttcacgggccctgtgggtggcaccttattttactttacaagcgaatcctgacaacaatttaagttgtgcaatacagagggcaacaagaagtctatctgatttcagcatgacaatcaatcggtccaggcgtccagccacttatgatgtaacaggatcttgttggcatactagtttagacattcatcagttagtctgtcctcttttatagttgcatatgctgcagcagtggacatttgttgatcatcttggttgtacaattcagtttttgttattgttttatattgtagcagatgggctctagacctctagtcctttcagggtttggtatatccttacaacagcaactaatgccagcaccaagtgtgccaaccaggctataacaatttgaccctgttggcctgttggataagaaattgaaaatagacctaacaagtaacaataacttgtctcaaatgtttaaggcatcctagcgaaaaaaacaatattatcagattttgtctctagtatttgttaaaagaatagctgtgagttgtgaaaaaccaagtcttgttaaattcaattctgtgcgcccaatcacctaatactgaaaaaagaatctccacccttagatttctgttggggtagtttaaatcttgaacttgaaattaactccctatcatcctatgagagccttcttgtgtggtgttgacaatctgttcaccttcacagccaacgccagtgcgcttaaagtgagctgtgaacttctacggatatttgtcacaggtatgtacctcttaaattgttctattgcctcatggtgttaagtgacatgaagtcaatactccatagctacagtgtaactagagaaattttcttgcagaggctgttcaacgttctgcttttattgccgaagcagagggcacaacaactattgaacccacccatctggagcgtgtattgccacaacttcttttggacttttgaggtacttcagggatctcttatctctagcttccaaatctataaggttgcctctggcagaaagatataaaaacacctaagcatatagttttaaactatggcatcagcaaaacggtttattatctgaacaaagcaaaatcgtctggataaatcagtttactgacttgatgtatacacatacaggatacaacttgtaccagctagtgcttttattttgggggagaaaagcttgtggtcagatggatagctaagggacccgagcaaaattcatactcgagaagcctgttaatgctagtaccacttgctgtgaatgcgtaaaaatgacctggggcaacaacttctactaggatccgtggatttctggataatcactgtactgcatctttacactgatacctgtgctggcatgtcctaaataccaccttctttgacaggcacgatcttggtcatgtccacactgcagattgcttgataatgttctactagtatctaaatataaacaacagaggcgtttgaacgagatgctttctgtcactactactacgagttcgctgctgacagatgatgggcgaaccctgctgatgcaggcgcatctacggtgatttggtgaatcttcaaccttcacgatctctcggtctcttccgaattcaggagacggaacacccgtatcgtatcgcaccggggcagagcaaccagccaacccgcgaagtagtactgagtactgaatggaaggtctggataggcaggccacgcgcgcacacccgtcccttcctgggcggcagccggcaggcacccgtcccccacccacgctaccagagttcgccggagaggcggccacctgtcgagagggagcttctccacacggccaccgcagcggcaaccacccccaccacctgtcctgctcccctcctcgtgccgcctcgtcctctttttaacgggtttctgacgcacggggggccgccgtcatgtgcctcgccgccgccatcgcgtccgcgtccgcctcacccgcccgctgcctgtcgccctcctccgccgcgctcccccgccgcttcctccaccacctcctcctcgccgagactcctccccggccaacaccgcccccgccgccggtgcgctgcatcccgttccaccggatggcggtaagcgttggtgctcctcccctcccctatcgattttctcctgtggcaatcccgattccgtggaaatttgtgcccggcgatgcccaaccggaacctgctccggatggctcctcgtgtgacctgttagggtaaagttgcgtggctaattttggggaatcacttgaaagcgcagatgtccaaaccagtgaatttcggaggtgtgctggattgctcagctgtttgctttgcccttgtgactaaaaatgttcaccttttggcgacctaacttcatatatagggactaccttaaagtgaaatccatgcttgaaatgaatcccgtatcttaccatgtccatgtaaatgtgaatttacattgtacgtcttgtgaattcctggttgctttccaaatgatccatgtactatagaattatgatgagtgaacatttaacttttgagctctgtcgttccccccaaaaaaaaaagttcaagcattgtggatttggttgttttcangatgcatgcactcttttcaagaacacccaatgtattagtttcaagctatgatcatacctgcgatggatgctttcatctgaccattgcttgcttgccatccagcaattctggactcaaggatcactggacaagaacaaagctcttgtcgaatacctgaagcaatatggtgctgttagaactgataaagtggctgaagtaatggaaagcattgacagagcattgttcgtagcagagggccttactccttacactgacagccctatgcctattggttataacgcgacgatatctgctcctcacatgcatgcgacctgcttggagctactgaaggatcacttgcagccaggaatgcatgctctagatgttggatcaggtattcaggttcattactgaaacaccatactcctgtagtcctgtactatagcaaatgcggttgtttttagagtgccctgttgagttttctagaccatgcagttgtgtgaacgacttgctgttatccattagtattagatagttgagatacaaacaattttctaactattgacacatttcatctgcatgtgtaactcttgtaggcagcggttacttgacagcttgttttgcaatgatggttggaccagaaggccgtgcagtggggatagaacatattcctgagcttgtcgctgcttcgactgagaatgtccaaagaagtgccgcagcacaattactgaaggatggatctctttctttccatgttgcaggtatgctaagctgctaactggtctgatactggcactagaattagtgtattactgaacgcatgctttgcttccatcttggcgaaatctaaaatgcaaaatcactatgcgcataatatttcttgccgttctcaacgctgcagatggcaggcttggttggcctgacgatgcaccatacgacgccattcatgtgggcgccgcggcaccggagattcctcagcctctggtcgatcagctgaagaccggcggccggatggtcatacccgtcggcagctacttccaggagctgcaggtggtcgacaagaacgccgacggctcggtgaccgtccagaacgacgcgtccgtccgctacgtccctctgaccagccgctccgctcagctgcaggattcctaaggtcgacggctctaggaggtcatgaaaacacatgtaaatatctcgacgctcagtctacttgggtagttgggtagtttgattagtgctaattagtttcttctaacgaggttgagtagatggtttggtctgagacgttcagtcatggtcatctgtcagatgctgtagatcgagcgtgagctctgagcaatactcgataataaccaataaaagtacttcttagcctttcatatacgtgatttgtttcatgctaggaatgggcttgataatttctccattgagaatgttgttagtttggaatttggatggaagagaacaccacgcgctacgcagagatgtttctgtctcgaacacctctgttccaagttcagttccaacacccacaaaatagttcttttgcacaaatagtgagaatctgtaaattatatactctccctccattttaaaatgtttgttcgaccattcgtcttatttaaaaaaaatataattaactatttattcttttcatatcatttgatttattattaaatatactttcatgtacacatatagttttacatattttttaattttttttaaataagacgaacggttaaacatgtgctaaaatgtcaacagtgtcaaatattttaaaaaaatgtaagtaactatttattcttttcatatcatttgatttattattaaatatactttcatgtacacatatagttttacataattttcaatttttttaaataagacgaacggttaaacatgtgctaaaaagtcaacagtgtcaaatattttgaaacggaggaagtacatccctaattataatactagatgtacatctcaagatttccatgagttttagcagtaagttggctctggcacctacatgtaaaaacttcacatgggcttgaagtttctgtacgagatgaccgcgtaaaacgggtcggacgagcccgccatcccgaacagcctcatcacggcgtccagcggcgacgccggcttcccgccggcggcgtcggagggcagcttcctcaccacctccggctccgtgaacccgtcgacgcactggaagtactgcgtcacgagctgcacgcggctgtaggccgtgcccttccgccacgccccgatcgccttctcgtagaacatccggttgctgaagctcacgatgcacactccccccggcttcagcacccggaagatctccgcgaaaacctacacgacacaaaacaatcaagagatctggagaagaatgcagcaatggcagattggcgttcaaaatgttataattaaaaaaatcaagataaatcaatatatgatatatatttttacaaatatacaagttaaaatttgatttatacaactggaaaaaaacaataaatttgaccatgaaatacgtgttcttttcgtcaaatttattatttttgtttcaatcggtataagttgaatttgaatatgtatagttgtgaaatga

SEQ ID NO: 10822 - DNA, 3797 bp, Oryza sativa
catattaaattattatactaatttttttaaaaataatttgcgatgactttttaagtgacatgtttatcctcttaatgaatagagttttcccaatgtcagcaatggcgggcatactttctcaggggactgaaggtactggacgctgaccgtgcagaggacggcgtcgaggctggaggtctggagctcgagccgctgctccttgttgaggtccttgacgaagaagtagtcgaggcgtgggttcttggcgagctcctgggcgttgaggccgtggccgacgacgcggcggagcgggagctcgcgctccggcggcaggtggctgacccaggagctcatgaggtccagcacgtcccacccggggcggaggcgctcgcggtagaggtcggcgagcgccgcgaggaagccgtcgtccacgtgcttgacgagccgcgggaacgcgtagaagtcgcggtccggccgcgcgtccagcttcgcccggccctccggcgtcagcaccagccgccggatgccgccggccgacggcggcggcgacgcgcctgcggcaggggagcaccgcggcggaggcggccgtcgcgaggcccgcggcgcctgaggcggagcgcggagcatggctgcgatttgctgccgtcgccctggagaacggaggctcactggctcgtcgctggacgtggcgctttatctcgtcggggagttcgagtggttggcgtcgcagtgtgcactgtgtagtgaccgtggcacagtccagtgcagatcaaaactccctcttttcaggccatcgttttatgtggcttcaaatatcatcctcattcctcaataaacaggttaaactttaaaataatttaaactgaaattcaaattttagcccgtgtgctatttttagcccgcgaggcgtcatgtcgccatatctgagggaaaaatgatagtcttgccctcataaatgatgacgtggcatttcgctggctaaaaattgacacgagagaaaaaaaatcgtctctttctagtaaaaaaacgaagtcatccaagaggggatagtggtatttgagaatggaaaagtttattagtattaaattttcttttcctaaagttttactaagactagactatgtatcatgctgtgagtatacgtagatatctatgatttttatcttcttaaattaaacgcatgatattattgtttatgagagttttgtaaaaatagaaagaagttactccctccgtcccatattatagcaatctagtatcggatgagacacttcatagtatagtgaatttggacatgctccctgtccatattagttgtgctataaagatgtgacattttcgccgtgtttagttttaaagtttttcttcaaactttcaatttttccatcacatcaaaacttttctacacacataaactttcaacttttccatcacatcgttcatatttcaaccaaacttctaattttagtgagaactaaacatatcctttataatacaactaatctggacaggaagtatgtccaaattcattgtactatgaaatgtctcgttcgattttatattgctatattatgatacggaaggactaagtacatttagcagtgctcttcgagaaggaagggggccaaatagtccataaaaaccccgatttcgtagctgtcgccctcgtcccccccgcgtagtcgcgcacgcgagccgagcgtcgccgtctctctcgcgtcgcggcgagcgcccccatccacacgcgggggtcccgatcatggcagcggaagtactaccggatatcttagtctatcccagctcgaagctgacatggcgatgacggggacggcgccctggaggtcgccgcttcgggcccctcctcctactccctcgcgcgggaataattcgcgcccccgcggcctcgtcccggcgcaatgccggccgtggccgcgtcccagcctcagttccgccgccgtcgcgtgcccgcggagcgaggagatggcgcggctggagcgcgggtcgctggtggtcggcgggcgggagctcctggagcgggcccctcccagcgtggccctccgccgccccgcggtcgtcgcctccccggggggcgccgcgttccttggcgccacggcgcccgccccgtccagccgccacgtgttctccctcggcaccctcgccaggtagagcccccgcccccagagcagagattgcggtgtgcgccgcggccggcagcggtggtactgattcgttgttgggttttggtgtgcagtgggtggaagtggctgtccctgttcaggttcaagatctggtggatgatcccgacggtgggcgaggacgccgccggcgtgccagcggagacgcagatgctgctcttggagtcgaggagcgaggcgggtgccgcgctgtacgcgctcatgctgccggttcttgacggcggcttccgagccagcctccaggggagtcctgagaatgagctccaattttgcttcgagagcggtaggtttattctggatttgctggattctgaggtgttcgaattgaaacgaactgcaaattttggaatttcggttggaatttctgaagagtacagtggtggactgtttttaggtgatcctgaggttcagacactggaagcagttgatgctgtattcatcaactcaggggacaaccctttcaagcttatgaaggaatcaatcaagtaatgtcatcctctaacataaccacaatgacacatatttttgttctatttgcaactggctcacttcagttgtatctccatttaggatgttatctaagatcaaaggaactttcagtcatatagaggacaaagaggtatagtgtagctaaggatgttcatctttgtacttctatcttctacttagaataagactgttaatcatgtaaaccttttctagtcatttatagttctatgttattttgtttttcacaagtcctgttgaaattcatcacaaatgccagatccctgcaaacctggactggtttgggtggtgcacttgggatgctttttataaatctgtcaacccagtgggaattgaagagggccttaaaaggtacaaatgaatcgatcttacttatgtgatattcgaaaacaattgaaaggtcttttttattacccgcatcctccatttgtcaattcctgataaagcatttcttgttgtatagtttgtgtgaaggaggtgcaccaccaaggtttctaattatagacgatggctggcaagaaaccgttaacggattcaaggaagtggatgaggcctttattgaacagactgtgttagcgtctaaccatttttcaacttgctgatcggtccatgaagtatattaaattcctgtttaacaaagaaaatttactccaggaaatggacgtttgagtatttgatttcatattaaataaacaccaatacattttgaaatctctccttatctgtttgtgaaagagaatctagatccaccaacatagactgtatactttttctttattgtgagatttcctatccaatttccttttttttttcccctgaaactgtaaatcactgtcataacctcatattatatctatacacataaaagtgcactcatctgttccttacccatgttgcaatattattaggtttgcggagagacttatcgatctgacagagaacgataagtttaggggagaaacctgcaagaatcttggagaccatgtcaagaaaatcaaagagcactatggagtcaagtacttgattcttattgaaatactagttctataatatgcttttcataatatatgctgagaaaaaggctttgtatgaaactacaggtatgtctacatatgg

SEQ ID NO: 10823 - DNA, 9928 bp, Oryza sativa
  unsure (1)..(9928): unsure at all n locations
gatcctgccatgatatatgacttctacaatgatcagcacagctacctttctagtgtgggtgtggatggtgtgaaggtagatgtgcaaaatgtgatggagactcttgggaagggttttggtggtcgtgttgcattaactcagaagtatcaacaagcacttgaggaatctatcgctcggaacttcaaaggaaacaacctaatttgctgcatgagtcacaatacagacagcatttttaggtacatattcttgtcgctgaacaatatgtgtgacatacatgaaatttgacgtaaatcttggttctttgtagttcattgaagagcgcagttgctagagcatcagaagatttcatgcctcgggagccaacgatgcaaaccctgcacattgctactgtggcattcaatagccttttattgggagaaattttcatacctgactgggatatgtttcatgtgagattatggcatccccagtacctctttctttcttttttttcatgccaggctggcagctaattttccattcttgccaatgtaaagagtaagcatgaatcagcagaatttcatggagctgcgagggctctgagtggtggtggtgtttatgtcaggtaattcttgcagtatatttatgcagatgttgtatttgcatttaagaaatttgcatgatctcattatggattttatattactgaactgatatgcagcgacaaaccagggatgcatgatttcagtgttcttaaaaaacttgttctgccagatggcttgattctaagaacaaagcatgctggtcgtccaactcgcgattgcctgttcaatgaccctgtcatggatggcaaaaggtacacacacacacacacacacaccaatttttctaaaaagtttcctgctacttgttctaaaaataatactaactcagttaacttttgtgcagtctgttgaaaatatggaacttgaacaagttttctggagtcatcggagtgtttaactgtcagggtgctggaaattggacttatccagtgaaagaaaatgctcatgttcccactaccgtctgcatcactggtgatctctccccatcagatgtggagttacttgaggagatagctggggatgattggaacggagagactgcagtatttgcttttaattcatgtaaattccattggacacatatttcttgcaactgttacccatctccttcatcgatctttttcacgattattaactgcagctacgccttcaggttctctctcaaggcttcagaagcatcagactatggaggtttccttgtctactatgacatgtaagatatataccatagcgctgataaaggtcagatttttctccattcacctacttacttgagcaatcaattttttatcgcgaatatgcaagccttttgtatctttgtattaagaactcaatctattcttgagcaatcaatttttttttttgggtgaatacttgagcaatgaatcattcgatatatgtttacttcttagagaaatgctcttgtttttgcaccaggtttttggtggctttgttcagtttgctcctcttggactggttaacatgtacaactcaggtggtgcgctcgaaaacgtcacgagcacaggtgattgttcagagatcacaattcagatccaatgccgagggccaggtcggtttggggcgtattcagcaaccaggccggaaatttgcagtgttgatgagcatgaagtagagttcaaacacacagatgatggcttcctggcctttgatctctctcacggttcgtcccaggacaacctcaggaacattgagattctgtacagagcttcctgaacctccattttcagtgtgatttttatgctctttcgagcagattatgctgctctcaggctcttagctgtggataattattgcttnccgcaagcgtgtgttagctctgaattactgcatctcgcgtgtgttgtttgtgccaattaatttgggcttgttctaagtttcgaatctgccggagacagttataatacgaatatgtattttggcagatcaattccaattttgtgccaatattacctaaaacaaaaatattatccctctcgcggtaaacctgtacgtaactttataagagacgggaaggaattgcatggatgaatcatgaattgaattgttacatcacaagaacaccgctcttgttcaagggcagtgtcttctccttcctgcgccagatggcgtcatggcgattgcaatttgcaagatcattctacaacaacaatggatacgtggattactccaccatgtatatggtgagcttgtgctcacgcgcacgtgcaagatggatttggctaatcatcagagggacctaatcttccatgacctgagctttggcggcagctgcgcgagcatggtgttcgtcgccgccacgctcctcgtgctggtcaccagcttgaaccactggctctccgggtcgcagctgttgtccgcgctcaggcaccggcacgggttggtcaccaagctccggccatcgtcgccgacgtccaggcagagcatgccgccgttgctggtctcgggggacgacgacgacgacgaggcgttgacggcgaggtgcagcttggagtccgaggtgaggctccaccgcgccagctcgtcgccgcacgacaggccgaggcgcgccggccggccggcgccctcggcgcggaggcacagcagcgggctgtcccgcggcgacagcctctgctggctcgccgtgtacgcccacgcctccgcctcgccgcaggaccccagctccagcgtcgtctgcaccaccgacgacgaccgccgcaccacgcaccgccccgtcgtcgggtggaacatcaccgtgtacggcgccgcctccgccagaccaggccctgcacacgccaaaccaaagtcatcgccggagaagatagataccggcggcggcggcggcgaacctacctctgaaggggcgctgcagggcgtggagcctggtcagggcggtgtcgttgcggggcttgcaccacgcccagtcgagcacgccgtagacctcgtcgaggcccaggacgccctcccggaggtagtaactcccctgcagcgtccagagcgcccagtcgaggtcgaggtcggcggcgacggcggcgacgcagccgtagtaccggttgtcgttgacgttgccgccgcggttgtcgacgccgaactcgctgaggaacaccggccacccttggtcgagcaggtacagcgcgcggcgcgacacgctcgccgccacccgcgcgcacacctggttggcgttccccgcccgccacgcctgcccgtcggagaagccgtaccagtgcacctcgaacgccaccttcccggcgaagctgacgttcacctgccgcgagttgaggaacgccaggtcgttgtcgaagctcatgccggacaggatcaccaccacgcgcgggttcgccgcgtgcaccgcctccgccccgcgctgcatgtacctgcatgcacgcacgccatttttttcccgcgcagtcgtcagctatcagctcagccgctacatcgttggcgccattttttatttttattttttgcagatggcgctagtacacagtacactgaaatgaatgatgcgaactgcaactgcatcagattattgccattactgttcttcacatgcttgtgcagggacgagcaatggcggacgcggtcagtcagctcagctgccaaccaccactagcttcaggttcatttactgatcgatccaggacatggccgacgatgaacaatgcgtggttcttggatgcagatgctaatcatggcggtcggtgtgcaaattgatgaggaggatcgatcgagcaaatgggtggtgaactggtgtgacttacttgtaccagtcggcggagttctggcgggggccccggagctcgttgcggaggctcatggcgacgacgctggggacggcggcgaacatggtggccatcttggtgaggccgtcgacccacacgtccgggtcgaagtacgcgtcgccgaagaagccgttgccgtcgttgttgccgcagcaccaccccggcttgctcacgtggttgtccagtatcaccatcacgccgttctcccccaggctactcaccaccgcctgcacgccacgccacgccacgccacgccgcgccgcgccgcgcgtcgtcggtcaatctctctctctctctcgcattgtcaaaaataagtagtagataacaatgatcttgccttgaaggcgtcgatgagcttgaggtcgacgagggaggggttgttgacgcggatggcggcgagggactcggtgaggttgaggcgctggaaggactgggcgacggtgagggaggagtaggaggcgttggtcaccatgaacgtggcccaggtgaggcggacgcagttgaaacccatggcgaccacgtccttggcgatggcgcccacaggctgcttgcccagcccttccgccagcatcggctccaggtgcgacggccagttcacgcacgccagcttcaccctgttcccgccctcgtcgacgatccacctcgacgccgtcgacagcgtcgtcgctgccgccgccgccgcggggcgcccatggctggccagaccaagaaccgccaccgcggcgagccacaccaccacgagcctcatgtcgacgccggccgtccggcaatgcgagacaccgagaagaagcagcggcgaggtggatttatagcgagtactacggcggcggggttgcttcggcatggggaatggcgaggcttcacgggattgccatgggcggaagacgacgatctctcctaagctatgctgctggtccttgacatgtgtgaagtggagaggccatgaatgagggtgagtgagcaaatcgcattgctgatgtttcaagaatgcaaccaaatactgttttatccttcaaggcaggacaagctaagcgacatcactgtacgtctgtgacaatgcagtgcatagcgcgtttatttgcacattattatcgtgaactatcaatttaattataaagataaattaaatatttaaagaaataaacttaatgaataatataaaataaatagcctaggcaacattgcttatagtaaagaaaataaatatttttgaaatatggagtaaataatccgttttaataagaagcggatgatagcttattatgggcaatgtatggcgtacttatgaattaaagaagcaatgctgataaagaaatttttcgaagacgtacttttggaatcgtggtactaataatccggttgataatccgactgatgagccaaaccaacctggcctatttcagaaatcagaaccagagaaaacaaagaatctctgcacgtcggtcggtgggtggttggagtaaaaatggccaccaaacccttgcagttacagcttcggtttggacttcttatagtgatactggagtattgatgttggttacttgcatcgattattagtagtacctcatttgcaattaataccagatctaatcgtggttggttagtataattttttcgtgaagcaatcaatattcagtagtgtagcattggtgcacacacaactgggatttatttgcatcctgtttatgaggagctcgtccaaagcctcacgccgttgtcaacaattcagctacaaagacaggttaagaggttttgcttttactctaagaatgttgctagttgtattccagatcatgcatgtaaactgcttgcgattccgtatctgtctcacatcagatcagttaagaaatgccgtgctgaatatgaactaggatgaatgaggattttgcccttcaactaaaaggaaaggagaaaggcgacattgaaatgaacaaagagggaaagaagttgagtgtactgaaaatatagggaaaggcctttctctggcgccacgattgctgtttgcatatttcagattcagaatacaattttattttctcgaacacgtaggagagttgtgtaccaatgtattaagaagggaagtgcagatttcctagctgcattattcagtaaattgctgaggaactgaaataatattgatctcagactgatgctcctgttgtagttttttgcttcatccctcgaatcaaagcagtgacttatgaggttgttgagccagtacctgtgaagtcttcagaagaaaaaaaagtatccaactatgcacaagttgagatgtgcatgagaaatttcaataagtggacaacccatgcacgcgacctcaataactggacaccatccctttgagtgaactttgcaatgttttaagccatgtcaacatataccaaccgtaaaatactaacactttttattctatatagtatatcagagaacaagcatggtatttttctgtacattccttttattctctctagtttttgtacacataggacatgtttcaacagaactctatagaacaaggcacaagtgaattcaatggcatcactatatacatgtggagttctgtgtattattttacaaattacaataatatagtcatccaattgccttgattaactaggtggaacttggcccttactctgtcatattcatccaccacacgcaatcaggatattttcgaaatagtgccatggttaactagatgatgttggagaccagggaccatcagatggcaactgcaaaatggaggtgcctgtgtgtctactgcttaatataattttgaaccactggctctcaggattgcaatttggatctccggttaggcacttgcacggatttgttgtgatgataccatcaggagtggcatccaggcatactctggttccatttttagtgagttcagtcgaaacatgcattcctgaatttgatattagctgccactttgaactggatttgctgcaatcggtcccaagctgtgcattctcaccgacagacttgacctggaggcattgaccagtgtgttgcagtaccaactcgtgtgttgatgtgtagttccaagcgtttgattcatcacatggacccaactcaagtgcctctgatgatttcaccacgacacaaagcccggatagaggatggaatattacgttgtaaggttcttggctgttcggtagtccagggcctggagtgtaaataagtttgcactattatctaactcaaggaaatatagtgcatattgcaatgattaaaatttaccagatttttacatggcacattacttattttgtctaatgtcttacataccatattttgtttaaatgtcttacatcggcactatccatatatcgaagtgttctcttaagagggtacatgtcatattgtcatttcatgaaagggctaaaacaatgcatgcatactggtggataatctgaaatttatatcagtgcaaaataaatttcagccaacaattaagtactgagaaggggcccaatcctatgacgaaacatgcagaagtttatgtgttgattcactaaaagaggtcaaatgctttttttttattagaacagtccagtataaagtatataatcttaccacataaaattcgaaatgtagaacattccaaaaatctatgttcccatattcctgataatgttgctagacaagaataaaactgagataggcgaagcacaaaccttgaaatggtgattgcagagaattgatccttttaataaaactgggatttctagctgtacaccaatcccatgatagcaatccatatgattcatcataagctagagtgccctctctgatatagtaactcccttgcagagcccaaatagcccagtccagatccatttcagctgccacacttaagaagcaagtgagatagcggttgtccccggtgtgtgtgccagacatatcaaacccaaactcggagaaaaacaatggccagccttgctgaagtaggaaaagtcctttattctttatgaaaccaacaaccatcccacaaacatcattttggttctgagattcccagttgccaccatctgagaaaccataccaatgctgctcaaagactaactttccagtaaatgataggtgaatttgatttgggaccacgaagttgagagtgttgtcgaattccaggcccgacaagataacaaggacgtcaggatttgctgtatgcacagattcagcaccctccttcatgtacctaaatgagaatagattgtaaatgaaattttccaataccatgggtcacacaaaaaaatccctatcaattgagataaaaacaaggcctttaggtttcagtgacaacctgtaccacaaactaacattttcataggggccccggagttcgttcctcaagctcatgcccacaacattttttgttttcctaaacattgttgccattgtcttgaggccattcaaccattcttctgggtcaaagtacttgtcaccaaagaagccattaccatcagttgtgctgcagcaccatcctggagtggtcatttggttatcaagtatgaccataatattgttcctggccaaagctgacactacttcctacagttgttcaatgttaaccatgtcagatggaataaaaaaccagagtttttatcatgtattaaaactgtttactttagtttcctttcatatttagtacatataaactctctatatactcgtgactctatgagcatctgttttcacagattactgggtcaactaactggataactcattgcaaaaagagagataactatagatacttgatttggattagataaaaagtagtacacctaatgcaaccagttgccgtctatcttaatcattagaatagatccgtagaaagaaagatctgttctagctagagtattgtggcttgcaagataccctcttggaccattaatttggtaactagtaggtaatctgtacacgttcaaattaaacttgtttggaagaaaataaaaggggaaaatgaaatctattcaagcaacaactactgttggcctttcctgaaatagaaaatatgatcagatctttcttatacacttaagccctcaacatgaaattgattgttcttattaattatgcaaaaatggatatcctaaagtttctttgggaagctttatgacaaggttgagatgatatcatctgatttcaaaatccatcatctccaaagttttgacttctaagcaactagtttttttgttaaataaaaccgcatggcctgcagttggtttagctataagtcaattggttcaatgcatactgttgcttgccacaatgtaagtctacaatcttatgcatcattgcatcgtaatgactatttcgtcagacaatataaaatttgcatggactccgacttaaatgtttaaacggacacatagctttcatcaagattgtaaatcagtctgttcatctcacacaaagttactcctacttacttttcttgcattccatcatcaaaagactagtttctagcggcaagacagtaaaaaattgaccatctttgacttgctaacagtagaaacagctagctgccaatttaatggtggtggtaagaaaaactaaggaactatttcttcagactatcattaataagatttggttaacattgccaaaatctaacgaggttagatttaaaaatgccaaaatctaagaagggtagaacactggccggatagctccaaaatctttttgccaaaccaatgcttggatattgttttggctactcgaagagaaacccttacctggaacacatcgatgaggggcaggtcaaggagtccggggttgttgacccggacgccggcgacggactcccgcatgccaaagcgctccagcgaccaccgcagcggcaggctcgccagcgtggcgttggtggcgaggtagggtcggccaggtgagcctgacgcagttgaaccccatcggcgccacgcgcgccgcgatgtcccccacgccgcggggcgacaggccctccgccgncacgggctccaggtgcgacgcccagttcgcgcacgccagctttacgcgccgcccgtncgtgcccaccacccaccgngacgccgt

SEQ ID NO: 10824 - DNA, 9074 bp, Oryza sativa
  unsure (1)..(9074): unsure at all n locations
tcgctcccgtcgagttgacggtggctctcccttcccgccttgcatacgcgctccgtctgctccgcctcgggcccctgttcgcctctctccgagcagaacgcacaacgtccttgctccgtgcgcgtgaggggggcacccacaggacacccaccacctgttcgtggaaatgctcaacaccggatgcgtttctctggctgtatgtgcgggcggacttacaccatcatcgcatattcgcatgggcttcgccaagtgcggatgcagtgacaagcaatgcagagttgatgtctgttcgcggaagtgaaggaaggagaaaatcatggtgtggcgcgaagcggggtttgttcaagatgcaagaacagtagttggtgtttgctgttaccggcacgctaacaatagttgtgttctaagatgcgccggctttatttcctttagccccgccctcgacagcctactgtcaacatcaatttgtaatttgtaacttttctctctaaatcttgatgtactccctccgtttcacaatgtaaactattttagcattttccacattcatattaatcttaatgaatctaaacatatatatctatttagattcattaatatcaatatgaatatgggaaatgctagaatgacttacattgtgaaacggaggaagtaattggttggccatgtcttcggccaacccggctaaaaaatgttttcacccatgtcaacatatgacaccaactataaaaagatatcccttttattctctgtagtatcaaagaaaaagcagggtatttatctgtacattcttttattcttaatttttgtacacatatgataggacatatttcaacaggactctagaaaacaagaaatcaatggtactactactgtacacatacggtgttctgtgtattattttacaagctgcaatactatagtcatccaattgccttgaataaccatctggaacttgacacttgctctgtcatattcgtccttgatcaaattcaaacaggatattttcgaaatagtccaagattaactagatgatgttggagaccagggaccatgagatggcaactgcaaaatggaggtgccgcctggtatgtgtttactgcttaatataattttgaaccactgactctcaggattgcaattcggatctacggttaggcacttgcactgatttgtcgtgatatttccatcaggactggcctccaagcatactctggttccgttattggtgagttcagttgaaacatgcattcctgaatttgatagtagcttccactttgaactggatttgctgcaactggtgccaagctttgcattctcaccaacagacttcgcctggaggcattgtccagtttgtttgagtattaactcgtatcctttggtataattccaagcatttgatttatcacatggacccaactcaagtgcctctgaagatttcaccaagacacaaagcccagatagaggatggaatataacattgtaaggctgttgactgtttggaagcccgggacctggaggatggaatattcattaatatgtatagctcaaggaaatacagtgcatattgttgtgaccaaacttttagtggacttttacaagttacatagcccctttgcttactttcttgcacatcggcctgtgtatccatccaagtgatttcttttcaagggacacgttattctatgatgagggctaaaccaatgtgtgcatactagttaatgctccgatttcatatatgttccaataaatctgttccaacacaacccaaaaaggtgaaaaactgaaaagcggtccaattcaaccaatgaaatatgcacaggttttttctgttggttcagcaactgaggattcattataacttcaattttaccagagagctccatttttaatgtgattatcaaaacgtagaacaacagcacagttccagaaatcttgagagttgtattactaacaacgttgctatgtaagaataaaactgagataggttaagtacaaaccttggaatggtgattgcagagcattaatccttttaataaagctggggtttctagctgtacaccaatcccaggatagcaatccataagattcatcataagctagagtaccctccctgatataataactcccttgcagagcccaaatagcccagtccagatccatttcagctgccacggttaagaagcaggtaagatagcgattgtcagcgacatgtgtcccagacatgtcaaacccaaactcggagaaaaacagtggccagccttgctgaagtaggaacagtccttttttctttatggaatcaacaaccatcccacaagcatcgttttggttctgagatccccagtttccatcatctgagaaaccataccagtgctgctcaaagactaactttccagtaaatgttagctgaatttgatttgggaccaagaaatccagagtattgtcgaagttcaggcctgacaaaataacaagaacgccagggtttgccgcatgcacaacttcagcacccagttgcatgtacctaagtttggaatagattataaacgaaaattttccaatgatacgagtcacacataaaagccttttcaatacttctataagcaaaagtaagactcagtgtgtaagtaacaaacctgaaccacaaactaacatttttggagcctcggagctcgtttcttaaactcatgcccacaacattttttgtgttcctaaacattgttgccattgcactaaggcctttcaaccattcttctgggccaaagtacttgtcaccaaaaaagccattaccgtcgttttcgctgcagcaccatcctggagttgtcatttggttatcaagtataaccattatattgttcttggccaaagctgacaccacttcctatggttattaatttaacagaaggagtaaataatcagaattcaacacttgatagcaaaaatctcgtttactttatttcatttaatgtttagtacgggtaaactctcccagaatatactcctgagtatgtgaacacatgttttggtagattactaggtcaactaactagatacatcattgtaaaatgagagataactaatacatccctggtttggatttttttttttaaaaaaaggaagcagaccacctaatgaccccagttgccatctatcgtcagaacatattttacaaagaaagaatttatctagctagagactttcaaggcacccttatcttggaccatcaatttggtgactattaggaataatgtcatcttcacataaactggtttggaagagaaacaaaaggaaaaagggaaagctactcaaacaattaccattggtttttcctgaaatagaaaaggacgatcagattgttgattatgcttaaaccttcaacttgaaattgattgttcttattaaataagcaaaaaaaaaagaggataccctaggtttctttggcaagtcttgtgaaaagattgtgacgagatcatctgatttcaaaatcaataatctgcaaaattttgacttcttagcaagttgtttttgttaaattaaaccacatgacctgcagttggtttagctataagtcaattgattcattgcatactgttgcttccacaattaagccttatgcatcataatagctatttcttcagaaaaatgtaaaatttacatggactctgacttaaatgtttaaatgagcccatagctttcaacaacaaaaaatgtaaatgttcttctaggtacaacgttatctactccctccgtccacaaatataagcatttctagtgtttaaatttagtccacgaatattttctataaacatttctagagtatatttccacattccaagttttcaaccatccctcatagttatattccccatcccggtgaatcggatggtggcatggggattcaaccagggtacatgaaagtggtttcaccttaacctttacttaatttctcctacaactcttggacggagggagtattttcttgcactctatcagcgaaaatactgcttcctccgtttcatattataagactttctagcattgtccacattcatatatatgttaatgaatatagacatatacgtgtgcttagattcattaatatctatataaatgtgggtaatgctagaaagtcttataatctgaaacggaggtagtagcatctagcggtaagacacggtaaaatttggcgccatctcgaagactcgaactcgctaacaatagaaacagcttccatttcccatggtggttgttaaaaaaaaaacagccatttcttagaactgccattaataataagtttacttaacaacttggagaaaccaacgttgtcatttactccgtgtttgcttattcgaagagacgctcacctggaacacatcgatgaggggcaggtcgaggagtccggggttgttgacccggacgccggccacggactccggcataccaaggcgttccagcgacgctctcagcggcaggttcgccagcgtggcgttggtggcgaggtaggtcggccaggtgagcctgacgcagtttaaccccatcgccgccacgcgcgccgcgatgtccccaaggccgcggcgcgacaggccctccgccgccacgggctccaggtgcgacgcccagttcgcgcacgccagcttcacgcgccgcccgtccgcgcccaccacccaccgcgacgccgtcgagagcggcagcggcgggagcgacgcggtggcggtggcggcggcgagcgggagcagcagtagcagcaggagaagtggagaggaagaagccatggtaacaagtgtggccaacggtggcggatctgaggggggtttaaaaggaagagatgtgcctatgacagatggggccggggaaatggtgggtcccagctgcagtgtcacgtgcggtcttccgctctgataattagcgaaacgtgacagccgcggctcgtgcggttaagcggttggggcccaaagcccaactgcccaagcggactccaatggcgggcgccgccgacttcccagcggcggcggctctccccgcccccccaccgcgctggcgacggcgccggagttgtgcattcctcgcggcgtggttctctgcaacgtgcgagcgtcacgctggggtgccctcctcaagtcgggcgcgctcgccacctcgcccgaatccgtcgatgctctcctcgagctgacgccaccgcactcccggcccatggcaccttcaccgcccacgcgctccgcctgttcctcctctgcccctgctcgcctctctccgcacggttgtacagcatccctccctcgtcggcgctggtcactcggagccggaggacgccctccacctgttcgtggaaatgctcgacgccactggccccattctgcaccagcacagcacactgtcgcttgcacctctcgagcccacctcgaggatgtgcgctctggatttaggcgcggcgtccaggcttacaccaccatcaagcatgggctcatgtttgatcgtttgctggctgtggggatgtcacggcatcacttggtgcagttcgacgccatggaggacaacggtgcggtcacgtgaaatacaatggttgcggggacacttcaagaatgcaatggcggacgtatggtgatcttgagttttcttgacaaggcgccgaggttgttcgatggaatacaggtatgcagtggtgtgatgtggttgcatttgctctgtttggattgcaatgatctctggatacacagttacgcacatacgggcctatgtctggaggcacttactcttttcattgagatgcagactaccgtgctgttgctgaacccaaatgaggctactgtaagtcagtagtacataaggaggaagggtcttcctcttaccattgttcttggacttggcagtgcactggtggacttatatgcgaagtgtggatgcagtgacaatgcagataagcattcaaagttggtggctgcctgtgaggaactcagaggaacaccggggctcttctcatccatgtgtgaggccaatgttaaagcccacggacgtggcattcactggtgttctcctgtcttgcagttcacagctgcttagatgagtaggatcgcaggcattttgttagcaatgacccgggattatggcgccagccaaggatcgagcactatggctgtatggttgatctgttagtgcgggctggactgatcgatgaggcatatcagtttatcaaaaccatgcggtagagccaaatgcagtaatttggagtgcactagtttctgcctgcacagtgcacacaaatgttgatagtaacatgcaagatgcactgaggcatccactggacccaattagtcaatcacactggactgatccaggatgcattcccattgagttggagggtgcattctctttgagttcttcgctgaagacagtgaccatcccacccccacccccagctgatgacggagatatatgcgaaagctgaggagatgattgtaagtatcattatggccaggtacagatgatgtaaggctcgactttgatcaaaatgagaaggaagcctccgttacacatcacagcaagaagttgaccattgccttcagcctgatgaaactgcgtctcggtgcaacaattcagttatccaagaatctgagagtgtgcttggactgccactctaccacaaaggtgtacaacagggagattgttgtgcgtggcaagaatagatttcaatcacttcaaagatggttcttgctcctgcaatgagccaatgattactgatgagttgctatactaattctctctgctgagctttcttttatataggagtatataagaggcgcacctgatgtcctgatttattcattggagcagagagtaaatagtactccaaaatatcgaatatcgtttactgttggagtagtacatgtaacaacaattatcgtttactgttggaaggaaaacctgctaacctgctagtataaggggagaaaaagacttggaaggtactgtaacatcaagccatcaattggtgtgaatcgtgtgcagaccacatgctactgtgttacgcatgaattcaaatgagaaatcaacctctcaaattcgtgcttagcttttacggaaggaatacagtttgcattttgaatcttgaatactccagtcatcccattacctttcttaccaattacaacctccgattcttaatatatgattgagttgactttttaaatttgtttactatccatgttttttctaggaatatttgtgcaaatagattaaacatactagacatgtgtaaagtgttttgatgacgaatgtactggtatttttttcgctctaattaaataactaattgaataaatattgttggttttagttcaaggaaaaaaaaaactatcggtgtcatttattaaaaaacagacgtagagtactttacagcaacccttttttctgttttagtttatggagtataaatgaagtaacactatcaaaagtcaaagctgtcagcatttcgttttcttttcatttttgtattatcttttccatgtcatcgaaagattaaacctgctacgtttacatcgacaaagaaatgaagatttcatgttgctctgatcctaaacaaaagtagttagcacttggcagtcactagcgagtaggtgggtctgtgcctagacccacctgtcagtaactcaatgtcaccgagaatgtcacgtgggaatgtcaccgaatcccaatctagaagggtggttgaggggtactaaaaaagaaagaaatttgaatgtgtgtgattgatgggataaatagtacttgaatggtagaaagacaactaatttggaacggagggagtacatcattcgtgcattaactaattaaaacgataatgcttataaactcttatcggttgagccacagctaaagaggcagcggaaatatgaacaaaataatcaaagaaaatttatgaagaaaacttctattattggctgtttacaacttccctctcttaatacgaaacgtacgcaagtattttgggtattaaaaaaatatattggctgtttaaaagccaagttgaaaaattggttatgattaagaaaaaaaccccaaatgtaaattaaaactatatttcaaaaattaatatttaactgcagcaaataagcaaacaaagagacaatggccgtgtttagttcgtgtgacaaaatttttttaagtatacagacacacatttaaagtattaaatatagattaataacaaaacaaattacagattccgcctataaactacgagacaaatttattaagcctaattaatccgtcattagcaaatgtttactgtagcatcacattgtcaaatcatagcgtaattagtctcaaaagattcgtctcgcaatttacatgtaaactgtgcaattggttttttcctctacatttaatactctatacatgtatttaaatatttgatgtgacaaaaatttaggaggtttgaagggaactaaacaccgccaataattctgaatttatgatagaacagtacaagtcaaataagatatctcctcctgacatgacatatgtatagatagatgaacttagccgccctagagacaagctagagaacagcaaagacagcaatgtccatggcgtctctccaagctcctgagttccttgcgtcctgcctcctcctcgccaccattctcttcttcaagcagcttctcgcgccgtcgtccaagcagcgcgccgcctcgccgtcgctaccacgcccgagaggcctccctctcatcggcaacctccaccaggtcggcgcgctcccgcaccgctccctcgccgcgctcgccgccaggcatgcggcgccgctcatgctgctccgcctcggctccgtgccgacgctcgtcgtctccaccgccgacgcggcgcgggcgctgttccgggacaacgaccgcgcgctgtcggggcgcccggcgctgtacgcggccaccaggctctcctacggccagaagagcatcttcttcgcgcccgacggcgcgtactggcgcgccgcgcgccgcgcgtgcatgtcngaagctccttcggccgccgcgggtgcgcgggctccgcgacgccccggagcgcgaggcggccgcgctcgtcgcggc

SEQ ID NO: 10825 - DNA, 2500 bp, Oryza sativa
tcaacaagcgcaagcatgcatccgacgaagaagacgacttggtcgacgtgctcctccgcctccacggcgatccggctcaccggagcacgttcggcagccgcagccacatcaaaggcattctcacggtacatattacgtacatgaacaagaagagcatagcacgctgtgatatacgttttcctggacatgttttggaagacgcatatgcgcgcaccacactcacaccccacacgaatacgtctcccaacacatacactaagagatagaaattagcggcacatttcttatctcactaaatttcggtcggtcgaaagctctgtgtgcgtgtaaaatttgagcatcagaatttaaactttagtggatagactggagtcatgtactcacgactcaaccaccacaccgctggtgcttccccgttttcctggacattttgatcgatcgaaaccgaaatgtgtggtcttgcaggacatgttcatcgccgggagcgacacgtcggcggtgacggtgcagtgggcgatgacggagctcgtcaggaacccggacgtgctcgccaaggcgcagcacgaggtgcgccgcgtcgtcgccgccggcgacaaggtgcgggaagccgacctcccggagctccactaccttcgcctggtcatcaaggagacactgcggctccacccggcggcgccgctgctggttccacgggagacgacgcaaccgttccgcacggcgcacggcgtcgagataccggccaggacgcgcgtcgtcgtcaacgcgatggcgatacacacggaccccggcgtctggggcccgaacgcggaacggttcgtgcccgagcgccaccgcgacgacgccgacggctgcgcgcagcagcacgacgggttcgcgctggtcccgttcgggatcggccgaagaagatgccccggcgtgcacttcgcggcggcggcggtggagctgctgctggccaacctcctattatgcttcgactggcgcgcgccgccggggcgcgaggtgaacgtgaagaagaagaacgggctggcgggtgcacaagaagaaccctctcgtgctcatcgccaccaagagcaagaggaacacaggtggccattgacgacgcagacatgtaaccttgctggtagggtaattttatcagaaggtacatacaacatgtgtaaaaggtacatacaacatgtgcaaaaggtattattatcttgagatactttctcaagggttataaaattttcttgatagtattataaggatatgttcactttgttaccgcattctaacaaactaaacaaattattgcattgctgttctaccaaaatttagcatttcaaaagtttcttcttatataaacactaccaaattttgatagggctacaaactaaatgcaactaatgctatgaaaatttgacaacattaaaatgtgccaaaatttggtaacgctaaatatcggttaggttgatttcagcaaaaactgaagaagctctaagcactaaatcatcagtaagaaagtttattaatgctgctcccatcaagacggagctcagacgtatccgtactgagataccacaagttcacataaggcagaagccacggactctggattctggaacggtctcggtcgttccggatcggatgggtacgtatgtcgccctcagaaagatgatgacactgactgttgcatttgccaagagccaatgggttgcgtttgcgtccccaaactttcacaaaaacggcagtcctcatccatccctagagtttaattcttttttgggactgagggtgtagccttcctggtgagaaatgaaagtactactggtacaagcaactagaacggggagcatatggaagccgtcgtgaagttgccccggttcctactagctctctctctctctctctctcctgtttccggtgcaggattgggtaaagacagtacaggaagcggcggcgagcgtcgtgcgcacgggtcgccttcaaggtacagataaacggatggtcgtcccggtcgccgatcgccattggttttcccgtcgcgatcaggtaggaaacgcaggcgcaaccggcccgtacccgtatctggatggcttgggtcagtgctggtgttggaccgccagaggccaacatcaacgtgcagaatacggccggagtttgtggaggattgcgagacgcgtgtgcacgcacgatcgacgcgcgggttcggcaaaggaataagttcactttaagtccctctattcgtcgcccagtccgattttcatccctaaactccaaaaccggatactacccgtctccaaacttacaaaaaccggcacatagcggttttggctgacgtggtgtctacgtggctaagttaactaggtctccatgctacgtggcactgatgtggcgcttaagtgacaactcgatttgagaaaaaaacaatacccgtgggacccataggtcagttacataaaaacaataattaataaaggtgggccatgtgggccccacatgtcaatctcactgccctctt

SEQ ID NO: 10826 - DNA, 23017 bp, Oryza sativa
agcccttgcgtgcgacggcagcggagaagtcggtcccttcctcaagggggacgcgggccagcacggccgtgggcagcggcgactgctgctggtgacggcgtcgtcgtcgtcactacgtctttatatttatatttatatacatgtgggacccaccttgaataacaattacctgcttgctgcttttggttggtccaaccttacttacttactacttggtaaggatacattgttgatgccctaagatatctcctcctgacatgacatatatatagatagataaactcagccgccctagagacaagctagagaacaaccaagacagcaatgtccatggcgtctctccaagctcctgagttccttgcgtcatgcctcctcctcctcgccaccattctcctcttcaagcagcttctcgcgccgtcgtccaagaagcgcgccgcctcaccgtcgctgccacgcccgaagggcctccctctcatcggcaacctccaccaggtcggcgcgctcccgcaccgctccctcgccgcgctcgccgccaggcatgcggcgccgctcatgctgctccgcctcggctccgtgccgacgctcgtcgtctccaccgccgacgcggcgcgggcgctgttccgggacaacgaccgcgcgctgtcggggcgcccggcgctgtacgcggccaccaggctctcctacggccagaagaacatctccttcgcgcccgacggcgcgtactggcgcgccgcgcgccgcgcgtgcatgtcggcgctcctcggggcgccgcgggtgtgcgagctccgcgacgccagggagcgtgaggccgccgcgctcatcgcggccgtggcggccgccggcgcctcccccgtcaacctgagcgacatggtcgctgccaccagcagcaggatcgtgcggcgcgtcgccttcggcgacggcgacggcgacgagagcatggacgtcaaggctgtcctcgacgagacccagtctcttcttggtggtctctgggtcgccgactacgtgccgtggctccggtgggtggacaccctcagcggcaagaggtggcggctggagcggcggttccgccagctcgacgcattctacgagcgcgtcatcgacgaccacatcaacaagcgcaagcatgcatccgacgaggaagacgacttggtcgacgtgctcctccgcctccacggcgatccggctcaccggagcatgttcggcagccgcacccacatcaaaggcattctcacggtacgtgtacatattacgtacctggacaagagcatagcacgctgtgatatacgttttcctggacatagggaagacgcgatatgcgcgcgcgcaccactttcacaccgcgcggatatgtctcctaactcgtagacggaaactagctacacatttcacatctcattaaatttttatcgaaacctatggtgtctatagcattaactacattaccatgtaaaacttgttgcttatgtgacactatattaattaagagagagagtgaagagaggaagaaactgggtctcatgcaagacacagcttcaacacgagaatctatgcaatagacactatcaagttttgcattgggagagaatagtgtcttcataatagatgaagagtaaatatgattagtagagaagaaagatgatgtatttattaatgtcccactttaaaaaaccatgggttgtagagtatagtttctattgtgatgtcttattgacatgacatcatagacactacttatagacactatgggttgggactgccctattctctcgggtggacgtccacccgtttcttgcatgccgcctaaataattatgaaaaaattcgaaaaaaaattataagataggttaacatgtaatatatcatctcacaaacatgtaagttcaaattcgactactacgagttgtaacaaaaacaacaaattaaactctaactagtatacgtatattcacagttaaatttgttatttttattataatttgtagacgccaaatttgaacttgcatatttatgagatgatatattacatattaacctatcatgtcatttcttttgaaaatttttcataaccatttaaatgccatacaagaaacgggtggacgtctacccgagtgtttaaaacaatttcccctctacgtctgtgtaaaattcgtgtgagcattaggatttgaacttgagtggatgaactggagtcatgcacccaggactccaacaccacgccgctggtgcttcccagttttcctggacatgttgatcgatcgaaaccgaattgtgtggtcttgcaggatatgttcattgccgggagcgacacgtcggcggtgacggtgcagtgggcgatgacggagctcgtcaggaacccggacgtgctcgccaaggcgcagcacgaggtgcgccgcgtcatcgccggcggcggcggcggcgacaaggacggcgccatggtgcgggaagccgacctcccggagctccactacctgcggctggtcatcaaggagacactccggctccacccggcgtcgccgctggtgcaacgggagacgacggagccgttccgcacggcgcacggcgtcgagataccggccaggacgcgcgtcgtcatcaacgcgatggcgatacacacggaccccggcgtctggggccctaacgcggagcggttcttgcccgagcgccaccgcgcccacgacgccgacggcgagcagcagcacgagcacgacgggttcgcgctggtgccgttcgggatcgggcggaggagctgccccggcgtgcacttcgcggcggcggcggcggagctgctgctggccaaccttctcttctgcttcgactggcgcgcgctgccggggcgcgaggtggacgtggaggaggagaacgggctggcggtgcgcaagaagaaccctctcgtgctcatcgccaccaagagcaagagtaacagagatgctcattgacgatgcaggcatgtaacttacggagtatcattactatggagtatatatctagttatcaaaagtgatactgtaaaaatttaagctcggtgggttcccgaatttcctacttccagctcagataaacgcagtagctgtgtagccgtcctggtgagaaatgacagtactactggtagtacattacagagagggccagctagaacggggagcatatggaagccgtcgtgaagttaatccggttcctactagctctctctctctctctctctctctctctctctcctgtttccggtgcaggattgggtaaagacagtacaggaagcggcggcgagcgtcgtgcgcacgggtcaccttcaaggtacagataaacggatggtcgtcccggtcgccgatcgccattggttttcccgtatggccgtatctggatggcttggggcagcgctgttgttggaccgccagaggccaacatcaacgtgcagaatacggccggagtttgtggaggatgcatgcgagacgcgtgcacgaacgatcgacgcgcgggttcggcaaagcggtggcagcgtgtggaactagccggccgcccccgcctgagtaccgttccattggcaacggcaacaaatatactactacgtacggagtaaacttggacaaaccgggtcacggaagcctcgcgtcacgggccatcgcgatcgagatcagacaacgcaggccggccacggggcgcgaatgcatgggtcgccctcaaaataatcgaatggttaattggttcggttgataattgccatgggttgcacgggaatgtatcctatacacataagtcttttacgtgtatacaattatcatagaaaattttaaaaaaatgttttacgtatattcttaataggaccttgatgatgaattggaggagttgtaatagcatgtcctggttgaacgtcaccgtgggtgcgagcgctgttggcaccacctgctgctgctgcggcggcatggaagctacctccacgtaaaggtctgcagaggcaaaggtctccatcatggcggtattgtcgtccgtccacatattcatcaattcaatcactatctttattctttttttgtttttttccttggaggagtaggaaaaaaaatgagtacgtgcgtctttggtggtgagagaagtgcatgaattggtaatgtgaaggtgaaagaggatgaggattagaggcattgtatcttgtcagggcgtcttgtaccagtgcggactgtgcgactaaacagggccccaaatcttaagggcccctattaagtatacccaatatataataactagcatggtggcccgtgcagattgcgcggctagcatcattatattttcttttatataatagcatatatgttttctcattatattattcaaaaatattaaaattacatcataattttaaattttgcaatagctttacgaaaatacaaatatgtaatattcatattgtattttatatacgtgtcagttattaattatatttaattccgaattttctgtaaattgtatttctatatagactctatgctcttcttccaatattatttatttttatttctgaatttttattatttctggttgtatttctataaggactctaaactcatcttttaatattctttaatttttaatttcaaattttagttacttctaaattgtatttctatattgactttaaactcttcttcccatgtttttcttaatttcgaattttagttatttataaattgtatttttatacggactctaaactctacttttaattttattacgtttattccaaattttagttagttttaaattcctattatttcctaattgtatttctatatggattctatactctacttcgaatatttcttatttttaattctgaatttctattatttcataattgcatttctatatagactctatactctacttctaatattccttatttttaattccgaatttctatttttttttcttaattgtatttctatatggactctacactctacttctaatattccttatttttaattccaaatttctattatttcctaattgtatttctatatggactctatactctacttctaattttccttatctttaatttcgaatttcagttattttctaattgtatttctatatatactccatactttacttctaatattccttatttttaattctgaatttcagttattttctaattgtatttctatatggactctagtctcctcttctaatattccttattttttaattctgaattttagttatttcctaattgtatttctatatgtactatatactctacttttaatattccttatttttaattccgaatttcagttatatcctaattgtatttctatatggactctatactctacttctaatattccttatttttaattccgaatttcaactatttctaaattgtatttctatatggactctgttttttctttttctccgattaatgtgagaatttctaggccatgagagcgaacgtggaggctcctttttctattcctttaataatataatagatattagaggctttaattttgttaatttgcagcctaaatagtagtaaaactaaggcccaaaataatgcagaaggtaaacgatccatcttccaatttccattgtacagccatccgcgtctccgaagtctcctctcctcagtcccctccagcctccgcgctgcttcacatgccagtttgttgggctgtaaatacaacagtatgtgtgtgttttatgtgctggcccatctgctagagggcccatctagtcatgtatatgtaaataaggatagcaatacagagaaggtgaagcttccagagaaaattggctgccaaaaaaacttcatggtatcagagccgaccgtccggcggcaggcgacggctaaaccctacctggccgtaggcgtggaggcttgagcagggtagagagtgcgcatcagcagcggcgcggaagagcggggctagcgcggcgcgtcgagaggaagaacccgagcagctgcaggtgcggagctgctgctgctgcttggggctgagctcgcaggtgcagagctgctttgggctgaggcaagaaagaaagtgctggtaaacagctggtgttggtgctcctcaggaagaagtggctcttgctctgtagtggcggggtcacagcacagtgaagactttgcatctcttgtgggtgtgtgattggcaaggaaaccgaggtaaaagcacagctactgcttttgtgatattgactatttgagcaatctataggaagggaaaggtagaacagggggctcagatctgctagttgggtttctactggtttgcagtttcagaatttgcattatggcagaaaatcaaggaatagaacaagtgatgggtaaattggtggacatgctagcgaaaaaatttagtgaggcctcaactacaagcaatgcaattatccctcatactgaatcaatactgaagattgagttaatgcaaaacgaaatcaagttgggtgtcaaaaattatttgagttggtcaaggagggcattactaatactaaaaacaaaggggttagaaggatatgtcacaggagaagtgaaggagcctgagaacacatcaagtgtagaatggaagacttggagcactaccaactctttagtggtggcatggttgttgacttcattaatcccagctattgctacaactgttgagactatctctagtgcgagtgagatgtggaaaactcttactaaactatactcaggagaaggtaatgtgatgctaatggtggaggcacaagagaagataagtgctttgagacagggggagcgctctgtggcagaatatgtcgcagagttgaagagtttgtggtccgatttagatcattatgatcctcttggattagagcactctgattgcatagcaaaaatgaagaaatgggttgagcgtagaagggttattgagttcttgaagggtctaaatccagagttcgaaggaagaagagatgcaatgtttcaccaaaccactcttcctaccttagatgaggccattgcagctatggcacaggaggagcttaagaagaaagtattgcctagtgccgcaccatgttcaccaagtcccacctatgcaattgtacaaggtaaagagactagagagtgcttcaattgtggtgaaatgggacaccttatgcgtgattgtcatgctccacgcaagcctacttatgggagaggaagaggtgttgatagaggtggaacaagaggtggaagaggctatgctggtaggagcaatagaggaagaggttatggatatagaggtgattacaaggctaatgcagttactctagaagagggttcttccgggactacacctgacaatgttgccaactttgctcattctactccaggtagttttaatcaagcatttatgtctatgaacacttctcattcaagttggatattagactcaggtgcatccaggcatgtcactggcatgagtggagaatttacatcatataaaccatattcatttgcacacaaagagaccattcaaactgctgatggcacatcatgtcaggttaagggggagggcatagtgcaatgtactccatccattactttgtcatcagtgttatatgtcccttcttttccagtgaatttaatttcaataagttctcttgttgataatatggattgtcgggttttccttgatcgtgagaattgtttaattcaggagagaagaacagggaagaaacttgggattggtatcatgcgtgatggactttggtacttggacagaagagggacaaatgaggatgtgtgtgcactaatggcttcaacaagtaaagaagtgactgaggtattacttttgcattgtcgactaggacatatatcttttgaaattatgagtaaaatgttcccggtagagtttagtaaagtggataaacatatgctgatatgtgatgcatgtgagtatgggaagcatactagaacatcatatgtgagtagaggacttcgcagtattttgccctttatgctaatccactcagatgtgtggacgtcgcctgtggtttctatgagtggaatgaaatattttgtcacctttattgattgctattcccgcatgacatggttatatctcatgagacataaggatgaagtgcttaaatgcttccaaaacttttatgcatatattaaaaatcattttaatgctcgggttcaatttattagaactgataatggaggggagtatatgaatagtgaattcggtcactttctttctttggaaggaatattacatcagacttcttgtcctgatactcctccacagaatggagtggctgaaagaaaaaatcgccatcttttggagatagctcggtcactaatgtatactatgaatgtacctaaatttctatggagtgaggcagtaatgacggcagcttatctcatcaaccgcacaccatcaagaatacttggaatgaagacaccatatgagatgatatttgggaagaatgaatttgtggttccaccgagggtgtttggctgcacttgttttgttagagatcatagaccatctattgggaaacttgatcctcgagctgttaaatgcatctttataggctattcatccagccagaaggggtataagtgttggagtccatcagaacggcggacatttgtaagtatggatgttacgtttagggaatctgtccattctatggtgagaaaacagatataagctctttatttgttgatcttgatgatttaactagaggtgaccatgatcaacaaaaggaaggtgaaatcttgggtctcaaggagaatgaacaatcaaagggaaagattgtggttggtgaaattccatgtgctataggtgatcctgtacaagaacaagaatggagaaagccacatgaagaggaaaatcttcaagtttacacaaggagaatgagacttccaacaactcaacaagttgaagttgatgatcaagtatcagatgatcttactcatgtgcaagtgtcttcggagtcagggggagaacaaatagaaattagagaagaagaatcaaacttgccaattgccataagaaaggggatgagaagcaatgcaggcaaacctccacaaagatatggttttgaaattggagatgaaagtggtgatgagaatgatatagccaattatgtatcttacacttccttgtcatcgacatacaaggcctttgtggcatctctaaattcagctataattcctaaggattggaaagaggcaaagcaagacccaaggtggcatcaagcaatgctagatgaactagaagctcttgagaagaacaaaacatgggatcttgtatcctatcccaatggaaagaaagtggtaaactgtaagtgggtatatgcagtgaaacaaaatccggatggaaaagtggagaggtacaaagcaagacttgtggctaagggatatagccagacatatggaattgattatgatgaaacgtttgcaccggttgcaaaaatgagtacggtaagaactataatatcttgtgcagttaactttgattggccattacatcaattggatgtcaagaatgcttttctacatggcgatcttcaagaggaggtatatatggaaattccacctggatttgctactttgcaaactaaaggtaaagtattgagactgaagaaatccttatatggtctcaaacagtcgccaagagcatggtttgatcgatttaggcgtgcaatgtgtgctatgggctataaacaatgtaatggagatcacacagttttctatcatcatagtggagatcatataaccattcttgctgtttatgttgatgatatgattatcactggaaatgattgctcggagataactaggctgaaacaaaatctaagcaaagaatttgaagttaaggacctaggccagttgaaatattttctgggtattgaaattgcaagatctcctagagggatagttctttcacagcggaaatatgcattggacttgctcagtgacacaggtatgcttggatgtcgcccagcctctacaccagttgatcaaaatcataagttatgtgcagagtctggaaatccagtgaataaggaaagataccaaaggctggttgggagactgatatatttatgtcatacacgacctgacataacttatgctgtcagtatggtgagtcgatatatgcatgatccaaggagtgggcatatggatgctgtctataggatcttgagatatttgaaaggaagcccaggtaaaggcctatggtttaagaaaaatggacacttggaggttgaaggctattgtgatgcagattgggcaagttgtcctgatgatagaagatcaacttcaggctattgtgtgtttgttggtggcaatctagtatcttggaggagcaagaagcaaccggtggtgtctcgctcaaccgctgaggcagaatatcgggcaatgtcagtgagtttgagtgagttgttatggctaaggaatcttctttctgagttgatgttgccggtggatactccaatgaaattgtggtgtgacaacaagtcagcaatcagcattgctaacaacccagttcaacatgatcgaacaaagcatgtggagttggatcgtttctttatcaaggaaaaactggatgagggagttttggaattagaatttgtaatgtctggtggacaagttgctgattgtttcacaaagggtttaggtgttaaagagtgtaatagttcatgtgacaagatgggtatgatagatatctatcacccatcttgagggggagtgttgggctgtaaatacaacagtatgtgtgtgttttatgtgctggcccatctgctagagggcccatctagtcatgtatatgtaaataaggatagcaatacagagaaggtgaagcttccagagaaaattggctgccaaaaaaacttcacagttcaccaggacaccaccgagcaggggcactagggctactagggccccattttaacatttcgcacgaggactaatttggccgggatgcccctgatcttgtaggtgctaagcttgttatttgggtatcgatcttgcaccgatcggcataaggcttggtgccaccgagtatctctgagattggtaccgacaagtataggtcgttaccgatggggttatatgcatgccaaataaattgtacaaggtttcatgaactttaacttagtgatagagaataaaacactgtactcctatctctttttttttaaaaaaaaaactgacattgcagctattcatcctcaagttttgacctctcggtctttcttgaaaaattagaaatacttaaatatgtggatgccatgttatcaaattgtattgcatcaaccataaaattagaacttttattcatggtagtctaactatttagagtaactcagttaaaacggaagtgtagcaagtttatctcgacagttctttaaaaatatagaaagaataggcttatatgtacattacttatcatgggtgtatactaaaaggtaaggcatgtcatattgttgtttccctctatttattattgaccaccaagcttcatttttcactttccgcggaacacttggaacaagaaggccattgcaaatcccaaaccgaaccctgatccaacggaaatatacagtacaatggtctctgtccgggcctcccagctctcactgtgctccaacgaagggggccctgcattcgaaccattgcaccgaatagacagcggtttgccgcatagggcggcattcccttcaaatgagctacttccaaacgtctgaaattgacctccctgcggaatagcaccctccaaacgattgtaggacaagttcaaccagccgacagaagttaaagacaccaacacctctgggatctccccactaagctggttcaaagagagatcgagcgattcaagctgcgccaatccactgagctgagaagggattgttccggtgaaggcattatgcgacaggttgagacctcttagcgaggtgagccttccaatggattcaggaatgttgccggtgaacgcgttgtcggagaagtcgatcatcgtgaaggcgatcaggaccctgatgaatgtcgtggccgcgcccttgtacgtgaccacgactgtgtcacggtagaatttccccgagaggttgttctccagggcctttcgcacgtcaccctctcttgtaaccatcattgctttgaggctatcgaaccattgcggctgcaaactgccagagaagttgtttgaggcaagatcgatgatctgcaaactagagaattgtgttctgtttcgatcaccgttgtcgacaggaattccccccactgcgccgaagaatttgttggatcgtagaacaagaaccctaagctttggtagctcccctgtccagcttgggaaggagtccacgaaattgttgttgcccacatcaaggatttctaggtcattgcagttagtgagtgatctaggtagcttcccccccaattgatttccattcaggtctattgtctgagaaacacatcctcctttggtgtcatcaggcaaggtcccctcaaatttgttttgtctcagcttcaatatggtcagatgtccatctagtagacaaggtggaacacgaccactgaaatggttgtaagacaggtcaaggaatttgaggtcacttgcattgcaaatgataggtgggatgcccccctgcagtgaattgttggccaagttcagaaagaaagaactgctcaaccttgacatcaagttctccgggattgatgagaataggttgttggagtaatccaagaactgtggagatgaggggacaggtagaggcccttgaagatagttgaaactaagatcaagatagtatacgctggcattagccagagggagctccatgttagtaaatctattgcgcgaaagattgaacttgaagacatctatgttctcgttctgatttgcccatatccaatcgggtataggcccatcaagttggttgcacgagagatcaaggtcattcaccacaactgaccttagtatggcagggatcttggtcatgttgcagcatgctaaccccagggagttaagttgaaggagtgatgcagaggaagagctgttgtagatgtgttcatcatcagctatcactgtcagtctgtttgctgacaggcataggttacttagatttgtgagtctccaaatgtaactaagttgtacttccccactcaagccgttcctagagagatctagtgtctgtaagcccatgagctgaaagaaagacctgggtattgatccattcaactggttgtaattcaggtaaacagatgttagggacggagaaggattgtcgaattcttggaggggacctgctagattgtttgacatgagcgatatgaactccaatcgtggaagtgagaataagaaggctggaactggccctgacagggagttacaacatagctgcaatatctctaggttcaggaatgcccctttcctgttgatggaggttattggccctgcaaataacataacccaaaaactatctaaaaaggagttccaagatagcagttttgtgtgctttgtgtacgacaagaaagttgaaactgacctgtgagattgttctgtgagagatccaactctctcaagcgtgtgagattcccaacggacgacggtatctcgccggagatggcacactcactcagccgaagcgtggacagtgaccgcatcctgccgatggaagcaggcaattccccgagttggaacccgctgctgctcaggtccaagaagctcaaggatgtaagctcactgatcgaatcaggaagagcaccagagaagcggccgttgctgccactgatgtccagcatcttcagacgcttcaggtttccgatggagcccggaatttggccggaaaaattggtctcgctcaggtccagcacctccagggaggcttccccggcggccgggaactccggcaagctgccggagaggttggtgttcgacgacacgtctagcaccctgagcctctccaggtggaacactccttgaggaaacgagccgttgaagccattgttggagaggttgagaatcgccagtgagctgagctcggcgaagaagccggggatctcacccgacaaggcgaagggctcgccggacgcgtcggagaagccctggttgtatgacaggtcgatgacggcgagggacccgaggcgcgagaaggaggagcgtatggcgccggagagcttgcaggactgcaaggtgaggagctggagcttgggggcggattccgcgagcacgtcgcaccagtctccggccgccgccgccgccgccgccgacatgtccaccccgtccagccggagctccctcagcttcgtcaggttggccattacagctctgaagctcggttgcttgaaggagagtggcatggaggagaggtcgagggacacgagctccctcaggctgccgacgccgatgggtatctggccggcgaagccggcgttggagaggttgaggtgggtgagctcggcgagcccctcgagcccggacgccgggagccccgcgccgccgaagtcgttccccgcgaggctgagccgccggagcgacgtgagctggaagagggcggcgccgtccaggccgccggggctatgtaccccgtggccaccgaggtcgagcgcggtgacgacgacgccggaggccgcgtcgcacgacacgccctcccagaggcagcagtccgtggcggcgcgccacgacggcaggaggagcggctggtggtggtggtggaaggatcgtttgagccggagcagcgcggcggcctgttgcgccgggcaccgcgaggtggccgcggccgtagcttgtacgaggaggaggaggatgatgatgaagccatagacgtggttacggctcgtatgtaatctctccatgtagaagaagaaaggtgtgcgtgcgagtgccaggctgcaagctggtgtctggtgatggcggaagccggcaatggcgtgttcatgcaatccctacatgtcaattgtttgttttatcaattgtggattgcatgaacacgtcaattgataaaataaacaaattaaactgtagcaacctcaattgaattcaccccaaaactagactcccgaatactagactcgccggagaccgcaaccgcgaggctgggtgtttcgtgctcctaccttgcactactgttcatgtgtttccagcttaccttgtaccgagtcaagtcaaccaacatagacgatcactaaatgattggccaatcgggggctatttggttatggcaggagacttggaatttggaaaccatagaggccgatataggccgaaatgacaggaaagtgaatggtttgacaggtaaaaacaggtatcacgacgtgcacggcagggcgtgtgtgagcggggctcaaggtcaatttggaacacaagttttacatgaaatttgcatgattttcagatgaattctatggagttctaaattatcctctcattaatttgatttctggtaatctaaactaatcctcggtgcacaaaacccttgcaaaactcaatatggtatgaaaaagaaaaatatgagattatatccccttttttttcgaccaaagatataaagccaacaccataatgagattctatcctggttaacacattactaatagataattaatcattgcccactttttgtaagccaaatggcaattcagtgcgacatggtctggtctgctaacataaacctataagctgaaaatggaccctcgcaacatcatctgaacttcacaatgtgcagggttactattcctcgtccagtcaatcgacttgtcacagcctgctaatgggcagaaatccaatccaaatccaacccaccccatctccattatacacagttcaccaaaccagttcagtctacttcatcacatctaaaatccaaaccaatccaacccgcgcaagatgtaggaccaaaccaacccaatccattattgtcaaatggtctcaacccatttccaatccatggactcaacccaaatcgtgtgcgtcgtgtgcggtgcaagacttgcaggcttcgccacttcgtatcaagccgtggaggtggcggagaccatggctgcagtgccccgtgctaactcgcgcggcgcgcctagccccacatcccccgtgctggcgctatccccctccaccgccacgatctcgtcgtcgccgttgtgccgtgaaactggaggagcaagatggcgaggcgagagtgagaagaccaccgccgccgccgccacggctaccaccccgcggctgcggcggcggcgatgcagtagcagcagatggtgtaccagcagctgcggcggcggcacgtggacgggtcggccagtaggcgtgcagcgcagggcacagccgccagagcacgcggcggtgacagtgacgacgacgtacgggcgagcaggccgccacccggccaccgttgccgaggcggcgcgcctcatgatgatgggcggtggcggcggcgtcgtcgtcgtcgtcaacctgctattcggcgccgtctcgccgtcggctacgatttcatcctcgtcaggctgcagatactcaagtgcttgatgcagcatggaggtatggatggttgcatgaggacgaacaggagagaggaaggtggagactgcccgtgtgttctgaactgatttggatcgaagctattgcctagaatccatttgaacccatggacgcaacccatttttgccccaatattttacatccaaaaccaaaccactccaaaccaattggtatgtgttagtgatataccctagagacaatcatagagatgattatattatatactatgtttacatatttatccgacattgttccttgaaatagataactccttattggttaatgaatatgtgattctttcataagactctttatgttgtttgttactatttctaaaggatccctgatcaaatattatatgtagaataaatatgtttatatgaacagcacatgtattaattgatgatcatgtctcatggatcatggtatagagataccaaattaataatgtggacacatgttggtgaacatgttgttggatagacccaacatgagacactgcaagagccatatgtgttgtgttatcagtgatctcattgagtgttggtgttgaatccttagacctgagattatcatggttctcaacatatgtagtagcttacttagggactgctaaacgctactccgtaattgggtagttataaaagtagttttcgggtatgctatgaaacatgtagtgggatatgaataatcaagatgggatttgcccctcttatggagagatatctctgggctcctcgatgttgtagattatggaagtgcatggccatgccaaaggtgattgaggagtcaatcacaagttatataatctatcaacaagttcgagtgaatgattgagctattagagaatgtcacatatttagccttgagctcaatcgatatcgtgaggcaaaggggttcatacaagtatacactagaggttcagccgatatgatctttatgtatacccggtgggtcaatacgttctgctaggggccgctgttgacgcgtggaccgaaaatgagtttttaggttacaaccgagtatatatgaacctacagggtcgcaagcttaatgggccggaataaggggattggatagagacccaatatgagcttaattcggatagggatccgaataggagtcctacgggccttagaggcccgagtgatggatcctatatattcgtgaggggtgtgaccggcggaggcattgcatcacgtgagaaaccctagccgtcacttcccttcccgagcaaaaccctagccgcgcgtgcatgctagcacatctacgcgtggcgttccgtccctatgcgtgtggataccggtagaggcgccgctggtttgcggtgctgatcggcgtggaagtacggtgaggagaacgcacgaggagaaggtcgagccggtgcgatcgactacttcctctacatcgacgcgcgctacttcgcgagagttccttcgacttctcagcgtcttcttctgctgcgcagcacgtcgagtggtaacgatctatgatctaatacttgcatggttcctgatttacgggatagaaaattttgatttatgctatcgtagcctacgcgtatcccaacagtatgtgcacccaacccgcaccaatccatttaccgcacgagcccatttccctccaatccaaagctaaccaaataaaaatccaacccaattaatccatttccatccaatccattagcaggcttaatgtcaggtgcccatcctgtcgatatcgttttattttaaccaggcatgccttataaatttaaacaaagccaatagttacgaggagtctaaacgattttatgttaccatcaaacgtactcaaatgcacaagtaatacaaaagaaacatatgaagttatatagcaagaataaatataggacaagtagcacagttcattctcacatcaaaatcacaggaattaactaatgcaagtatagagaattgtcatgcaatagtataccactgaaaggtgcagcgatagggctacacagagaagcactaactaaaagcaaaccaattaatacaaaacccgcacctgactagccagccaagaggaatcaaagatggactttgttcgtccacacagaaagatcaaataagttcttcattgaactcgatgataagctgtggaccaacctttactgctcctttttggtttttttcttccttgaagcgaagctacttgggccaactgcttctactgacagtcgctttgtcctgctatattaaaaaatatctcttaactatgttgtatgcactattgaaatattgaaagaaatgttcgagagtaccttgaagcaatttctcttgtctccttgtcatccttgtcagccatgtcatcaccatcgtcatcaccatctatcatattccaaattagacatggaacataccagatcatatagttcaaatttcaatatctataatagcaaaagactataataagctaatcacaaaattcagaagcggaagatttccactgaaagtattgagcagatcaaatgtaaccactctcgaacctcgcatgcattcatacaactgcatacgaatctgtttctcatattctaaagaactcagtatatataaatacaaagtattagaccaatactatctcaagcaaagcagcaacaatatctcccgcatgtgctaagagttatgatcatggctttaaggcttgttaggttaaagcagttaaataaaacaaaagcaaagcttgccaagttcaccttcatcctctgctgcatcatccttatccttcactggagaggaggtccatcggtcttttccatcatcatcatcccaacgacttccaacaggaggcacccagaaatctggatcatcagaattatctgaatcatcaatctctggtttaggttctcgtggcaaagaagggttaacaacagcagctttcttcttgtccttcttcttccttgacttggttttattttccccttcatttgactgttcagcttcaccttcggccatttcacctgatgccatcttttcttctagtttttctattaaataggagtaatagacatgttaaatataggagcaaccaaacattccaatgcaatggaaaggctatctgtgtgggaaaaaagaattccatgcaaattgctttggaagatattatttccagaacaatggaaaacaaatataagaaagttcaaataaccattgcaaagcaaggcacatcatccacttgaataagcattaacgatgaaatccgttcataattgttctgagaaaatgtaccaactactcatccaatgtcaatcactatttttctctctcagaatcattgttgatgaaaattcatactagtagatgataaatcacatgcctatagaagaatacagcatgaagaaaatgatagccgcatggaaatagtcaacctcatgggttcttaaattagtagttcgatatataaaaaggcagagctcagttcaaagttcaataggccgttggcacacatggcattgcatataagataacgctacaggattatttacctagtttgttgaggaacctcttcccattgatgtgcttccagatgtgttcctccgacttgtttataatgtccccagtaatattgcatataagcttcgacctacaacataacatactcgattcaacatctcgactgcatcctaaaaagaacatagatttttttccaactttatttcacaaaatacgatcaaacgttggacactagaatttagaaccctcgtattaaacagcaaaataaccaattaaaccaagattaagcataaacaaattccgagcacgatacgtgggatacgccttggtgcgtaacgcgagagcaaaggcaataatagatgggtagcgcggcacaagatgggggcggattccggtactagtacgcacttgtgctcggggtgaggcttgaaggcgttgagcggcggcttcttgcgcgcgacggcttggtcgatgagcgcgagcctgcacgcgcgggaccgcccgtacgccttcttctcccgctccggcagctcgtgccccgtctccttgcaccgccaccgcccgcccccggggtcctcccaggtcggcgagcccagcaggaagctgccctccttctccccgccgccgccttgcgggctcgatacccccgcgtcgggcgccgcggcctccgccgccgccgccttgccctttttcgccattagggcgcccgtgaactgcgcgtccggaggcggaggacgaggagaggagaggtggcgcgcgaggttaggggaaaccgagagtccaggaggggaggagggaggggtttttggctgccgcctccgccgctccgcgttggggaaaaatggtggtgcccttctgtgagattccataccagccgtccgatcaaaccctaaacggttcaggatggctccaattctccaaacaccgaattgctggctttgctgcgcagataaagaaagaattctcctttattaaactttcacagtttagaggtgcagaactgtcatggagtaaattttataaaacctgggtatgggtgttatgaactttcaaaataaaactaaaaccacaacccagtaccccgcttattatggttatataggtagagatttttttaagaaaaaggttaacttggataaaactttttatagaatagatcaataatgtcaaaaaattaagattcgattttagaactcataattattgtgggtcaaagaataattgtttcatagtgtggttttgttaaagtctgggtacaaccgagagtaatatatcagatgttaaaacacatgattttgtgtgacaaactcaacaccttaggttacatgaaatttactctagatacaatggctatcaatttatcaaagtaaccaatcagacaatgtgatagaacatacagaaactcccagctggaggaagatttgcacatcccaacaaatgaaatcaacgaaatgtagacaggtacaggaagctattagcaacactacttgtctaacctagttggatagtataacggagcaatcacgtgcaatcgcataggatgatacaaactacagaggatcgatgtgatctcaaacgcaaaattttgagatcaacccaaagctcaatcagcacatttacagccacgctctgacaccacaatgttaaactgctagatgactgctctatggagaggcagatcagaggagggataatcgactccagtcaacttctctaaggaatagggatgttactcgaacagcacatccctcagtacagatatcccaacctccaatgctccctcatggagatctaaccgactttggtcaatttctctacagatttggcttgttttggaacaactttataagcacttcatccctcgatattggtactccagtctcaaatgctcgcttgaggaccttttgccattcatcgacaagggaagacttcatttgctgtagagtagcgtattcctgatccatgatcaactctagctcctcaaagtgtttgatcttgtattggatcttttttagctggtcaacataaagtagacagcagtcggtcattaaggaaatacattcagaaagtatagataaggtctgtcagagtttatttcgtttcgaaacaaaacagtcagacaatcatcaagacagcagtaatagtgtaagaataaggttgtgaatttgtagcaataagaatttcatttctttgagccctgtgaaaggaaggggcatgtgctgtgccaccatggtaggagttcagctagcagcagaaatcaaacccataacttgaatcatgattcatcaggttttgcaggatccagaacgaagttaaaaatgatatctaggtgaacagacttaactagacggacctcttccctttagccacattacaatatgtcacacagatagaaaggaaatggctcgcacaacagaactaaaaaaagagttatgtccctccgctctgccatttgatgtagaagaacatgctgcatatttattccccaaccgtttaagcacgatgtttgcgatatcatccctctctaaacaatatcatgttttttagaacataaaaacagctaggagattgaattatggtagtgttcaggtagtgaagtcatgaactgaaatggtttgcaggaatgtacatgatgtgtcagatatgtaactttcagatgaataaacagtgttagaactacgaacttaaactatacccgcagatgtaaataagaataggtcaagagatttaacctgagtttctattatggacgccattaggagctccatttcccgttcttcctggtctgcaagcattttagcacgggcagcagctacacctatggacgtagcaacagctgcccttacttgatatgtggtagaaataaacatcttcccctgctttttatctgaaacatgattacatgaagaaaggatataccttttagacgatcacagtataaacacaaatacttcctccgtttcatattataagactttctagcattgcccacattcatatatatatatatatatatatatatctagactcattaacatat

SEQ ID NO: 10827 - DNA, 10406 bp, Oryza sativa
  unsure (1)..(10406): unsure at all n locations
gatcctgttggatcaactgcaccaacagatatataaagaattctgtaatttttagccatccaatgatccaaatatttggcctacctgggtgcccgtgcatttctacatcccgatcaccaccaccaacatcatcactgcaataatccctaacagttaatacaaacaaactgcactgatactggcaaataagaacaatatataccatatctttacctctgccgggcatggttagaagagaatgccctggtttggtactctttctcactgagttgaaaagctctccttgcttgggggttttcattacccagtgctttaattgcggcatcagcagctgcagcaacaacatctgggcttgtcgatgtggtaagatgcgctaactgaggtaccaatagcaatcatcagttcgttccatttaaaatctatgtgtcctcacacacgagttttttgttatctgtttgttatttatttattacctgctccattaatgagacagtgatatctattgaagaaaacaaccgtctatgttttgtaggatgttcttcaacagatttatcagcgccatcttcatttccatcaatctgcatgtcatcaactgtttcagttggttgacttgaagactccttcacagtggacttgttcacttttccatcggttgtttggattttatggagtctgttatccaatttaccatttactgtgcccagcatatgttcaccaaaaggcaactgaattagccttgcaatgcattctgatttattctttgtgcggacatgctgggcgatgagatcccagtcatctccatgttttagtacaccttccaagagaaggagagtttctgcatctgtccatgcactagaagaatgattgtcgatccgctcctttttgtcacctggatgtatatttgcttcacccttattatcattattggcataacattttgagcatactttaaaaccatcctgaaaagcaagcataccaaatgttaacaaacatataacatgtacttttctcagattattcccgtcgaagcttggtgtgctatgaagcataagcaacaaaaatcatgtcaaggagtacgacaacataaacaggatgccataaataaagtagcgatgctgcaagaaatcctataataaaacaataatagatacatctcacagaatgccataaatagagtaatgatgctgcaagaaatactataataaaaaataataataatggcatctcggagtatgtattccatgaaaaccattagtgcagaaggacatcatgctagacacatacatggcgatccaatctataatctaaacgctttacctatttcagagccaaatatcctttaatattttgtaagaactgttatttcataacatattcacgaatctatttctccacaagacgacaagtaatttattcaaaactgtaggttgtaaaatgttaaatacttgcattcctaaagcctagaatttaaacctttggacattttttgcatgcatgatacaaagttcaaaccaatcatttgattgccacacagtagcgctgtaaccattagcatcctaaatctagcaagacatgattactaacccaaaatttgctaaagaagacaacctaatgcaaacggagagagaatggcgcacagctcagttgccagatagctgccaagagctttgcgccagcctgcgttcgatgacgtagccactcatcacctccattttcttaataattgataccgcattcctccttgatatcccacatttatcccagctaatgcaaaaaggaactttataactcgatagtaccttcaatatttgggcattcccgtctctgcactccatgccacagagcccacatataggcgccatcccaggcgcccactctccaaatacatcactatacgaggtcagcggcggcaaacggaatccgttctcgttgccccctcctcccttctcctccgcgaagtacgacggcggcggccgtggcgtcacctgcagccccacgggcgcctccacgacggcctccgcctccgtctgccgctgctgctgctgcgcctcggggcgggagggggaggcggagaagttgatgaggcccgaggagtcgaggaaggcgaagagcttccggaggagcgtgacgtcgccgacgagcgccttgcggacctcggtgaaggtgaagcggcgggaggtgtcctcgcggtacctgctgatgatgtagtcgcggtactccctgtagatccgcgggttccgcgacgccgtccccaacccgctccccccggcgccgncgaagaactccggcagcgcccgccgctccgtctcgtggatctcatcccactggaaccaacctgcgagagcgcgcacacacacacgcacacacggaattatttctcgtgccgcaacctcctcctcctcctcctcccaatcctcccctctcctaaccctaggagagcgagggggagcaagaggaggaggaggaaacctcgattcggggtgggggggcggaggcttacccgaggaggcagggatggtgtagagctcgcgcggcgggcgccccggcggcccgtcgccggaggaggcggcgccggccaccggcggcgacatggggaggagggggcaaggcgggaattagggggggagcgatctgggccgtcggatcagagggtgtggtggcggtggggttttgagctgcgtgcgtggctttggactcgggatttttgggcgacgccacgagacgagacgaggaaggagacggcggtgaggtgaggtgaggtgaggcgtgtgaggacgtcgaggaggattacggtggatgatggatctctcgtggggggccgtgtgggtttttggtgcggcttcctgtctcgcggtttgggccttacctgtttttgggctttttcttctgttgttgcttgtgcttgtgttggtccggaggttttatgggctacttgggcaaaattgcattgccaacaggcgaactgccatagtaaaaagagaaaattcataaaatgtcatcgataaatatcccaattcaaacgaattcgctatccatctgtcgacagattttcgtttaaagatttgtcgatttttgggccatatgatttgcgtggagatttgtgctaactaatacgatggataaaagagacaagtctgtgcgtagcgggggatcgattccaagagcactagttttccctgttaaacgtacaccacagagcaattaagccaagttggttcaagacaaaataaagtttatattgaagttacagtgttagaaaactaaaattacaatgtaattatactatagttacatgtatgtaaatatggtgcaattatagtgtaacaataatataattaaaattacagtgcaattatactataattacatatgtaactatggtgtaattataatgtaacaacaatgtaattaaaattacagtgcaattataccataattacatatgtaactatggtgtaattatagtgtaacaacaatgtaattaaaattacagtgtaactataccataattacatttgtaactatggtgtaattatagtgtaacaacaatgtaactttagtagatggattggtaatatctttgtatgcactaaaaaatatctagtagatatcacactatacatgagcagatgagctctcaaggattaataattaatatggataaataaccaactaattttgattaagaaacgagagtgtgaattaacgtcggaagcccatccatactatcgattagtagatgcgggacctcagcagtgctgtacacgtgtcatccatctatcgtttatgggtttaatccaaaggtacaaattttgacaaatttatgatgaaaaatctgtcgacagatgtgtagactctccccaattcaaaaaatatcatcgataaatctaatctctttagaaatgtcatcgtacaagtgcttttgttctagagttaccatcgttgttaagttttcggttgcatccatctgttaagtgctataaaaagatcattttaccctataaattattaaaggttgattaaaaattttgctcttttcgttagtttacactcaattagtttgctctttacactaaaatattgaaaattgactgaaagagtaaaagttttaatcatttaataatttgtaggggtaaaatggttttttatagcactcaacgaatggctacaaacgaaaatctaacgacgatgatatttttagaataaaagcgcttgtacaataatatttttaggaagctgtgttcgttaatggtatttcttggattggagggctcgtgatttttctccggcaaacagtgtaccgtgttctgaccaccaccaacagactgtctgactactaccgttaacgtggtactgctactagtctactactactactgtgcagtgtactacagataccacacagctgcattagcctgcattcgccgcttcacatcgccatggccctcaaaaggtcgaccgaggtgccccatcgagccgacgagacagccaaacgtacgtgctccgacagtcagacccgcgtgaaccatcaagctccgactttcggaaccacccatcgctaccctcctcgaccccacaaagttgaactcccccgatctccctccctctccacgagtcaacttactcgacgctaccacgcctatatataagctaccgctccgctcaaatggcctccacctctagcagagaacgatcatggctcggtttggggcggtaattcaccgcgtgtttctaccgctgttgctgctccttgtagttctcggtgcttgccatgtcacgccggcggcggcggcggcgggggcgcgcctctccgcgctcgcgaaggcgctcgtcgtcgaggcgtcgccccgtgccggccaaggtgcgtgcatccatatgcatatatattattctcccttgctgtgctgttttgtgtttggtgtactttgatttggtgaaaactgatcaagaggattgtgactttgcaccttgatttgatctttcaatggggacgatcctagcataatctgcacgcgaaatatagttcaggacaaatacttgaataaatccgtggttttcttcacttggttggctctagagcctgatattattgactttgcaaaagcgttttggctcacaaatttctaattcgtctagttcttacaatctcaagtggaatagtgactccaagttggcaacatgttgcatgtcaatgtaacgttgtcacgctgtcaaattgatgaccagtcctgcacgccggcgaggacgccatcaccgtgacatggtcgctgaacgcgacggcggcggcggcggcggccggggcggatgccggctacaaggcggtgaaggtgaccctgtgctacgcgccggcgagccaggtgggccgcgggtggcgcaaggcccacgacgacctgagcaaggacaaggcgtgtcagttcaagatcgcccagcagccgtacgacggcgccggcaagttcgagtacacggtggcacgcgacgtcccgacggcgtcgtactacgtgcgcgcctacgcgctcgacgcgtcgggggcgcgggtggcctatggcgagacggcgccctcggccagcttcgccgtcgcgggcatcaccggcgtcaccgcgtccatcgaggtcgccgccggcgtgctctccgcgttctccgtcgccgcgctcgccgtcttcctcgtcctcgagaacaagaagaagaacaagtgattgtggtttgcttgtgttagtagtctgtacaattgtaatgtgtgactgtgtacgacagcacggagtgtgtctacagcgcccagcacacacacctccgtatgttcaacctacaaaaccaacggaataatagatggatctttgaaaaactcaggcgcaagtgcaatgcaaataacctgctcatatgatcctccacttcctgactcggtttctctctttatgatggcacaaaattcaactcagtttctctcttttattatggcacaaaattcaacagcataagtacaagtgtactccaaaccacaaagaggcgcagaagagtgagaagacccttgcatgaaagaaacacaggacacccagcgatgtgctgacgtttttggtttttgaaataaaaaccctcctcatcggttaccaaaaaccgtggaaaaccggtaaaaaccgattactttcggtcaacgccgtacgtaaactggctaatactaagttctctatgaatgacagcaactcaaaattatatgataaattgcaaaatggcattccatcgcttttagtagccattggatgacggatacacggctgaattgagataaaggtacattcaaaatgttactataacgatcaccaaccttcttccccttctcggaggttgcctttccggcgagcctcaaatcagcccattcactgcatccttctcataacttaccagaaactgccctatcgttagtctccgaggccgttttatgcgaacaagtcgccgtagtcgcgcctcctcgagttgagccgcgatttaggtgccctggcggctagacgctttctgcacgagtttggtgtaacgctagccgctgaaaatggaactggagatcgaagtggtagccacaacaaggccggttgtctcctagtaatcaccattccagttcggtgttcaggtcacgtgatacaagcaaaacacacaataaaaatgtttctaaaatattgtagcgcaacatctgagccttacatacttgattgggtggatacaactcacctaatacactctgctatttattctctactcccttcgtaaaaaaacactcaatcggtgtgtgtctagatttaaacctgaagattgagttttttttagccgaagggagaacattagaacctctaatgtaaatgatcctgattcaccacagcgctgggtccctcactccccccgctccggcgaattgcttctccaatagcacaggtgaggctgcagctgatttggaagtagcgattgacataaaaaacagaaaccatatgaccaactaagccagtaacagagcgcgcaacggcagtacggcagaaatcaccaagaccaaagacagcagtaatccacaagctggcaagacgcaactaacagcgaagagaatcacttgcatatttccaggtactaaacacctaccgtccctccgtaaaaaaaaaaagagtataagtaacaagcgcgcagggattatcctacattctattgcaatggaactggtgtgagagagaacttcaggcatgtcattgcaaggcaccagtacaacgggcacagtaaagagaagttaagaagcattggcaaaatagtaggagcaacaaataacagaacagatggctaacacatgcaactgtacaaaatatcaaaatatccatacaaaaggtctccatccatgaatgcttaagagaccacatgcgacatgaaccgatcaggaacaatagttagtatcaaagtttgccaggtcttgttttggcatgggagatgacaaaaagggaaccaaaataccctacaacttaagaggcgataataaatagcttcacgcagagtaacctccattgacaagcttctctccaatctttctagatcagacaaaatgggagtcaaaacacagaagaaaatgacttattcttccccattctttcgaaacaaaaaacgaggacccagagtttccttaacaaatgctcaaacgccgtatctcaccacctctgccttgtcattggcctgaacagaaacaaaacaaaaccgattaagagctgcacatgaaccgataatatcaacatcaattggttagaaactgatttgacttccatcatatttttaaatagaccagattgtatcacatcaagaactaaagcaaataagatgaacaagatagatataaaggttctacgctcctatttctacccattaaaaaagcaaccatcatacaagaacacttcaccactggttcacaaagtttaagctgttggtgatcatggttccttttctttttttttttacaagaaacagcaggagaggctcctcatgtactttattaaataatataaatagagaataattacagataaatacaaagcagaggaaaaaaaatacaaagaaaaggttatacaaagttgcagacaattatcttcaaataaaaaagaaaccccaattctgagctttgtatcctctctatgaatctctagtgtcctacctagacaaatatcccattccaactctcatcttcaatcgaacagtatactatacgttcaatctcaaacctgtccaaagttgaagtgctacttggcttataatcaaaacatggtatatcaccatacaagaagaataactatataaaaggttccgtattcaactaaacatgacaaacacaacaaggcaggcatgaaaaattaacgtcaatatgaaagtgtgatgcatcatacatttacaaaaagaattaaactatatagaaggattaaggaggcatttcagctaaccagcaaatacatgcaactgtcaataggaaacattaacctggaaagaaattgagcaagaattgcacgaacctgtctgaacttctgcttccaccaaaagagcccctctctctgctaccttggaatccccatctttcctcagctggtttcggaaatggctccataccaccacgagagcgtggcctatccacgatggataccacaatctgtggttcctctgcaatagctggtggaactgctgaaaccctgccagctccagaaccaggtctttgcccaaatcgaaccttgtcatccaactcaatagtaagcaactcaagctgcttttccatctgagttatcttctccgacaaatcctctggatcctcaggggaagcttggtccggaccatcagttttattggcctcactttctttcagtttctccttgaggaggtttatttcttctttcaagatcctttcttcattcgtctctggcctgaaaaatgaggtacagatatattgaattaatagaaaacaaacctgcactggctaaaagaacagaatttcagaaggaaccaatccaagtatccatgtccttgccatccatgagtgatgacttataaaagcaaattatgtctttatcaacacaatagcatgctacattttgctagcgaccccagttaatttcacttcccacaaaactaagcgtaacggtgaacaatcaagtttgaatggaagtgacaacatataactgcatatgcatcactacattcagcacccacaagagaagattgaatttaactgaacaattgctgtaaatgttgattgttgactccactgcaccgttcaaaggattaatgcagataacttcataacaataaatggttcgacattaacattaaatgcttaattcactgaagtatactataaaggtaaaccttcacttctagttgctcattttttggatttcaattatgaagttatcacaaaagcaattcttccaaaatattacataacaaaaacagcagggcaattattgttaggacatgctacgtaaattgctaggttttttatatattagaaaagaactaagcagaacttgcacaattctttatgcaaggctgcacgcctgcacctttactaacctataccaatactccagtattgcaatacgcatgttttacattatcacaagaagcactccttttactaacctatatcagtcctccagtattgcatgtttccattaccacaagaaatacaccttcgctaagctatatcagtacacttgcattgcatgtttgcagtatcatgagattcatgagaaatgccaagtgcaatcaagaggtgacttcatatacatacctattaacggcacgatgttccagctcaaggtctatcttcctccagtctttccctttctcttgcagcaccacttcccgtggcttggcattaccaaacggatttacctttggccgtgacctcggtgccccttcactcccaactgctgagacctgtgatccagggctcccagggcgggaggaatgtgcgctattcggccggctggactgtgagctggtagggcggctagttttctgttcaatctcggtctccatcttcctccaatccaaccctttctcagccagcacctcctcccggggccttgcagccccaaatgggcttggccggttgcgtgccacctcagctggtggcgtagcagtagccaagggatcccgcttcggtggatcaaggttgagccgcggcctctcacgctcgccgttgtgcggcatcggcgcaaagctaccaccacgagaccaacggtcagagtcggaggggcctggtgagtcgcggaaaccaggtgattcacggaagccgccaccaccaccaccaccagaaccgaggcttgggtagcgcgatggcatcggcttcttgtcgcgcgaccagtcatcgatgtcatcggagcggccggctggggaggggccgccga

SEQ ID NO: 10828 - DNA, 6832 bp, Oryza sativa
  unsure (1)..(6832): unsure at all n locations
tttggtgctcggaggcgcggaggcgagcggaggtgaaagagagaggagtcgcttgcgcttctggtggtggagtggtgtggccgtgtgggtgggttgggtgggaaaagaaatgcgaggggcgcgcgctaaatcgcgcgggttccaggggcggaacggcaaaatggtgtgcgggccggggggtgggcccgcggcggcgtgagctgtgggtgactgggtgggatcgccgcgcgcccgcgcgcgcgccgttgcgttgcgttgcgtgctggctggcttggcttggctggctgctgtgctgcacgcgcagctttggcgagcgacttgtggcggcgcgcgcggcctctcgtgtcgcgcgcgggctgctctcgcggcggcagctggcgcgccgacctggctgtctgatgctccgatcgatcacaaccagagaaccttggcgtgaagctattgcgtattttttttttataaaaacacgggacaaatgtggcgctcacaatgcacgcactaaccccggtaaaaacatacacatatcttatttctatgagctcatctaaaattacgggttcggtacatcttaaaatttacgaattcagcacggacatcagctgaatcaggggcggatttagggcccggccaggctgggcagctgctcgggctcctcggtctgcatcagtacatcggttgctctgttttgctggcgaagctgcatgaaaatctgcacttttttttggcagcaagagcagtagcaagcacagcgtttggccgatcagcaggagcactgaagtgctaataagaattgtttttctattagtcattactttattgtgatctatatttgattaatcaatcagatttgtactggattaggatcctctgtgtttatctatatctagctctagctcaaacttaatgtcacggcgtttagttgatacaaggaaccatgatgatactttagtgaaaaatattatttgcacaatcttacatatgtgaaagattcttgtgcattaccattcattagacttgtccgggcttaaaaaaattcttggctccgccattgagctgaattagtcgtaaatgcgagcacgtgtatctaattcagaatttaaaccaagcgagctgacctaacaaattaaactacgctcacttcgcttttagtttttttattacacggaatatgttcttgtgcattaccattcattagctgcagcaacacactcacatcccattaatatgttccctaagctaagaccctaacaaatggaaaccaatggcccatccccattctcactaagatcatattaaaagtctatctacgcatgagcactaagatttaaaccatattatactactccctccattttactatactataagttgctttgatttttttctagttaaataattttaggtttaatcaaatttataaaaacatgtagtaaagtttttaacacaaaataagcatatatcattgaaatatgttcaatataaactaatttggtattgtggatgttgctaaatttttctataaatttgattaaacttaaaagtttgaaaaaataaagtgtattataatataagatggatggaggaacttgcagcttgggatggaaaaaatgctcgtttgggtttcataattttgacggtatctctgcgcatagtatagaatatcagttcaatatctgcatagatgaatgcccagttggcgaatcacaagcagaatagtataatatctgactaactttgtcaaccgtgctcgccaaactaagaactctgtcttgcagcagatttagaaaagaggggcacgaatccactaccaggagaatatcttctttctatccgggtgaaataccatcatctaaaaaaaatccggtgaaataccaccagaataatcccgtggttttccttctctctctctatctttcattttcatcctctcacctgttccctttcccgtccaattcatttgtctgctccaccagcaatttgcagagaggttcctgcatccagggcatcttaatggatttttttagagtacctctgagtgaatgcgagccgtttattgtataagatccaacagatcatatttgtttctactgcacctattagattgcacctattagattgagtagtagtgtagtagaagggtattttagaaaaaaaaaacatggcactgatgtaaatacgtagttgttgaagggtttcgtagttcatcgctattccgtagatccgtccgacgaacagagtaataaagggataaaagcttttcagcagggcggcttcgccgctgcggccgtcttcctccggccgcgttcgcttttccctgaagggccacctcctcctcatggacacggcgtccgcgagatcgtgacggccggccactgacgggaggggaatctgctcggtaaccggcatgaccgacgtgatcaaataaacgaaaaactagcgtacaacagatcacatgcatctggattaattacattgatacatgcaattgccaatcgggataactaaattgattaaaaacaactaaacattcacgcatgcatgttgtgggtttaattacagtaaagcatgaatttgggattgattacagttatgcatggttccgcggtgaccatgcttgcgcgacgaggagagattgaaggcggacggcggctaggagcgcaagattttggcggcggctgtccctcctgttctcttctgcttcgtcaactcacgatgaaataaaattgggtctgcaaacctggcccgtttgatctatcacgggagcacaattacaagattacccttccacctcacttaaacaaattattagaatgaccaacaaaatcaacggtgagatttattcctactacactactaccaccttaagtgggaggtaccgtaaaatgactcttaatttgtcagatcttataaaaagctgcgttaaatttgctacacagtccgtgcagttaatcacattatcagtttatcacatagcttatcactgattttaatactacgtcgttgaagcctctcatgagcattctgatatctgagtcgatcgtaccaccagctttttccacaaaatgcgtgggactaatcaggacaaaaagacggtgacaaggatgtgaagcctaccaggacgtagtcggttaccggtaggtaaagcaaagccctaaaggggttaatactagcttaatatatcttttactacctcagtcccataatacaaaggattttgagtttttatcttaaatatgtgaccactcgtcttatttaatttttctttcaaatataaaaacaaaaagttgtgcttaaagtactgtgtataataaagtaagtcacaaataaaataaataataatttcaaaaaatttgaataagacgagtaatcaagcgttgaaaaaaaaaatcaaaatctcttatattataggatggagggagtatttgacattggcaaaacgaactcctctttcttttctttttcagagatcagaagtagcgtcataccgtgcgatattgcgatgcaagtcagattcttctttagttctgcaccaatcgaagtcctgaaagtcaagcagaaaagcggcaacaaatgtgttcagaattgaaccagctgacagcgacggtggcatatgcatacagcagctagtagtagccagctactgatatcacccggatagtgcttgggtctcgcacgctgttttatgctttgagtagctgatgtgagaaaatgagagatgaagaaatgattaggcttctaccgagcgatggccgatgggtctcggaagttgacgttgcagttaaacttgacttgcaaagcctgtgtgagtgtgtaattctaatgaagccatgaaatgcgtagttttccatctctctccctttctttcatttccatcgtgcgaggcacacgcactaccgccagggttccccaaaacccaaaaggttacctggttattataaaaaccgtgtgattatcacgagatatactatagttttaaaaatgagaagggtaccgcacgtgataaccatggtaaccgtatggttttctaaaccacgagtaccgcacacacgaaaaaggctatagttcctactccatccgtcctataatatataagattttaaagtgacatatacacatccgatcttaggtttatagtataggaaatgtctcattcgattctaggttcttatattctgggacagagagagtattttaggatggagggagtggtagataggagaagcgacatcccgtgaattttggaggtcatatgaaaaaaacaagtatgaaacttactccattcgtcctataatataaatggatctggtatagaatgtaccatattatagtattatgaatctgaaaaattatctgtttaaacttgtagatttagggaatgtcacatcatatattaggtgaccttatttaggnatggatggagacagtaactcataaattaaagcatgtgtattttttcctcatggtatatttttatcctcatagcaacatanaatagaccggaagaagaatttttttctaatcttcacttggaaagcatcgcactaaaacattattatagtgtatttcgaaataaaatcttcgatggtatcttcttaattaatcttcttgagcatgtcactctcaggatcattacccatccggatgagagagatggtgagagaatgatgggcggggaaagagaaggatgtgttatacggttttgtggtaagccagtcgattcgatcaggtacgagatgaagaatgtgaagtagacttattcactttgtagacgaccgagacaagacacaatccggttagcagtactgcagtaggccgtgctgtttttgggccgcaccagcaacgggctggccagcccggcatggtctgctcgagcacgccctttaccttctttctttctttttttttttttggaataagtccactttgacttactaacccgaatctaatccatgaccttaaaccgcaaaaccggatatctcgactcccgaactattgaaatcggtgcaatttgactcccttgatggttttagatggcaattttgctgatgtggcagggttgacctactttgtgggattgacgtggtgtttagttggtatttaaattaaaaacgtatatgtgggacccgtttgtcattcacacacataaaaaattatagggcccactgacatatgtgccccacatatcatcctctttctcttcttcttcctcccctcttccaccctcctatctttctcacccattctctccccttcgaccagccaccgccgcacgggctggagcacaggggcaagtccatgtgggacaagaagccgccggcgacggcgctcggcggcgtccacgcgcccatcgaacatgaggaagaggaaggactgagagacgaagcagacgaagctgccgccgctcaagaagaggagggcggtggcggcggcacgacggaggtgaccacgaaggaggaggatttcgagacgtccgtgcatatgcgtcggggcaaggcggtggagcatggtcagcctgggcatggcgacggcagtgggggcggtggtgtgggcggcggacgcgttgtgcttgccgttgctggcggagatgttcgccacagtggatatgtccatgtgtagcgtcgcgcgcttcttcctccgcgagtccgccgccgcgctccagggcggtaggccggcctcctcctcctcctccgacgccgtcgcgccgctcagcctcaactggttcctcctcagcgtcctcaccttccccatgctccccggtgccgcccacgccatcgtttccattgctgatctcagctcccgccggccgccgccgctctggcccccgcccgtcatcgctccagcccgtgcggcggcgaccggtcgaaagggagaaaaggggagagaaagagggaagggaggaagaggggaggaagaagaaagagagagaatgacatgtggtgccacatgttagtaagccccataattttttgagagaatctgctcagtaccactgagttcgacacacttcaacaatatgccactgactttgtcgatatccataatatgccatcgccttttccttaacctttacgatttaccatcgccgtcaagctacatgctgtttgcactgttaatttttttagtaatgaccgaaataccctttgaatcatctaattcgcatggcccagggcccctttcttcctagcatcgcatctcccaacgccggattgccacccttcccagtgccgtcatggcgccacgccgcatctctgcccaccgccgctcacatgtcctcgccagcgttgccatctctagcgtcggcccgctcgctgtccccagcaccgccatccctagcgccagcacgtacgaccttcgtccccagcgccggcacgaccttcgtcaccagcatcaccatcgtagcgctggcccaaccgcgtgccatccacagcggcggtccgaccactgtcgtcaacgccgtggtcacatctgatgggagacggcgcccctattggagggctgctgctggtgctgccgttgcaaacaaagggacacgacgcccctgttggagagctgttgctggtggcgggtgccaccgccgtcgtcagcgctgccatcgcatgcaaggggacacggtggccctggccctgctggagagctgcatctgtgattagtgcaatcctcaaccgctcctcaacagtcctcggcaaaacaaaactccgccccctcctgtagccttggagatatttgctcataattaaaatacttaaaatatgtgctcgtaattatttataatcatattgcataaataaacagttattataactctcggtaccttgcacgacatggtctcagt

SEQ ID NO: 10829 - DNA, 3591 bp, Oryza sativa
aactcagtggtactgaattttttatgtgtgaatgacaaacgggttccacgtatacgtttttaattcaaataccaactaagcgccacatcaacccctcaaccttgccacgtcagtgccaaatcaacaaaactgtcttccaaaaccacaagacagttaaattacaccagtttaaatagttcgagggtcgagatatccggttttatagtttttgtcatggattagattcgacctatttttaaatgactcagagtggacttattcctttcatttttcgattttcgttgctcgagcgcgctcatttcccttttcctttttcgttttttcgcaagcgcgcccgccttcaaattttcggccaaatattcccgcgccatctccgctttgtcagatcgaaacttccggaagaaatcccctccctcacctcgtctgtataaagtccacacgagatgggtcgccgtgaccgccacaaatcattatccgtccggaggagagagaggcggcggaagaggaagaggaggaggaggagagcatggcggcgcctctcttcacaatctcggggcttcgcgaggcggcgatgctgtacgccagccgcgacgaccccatcaaggtcatcgtcacggacgtagagctccgccaggcgcccgccttgctggagttgctgacgaaggccagtcggctcccgcgcgggtgggatctggtccgtgaccacaagcttcgtcagctcgcgcgcctggcgaacgagatcgtcgtcatcgtcgacgttctggtgccgatgctccgggagaacgccctccaccacgacgccggccgcctcctccttcagtaaggctggtcactcccccacatcgctcgccatgtcgatgggccggaggggccgttccacgcggtcgcggtcacggcaggcaatttcctccgccaccacgtcgaccacatgatcaatggtacgcgcgatcgggactagcttgtcgcgaatgtcgagagagttcgcgacaaggtcgccgacctcaacaccatggtggtcttcatccccgagctcggcctcgacgatggaccggacggcggcgaggacgacccggagttcggtggcgatgatggatccgacgacggcgaggacggcccggagttcggcagcccgcaaggtgacaacgaggaagctgacgatgcatgaccatggggcgtgtttgtgaagagtacgagcgccgagcgtgtggtgagggttgtttgctacattttcttccagtagactactctcgttttctcttgcttttgcgactgtcgatcctgaaaccttagtagtatatgagtaacattcttagaatctcgtcaacagtagtacatgaatccatgtgcttattctagtagcagatgcagatcgcttcgagcactgtaaattgaatccaagcaattataccatgaaatggaaatgtccacccgatctaagtgttgtccatcagaattttactttgcttgtgacgtcgttgaatgatttcttccatctgtcgtgaaatcccctttctgaattttgctgcatttctgttgcgtgttcttcaattgtcgttcgttttttgttgccatcagatcgttcgtggaaattcttgcagcggaaactgtggatccacagggttcagattttttttctctcgaattccttggttaccgtgccatttatttttcccaaattcacctgaaagggaaggcaatgagcttagccgatttatgtgatgaatttcgacgacaccaacgcctgtagatcctgctgcagcgagcttcccccgtcggctggatttcctcccgtgctagtatttctctcatggcgtacgggctatttcattctgcaccgactgcgttggtcttctgactaccggcggatcggggcatcaagtttcaccatatggtccaaaacaaaccatctgcatttgagctgataaactgtgggataactctttgttcttcctctccatttgcaatggaaaatacatttgaccttcattttcgtagttctcttttcagtttgtatgccttttttttttaccgttcttgcatcatctaattttggagactgaagcactagtacagtagtacctgtacctgattgatatttgatcttgtatgatttgaggtatttattgaaaccatagaagcttttgttttgttattttggctactgttgtgttggggtcctgacattgttcttcaggtatactggtcatgatcgttgttgatttgatttgttttgaaatgcgaaggctaaatgtgagtgacttgcttgttgttactagtgcctaatcttctggagaatagcaaccgcaagtgttcgatgaacaaaacctgcattggttatactttgcattgtcccattatctcctctttcattttaaaggaatctgcaacagtacctgctgaatagatttaatcaaaacctggagtgtatgccgtatggtagtgaaaaaaacattttgggcttcctggccacgctgtagcttccataaagaagatcaaagttggtatgcttctctttgtgtttcagtgtcaggaaagagacattaggggggggggggggggtgtatttgaggctacttcagatggaggactgaacatatttttccaaatgcattttcttctttgaggaagccccagccagcccagttaagttttgcttttcttattgggttcgttctcctagtttgatgtcattgtttgggtcgtgttgtctctaatggtttgttattgattcatgatttagtcttggcaaatatttctatgggtttcttctacagtttaaaatgcagagaaatgctggttattttatttttaatggctgaaattcaggttccctttcaagagttaggtttgtaagcccctgatggaaactgagttttctagtgccatccatcaaggaaaagtgtctccaactccaaatgccctttggtatatcataccaacaggtttgctatgccaacttgaagtttgtgaattgtgatctgatgactattttagtgtctctaggactctcagtgcatgttttaattctggcagacctgtttgcttcaaagaggatcaggctgcagccttaccagaaaccaaaaccaagagttataggggattacaaaatctcttggttaatcctggccaagaattcagtacacacactcataacaagaccttctgtagccattcatcttcgatagagtattttgcaataatagtttctcattgccacttagttgtttcattgtttcatgtacaccaaacataatacaaagcactccacctaagactgcgatctaatgagaaaactttagagtacctaagactgcgatctaatgagaaaactttaagagtgcgaatgttgtctgttacactcccctttcgtttctcatttgcatgttgaatctgatgactcttttgcttgttgattcttatgtactctactaggtgttcgatacaatgatagaaaaatgaatgagcgtgtggaatgcaaagtttccttttctctgttttgcatgttcattcttatgtactctatcaagtgttggatacaatgatagaaaaatgaatgagcgtgtggaatgcaagtttgcttgcaatcggttt

SEQ ID NO: 10830 - DNA, 652 bp, Oryza sativa
tcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactat

SEQ ID NO: 10831 - DNA, 635 bp, Oryza sativa
agtacccacatctgcgcatccagggacacatcgtgacccgagccagctgcgaaatcttccagaccctgctggcgccgcacagtgccgaatcctcgaccaagagcagcggtttggcgtgggtctacttgaacaccgatggatctctggcctacaacatcgaaacggagcacgtgaacacccgggataggcccaacatcagtttgattgaggagcagggcaagcggaaggccaagctggaggatctgacgccgagcttcaacttcaaccaggccattggtagtgtggagaagttgggtcccaaggtcctcgagtcgctgtatgccggcgaactgggcgttaatgtggccaccgagcatgagacgagcctgatccgtggccgcctagtgccccgtccagtggccgatgctcgggactcggcggaacccattctgctgaagcgacaggagcacacggatgcacagaatccacatgccgtcggcatggcctggatgtccattgacaacgagtgcaatctgcactacgaggtgacgctcaacggtgtgcccgcccaggatctgcagctgtatctggaggagaagcccatcgaggcgattggagcgccagtgacgaggaaattgctcgaggaattccgctgc

SEQ ID NO: 10832 - DNA, 662 bp, Oryza sativa
  unsure (1)..(662): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacatgtcttaaaaaaatttactttcctggtttgatttatgtctctggcttgattttgcagcaaagcttgcacgtggaccacctatcaagtcactagctttccccgactactggtgggagatggactctgtcaatgtgattgcaatcaaggtggccgagtctgatgtgggttaccctatcagggtatttggcactgtgctggccagggatgagtacgatttcaggtgtgtctatttgttcaggcgtgacaggaacaatccacagatcatcacctcgccggtatgttactgattcgttcctcctccttgctagattaatactatttattgttcaaatccatatgccattgccttttcaatccgctgtctgatattctacactataaatgacctgttaattaggctcacattgttaagtgaaatgtggacggttgcatagt

SEQ ID NO: 10833 - DNA, 5843 bp, Oryza sativa
  unsure (1)..(5843): unsure at all n locations
nnnnnnnnnnnnnnnnnnnnnnnnnnnnnnnnnnnnnnnnnnnnnnnnnnnnnnntaagcagcagtttccagcccatttaggaatgggctgtgatcaactgcctgctaggactaatgtacttaggtgatcagtccattttacaacatgtggcaaaagctattgttttgtgaacttgggagcttttagtaatgaatacatgcttgacatatattcatcaattgtggttgctcaggatatacccttgtggtctaccacagtaagtgttcctatgtaattatttgtgtggtttgcttagtttgcatatgtctttgcatcatgtgctctctgatctatatgattattatttcctgaaaaatttaacaagtaccgtagcaccagaagttctctttatgaatgcatggagatgttattttggttatcgaagatttggttgggattattttatacttttattgtttatttggggttggtttagttctgaactaaatcgtacacaaatcttattttgtaggatattttgaaccacatgtcagatattcttttaagactatattttgatgaaaataaataaaaggaagcatgccaaaacagcatgagggtgtatagtaatctggtagtaataaactattattggattttcacaggaggaaatttggattgtcgtaaatgttcagatatgctattttatctgggaagaaataaagttctgcttgagttgtgctttaaccagaaggaatttgtagttgtaaatttaaaaaaccaaaatcaggggcgggctatccattcaggcttacctggatttctttgccctctgggacctactttcctcgatacagcttgagcccgcggtggctgacgcggcggtctggtggccggcgaagaacggaaccttctccgtcaagtcagcctactcgttgctatccgctggtcgtactcgatgtttgctgggcaagattatttggaagtcacgcgcaccggaatgctgcaaattctttatgttctgcgccatgaagaatgcctgccttacggctgataatttgcaacggcgtggatggcatctggctccaatctgccatctttgctccaaagatatcgaatcttgcacccacatcttccttaactgcgccttctcccatgaagtttgggggctagttaggggcaggattggcctccttcatgcagtgccagatgatgacttgcccacttggtggtgtgccgcgcgcaaggtggttaccaagaaggagaggaaaacctttgacgcgggcgtgattttggtgacttggctgatctggaaggaacggaacgctcgcgtgttcgatggccgagcctcgtcaccggcctgcctattcgcgacgatcaaggatgaatgggaaatgtggctggcggcgggtttgatccctcctccgtgagaaggcttgttgtagctctgttgggagaggttttttgtgtgtttgctccccatctcctttgagcgacggctttttctgcctctcttagggatgtggtcctgcttgtaacaaataatgtacattctttgctctatcttaatatacttcggccggcatctttgccggcccggtgaaaaaaaaccaacaaaagtttaatgtcttcaaattctgaaaaatactatccaacgactgtaaaatgcatattgttttgtggatggattgtcctacaatgggtaaaccaaactatttttgtgaatctgtggtctataactcccttctttcatgtttatatgttaaaaggagttgcatccagcttacaattttccttgttattgcttatgctattacattaccttttgcagcatctcatctatattattgcaggaattatatgcaaagttaaacgtcatgcgagcactgtggcatatatgttaatttgttagtaggggaaaggtttgctacattcctactgatgcggtttacagaaacagtcatactgtgtctgtcagaggaccagagattttgggaagagattgaagagggaccaagggctatgggtccccttggactttcagcaggtgagctcctctttttcttcttctgatcttatgacaccaactatcattcttattattttcaccttcctttacagttctacctggatatgcaatttgtgattcttttcgggcaaggccgtctcttatctccggtctccgcacatacatcaagtaatactgaaaatcgttgatagagtgatggcggcattttctgttactggaatgaaccctgataggttatattatactttcaaggttaataaaccttttcgacccaactgttttcagtacaaagtgctgtaatgtttatgcactttgtgctgcaatagcaagcaggagcatatgcatgtgttttgctccatttgttacacttctattatagatttttcacatgtcagaaattggatgatgtaggatatattaattatgaaattcctggttttgtctaaaaatgtcgctggcctttaaaccgaagacgatgatgaggaacacccgcttattcctggttttttgtctaaattggatgcgtccttccaagcaaacaattgccgaaaaaacacgttgtggtcgataatgttgccaagcaacatacaaccatctctgcacagggtaatcgcaaaagcaaacatgctgatgtggtaatgccagttatcaatgtatttgatgtagtaggtacatgtgttgggtttgaatgtttctcttacaaacaattaatacagtgatgcaatacttgttacaacagcctctaaactttcaatcttctacattacaacacagccttacacccttgtgttgcatattgcaatggcaggaaaaagaatagccagatatgagcttacaggcaaacagaaattaccaagtggagtacaatttcaacggcacaaaagttaacaccaataatatatatttcagtgtacgaacactagatcgatccatgttcattacacacaggactgccaacacattaagcaataaacaaacaagtttcgtgggaattcgggaaaacatgccccattttacagcctataacaaagatacttcgctagagatgtatgcgccacatataattcacccagagtttcacatactatcaccataaaatatttccaaatctcccaatacgctcccacattttccgattgtagtgttctatgattccaatccacctaaccttcacttgcagcacataagggcctttcttccgagtacattcttcattacgatgccctagaacaaacttaaaacatgcaacttcactgccaccctcaaacacacaaactttgagcaccagcttgtgtttacacacgacagctactatattacgagttaatgtaacacgtccatcattcctaacagttgtctctgtcccttccactctactgtcatataagatgatctcattttcaacattcccagtagtccaagcacttactgtaccggtgaaatttgacagcccctccaagaaattgacagcaagggtagcttgcacagcataaggaacaggtgtatagataaacgccactctactcatgaaactttctagttctaaagtcttgagtggcttttcataagcgacggcatcatgttctatgaaacctttgctgaaatctttgtcagtagccccatcccccttaatcttcaaattgaactcaaaatacatggatcctttggtagcaagccctctctttgggcctgtaagagttagtgtatcctcctgcacgtacatcgatttaatgaaaagcatgtcacttataattcagacgatgtcaagaatataatgtgttcgagaagaggaacgaatcggatacagaccggcgaggtgctgagttggggatggtcctatcacgcctgaacaaatagacacatctgtagtcctgcttatccctcgccagcacagttccaaagatgctgatggggtaacctgaatcagactcggtgaccttgattgcaatgacattaacagagccttccaacatcacaaacttggaggaagggatagtgcgaatcggagacccaggactaatttttgctgcaaaaatagggccagaaacagaaatcaaacaagaacattattattactacacatgacatcgatctagagactcaacagatagggaggaagaagtttttacaagtatatattgcttgaatttacatgtattcataggaataaacggatcgagaactaattagacaagtgaatgaaatgatacgtgcaaatttagaaatttagaataagtgaaaggatactcacactctttgtcgtggtcaaagaatgccatgttgcagaaacagaaactgacccgggtaggggtaaattcttttaacttggggtcgtattcagttaactgatagcggcgaacgatgtcaagaacgctcaccaccttctcctcccatgtcaactcctgtccaaaatccaggaacttcttcttcacctttcccacctgctgctgctttttcagagttggctgctgcttctcctccttcccagcagccataccacctccatgctcctcctccttctccatggtgaccttcttggttagttcacccatcttgccaatgctgtcatcgccacagctataaattcagaagagaagcaaaaattgcaatatttagatttgttcttttatgcatcgcataccaagaggaagaggggatcgatcgaggaggcgagcgtaccgtacgtggtgcgagtgcgatctcctcgaaccctagcacgccgcaaccgagaagtcgatcgatcgccgccgctgcggtgaaaggggttttctttatataggcccatcaggttaagtcttttccaaagaaaaaggcccatcaggtaacctactcttccggtctgtttggttggagagagtttttaggagggattaggagtttagagggatgagtctattaactgttttgtttggttgggggacatgggaattttggtgggatggggatggggatggggaattgaggaatgaattccctccttttcaatacctgggtaggggcaggtaattaggagggaattcctcctttacttcgtctaaacaaatctcagccatccattttcattaatgatctaatcaccaactaaactccctatcaatttccaccacctctaccaaacaagagactgggatgaaaaatcaaattcccatcttaatctcaccattaattccttggtgtaaactcccaattcccttccctcaagttgccaaacaagccgttcgtcctcaccaaacaaaccctagcctcttcataatcggggaaacagaaagagaaaaccctaaggctctctcccctccggcggcgacggggcgatcagggctgccagcgaacacgtctacggtacactcctcgatcgcctcgattctctcttccgattcgacgaaatcgcattgtatgggcacctaatctcacctgtgtccctttctttccgtgttcttcttctgcatgagcgtcaagatgcggacgaaagcgagaggggcggtatggtaatcgacgacgtcggcggcggcggactgaatcttgcaattgttgcaggcaagcgtaagcgggagatcacatgggaagagaaggcggcgttgacagttcttgatattcctgccgagcgtgattgcagcctcatagactcggagaaagattactcatgtgagtgtatatataatccacaactaatcgatcgatcattcatcattcatgtacatctgttctgctttgttcactcgtttgcatcagtcagtatatccctcttaattggtacttcctccgttttatatnnnnnnnnnnnnnnnnnnnnnnnnnnnnnnnnnnnnnnnnnnnnnnnnnnnnnnnnnnnnnnnn

SEQ ID NO: 10834 - DNA, 5908 bp, Oryza sativa
  unsure (1)..(5908): unsure at all n locations
nnnnnnnnnnnnnnnnnnnnnnnnnnnnnnnnnnnnnnnnnnnnnnnnnnnnnnnattcattcatatatatgttaatgaatctaaatatatgtatgtgtttagattcattaatatctatatgaatatgggtaatgctagaaagtcttataatatgagacggaggcagtattttttttttgtttgttggatgggaaacatcaaaaccaaaactttgcttgttttgcagctatggctggctgccaggccggagaacacgctagtatatttggcattgacaagaatggggatgattctgatgaaccgtgtgctaaggatgatgccaatcaaagtgatatggctgctctgaaggaggaggaggagaattgggagctggacagtgaaccagagctcacatgggatgagaaggtggttcaagttctaaacatggttcgacaccgagagatcaccgaatataaccccaagcagttttgctcaattcctactcgattttgtgcctacaacatagccttctttgacctggacaaagagtgtgagtacatccatccactgttagggttttctataggatcgtctagccttagatctagtcgggtagagctcttgggtggatgaacaaatatggatgaaacaacagagagggaagtgagagggtttagggatacgactggttgacgttgaggaggaggaagaggcgccggccatcgtcgttgttgtcgcgcttgacgtggacggcggcgacgatggtcatgacggcggcggtcgtaggcgaggacgacgaggcgtggcgcggcgtgatgcttcccgtcactggctgcgccccctcgatcagttagggttttgtgggtggagttggcggtggcagtgaacctcgtatcgtgtgccccctcggcctccacccctgtttatatggcgcagggtgacaggggcccaccagccaatgggctgggcgccccccgatcagggcacgggtcaaggtccctttgtgccgttgggctcaaggggagggagatctatctaacattctcccccttgatctcactatttcttttagcctttttctattccatcacagatttgcacatagagcatgtttcatcgtcacggttaatcgccgatggattcgacagccactatacacatctctattatactttaacttttgggccctgtagtccaggattcataaggcttcccttaaacccatgccggctacatgttccttgaacacattgggtggtaggtctttcgtgagcggatccgcgagcatcctttctgttctaatgtgctcgagactgattgtttgatcccggactttgttcttcacaacatagtactttatgtcaatgtgtttggcagcaccacttgactgattgttgtgagcgtacattactgtaggtttgttatcgcggtataactttagtactcttcctgtccatagctcatacggtgttttgggcaccgatttgcttgaaactctgttgaggatatgaatggcggtttttaacgcctccatccataaacccaatggtagggtggagtagctcatcatgctgcgcaccatatccataagggtacggttacgcctttcagctaccccattctgtttaggttcgcccggtgttgaatagtgggctactattccattctctagcaagaaccttgcaaaaggtccagggacttgcccataaggcgtatgccgaccatagtactccccccatggttagatcttactattttaaactttatatcatgctgattttcaacttcagctttgaatatcttaaatttatccaatgcttctgatctttctttaattggataaatataaccataatgggagtaatcgtctgtgaatgttatgaacgagtcatagccatccacacttttcacaggaaatggaccacaaatatctgtatgaatgatctccaaaattcccgcgcttcgttttgcaccctttttgatgctctttacaaattttcctttaatgcattctatgcattgttctaaatctgagaactccaatggaggaagaatatcactcttaactagtctctcaattctccccctcgaaatatggcctaaacgatagtgccataatttcgatgagacatcaggagttctctttcttttcttgttttcttttgtcaacgaggacacaacattcacattctcagaaagagataacaaataaagctcatcttgcaacacaacaaagaattgggctcaatcccagagtgtgacaccgtctctgagtacctcgaaagaataaagagccagtttactggttcttcaaagacttatgcgacacagctgataaagcagcttgtgacagagaggtaccatgggggtggtgtaagagaccacattcttaggatgagcaacatggcttccaagttgaagccaatggatttgggtatcacagatgactttctggtccatctggttatggcctcattgccaaagcattttgacaactttattgtcaacttcaacataagtctagagaaatggaattttgaaaagctcatcgctaattgtgtgcaagaggaggaaagaatcaaagagtccaatggtggctctattaactatgttaaagataacaagaaaaagagccacaaaccatcccctcaaaagggaaatagcctcagcatctgcctcagcaacaacatttcactgttgaaaaggatcagtgtctccactgcaagaagacatgacattacaagaaagattgtcctgacttcctgaaaatgatcatggcaaagaaaggtgagaacattattacatttgtaaatgaatctcattatgttggttattttagatccacatggtggattgattctggagtaactattcatgcgtgtaattgtttaaagggattccgttcgacgaggactacgcaaagaaacaaaagatccattagagttgccaatggagttgaagcaaaagtagaagctgttggagtctttgcctagagctcccgattggcttcacacttttacttcgagatgttttttatgtaatttaataagtgtatcgaaataggattttgatggatatgattgccattttggaaatggcaaatgtgaactatggtataataatgcatgtattggtcttgctgtgttgcaagatgagctttatttgttatcttttgctgagaatgttaatgttgtgtcctcattgacaaaaggaaacaagaaaagaaagagaactcctgatgtctcatcgaaattatggcactgtcgtttaggccatatttcgagggggagaattatgactagttaagaatgacattcttcctctattggagttctcagatttagaacaatgcatagaatgcattaaaggaaaatttgtgagtggaattggcggcggcagcgaacctcgtatcgtgtgccgccccggcctccacccctgtttatatggcacggggtgacgggggcctaccagccaatgggctgggcgccctcgatcagggcgcgggtcaaggtccccttgtgccgttgggctcaagggggagagagatctatcaaacatccatttgttataatatcatccttgtttcttgttcattctttgactattgtacatgtcttaaaaaaatttactttcctggtttgatttatgtctctggcttgattttgcagcaaagcttgcacgtggaccacctatcaagtcgctagctttccctgactactggtgggagatggactctgtcaatgtgattgcaatcaaggtgaccgagtctgatgtgggttaccctatcagggtatttggcactgtgctggccagggatgagtatgatttcaggtgtgtctatctgttcaggcgtgacaggaacaatccccagatcatcacctcgccggtatgttactgattcgttcctcctccttgctagattaatactatttactgttcaaatccaaatgccattgcctttacaatccgctgtctgatattctacactataaatgacctgttaattaggctcacattgttaagtgaaatgtagacggttgcatagttccataatggctggtgaaacgcctgatacgatagaaatcctgtttcctggacattaaaatccctactgccagatcttaaaccttgctgtcaatatcatatatccaccgaatctgattgcctggtagtccattcctgctgtctaagagggtcaggacagttactgttggaacatcaatcaatccatgacttccccttttttgtgagatttgatttacttaattagtttctatatcccaagatcctggtacttttacctgttatactattttgttaatccagtgcaacggtagtgctctgggatcatgtacgttttgtactggaaaaagtggaaacaaaagaatttatattggcatgttgctcatttgaacgtgggaatttgaaatgcaattcacaggctgtttcatatacctaaaattattatctgtatgtattatgtacccaaatttctcttaacatattgttggcactgtctgaactgtattcgacttatcgagcctggtgtttttggtggcatttttgacatgatttcccctaatctatttacaggaggacacactaactctgacaggacctaatcgagcgctgggtgcaacagacaaaatgtatttcgagttcaatttgaagattagagacgatggcgatgtcgacaaagatttctgcaaaggtgtgcgagaacacaatgccatctgctatacaaagcagccgatgactttatcgctagagagctgcctgagtacaattgattttgtgtatagtcctgttcaattagctgtggaagcttctgttgcagtcaaaattaagggggttgtatccacgtttttcactggcaaagtgactgcttggactactggagatgatcagaacaaaatcatcctgtatgacagtgaagtggaaggcagcaacagagttgttggagctgatggatcagtcgatctgactcgctgtttcgtagccgtcaatttggatgatgaactggtgctcaatgtctgtgtttctgaaggagctggctcaatctttgagctcgttcttggacacaatgatgaagaatgtgtccgtgagcaaggtccctatgaactgcaggtgaatgttgtttggacagctgcctttaagcatcgacagcgcagaaaattgtttgagcgtatcggtgacttccgcgtgttaaggtgatatgatgtagtatgaagatttatatgggggaagttgttacatctcaagcagttctatcttgttatatagatcatattttttgttcagctgagtttaactcgtgcttaactgaaaatctgcctgcaagacttatatgtactggtagactggtagtctattttgccgggtcggccaaaagttggctgaccaatttcattaagattgggaagaaaatacagtgtgaaaggttacaacgacattagtacaatgtcgtggcggctagagaacccggatcatctatcccaccatcttgtgcagttagccagaagatctctaggcgtttctccgtattaattaagctcacatatatcacactaaaaaattgtcaaaaaataaatcagtatatcttgtaaaaattgtaaagctatagatcaatatatgatatatatctttttcacaaatatacaagttaaaattcaatctatataagtagaaacaaaaatatcacatttgtgaactacacattctatttatagttaaatttgtcaattttttctacttgtataagttgaatttgaacatgtatgtttgtgaagtaacatatcacatattaatctatcttactccctccgtcctataatataaaaagttttagggttgtacacggttattaagaaannnnnnnnnnnnnnnnnnnnnnnnnnnnnnnnnnnnnnnnnnnnnnnnnnnnnnnnn

SEQ ID NO: 10835 - DNA, 3511 bp, Oryza sativa
actatagggcgaattcgagctcggtacccccaaaagttggctgaccaatttcattaagattgggaagaaaatacagtgtgaaaggttacaacgacattagtacaatgtcgtggcggctagagaacccggatcatctatcccaccatcttgtgcagttagccagaagatctctaggcgtttctccgtattaattaagctcacatatatcacactaaaaaattgtcaaaaaataaatcagtatatcttgtaaaaattgtaaagctatagatcaatatatgatatatatctttttcacaaatatacaagttaaaattcaatctatataagtagaaacaaaaatatcacatttgtgaactacacattctatttatagttaaatttgtcaattttttctacttgtataagttgaatttgaacatgtatgtttgtgaagtaacatatcacatattaatctatcttactccctccgtcctataatataaaaagttttagggttgtacacggttattaagaaagtaggtagaagaaagtggtggaggattgtgactggataagtagtggagatatgtggaaaaagcgaatggtggagggttgtgattgattgggaataaaagttgttatattttgggacaaatcctgagggctaaaagttgttatatttttggacggagggagtactatattttataaaatatttttgatgacttttaagtgatataaaaaatagtaaatttcacaaaactagagttattttgatcaaactatcgcaaaactacagttttaagacgtatcacaaaacaacagatttagcaccatatttgtcacaaaacaacatatttaaggttaagtatcaaaaaatacatatttaatattgaaattatcacaaaactacagcttttagagtttaaatccctagcaccattattatgttaagcataaacattattgttttgtaactaaattggttctaaacctatagttttgtgatattttagttactaaacatatagttttgtgaaacttcatcttaaatgtgtagttttgtgataaatttggtgttaaatgtgtagttttgtgatacaccgagtaaaatttgtagttttatgatagtttagtcatagtatatgtagttttgtgaaatttactctaaaaataagaggatatgtatagttagctagataggagtacatgtgagtcagtacgtgcatgcttttgcgtggcccatgcgcatcacatgcaaatcaataagctagtttcttagttaagtaagtaatcttgcttgcttagtctatcctataattcaccaactcactgttacatctatattactcattcatcagatctaacggacgaaaatcatccaccgctttagatccaatgaaccatacctccctcacctcccaccgtgcaccgcaccatcccacctcctaccgcacaccgctcccatcccacggaaatcgcatccgccatcatcgccgcaccctcgctctccccgcgtcgcgccgacccccaatcccaaaccccggagcagctccacctgcgccaccgctggatcgatgggaaagaaccgcggaccgccgtgcttgcactagcatccagatcagcgccgcctcatcgatctcctcatgtgccaccgctcacgattcgccgtcgtcgctcacaaattgtcgttgtcacgaaatcgcaaccctaatctccccacaccgcgccaccgcccctcgcctctccaccgcgctggtctcctctgcgtgcgtcgtcgcctctccaccgcgctgatctcctctacgactccctcaccctccgtcgacatcaccgccgccacccacctctccaccgcatcatcgtcctcaccgccaccctacggttcaccgcaccgccatccactacgccaccctccgctcgtcgcgccgcccacatccacgggagactgcccgttaatttgcgtacctcaactttttttaccacttaattcgcatgccctctataatatatcattaggactgctaattagtttatttggtaccactttctctgtttttcatgtattacttatttcttaattccatatgtatatctttatggacatttttgcccttgggcctaggggtgaaaactatcggaaacggtcagaatcggtagcatctctttggaaacgatgctcgatcggccggtaattgaccatatttatcatttaaactactcggtatcgacattaatacgatggagaaagaaattagaaaaaacaaaatttaaaaatagccaaaaaggtacggtcggaaacggtaccccttaaacgaaaatggcgcccggtcgatcgggaatttccttgaccgttttcacccctacttgggcccacctgtcagattcaaagagagaaatctctctctggatcgaatcgatcgatccctcctccagggtgagcgcagagcgccaccagccaccagcgacgccaccaccccgctgccgcgcgccgtcaccaagcgccgacgccgtcccagccgccagggtgccccaccacccccgccgcccgaggtcgacacccccactgcctccaccgccgagcaccacccccaccaccagcatccaccggcatcgttgcccctgagcggcaccatcccaccaccacgccgaggagaaagacgggcgcgccggcactgccggcactggatgagcagtccccaatagcatgtatcaacttttgcatatttcagcttgatgtcatgtagaaaatgcaagccctgtatgagatgggggctgctataaagtttcagacatttttgcaaattgttgtcggctgtggggtggtggcggttggcggcggggtggtggcgcccggcgtcgcggtgctcggcgacggtgggaagcgaacgaatgctgatccaaagagagatatttctctcttctctctttggatctgacaggtggggccaggggcagaaatgtccatgaacaggtaagaaacaaaaataagtaatgaaagcagtgaaagtggtactaaatataacagttaacagtggagacgactacggagggaaaaaaaatcggacgctgatgtcagcatgatgcatacatgcaaaaacactttaaactattttttctcttaaattatttatccaaatcatgatccgattgcaccattaaattcgttgtaattaaatctttaaagcaagaccacacatggatatattccgacggaattttttttagcttattattgaattatttttaaatgttgcacgatgttccactaattatatcggaattgtttcactatttagatcgaaaatatttcaatcgtttgaatcggacattgtttcaccttatataaaaacaatgtttcagcaagtagcgaaagaatgtttcagttcactgcaacatttgatactataagtacactaggtgaaacatttttcgtggaacaaaaaatgaaacgaattcccttaatagaaggtttccaaaatattgttgatgtgaaaacacgaggcctggaagatctgcttaacttcagtgc

SEQ ID NO: 10836 - DNA, 1437 bp, Oryza sativa
agcgtgccagttgatttgatcctgcagtcaacaagaaataaagacaaagaaactacggttaaattcataaatgatagccgatcgaccagtcgccgatgacgtatgatttatctttgagccgatatcgtatttgattcgatcggcaatcataaataggcaagaaagaactaaatctattcgatcggctgtaggtatcaacggaatataatccctacgtcgatatatacttaaatcaagcgattgggatagatcggtcatcacgccgagacagtataaatcacttagatcgaaatatatactaaggaaaggactataagcattcataacatagctgatcagatagatctagcatgaatcggctaatactccgataccactatattaagatattaaagcaagtaaaatatatcaaacagaagattaacatactttgttgtagtaagatcttaacataaaaggcagatctatcatatcaattaagcacatgaaaaaatataaagctaaataaggtaagatcggctgaaaccccgacactaccctaatcggcaaccaaaagcaggctagagatcatggttctaatcacgacttataaggtcaaactcaactgatgcagctataagtatgaaaagaacaacaatatctagacaatcaagccgttggatgcttcatagagtggtagataccctatataatcgaagtcaacgttggtatttaacttaatcggctgccttctcacaatagatgttaaccgattgaaggttaaataacaatattgccagagattatataggatatatggtaacttgacgaattatataaacaagattagagtatcataaagatggaagcactaatcccgagaacgcaagccgccataacaagttttacctctagttgaagatcgaaaccgatgcagctcaacccggcagcaggaactcgtcgaaacaaaacgaaagtaaaaggatggcgatgcgccgagattgttattgaacgtgtgttagatcaattacatggggctcagggtctatttatacccgagattacaaaatatgtccatgtcggacacgactcttatctctaacaaactctaagataccataagtctttgcggcagacttttgctcaaacttatctctaaggaaattacataaaatatcctaattgatagatacaattaccttctcaagacttaatccgtgcatggcaatccacatgaagcacattaactcaacctgacaatgtgtatcgagtcatattgttggaatcggcttaatcggctaaccttgtctgactcgaactctgccgactctgattgcagccgattcttgctctgttcccagaacgatctccatcttggattccgctaaagttttatcttcatctccgatacttgaattatcaaatttggttgttacaaatatgtcggtgatttattgc

SEQ ID NO: 10837 - DNA, 1066 bp, Oryza sativa
atgctggtgctcagtccattgcctgcatcgactcttggatcccaattgaggaagctccctgcatttgtgcaagatggcctttttgcgagcagtcaggtaaaggcaaaatgttcacagttgctgcttgtgctattaattctaattttgatcattctgttacactaatgactatgggagcagccgcattctgcatcgcaccattggattggatgctttctgcacgcagcataggagtccatatgcttccagacaacttgctatcacgtaatcccttccagacaactgcattataatttgactttgtgttgtttgacaaatttgtcagatttaggcatgagttatgaacaggatccttgtatggtgctaaaaagttttgggcgtatatatgacgtgcaaagaatagtttagacccaatgaaactgtagagtattattgtttatgcctgcagttgcttcaaagagaacaaattcaatctatctctgttgcttgtgtttcttttgaagccaccttataatttttagcacttaatgaagccaactcttctattgggtatttcaaggaagatatggggtcttgctttcagaatagaaattgtttctggtggttgtgcctgtgcatcctttgttgctgcttaggaaaaataagtctgcatggctcataccatcacctggaatatttttgtttcatatcatctgaatttcaattaataaagtctgtatccggttctatttcactattggtggtttctaaccgtcaataatacttgaaatcaagtttgtagtctgcatctggttctacattctttggtggcctcaaattgttatcacatatgcagattcactattgagtatgtgataattaattatttgtaatgacatttctgttatatcttatatactcccttctttgtaattaacagtaatggaattattgttagttcaatttgaaccaaccaacatgtcatataataaaaacaaatagagcgtgaaaatagcatttttcgaggttatgtgactaaatcccttgaacaaagaactttaaaatagaaagggaggggtaccgagct

SEQ ID NO: 10838 - DNA, 4978 bp, Oryza sativa
tccgttttgctatttgctcagccagtgcccaatagccagttgctattaattgtactgttcaaaaccataaatttaactaacataatttttttggaaaatgattttttttttctaaagtaggggaacgacaccctagagtgagcttgttttttagtgcttttaatgttctatgtatgacatcactcaccacagtcatcttatatgattatgagttaatcacgatatcttttttatagatcaggagaacatattcttatcatctctgtggctaatctgtatatttatagagaatagagggtttgtccaaattctacatataggaagttatttttattttcagaattacttcttaggattagctgaaatattaatttatttggctgcttcaaagtacgagtctgcctggtgtgtacaaatttacataaaactgaatatgaaggagcacaagtggactaggactgagcatgctaattcaaacaggcatccagggtgaattgtgtggggctgtgggcaaattcagtacataacctgctcgtggcaaattgaggactaagattttgattttgaggtatacgatctgatctcttcacaccttcaattcttaggtgtgtcatgtaagtaccagattaatacgtgatagatggaggtatagtcattgacagtttgccactgaaatggagtcttttgggtgatggcttgcatttgaaaatgcactggtatattataaaaattgcacagaacaagcattgacgtttttcatgtacaaacaagtttaaaaatgttatgcagcttatgttgttttcaagtttagcatatatgtatctaagaaagctatgttgttacttattgtagattgtggagataacatgtaatgttttgatttatgcagcaccatcggtgcctttttggtgtgggctatcaagaccatcgacagcttcctcccttgtccccaccggccatccgctttgcaacgtgatagatattttccttgtattatgacgttcatgaataatgtagtcatgccatatgaagcagttgtgtagtatgtgacctttttggcggttgattgaaaagtaaactgattggatctgggtgactgaataaagtgctttagtattcagcttgatttcatgaagcagactcatcatgaattactatatgttctcccaattgccaaattcagttctatttttcagtgcaaaatttagatttccaaaccttttctcattttcttttcatgccagatcaaagaagtcatatgagatatagattataaacttgaatttagcagatggtgatggatggtctggacatgtaaacgagataaactaccttaccacatcaatcactccgacattagataatgtatactattatagacattagataatgtatactataataaacgagatatagatcaaacattagatggtgatatccgggttagattcttttttatgtctatgcattaattgtgaagttgtacattacgaaatagatttttacgaaagatagaggtcgtgatgttattttactcatgcggctaaagattaacaatataataactcgctgtgtcattcagtttttaaattttaacttgtctcatttaatgcttgattggaaaacaaatatatattctttgaattatttattttgcatttctaaatgctaccgtagcgttagcacggatcaattactagtgtataagatagcaaaacaccatcaaatatttttcaatactggtagtaatttttttaatataccttaagtacaattaaaagctcatatttttacgtgaagaactttgcaagttttgagttctcttaagattggtcttactattgaaattgtacttcttacacatttttttaccaccgtataaagtacactcgatctacggttttgtttagcacacaaattaaccatcttaagttctttttggcgatggatacatcttctaaactggatattatgattttagtttaactaaaattttaataaaataaaacaaaccgtactaaacatgctcatgccattgccacttaccaaaatttaatgacgccgtaatgtacgcaccaccaggggatcagtgatcagggtccattcctgtccctactgctcggagcatctaacaagagtaatagaaatcggagagagacgcgtcagcaagaaatatatatgtgtgtgaggcagatgaatcatgggcaagtaagaaatctctgagatgactgaggccatgtttaaatcccacctcaaaatttttcaccttctcacatagaacgtttaacacctatctgaagtattaaatataggctaaaaaataactaattacacatattacgatgaatttgcgagacgaatcttaagcctaattgctccatgatttgccaaagtggtgttatagtaaacatttgctaatgacagattaattaggcttaataaattcgtctcgcggtttacttatggattctgtaattaattttttattagtatccgaacatcacatgcgacaccctatataatacctgatatgacacgctcaaactttaccaccctggatctcaacacccatgagtggacattgtatcagcgctagcgtgtacctttaaaaacttatttacaaatggagccttgctcaccttatataacttatttacaaaaggctaaaatttggcatggcattggcagtagttgatccaaaaatattttgaaacccggataaacttcactcactactacatatacgattattccatgcgaccaaaattgatttttacatacggaagggtggcccgcatgtgtcaaaaggtatgtgaaaaatccaattttcgcatgcagttaacgcagtcgcatgtgaaaatccgtttcttgcgtacgggcgcttaagtcgaccgcacatgaaaaggaaaaatcgcgaaaaaaaatccgaaaattaaaaactacaccgaaaccctaaccctagaatccactcgccgccaccgccaccatcgtccttgtcctcctcctccagatgctgccgtcgtcgtcctcctcccatatcgctgccgatggatccacacgggagggggcaaccaccagattggggcgggggaggacggctgccaccggatcggggtgggccgggggagggccacggctaacgaattggggcactggaggacggtggaaacctaacaaatccctataacacattatttaaaattgtcttttacatatatcactatatcgattaatctataccgttactataatttagacacacttcgatctaacatgttaaatctccttctttgtcatccacttagaatgtggaggacacattggttgtttgcatgccaaaactgcacacatattaacccaaattaataaaacaggtttgaccttgaaaaatggtttgattagttgcagatggattttttttcttttgagaggatgtccacttgtttgcatatgttgtctaaaaaattatatatttttttaaaaaatggtaagatatatcaatatgtgatatgcatggagttcccattatggtaggacagtttggaagagaaatttggtgcattcacaaattcagatttgaatttggatttgacatatggaaaggtttcaaattaagaagagatttggaaactttttgaatttggggaggagaagatttagggtttgcgggtgattaaaaggatttcgggtaggatttgaaattaaggcactcatttcataatttgaaccacggaatttggaacggaatttaggaataaggggttttggaggattcaaggtaagggattttggagtaccttttggcacttagtcctcctcaatccacgccaaaaatgcaaaccaaaatttggaatatttttatttaaaactagctgggtggcccgtgcaactgcgcggctaacaccgataccaaattatatatttttaatacgattttacttaaaatttattaaatagttatctcattgttttaagactttgaaagaccaaaccttatcatcctcttgtttctaattttatagtttttaaaagtcacaccagttgctatcccttacttctgtcatatccttctttatttgcttgctcgatctatcgctgtttctattcattctctttggaacccttaaaaattggatctaatagtttttagagtttattatcctgttgggtttcgtttttatagaagtcccgtcaaacgctgccattatactccccttcggtcgtccactgtctattctctttattggcattggtattttaaaaatcaaacataattattgtttaggtttattttttactataattattgtttaggtttattttttactttctagaatttccgttaaaacgtcaacgactttgtcactgtactcctctatggctcgttcgctgcctccattctttattgccatcgagattttaaaatcaaacataattataattggtgattatttttttattttttagaagcccgaacctttaaaaatttgaccttatagtctttagagtttattgtctcgttgggttttattttttataaattttaaaataccgttaaacattgccactatacttctctacgacccgtccgccgcctattctttattgtcattgggattctaaaaatcgaacataactatcgttgaaattcaaaatttactttctaaaagtcccaccaaccatcgacggctctgccattgtactcctgtacgatccgcccgtgcctctcatttttattatcattgagattttaaaaattaaatatgattaccattagggtttatttttttacgtttttgaagtcccgccaatcgccttgaccgattgcttcatgacatgcctgtcgtcatttcttttaatccttattagtattctatttggtgttttattaatagtttttagatgtcccatcaaccgccaccactctactcctttataggcatgttacttaattaatctcgtcatgtgttttagatgg

SEQ ID NO: 10839 - DNA, 1998 bp, Oryza sativa
  unsure (1)..(1998): unsure at all n locations
gtttctattgcgccataggtgaaacggactattattttccaaaaacttttgtgtggactcatactaaatctcagccattaaaatttagacttatcacgatcctaaggttaaaatttagacttatcacgatctaaaggttaatatttttcttttttcnnnnnnnnnnnnnnnnnnnnnnnnnnnnnnnnnnnaacgtgatgcttttttttagctgtcttaataatataataatagatagatagatattttttgcgagccgaaaaaatcagggcgttaaaatggcggcgctgcccgaacaccagcaagctgccccaacccaacgctgaggtctggtggtgacgcgcgcggcctggcggaggcggcggcagtgacgatggcccgacggagatcaaagagcattttcgttcgttcactatatatgcacaaaccattctgtggcgtacgtgtttgagaattcatgtttgcaaaaaaccattctatgcatatatagcgtgttctctctctctatatatgcatttctgtatatttgagaatggaatttcagtgaaacccacagattaggacaatattttggccaagccgcgttaatttggaggatgtggcacaacctcaattttgtcaagaatacacacatgtaaccaaattctcgcaccgttacgctaaatttttaagttgtcatatactcaaatgcacccagttgataaagttgtcgtacttaattactccctctatctcacaatgtaagtcattctagcatttctcatatttatattgatattagtgaatctagacatatgtatctatctagattcattaacaacaatataaatgtggaaaatgttagaatgacttacattgtgaaacggagaaagtatatgaagtaatttttacataaatgtatgcatgcacccactagttcttgtgcccagccgtggcataaatttcatgtgcacgtggctcaattttcgctattaattttttcccaatgccagtatatatatagaacaaatgggctgcttatatcatactcatatgtttaattgcgccagtgttattatttcgttacattggaaagattttgttttaataatggataatccggcctcgactatttgaaagctgcaactacatgtacctttcaaggtagcatcaaatgcaaagtacataaggatggtgagaaaataaacttaaatcacaccaactcaacacaggagatacaacttaattactacctccgttccaaaatgttctacctagtatgcgatgtgactaagatggaggaagtatttatttaggaagaaatcatattactaaatctccattaaaactagcttggcgaagatttacatggtcgttacattgtctccacattctggcacgcattatgaatcaatttttatcgtcatcgcatatttgtagctaggcccaaaacattagctagttgttacccataaaaacctgcatataagatttagttgaagttttgtcaaaagccatatcatttttagtaatccatagaacccaacataaagcaaattcttctactaaaatatgtttcttggttgagtcaataccaataagccaatttccaaataaatgtaagaagttatttgatggattcatatagaaagaaatatgaacaattctcaaaagaaatttagcaaagtgactatcaaagaacaattgttcaatagttccgccgtacatacaaaagaaacattctctcccatttcaattccttcgtgctaaattattcctagttaaaatcaccctttaaataaatatcacataaatatatttattttaaggggtatcttctgttggaaatatagtcattaatcggcatattttaatccaaaatgttaaagcaataatcatggcataagcagtgtaggacgatcttaacataaccagtagcatactatgcgcatcatgannnnnnnnnnnnnnnnnnnnnnnnnnnnnnnnnnnnnnnnnnnnnnnnnnnnnnnnnnnnnn

SEQ ID NO: 10840 - DNA, 11155 bp, Oryza sativa
  unsure (1)..(11155): unsure at all n locations
nnnnnnnnnnnnnnnnnnnnnnnnnnnnnnnnnnnnnnnnnnnnnnnnnnnnnnnnntggcaatccgacccccacctcaactggtcaacagggagcctccaataattccctatttatgttgagatattcctcgcttaaatcctgaggtggtattattatccttaacacttattatgggcctttgagatttaataggataagttgggcctaacccaattattctaacaatccccaccaaatttcaaggctcataagaaatgttctcaatgttgtgcctgtttgatataccagggttttggtggagactgttaagttgaacttccacctaagaaatgagctacatcagaccacaactgaacaatggactatgccttgaattgtcagttttgtgttatcaagtttcactcagaaccttgactggtactgggctgccgttcgcatcccctctgtttggagcatataagtcaaactccaggcctttcataaatatctagagattgtccaaacctcatagactgtgactagcagtcgaactcatataggtgtgttccttctaagatgttctgcaggtcaacatctctgcttggaaaagccactcggatcacattaaggcatgagccatcctaccatgcaggaaagaagagaagcacattatgaaaatgagcccttttcaagggtctcttctctcagtcacacaatagtttgtttcgctatccaaattcacgggatctccgatcacaatggacaggtttccactattatgcaaccttaggtgggtatcaagcccatttccctcgatgcactgtctatcacattatgtggtagccccttggtaaactgatctgctagatttctagccgtttggacatagtccaatgctatcactccggagtttttctgctttctgacagacttcagtcttcttttaacatgcctgaatgacttcatgttgtccttcgaactgttcactttaataatcactgtttgattatcacagttcatcaggattgctggtactggtttttcaaccaccggcaagtccatcaggagctcacgaagccattcggcctcaattgtcgcagtatctactgctgtaagttctgcttccattgttgacctcgttaagatggtctgcttgcaagacttctaggaaacagcgccacctccaagtgtgaacacatatccacttgtggcttttatctcatcagcatcagatatccagtttgagtcactatacccttctagtacttttggatacccggtatagtgaattccatagctcatagtgccctttagatagcgcattactctttctagagcctgccaatgatcatctcccggatttgagacaaaccggctcagcttgcttacagcaaatgagatgttaggcctcgttgcgctagccaagtacatcaatgaaccaatgatttgagagtatctcagttgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatccttcatttcaaaactcttggacagatagtctttgacctcctcaatcacattaaggctggtcccaaagatcaatatgtcatcgacatataagcataagatcaccccttctcccccaccatagcgatagtatacacatttgtcagcttcgttcacaacaaagcctgcagatgtaagcgtggtgtcaaacttctcatgccattgcttaggtgcgtgcttgaggccatacaaggatttcaatagtttacacaccattccctcctgaccttatagtacatacccgtctggttgatccatatagatctcctcctctagctctccgtttaggaaagctgtcttaacgtccatctgatggacgagaagaccaagagaggctgccagagcaagtagtactcgaatcgtgtcaagcgagcacctggtgagtatgtgtcgaagaagtcctcgcctccttttgggtatacacttgcctggagcccttgccttgtacttttcgattgtaccatcaggcctaagctttttcttgagaacccatttgcatcctacgggcttgcacccatatggacgctcaacgacttcccaagtaccattagacataatcgagtccatttcactgcgtactgcttccttccagtagtcagcgtcaggagatgaatatgtctcttctatggttcttggggtgtcatccacgaggtatacaatgtagtcatctccaaaggattttgcaaccctttgtctcttactcttgcgagtatctacaatgttgtcctcctcaggattttccttaggcgtttgatcattgtgttctatcggtgccaagtgctcatggggcatgacagtttctttactagaagtgctaggtgtatgtttcataggaaattcattctcaaagaatgtagcacctctggactcaagaattgtaccaacatgcatgtcaggtactccagagtttactattaagaatctataaaccacactgtggatagcataaccaaggaacacacaatcaacagtatttggtccaaatttccactttttggctataggtacatttaccttggccaaacagccccatgtttgtaggtatgagagatttaatttcttcctttcccattcctcgaatggtgttacttcctttcattggaattttattcaggacatgatacgcattcaaaactgcctcaccccaccattccttggaaagccctgcagtgtctaacatagcattcaccccatctcagttagagtacggttctttctttcggccaccccatttgattggggtgaatagggaggcgtcctctcatgaataattccaaactcttcgcaaaaggatgcaaactcattggaaaaatactccccacctctatcagacctcaaccgtttgattttcctttcaagttggttttctacctcagctttatagattttaaagtaatacaatgcctcatcctttgttttcaatagatacacatagcaaaatctagtgcaattatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacgcaagtatggcacttggaacctttgaccaaagtgaattttggaattaaactcaggttagctaagcgcgtcatacaaccgaaattcacatgacagagtcgcgaatgccacacattagactaatcattctcgctaatatggttcacagcattatgattattacacatgtcattcaaagaaaagcggaacaagcctccgctatcataacattttccaacaaaagtcccatatttaggtacgacacatttattggacttaaacacaagtctaaaaccttctctacacaatagagagccgctaactagattcttctttattgaagggacatgctgcacgttcttcagctgcacggtctttcccgaagtaaactttagatcgaccataccaacaccatgaacagccgcaagcgacccgtttcccatcaacaaggaggaacctctcccgacctggtaagaagaaaacagagaaatgtcagcacatacatgaatattagcaccagtgtccacccaccaatcaggtgaatgaaaaacagagagaactgtagataatattttaccgtaccccgatgttcctccgccctcgctaatgaccatgttggcagactttctgtctttgcgctcaggacagtccttggcccaatgcccagacttgtcacacacaaagcagtctacctttgcctttcccttgtctttcttcttaaaattggttgtagccttggatttgacatcaggcttaactttcttgttatcgtgggatgcatgagggttcttcttctgtaccatattggcactagaacctccctcaacctttttgccccggacgtcctttgccctcgccttctcctcaacacccaaagagccaatgagatcagaaacactgaactcttgtctcttgtgctttagagaagtggcaaagtccgaccaagaaggtggtagtttggcaataatgccacccgccacaaacttgtccggcaactcacagttgttgttctcaagttccttaaccagcatctgaatctcatgagcttgttctactacagaacggtcatcgaccatcttgtagtcatagaactgctccatgacatatagctcactgtcggcgtcagaaactccgaacttggcctcaagagcatcccacatgtccttcccagaaggcatgtgcatgtatacgtccactatgttgtcagcgagtacactgatcaatgttccacggaacaggcaatctgaagcctcgaacttagcctcttcctcaggagaaagaggtggttcacttcgtttgccccgtgaaacatagaagcactgcatcgctgtcaaccacaatagtgcacgtgctttccatcttttatagtttgaaccatcaaaagcatgtggtttcagtgcagcagcaaagccaactaccgaaaatgacctatcaagtttttggattgttggaaatatagtcattaatcggcatattttaatccaaaatgttaaagcaataatcatggcataagcagtgtagggcgatcttaacataaccagtagcatactatgcgcatcatgaatgtcaggaacaggaacataacagtaacgcatagaggcatcatgaagaacaggaacaagaacatagcgcacatagtatagcgatagcgctaataatggaacaggaatagcgctaacaatgggaacaggaggagaagattataccccgagaatggccctctgctggatggtgaggcagaattgcctccgttgttgttgtcgttcacggcacctcctcctggcgcactagctccggctcctgttggcggcgcaccacctccgccatctcctccagcagcggcggcaactccagacatcgcgatgagcagtcgtgtgggaggcactccccaaaaacctgatcacccgcctacccggtgcagatctcaggcgaaggtgtggtttcggaggcactgctccttccaatctctcgtgcgcgcaagagatcagaagcgaggaagcgagagcaactcaggcggagaaggagaaaccaacaccggaaaagaagcgatgaaaacggatcgcactcgcggcctccttatctatcaggagaaagaacgtggatgcgctgttgcggagggaatcgtgggaacgtgggttagtggctgcaaaaggatagcgacgtgacgtgacgtgacgcatgcacgcagccagccacgccacgcctcgcctcgcccagcccacgcccacggcctcggcccggcgcgcgcgtgtggcaatccgacccccacctcaactggtcaacagggagcctccaataactccctatttaggttgagatattcctcgcttaaatcctgaggtggtattattatccttaacacttattatgggcctttgagatttaataggataagttgggcatagcccaattattctaacatcttcaacttccacataaccttatttttcactatataaccattgtttagcaaggctaaatacataaaatggacccaaaaaatactattgtgatgaagattttatctaaatgtctttatgatcatttagattagtatgcacaatcttaacatgccaaagaactagatagatttttatatatcattgacaatcttacccagttatcccagaagagaaacattattgaccgttattatatcaaaaagtttggggtctgactcaactgtagtaagggatgagaacggtataaaagcccccgaccgtatcgaccatcaattccgttttatacggactgtttaatttgtttctgcggactgtttaattttggattgcccggaagtgaaaaggtaacgatgtataggtgtttttctgaccgttttaacggtataccattttgtggaatttccggagaaattactgtataaaatcgataacccatcaagatatacaaagaattaactataaatcttgtgtgttctaattgtcgatgcattaaggatttagatcccatcctaaaattttatacaatgtcacatcgaatgtttaaacacctgtataaagtattaaaataactagttgcacaaattgtgactaatttgtgagacaaatattttaagcctaattgctacattgtcacggttatggataccacatacctaatagcagttgactagatcttggcaggacccaccacataccatgtcttgtatggacattgacctcagatatggatgaagttccggataagaaaagacaaccagagttctacatggaaacgataaggactacttagattgtatccatattggtctccctagttctacttggacaaggggacacatatgggtataaatacaagaccccctaggaggagaggggagacggacaatatagacgccacaaagccacaagccaatacaagccaacatacgccaagacaagtcgccggatatcgacatcagagatatgcctggattgaccctatccggtacctacagaggccggccatagggatctagtgctatctctgatctcgtcgggcactgattcgaggaggaagactaccctgttgtcgactacgtgatgatacttcagtcccgctatgtcgacaacagttagataggctaccccaaatattggactggtgtgattatggtgaataagaacaataccggcttcggtcaacgggatgtagggttattacttgccaatttaggggccagaacttgtataaaaatcactgtctccatctcttttacctcagtcttgcgtatatcctagtaccaacgatccctataccatgcaaataccggaatcgcgacatcaaacgtcgacatacataatttaataatgtggtgctacagtaaacatttgctaatggcgtgttaattaggcttaataaattggtatcgcggtttactgacggattatgtaattatttttttattagtgcccgaacatcccacgcgacaccctatataatatccgatgtgacacgccaaaactttacacccctaatatcgttaggattaggatgtattcaaatatcgttgtttccgaggctctattccgataattccgtttctggtattttaagatgttttgatagtattgatatcgttatggtctctgactctaccacacccatttcgttttgaagaaaaaaagagtaaataaatgttttgagcgtttttccggcatttttcgccgcaagttatactgcgatatgataaaattttgggaatggtttagctagatacgtggtgaagactgaagcgaagtgcccgggttgaattagactagacaagtagacagcctacgtcacgtactagcagtagtgtgcttatttattattactccccttgtttaaactaatgacgttagtctaactactgtacattaaataatcatcatgcataagacccaggttacgtattcgttcatgcattgcaaacttttgctcagtcgacataagtgaagattcttttttgaacaagcacattctccacggaggtaataaagattaactaccacgagttggctaaaagccccatggaagaatatagtagaatctcaattcccagaatatgtatattgctgatgatgttggtttgcaatgatcatcaggagatatatatagagggagaggggggaaagatccttacaaaaatgactgatatcaatgtacatgtcttgtcaaaagaacagagataccagcatatggctaactgaaacatattaattaagaccaacttagctactccaggactcctacacaaacagaatgtccaaaatggcatgtagggtttctccacgcgaaaagatcagctggtctccagctactccagttacacgtccttgacatgcttctgtgctggttgaggcacccatgccgctctgtacttgagtacccgcagtttttcagcaatctgagcaaaagttagttcacagccaactggaagctcctgtgtgaacaaagcacgagagtacttgccccattcgttgaactcacaggaaaatttcttaggaaccttcttctcagacttagctgtaggaggtgcagagaaagtgcctaaaacccatcgctgcaagagcgggaagcggatggattctgagatggtcacgaccggcagactcaatgggcctgacccaagttcttccttcaggcgcttctgtctgaccaactcttctgccatgagtagggattggtgacaattcttgaatgcccttctgcctacttcaatgttatggccacctacatcattataacttgtgctaatattgttcatattaaataccccttccttctccttcttggagtagtgcagttgagaacgcggaggcagactctcttcagcgtcgctcatcctataccattttcctgtcacagtaagaagacaacatagtacattataattggggaacacatgcatgctggtatctactagtagaagctaagataataaccaccgacttgtgagctagttaaactggtggtacaggatgcagaggaatattcacagtacacattgggcaggtatgtgcaccctcattgggcaggtatgtgcacccttctaactgatgctaatatgctaccaccaaccaattaaaagcaagtctggattttggaaaagaaaatacatgcatgtcagactgtttttatcctaatgcaataaaacaacagcagaaaaaggcaactactagaagtgcatgttttgtagtctagttaagcagttgttgataatataatcatcggtaatattgtgcgaaaaccaactgaagcaagtagctagtgattttgaaacatgctaatgtatacaaaagaagtacagaacgatatatactataaggggaaaaaaactgtagcaatatgtagaactatcagaatacatgctaatttgtagtgcagttaatgtgcatgaagggcaacaaaattccatggatggaaaaacccaaactgttggtctatttgagtagttgcattgcatggcattctgtattttacatttgtaaacatgttctcacactttcaaaaccatagaagcaaggcaaagttcatctctttagagttctcatcccccctcacaaaattttagctagttataacacataatagattaaaattttgatgtgaagttacaaaatagatttagtgtatgatgtgaaattacagattgtattcataataacaacatgcaacgatacgatggtgtattgattcttaacccacaggaaattgtgctacataagtgttaacatggtgatttttcttatcagaatacatcataaggcatactaggacaaggaaaaaaatgcgtgtgaacatgcgcatgttaatgatctagctaggcatgatctaagtctagctttggattacaaatgataattttaaatatcttccttatctaaaaaattactcttgataaaacttatcatgtcaaatattgcagatatcacagattcagttgccacagcaagagtttttcgtgttgtgaacagttggcacataaggtgctgcaaaccccaatgttcatattttctccctctctatcctatcattcccttccggcgtcccacaggccacaaacacaaccttctcctcctctgtaagcagctagcatcaatctctgatcctcccttaattatcaagaatggaaatgcatttgcatttagcaaagaatcttacctttagcatgaaaggcctcaaagtagaggtctttccatcggaacaggagtgttacgatttcctcatctggactgctcttggtcggcttcaacttcaccagaaaagtcccacctttgggcgtgtagagtctctcagcaaccttggagaagagctttttgcctttgctattggacggagcttcctgtatgattatctgttctaatcttgttggaatggcgtcctccatgagcttcttgtagctttcaggcaaatcattcagcacgagatcgaattcatctgatgcagggggcttgacaagaaacaacaagcaaggagaggaaaaaaaaaagatcatttttttcatttgaaatccccatgatctttgaagaaccaaagtcatggcgcacgacacacaaacaggaataaggagtgttgagattccgtacctccttcactggctgttctttctttggggccatggcgattcatagaagatgcttttcttgttcttggaagggggttttgaagcgagcaggtgggggttgaagggtttttgaagcagaggatcggagcagaaggccaatgtatcttgccggtggccaaggcttctcctacttggacatctccctcctcctcctcgcagtcatggcggacgtatgtatcactggagaggaggagtaggcggaggcgcgcggcgggggcggagctcttgagcaatggagacttgggagaagagaggcatttctgggtggtcaggtgatcaggtcgacaggtcttatatttctttaatatttttctattgttcctccctcgggttccactttttgttttcttttttgtcgtatagtactcctcctcctaagagagagagttagagagcgagagagacacacacacacatagagagttccaaagtaccaaaccctcgccgccggggatgtcgccgtcgacgccccacccgggccgcgcgccggctggccgttctccgggactcttgggcacttacctccatccagctccagcctctcgcgcagccgtccattcattcaacgccagtatgtgagtgagttcgagtacgccaaccatgactaaattatccatatctctagctagtgaatgctactctctgatctcgatctactccttgttactggttgtgtcttagttggaacgattgtgctaacacgaccacccgatttgatttgtatgcgtgtatttttttttttttgggggggggggttgtatttgcattaattctacgtaggagctgaggatcgcagattaatt

SEQ ID NO: 10841 - DNA, 5836 bp, Oryza sativa
ggggaagtgaataacatgcatgtctcgctcatctgctgtgcctggctctatgtgttgattaagtagggtgatttgtacttttgtagtatctggagttgacaatgtgcttgttggtataatacccgggtgtggttgaatatctcctttgagctgtgatgaagctgtgcagtttggaatcatagcataagtgaataatgttgagacaccagtgtatactttgcccggatttgttcagtaatctccgtgaccgtagcccactgttacttttgttgcagccatttttcagattaggagcagtggggacatgcttccatgttggtgtttcttggttgcagcgaaatgtggttttgtatgtagttgtttctgagccagaagtagtatggccccctgtttctcctgaaaacattttacatgtgaagaaaagccaatgttgtgcatgcttagatctcttatacttagtcttacttgttctctttgcatggcaacaatatgctccatgcctctagacattggccttccctaatgtctttacttcagttccataaaagaatgtcttaagttatctataacttctatgcttttctctggccagttagtacatgcatatgttctgaccattctggtcatgtagcacaccactttatatgctttccttctacaaattgcctgtaggggttaagaacaagatagattcatttacgaaaatattttgcggcctactatttttttttgcccaaggacaaacaaactggtgtttttttatcttctggaccttgatagatgaattgtgtcttgtgaagtaaatgatcactttgcaacttaatgaatggggaagaattgtggcaatgcctgattgataatagatacttagcagaacacattgttgccgtttttttaatggagttatcagttttggaggttaagtaagaatggtgacaatgtcttatagttacttaatagatacttaccagaaaaccttgaagccgtttatttacggagttatggaggttgattcaaacttctttttaattactgtaagttgtgagttcctaagagcacaagattttgggaggacttgtggctgggcccagaaactttacaatttgaccttcatcaagcagactttggttgctgaagttttttaattgcatgttacgtagaatcaaatttagaagatatctagcacataaaactttgcagatgtggaaacagatccgagatatatgtggcagtgtgggtcagtaaatttgaatattgtcagataggctggtcttaggttgaactccagaaagaattttacagtaaagttcctctatggaatcagaaaggtgaaatctatggggttttttttcaataaactttgtggacatggaaatcccccttaaaattgagctttttctttagttggtgatgatttgttccattgtaactaaaaatattcttttgtggatatgtgagaaggagagagcatagatcaattagatgttttcttttactcttgtgttttacctagactattgtgatataagtttgttactttttaatagtaatgacagatcatcttcagttcaacatctgtttgaagtttgagtgaccaaaattgaaggaaaaactagaaaaaacgatgattgacgtgccccaggggaggggggttagctactgtgatttgatccatttagataactgcagtaatggttcatgtttccaggagaaagaagaagataatttctggatgggccaaagctaattgagatggtgacgaccgaggtgtttctaccatgaaagttccaaccatgaagagggtagaaacctcaagtgccatgaatggaagttcgagctgaaatgggaagtgatatgtctaactgacaataggactgccctaggcactaaagggcaaggaacaagggagtagtacatggaatgtttgtgttgaataaggaggtgtttgggtgagagggactaaataagtccctccctaggcactactccaaggaagttggaactagtaactatatccacagctgtatatggaaagtctttggtctctgcagaggaccaaaatctgtacaaggattgtgtgggtgggggttcagtttagtctctctccctctctcttttttgtttttcagtttttgaacaggagttttaagccctgtttggcaaatgctctctgttttaactgctatgcaagccattttcatgcctgttgtgcagcttcaggttttcactgttttattgttcaggatttatgtagacaacctcctgagaaagtgtaaaatgttgtcacttaaccttgtaccctgttcttagagctaatatatcctagtatattttttttattttctaaaaatagtaaattcacagaactacaaatactttaagtaaactatcccaagactagatattttatatgttttattataaaaaaatatataaatttagcattgaatttatcataaaactacatattttaacttttgtgaaaaatatatttattattaaatttatcacaaaactactgattaatcattgacttcatcacaaagctacatatttacaagttccatcatgataaaaatactaggatggaacctctaactatgttgtttcgtgataaattaggtgtcaaaaatctgtagtttgcaatagtatggcttgataacctgtcggtgttaaacgtttagttttctgtgacaacgctagaatttgtactagtaactatagatatttttgtaaaactatcataaagctacaaattaaaggagcatttttttcatggaaatatatgtgccattcaattataaattatattggaaaaacgtgtataaatccaggctatgaaagagccccattgattggcttgataagccaaaacaaaagccaaaatttgaacttttaaacttgaatttaaagttgattttaagacattttcaacgtcatttatttttagcattggcttttagatcattatgaacaaatatataaaaaattatctataatttagtttttatttcttaataaaccgttttgatttattagtagtaggatatatgggtaaccaattaggctctcaagattactataagtaataagtctactttgcctccctcaactcatgctcctagttgaattgcatccctcaaccgcaaaaccggatataacccgtcctccaacggtcaaaaccattgcaaatcgacttctcggacggtttcggaggcagttttgtttgacatggcaattaacttgctgagtcatcaagtgggacccacttgtcaacagcctatatctcatcccatcttctcccacacctccccccctctctctctcttaactcttcctcttcttgtcaccttccatcagcagagaggaggggaggagctcgtccgccggccgcggcgcgcgtggggaggagattcgtcggtcggcagcacgcgaggaaggagctcgacggccagccgtgcgcggggaggagctcctagccattgacggacgccgaggcccacgggcggagctacagtaataaggctggtgtcaggtgacaccaataactttcggcaaaacctaaggcaaaactgtttatccatatgttattacactatgatctaagtataattagtgtactatgacaccgatagacacgctatgacaccaacgaatcgattttcattcgtccctgccgaggccgtggaggttctcgaagccgtcgtcaaaggcaacgcgtgggcgccgccgccgctgccagccgtcgcgctgtcgacgagagcttcaaggcgatgcgcatgcaggacatcgtcagggatgcgatcaagctaggattccagcgtgcggacttcgacgacgtgatccgctcattctgctggtactactcgtcgttcttctccaagcaggccgccgccacggcagtggcgccgcccaaggacgacgaacagggcaagaaaaccggcgccaccatctcctacgagctcacgctcctggattgcctgcatgccaaccttgtgccgccgtcggagggagccgccactgggggcggaggggtgaaaggcggcaagacgtcgaggatccggacggcgaacgagctccgccgctctggcattcgtctcatggccatggaggaaggctgcgcgtggtccagttcagcgaggacaccatgacgctgcgaggtgaggaggagcaaggcgagcaggacgaggccaattaccatgcccatggccaccgccgcgcaccaccaccaagccaagctgactcagcaccttccctacaagacactgacatgtggggcccacgcgctgactcagccagtcaacgggtccaaaatgacacgccggacgaaaccacctcccaacccaaaccacccgaggagtcggtttgcaatggttttggaagttggagaacggtttatatccggttatgtggttgagggatgagatttagacaggggtatatgagtcgagggaggcaaggtagacttattccttactactactatagtacaatacaactatagggccatcaggttaagtcttttccaaagaaaaaggcccatcaccatcaggtaacttactcctcgtccgtccgtgtggggactcttcttcgtcctcaccaaacaaaccctagcctcttcataatcggagaaaaagaaagagaaaaccctaaggctctctcccctccggcggcgacaggacgggttctcgatcagggttgccagcgaacacgtctacggtacactcttcgatcgcctcgattctttcttccgattcttcgacgaaatcgcattgtatggccacctaatcttacctgtgtccctttctttctgtgttcttcttcttcatgggcgtcaagatggcggatgaaagcgagcggagcggtatggtaatcgacgacgtcggcggcggactgaatcttccaataattgttgcaggcaagcgtaagcgggagctcacatgggaagagaaggcgttgacagttcttgatattgtcgggtcccaacagcaccccgcatgccaacctgccgagcgtgattgcagcctcatagactcggagaaagattactcatgtgagtgtatatataatccacaactaatcgatcgatcattcatcattcatgtacatctgttctgctttgttcactcgtttgcgtcagtcagtatatccctcttaattggtttttttttcttgtttgttggatgggaaacatcaaaaccaaaactttgcttgttttgcagctatggccggctgccaggccggagaacacgctagtatatttggcattgacaagaatggggatgattctgatgaaccgtgtgctaaggatgatgccaagcaaagtgatgtggctcctctgaaggaggaggagaattgggagctggacagtgaaccagagctcacatgggatgagaaggtggttgaagttctaaacatagttcgacgccgagagatcaccgaatataaccccaagcagttttgctcaattcctactcgattttgtgcctacaacatagccttctttgacctggacaaagagtgtgagtacatccatccatttgtttgttataatatcatccttgttccttgttcattctttgattattgtacatgtcttaaaaaaatttactttcctggtttgatttatgtctctggcttgattttgcagcaaagcttgcacgtggaccacctataagtactagctttcccgactactgggggagatggactctgtcaatgtgaatgcaatcaaggtggccgagtctgatgtgggttaccctatcagggttttggcactgtgctggccaggatgagtacgatttcaggtgtgtctatttgttcaggcgtgacagga

SEQ ID NO: 10842 - DNA, 2017 bp, Oryza sativa
aaaatgcaacgtatacacagaaaattgtaatttactttccttcaacttcaaagagagaatgtataaacgtgaaagaggatgggctacaataccagagtgtactgcagcaaggcgcagcgttggcgacgcatcgacgtcaacctgatgaaggggcgacggagaccggacagcaggcgatcgatagtgacttggatatgcacccaggccccagatcagacatgctattttgagcgggtgcatggtaataatggccagacctactatttcagtgaagcaacatataatactctatcttctaggaaaaaaacagagcaatgcaacctgggagcattggcattacctgccattcctaggttatcaaatagtggtggcaaatcgaacagaaagagaactgatagcttcattcaacataaacttgaaaaacaagtaggtatttgcaaaagggggcatgggcattcaatgacctcatggcgacagtgatgctcaaggcggaggaggtggcagtgcttcgatgcaggagtccatggctcgtcggcgtcccagatcagaaaagcaggggatggagtcccggaggcgaagcggagcagatcagtgaggcttgctgatggagttatggtggcgtggacgagatcagcgaggtggacacccaggcaatgatgaagatgcagtccttggcaagttacacctcaccaacgataccctaatttcaataaaatggagaacacaaatggatcaaatagcttgttctaatatgcaagatggaacacataaatattttgtcaaatatcgattgttttaaaactgtagtaggaaaattcattaggacaaattttatatgtctgccactgttcatgcttatgctctaccaactgccatttcgtcgcctccaatgcttacaggctcatggaaatcgaactatgacaatttgaaggatgtaaaaaaaaaaagagaaagaaagaagaattagaatatggctagagtttctccaggctctagtagtagcattatatcagaattcagattcttcatacatgtattttttttcctaagaaaacaacaaactgaaaactatgatgttgccctcatatattctttaaaattaatttatttatttttgtgcatgggtgttggatttgcctccaattttagtaagatcaaactaacaaaaagttcagttatgcctgagaaaggaaaatactaattttagtacgatcaaacgaacaaaaaaagtcagttatgcctgagaagggaaaatactctcgtttaacatagacatcatcagatcagaaacaggttaatcccccagatctcagtaccttcagtttgttcttagcgcatcatcagatcagcacctacactgtgccaaaaaaaattgagctaatcccagttttctttgaaacaggttaatccctcagatctcagtaccttcagtttgttcttagctcatcatcagatcagcacctacactatgccaaaaaaaaaattgagctaatcccagttttctttgctaactttatctgacaaataaaatgatctaaactcatatcacagtaataaaaagaccacaactaatatcaaaacttaaatcctaaaggttctaaacctaacgacatccaaattttttatcaaggttttgctaccctaataaattttactgattgaacactggatgtctagatcgtaactgctttcgatgcatagctgaaggcaatactactcaatgcaacggtagaaagtgtacattatagttaaaatgccagctcatgatagtgtataaagagatggggatttcggtgcattcacgtttgggaggggaggaaccgggatataaatttgcaatttgcagtgaataaagatgtactaattattggacgaggcattaccatcaatctatccagtctgcaaggtgctctaccattgttagactctcgtagtctcgttcccgctgtcctgcacacacgcaaataacaaagaaaaaaaatcagagaatggggattagactcaaggaatggagatc

SEQ ID NO: 10843 - DNA, 2479 bp, Oryza sativa
aaatgggggggcggggaggacgctgtgtcggcgacgcggtgggggaggacggcgatgggcgacgcggtggaggaggtcggcgatggcggcactggggttgacggcgtggtgggggagcgacggcgatggcggcgctggggtcggcggcgtggtgggggagcgacgcggtgggggagcgacggcaatggcggcgctgtatcggcgacgcggtgggggaggacggggatgggcgacggcggtggatgcgatggatgcggccgcggcggtggatgcgatggatgcgggcgctaccccccgatgcgtgaggatgagccgaggagttgggtggggaacgttgcgccgttggatttagcgatccgatggctcgtactccgcgtatctgccagggttggagtcaccgccaccgatacgaaattttaaaatagtagagatatagtaatatttttgacccaaaacaaaaaatattaaaatatatttaatgttacatttaatgaaaccagtttagcgttatagatagtgttattttttttctaaaactttattaaaaataatagatgcttgaaaagaatttaaagtgtcttgcaatacgaaacagtgggaataaataagttggaccgggcatgaatcggcttaatattatcatcaattctctggtgtaaactctcaatcctcttccctcaaggtaccaaacaagccataggcagactttacagcctccacgacacctcgacggcggcacgtggtacaccgtctccaccctcgatctccggccaccggtgcacgctaccggcggcgagctcgtcagctgggaattcgacctccacctctacaaatccacctcccattccaacgggtggatcaccaagcggttatgtctaaaggagttcgtcagagacaaggctatccctctacccaaatccgtcgacaggctgtaccacgagaccggcaagagaccatcgccgtcggcggcgaggccggcaccgtcgcgtttatgatctctctggcgcggcgtcttcctcgtcgacgagctccccgtgctctgggacatcccgctgacggcgccggcgaaggggaattggaataacttcctctaccaattcgatcctactccctggggatcctactatagtcgacttgcaggtatgcaacacattcatataaatgctaatgaatatgggcaatgctagaaagtcttataatatgaaacggaggaagtagctatttccgcgacgtcaccgtgtctcgaaacagacaagtatgttgagatggaaatctggtcacgaacagagccaatgaataataatcctaccccagtttcttacgtggattgggtgcgcgatctcaataaaccgaagaaattcaaagaaatcgatcgtggatggaaggctacaacatatagcatgccaatgccggtgaattgttcttcttcgtgctgctgtgatgatgattggcagattgactgtgaaatcgatgataattaaacacatcagcttaagcgacagctgtcgttctaatctgagctgcagcgacgacgacgaaaacagagagacaattgaaacaatattcaaaaaacttccaattggaaaccccaccataattaagcatggatgaagatgtgattttcttgctttctataactagccccatgaaaacggataggttggaagttgtgtttgctgttgatgtgaggaagggcatgcttcaaggattagcaaagcttgatgttcgaccgaagaacttggctatcatggtcaccttatgcaccagcgagatttgcaggtatctagcctgatgaatattattacaggtaacttaattctctacgctggtaattaactttattgtgtgtttttatgcgtgatcaatatgtgtgattatgaatgccatgcttgccaattaagatctagggaattattgtgttggtaattttctggtttcagtagggtctagagcttaattcagaagccatggcttgatgacagtgttatgccacaaaaagattgtatctgtctcgaagtacaccaatccgttacattctgtttgcccccttaattaacaatcctcttttgttggctacattgttcttaattagtgagacagtctgatgtgcagatgcacaataatgttctctcatttgaagaaaagaacaataatgcacaataatgctactttactcgcttggatccattttagttgagttgtatttactatttatgcaaacccaactttgatggtaaaatacctaaaattattatatgtacgtagtatgtgccccctccagttataaatatttaatgcagttgattttgatcataaagcttgatcatttatcatatttaaaagtttagtgtaaaaatatgcaaaaatatcatgtttaaagtacctttaacaataaaataagtcataaaaaaattagtgtactttttttaataagacaaattatcaaattttgttgtcaaagtcaactgcggtatgacca

SEQ ID NO: 10844 - DNA, 2318 bp, Oryza sativa
tttgggttctttgaatcaaacttcttgaagaattcagcaagggttgctagatgggcgcaacccataacctacctgcatgtctacgagtgtgacgccttctctgtatgtggatgtccaaatgttcaatttggtcatcttcttgtaacacttctgtgacagagaatactactagaagttaatgaataattggatatcttctctgctaatctgcaattgcttcgtgtttgttctgtagattggaatattctgcttaccaacatcggcggttattcctctccatgatcatccgggaatgactgtgttgagcaaattactctatggttcgatgcatgtcaaatcgtatgattgggtagagcctgctgttctagcaaatggcaagccaggttatttttcataccctgtttcaaatatttgtttttatttatctactagtatatattgcattgcagagtgatgacttaatgaactcgttgtctctgagaatacaagtgtactgaaaacatttatttcttcagatggtttctacagtaccaagttaatgaacaatattggttgtagcatagtaatagtattgatactacccaaccctattggtcactagtgttgcactgttgctcaggcatcattttagattgctcatttctatgccttgatgatttttcgggttctggtatattaaggattttttttctttctcctgatgtgcagtgaaacttggaaagttacatacggatgatgttctgaatgccccttgtccaactgctgttttgtatccccaaagtggtgggaacatgcactgcttcacttcagtaaaatcatgtgctgttcttgatgtcattgccccaccatactctgaatcatctggccgtgtttgcccctattttcatgattatccattttctagcttctgtaagtgaaatccctcactgtcgtcatattacatatttctgtcaggttcatgtttaactaaatcttttggcggaagcagaataccagccatctctggtattggctggtagttgttcaaaacatatattattagtcacaatgctgttcagatcttttctgtcaagaacagcaattaccttatacattatgttcattttatatgagaagaaaacttaatttgttgatatattgtcaaaacacaaaagtgatcattttcactatgctatatcatgtttgatttttctcacggatcactccaactgcagcagctggacaagcaaaagtagtccatgggccagataattatgcttggcttgaggccttaaacgtaccggtgaatattaatatgcgccctggcatgtatactggcccaactatacaggtatagcctaaatttctgcattttgttgatagtcttctgtagcaaccaaaacatgcttgagagttgagactgtttttctgatggaatatttgtctttttgctaggaacatctgccataatcaataaaaatgggcaggacagagcgtcaaactgtgtccaagtgccatctcacaaatacagttcttatcatgtagtgatgtaaatgtaacatgttcatctttaacttttgatttatgttgtccttcattgaaaaggtgtggctataatggtgacatagtcaaaacagtttgtactagccactttgtatcttagttaccaatctgcaaattctgcattctaaattgcttctggagatattgtaaatgtatttatgttaatgcctacatttttctttctatttctatgccttcagagaggctggttgccatggtgtcaatatggtctggaattcaaatattcaacaacccttgttaagatggtagttgagattcaatcaaaatttttagattattgtgctccattttgtacctgttctttccgtatttttattgggattacaaagcaaactcaatgcagttcaagaaagagttaaagtgtgaaactgacaagctggcagctcaaaaagtactggcccaatatgtatgggctgaacatgaactacaacactgttctggcccaatatatatgggccgcatgtgagtcacattactcttccgtcgttcaagcccattaatttgggctcagcacgcaggacctggccttcttgggcttcttgcgggaagttcaaatttttgcaccacattggcgcgggcgccactatacatgaaagctacgtgaattgggacgtccacgcacgatccgacggccatcattacatggcgtcttcagccgatggcaagctatgctcaggcaggtctgaccgtctgagatatagggcgtgtttagttcacgttaaaattagaagtttggttaaaattgaaacgatgtg

SEQ ID NO: 10845 - DNA, 3372 bp, Oryza sativa
  unsure (1)..(3372): unsure at all n locations
nnnnnnnnnnnnnnnnnnnnnnnnnnnnnnnnnnncaatcttttcaatactatactttaactactactgttttctttcgtttattatcaatacctacaaaatcaacgccatataaaaatagtcaaataaaaatctaacaatactactttattatataatgatataaaaatcaaataaaaagtcataacattaatcaaatatccaatcataccaggtatgcatatgtacaaattactccctttattttaaaatgtattgagatatatataaatataattaccttttcaaacaatcttttcaatattatactttaactactactattttctttcgtttattatcaatacctacaaaatcgacgccatataaaaatagtcaaataaaaatctaacaatactactttattatataatgatataaaaatcaaataaaaagtcataacattaatcacatatccaatcctgtacttttaatccattcattagacaagattttatgttttgatttttctcaaaataaaaatgccttatatattttaaaatagacggagaaacaagttagtatttctttatcatacaataatactctattgtcataaatatataacgtttgttttttcttgagcaaactttcgaaatttttcccatcaaggagatctcaacggcagggcactgttggcctgacctatatatacacatcttttaaacgggtcttaagagcctcgcaacgcgtggcttatgtggctagtttatatgaagccatgaagcccccatttccattaccagaaatgagaagttctacagttcttaaacctccaaaacaagagccaagaacagctacagttcaaactgccagcacctgaagaccctacaaactaaaacgagctactaacctccactgcatgtgtggagcaaaccagggccaaataacaggagctagcaactcaagccatcatcaacaaaacccaccacccaactgacaacagcaagcacgcagaaaaaacacactcaggttctggagacgctgagccacgaaaatataaagtctaggaaataaagtggaatagtttattataaacttgcaggtaggtctgaggaaataaagtggaatagtttattactaccatatgacttgacagcaaattaagtcttaacatcaataacagctttctccaaaatgacatacatcttccctcccaaaataaatcaactaatcaagacatagccaggatttgaatctttttgagacggagaggatgcataccaataaagtggaaacaaagtggagtatatatcaacctgcatccaaacgcttatatttcatacaaacagcccttcattggcaggacatcctattaggtaaataataacatcatataaggatcaggttgcatattttgaagaacctgatgaattgctacaagcctacagcagttttaaattttcaaatgacaacaaaatacatctactggacctagtttgtatgtatgttgtgctctgactgtttcgtgcctactacaatagcacaaaatggtacgctaatgtatacccttaagttctttaagaatcattgtacaaatttcttccgtgttgattggtaggaagagagaaaaaaaggaatgtatccaaggagagctggccaactcataggagaagtgagagctcatttctcctgtatcacaactcagtctcacaagcatatgtaataaccatcagcatgttttgtgcaattgtgcttattacagatttatgcattagcaagctttggaataggtattaccttcttcagaaatctgttcaaaacagcccagcattcagtgctatgaagcttctttagtcgagattgatgatgtctcaacatcttgaggacctcctgctgctcgttccattggggtttcactttgagcttatgattattatatgcaacaacacctgctattgctccagattgcagaaaagatggtgtaagagaaattaatgggctcaaacttgaacaagggtgtaagagaaaataaagttaaaccaataagagaaaaaacagtataatatacctatcaaataaccaattatatttataaaggtaagctgtgtatctgcaaagatagcagctgacagcaacaccacagtccaatccctcacaattccagtaacacgagctgtcagtgcactagttctggaaatgacaaggaagactgagggatttagggtgaaagtgcatatgcagtttaagaacaattttcaagttaattaattatgagatcaagtggtcaagatatatgcaagggctcacatagtacatcatggaaatcaagttaagcctctccctttttcttcagaaaaatctcatgaagatcagtctaagggcttctgtgacgattccacccatctggtaaaccacacagatcaagctgattgtattttcaccaacagatgccacaataaccccaatgctgatgacaggcatgatagcaagcattttacagctcgacaggcatgatagcaagcattttacagctcatttcttcaaggccaagggcagctccgaggagaaacacagctactacaatgctcaaacaaagagtacattaacatcatattttaaattaatagaaacctataacttgatcaaaaaccagagagctcacatacttatttccttcaacatctgtgcaaatgcaacagatatgtaaaggtacgcactgctccctagacagtgtgtcattgaaaacattgctccaattgcaatgaccgaactaacatatctgcaagtccaggtgtactggttgaattagatagaaatattgtagagcacctaaacatgtgctgctgggtagctacaaccaaatattgaaaatcaaacctttccaaaagagtcgacgccaaatattgctgtgtgtggagattatgggtaccccatacccacacggcatggttatccgactagttataggggataacttgtatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcatacatgagacaactagatcgtcagatctataatacacccggcggattcaaatccccaaacaggagtagggtattacctctcattgagagggcctgaacctgtctaaatcctttgtctccacatccatccacttttaggtctcgtgcgctaccccgttttattattgccgaaatcatgtttcgacagttggcgcgccaggtaggggatgcgtcgaattacccgtcgaaaagtgagatggaatc

SEQ ID NO: 10846 - DNA, 1421 bp, Oryza sativa
  unsure (1)..(1421): unsure at all n locations
agatatgtaaaggtacgcactgctccctagacagtgtgtcattgaaaacattgctccaattgcaatgaccgaactaacatatctgcaagtccaggtgtactggttgaattagatagaaatattgtagagcacctaaacatgtgctgctgggtagctacaaccaaatattgaaaatcaaacctttccaaaagagtacaagccaaatattgctgtgtgtggagattatgggtaccccatacccacacggcatggttatccgactagttataggggataacttgtatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcatacatgagacaactagatcgtcagatctataatacacccggcggattcaaatccccaaacaggagtagggtattacctctcattgagagggcctgaacctgtctaaatcctttgtctccacatccatccacttttaggtctcgtgcgctaccccgttttattattgccgaaatcatgtttcgacagttggcgcgccaggtaggggatgcgtcgaattacccgtcgaaaagtgagatggaatccacttcagaagaaacggcgagatcaatctcaccgaattcgatggctcgaactttggaccgggtttgtcgttccaatctattttttattagattaattttttttctatcatagatcaatcttctggtatattttcctgtgtcgatcttgtgtcggtcggcggagatcaagccgaagctgtcgacgacgccctcacgcatcgagactttcttcgtgctttgccggcggacatgtggtggccatcgctgggcacagtttaccaggagaaaacactgcatgagttgattcaactgatcaacatacatgcacgatccaaccaacatgcacattacatctacagagttaatctgtttactagttgattctaaccagcaattattttgttgctatctgtcttgcatgtacaccgccggccgtatctactgccggctatatccgtcagcgccgaccggctccaccgtctccgtagtcggtcgcctccgagctgttatcattaggctttacagctgccccggtcggtcatctacatgctgccgactctccgaggtcgcagggccgttgatggcttccgccggctactgctgatcgaggcattgcgacccaagctgatcgacgcgcacgacgtatccaagccacgccgtacaacttgggttggctgttccaatttaatttttattagattgattatnnnnnnnnnnnnnnnnnnnnnnnnnnnnnnnnnnnnnnnnnn

SEQ ID NO: 10847 - DNA, 794 bp, Oryza sativa
  unsure (1)..(794): unsure at all n locations
cgccatattccgtaagcaccgtcattgttgtcgagagagagaaaatacaacgacaagtatactacgtcagcgaagctctccatgacgcaaagacaagatatccgcagattcaaaagctgctctatccagtaatcatgacatcaagaaagctacaccactactttcaagcccacagagtcacagttgtctcctccttccctctcggtgaagtcgtgagaaacaaagacgttgtcggccgcattgcgaaatgggtagtcgagctaagctagtttgatgtccactttgtgccacgaacaaccatcaagtcccagatactcgccgacttcgtagctgattggactatgcccgacaacaaatcagacaaccaaatcgacaacgaaacgtggacaatggcgttcgatggtgcactcaacagccaaggagcaggggcaggattcatcttgacatctccttctggagatcaattcaagcacgcaatccacctcaacttcagggcaaccaacaacacggccgagtaagaaggactactcgccaggataagagccgcaaccgcatttggggtcaaacgactgatcgtgaaaggggactccgaactagtcgcgaaccaggtacacaaagattataaatgctccaaccccgagttatccaagtatctcgcagaagttaggaagcaggagaaaaggttcgatgggatcaaggtccgacacgtataccgcaaagnnnnnnnnnnnnnnnnnnnnnnnnnnnnnnnnnnnnnnnnnnnnnnnnnnnnnnnnnnnnnnnnnnnnnnnnnn

SEQ ID NO: 10848 - DNA, 9668 bp, Oryza sativa
aacatatattattagtcacagtgctgtcagtccttttctgtcaggaacagcaatcaccttgtacattatgttcatttatatgagaagaaattttaatttgttgatatgttgtcaaaactcaaaagtgttcatattcactattctatgtcatatctgattttctcacggatcactccaactgcagcagctggacaagcaaaagtagtccatgggccagataattatgcttggcttgaggccttaatcgtaccggtgaatattaatatgcgccctggcacgtacactggcccaactatacaggtatggcctaatttctacatattattgttgatgttgtcttctgtagcaaccaaaacgtgcttgggagttgagagttgagagttgagactgtttctgatggaagtaatatttgtctttttttctaggaacatctgccataatcaataaaaatggataggacaggagcatcaaactatgtccaagtgcaatctcacaaatacagttcttgtcatgtagtgatgtaaatgtaacatgttcatctttacattttgatttatgttggaacttccttcatagaaaaggtgtggctatagtggtgacatagtcaaaacagtttgtactagctactccgtatcatagttaccaacctgcattctaaattgcttctggagagattgtaaatgtatttatgttaatgtctacatttttctctgtttcgatgccttcagaattcagagaggctggttgccatggtgtcgatatggtctgatattcaaatattcaacaaaccttgttaagatggcagttgagcttcactcacaatctgtggattatggtgctccattttgtacatgttcttttcgtatttttattgggatcacaaagcgaactcaatgcaatttaagaacgagtgaaagtgcgaaactgacaagctgggagctcgaaagtccattctgggttctggcgatagtgttgggcttgggtaggaactcatcatgggccatctataactattcgggcccaatatgtatgggctggacatgaactataatactgttttggcccaatatatatgggccgtatgtgagccacattaccattccagacggcgcagccgcgttcaggcccatagatttgggctcagcacgcaggacctggccttcttgggcttcttgcgggaagttcaaatttttgcaccacattggcgcgggcacgtgaaagctacttgaattgggaccgtccacgcacgatctgacggccatcattgcatggcgtcttcagctgatggcaagacacgctcaggctggtctcagatatactagatactagtactagattagcagctactagtagctaatttttgttaaaagaaaaaaagggggaaaaaagaggcaaaacgtggtaacatggattgagcagtaaatttgcaagaccatgaagcacccattttcattaccagaaatgagaagttctacagttcttaaacctccaaaacaagagccaagaacatccacagttcacactgccagcacctgaagaccctacaaactaaaacgagctactaacctccactacatgtgtgaagcaaaccagggccaaataataggagctagcaactcaagccatcatcaacaaaacccaccacccaactgacaacagcaagcacgcagaaaaaacacactcagattctggagacgctgagccacgaaaatataaagcctgaggaaataaagtgtaatacttcctccgtttcacaatgtaagtcattctagtatttcccacattcatattgatgttaatgaatctagacatatataccgtttcacaatgtaagtaattctagcatttcccacatttatattgatgttaatgaatctagacatatatatgattcgacagcaaattaagtcttaacatcaataacagctatatgagggagtagtttattataaacttgcaggtaggtttgaggaaataaagtggaatagtttattactactatatgatttgacagcaaattaagtcttaacatcaataacagcttactccaaaatgacatacaccctccgtcccaaaataaaccaactaaaataaatcaactaattaaaacatagctaggatttgaatctttttgggacggagaaggtacataccaataaagtggaaataaagtgggtatatatcaacctgcatccaaacgctcatacttcatacaaacagcccttcattggcagggcatcctattaggtaaataataacatcgtataagaatcaggttgcatattttgaagaacctgatgaattgctacaagcctacagcagttttaaacttcaaatgactacaaaatacatctactggatctagttggtatgtatgttgtgctctgactgtttcgtgcccacaatagcacaaaatggtacgctaatgtatacccttaagttctttaaggatcattgtacaaatttcttccgtgttgattgatatgaagagaaaaaaaggaatgtatccaaggagagctggccaactccggcccggctaaaaaaaaaaaaagagctggccaactcataggagaagtgagagctcatttctcctgtatcacaactcagtctcaagcgtatgtaataactgttagtataatccttgttctagttagttatttggtttccttagacagtaagctataggctgcagctgttactcggttgtcagactgctgctattagtggtagtagtcaatttttattttacctctagcaggaacatagcagcagcagtattgtcggttcagcaaccgacctatccatgtactataaatatagctattgtgctaacataagtaagctttttcagctcattttcagtttcagtttcagctagactattgagtgtagttcagaagtgatcctaccaacaattggtatcagagctcaggttaaagaagtgtgagagagatggagggagtaccagctgctggagccaatgcttccaggtcgccacaacaccgcggccgccatcactcgttatcgccaacaccacggcgaggacgaggtcgaggcgctgctgttcgagaggttgttgtgcagcggactgtcagggaggttggcggcgctgctgctttccccaccctcacgcgaaccaactacaccgagtggtcgctgctgatgaaggtgatgctgcaagcccgtggcctttgggacgcggtggagcatggtgaatgcgatgagcaagaagacaggatggcaatggaggccatcctacgcgctgtccccagcgagatgatctcgctgctcgccaccaaggactccgcgaaggacgcctgggatgccatcaaagtgatgcgcgtcggcgtggaccgcgtgaggaaggcgaaggcgcaacagctgcaccgggagtatgaatccatctcgttccatgatggtgaatcgatcgacgacttcgccctacggctcacaagcctagtgtctcagcttgggacattaggagaacgaatcgaggagcagaacgtcatcgagaagttcttgcgcgtcgtcccagagcgattttcccaaatcgctgtgtcgattgagaccctgttggatctctcgacactcaccatcgaggacgtcactgggcgtctcaaggtggcggaggaacggcgaccagctccaacgtcgacgactactccagccggaggccagcttctcctcacggaggagcagtggctcgcacggcagaaggagcgacaaaaaggggagcgatcctccaagcagtcgcaaggtggagctcgtcagcgacctcgctcccatcgcaagaaaagaggttttggtggcggcgtaggaggcgagaaagggaacaccaatcgggacacggcaccaaacagatgccacaattgtggccgtcttggccattgggccaaggactgtcgccagcccaagaaagaagccgctcacctagcccaaggtgatgacgatgacgacgtcctgctgctttcgcgggcatgcgagcttgaagatgacgatgccactttgttgatggcccacgcttgcgagctcaatgatggccccatcatcgcgccatctcctgtctccctcgttgaaccgcgagtgcaggtgagcctaggagccacggacgctgaggacaaggaggcgtggtaccttgacacaggagccaccaaccacatgacgggccgtggtgacgtctttgctgagctcgatcgaagcatcaccggcaccgtcaaatttggagacagctccatcgtagacatcaagggtgccggtaacgtcatcttcaccggcaagaatggcgagcacaaggttctcagtggcgtctactacattccgcgcctcaagagctcaatcatcagcatcggtcagcttgatgaaagcgggacgcgtgtgctggtcgaggacggcatcatgcgtatctgggaccgccgccgccgccgccgtcttcttgccaagatcaagcggggacgaagccgtctatacgtcctccgcctcgaggttgctaggccgatttgcttggctacgcgacacgatgatgttgcctggcgctggcacgagcgcttcgggcacatccacttcggctcgctagagaagatgggccgacaagagctcgtgcgtggcctgcctcgactggagcatgtcgagcagctttgcgacacgtgtgtcatcaccaagcatcggcgcgctgcctttccaaaggcagccaagtaccgcgctcaggagccgctagatctcgtccatggcgacatctgtggccctatcacgccggcaacgccaagtggccggcgttacttcttgctgctggtcgacgatgccacacgatacatgtgggtggcgctcctagcagccaagagcaatgcacctgacgccatcaagaaaattcagatggcagccgagactcactgtgggcgcaagctgtgtgtatttcgcacggacaacggcggcgagttcacgtcgcttgagttcgccacctactgcactgatgagggtatccaacgtcatttctccgcgccctacgccccacaacaaaatggcgtggtcgagcggcggaatcagacagtggtgtccatggcgcgcgcccttctcaaacagaggggaatgcctgcggagttttggggggaggctgtcagcacggctgtcttcctcctcaatcgtgcaccaaccaaaagcctcactggcaagacgccgtatgaagcttggcacggcaagaagccgatggtcagcttcctacgtaccttcgggtgcctggcgtacgtgaaggagctaaacgatgtgcgcaagctcgacgaccgcagcacacccggcgtcttcattggctatgaagaaggggtgaaggcatatcgtgtcctggatccaaggacacggcgtgtacgtctcgcccgtgatgtcatctttgacgagagccgtgggtgggactggacggcagcaagcggcatagatgctcgaccgagcagcgatttcgccatcgagtaccatgttgagaagaccactgggcatcctatccctagtgtggggggaggcgtggtgaccccatcagcatccccaacgccactacaagagacttcaccagcaacccctgccacaccagcaccaagtcctagcgttgccccaacagagttcgtgtcacctccctcacacgacgaggagaggatcgacgcggcgcactccaacacccctgtccgctaccgcacagttgacaacttgatcggggagaatgccccggcaccagggattgcaaaacgggaactcgaggaggcgtctttgctcctcgctggacctggtgagccatgctcgtttgcagaggcggagggtgatgatgcatggcgagcagccatgcgtgaagagatggacgcggtgaatcgcaatgggatttgggagcttgttgatctcccacatggccatcgcccaattggactcaaatgggtctataaattgaagaagaacgaggccggaaaggtggtcaagcacaaagctcgtctcgtcgccaggggatttgtccagcaacctgggattgattttgacgaggtgtttgcgcccgtcgcgcgcatggagtcaattcgtctcctgcttgcggtcgccgcccaaaaagggtggcacgtccatcacatggacgtgaagtctgcctttctcaatggagatttggcagaggaggtgtatgtgaagcagccccctggttttgtcgtcgccggagaagaagacaaggtcctccgcctgcgcaaggctctttatggcctgcggcaggcgccaagagcctggaatgcgaagcttgattgtactctgaaggagctcggtttcgaccaaagcaagcatgagcacgccatgtaccgacgaaacaatggtggctctgctctactcgtcggggtctatgtagatgaccttgtgatcaccgggccatcgacaagagcaattgaacaattcaaggaagaaatgaaggcaaagtttcagatgagtgatcttggcttgctctctttctaccttggaattgaggtgaagcaaggagatgatggaatctccctgaaccaggggcgctatgctcagcgcattgtggagtcggctggcctcaaggactgcaacccttgcgccactccaatggaagaaaggctcaagctgagccgtgatagcacggcacctcccgttgatgcaacaaaatatcgacggctggttggtagccttcgctatcttgtgcacacacggccagacctagcatttgctgttgggttcgtgagtcgcttcatggagcggccaactgaggagcacatggtggccgtgaagcgcattctacgctatgtcgctggcacgatggagtacggacttcattacaaaagggagaaagaggagcagcggctgattggttacagcgacagcgacctcgccggcgacattgatacaaggagaagcacaagtggcatgttgtttttccttggttcaagcttggtgagttggcaatccatcaagcagagagtggtggctttatcttcctgtgaagcagaatatgttgcagccaccaatgctgccacacaaggaatctggttggctcgattgctcggcgaacttcttgggaagcaacctaaagcgatcgagctaaaggtggacagcaagtctgccttggcgctggcaaagaaccctgtcttccatgagcgcagcaagcatattgatttgcgctatcacttcatcagaagctgcttggaggaaggaagcatcagcgccagcttcatcaccaccatggaccagctcgctgacattctaacgaaggcattggggcgagttcgattccatgagcttgttgcaaggattggagtggtcaagattagttcagaatagaagaacaaggattaaggggagattgttagtataatccttgttctagttagttatttggtttccttagacagtaagctataggctgcagctgttactcggttgtcagactgctgctattagtggtagtagtcaattttgattttacctctagcaggaacatagcagcagcagtattgtcggttcagcaaccgacctatccatgtactataaatatagctattgtgctaacataagtaagctttttcagctcattttcagtttcagtttcagctagactattgagtgtagttcagaagtgatcctaccaacaataaccatcagcatattgtgttcaattgtgcttattacagatttatgcattagcaagcttcagaataggtattaccttcttcagaaatctgttcaaaataacacagcatttacgattgatgatgtctcaacatcttgagggcttcctctgttgactttgctatcagcaccctgctgctcgttcccatgggttttcactttgagcttatgattattatatgcaacaacacctgctattgctgcagatcgcagaaaaaatggtgtaaaagaaattaatgggcccaaatttggacaagggtgtaggataaaataaagttaaaccaataagagaaaaaacagtataatatccctatcaaataaccaattatatttataaaggtaagctgtgtatctgcaacgataagagctgacagcaacaccacagtccaatccctcacaattccagtaacacgagctgtcagtgcactagttctggaaatgacaaggaagactgtgggattttgggtgaaagtgcatatgcagtttaagaacaatgtgaatggtgggaagttctatgagactttcattcatcttgggtgctctaaataaagacacacaaagtgcaggaaaacaatatgataaagttaaaatagcaaacaggtttgaagttaattaattatgagatcaagtgggcaagatatatgcaagggctaacatagtacatggaaatcaagttaagcctaacacccttttttttttcagaaaaatctcatgaagatcagtctaagggcttctgtgatgactccacccatccggttaaccacacagacccagctgattgtattttcaccaacagatgccacaattaccccaacgctgatgacaggcacgatagcaagcatttaacagctcatttcttcaagggcaaaagcagctttgagaagaaacacagctactacaatgctcgaacaaagagtacattaacatcatattttaaattaatagaaaccagagagctcgcatacttatttccttcaacatctgcgcaaatgcaacagatatgtagaggtacgcactgctccctagacagtgtatcattgcaaacattgctccaattggaacgaccgaactaatatatcttgcaagttcaggtgtactggttagaaagaaatacatttctgggtttctgatactcattattaacaggacaagcaagcagtatgccaggagttcagcgttacatgctagttaataaacaaatagtgaaatactttttctgaaggaacaatggcattgaattagatagaaatattgtagagcacctaaacatttgcttctgggtagctacagccaaatattgaaaatcaaacctttcgaaaagagtacaagccaaatatagctgtgtttggtggatgttagttgtgttaacttcagggggaaaaaacggcaggcagttgtggtaactcaactgttcaacagtcttctgtcaatgtaaaaccttcattatctaccatgtaaaactatctcccaatcctaatgtaattagtcagcctactttggctggcccagctaaaaaaaaaagagtgcaagcaagcctactcattacactattcagaattaagaaacatccacccaatcgagatccagggactaccaaatttcaaattacttctattatgttctataatcgtatgcctcttgacattaccatatgcatattcagttgctgcctcagtcagaatctttacaaaaaaaatgtgaaacccgctcaattagttgaaatcttaagcataaagttttttttttcattaacaacaaacagcataacatttttttttcctgtcctaagaggaggtttcaagaaacagctgtctaactgttgtccttttttttttccttctctaacatgagatgcatgtatctattttgacaaaatccaacaatgtcagcaaggatataataatacgtcttcaacatatacatataaatgcataaactacattcctgctttcttctatcagtgaaatggcagagctccaacccattccctagaaaaaaataaactatattcctga

SEQ ID NO: 10849 - DNA, 29444 bp, Oryza sativa
  unsure (1)..(29444): unsure at all n locations
nnnnnnnnnnnnnnnnnnnnnnnnnnnnnnnnnnnnnnnnnntcagcaaggatataataatacgtcttcaacatatacatataaatgcataaactacattcctgctttcttctatcagtgaaatggcagagctccaacccattccctagaaaaaaataaactatattcctgatttgttcagatgaggagagacagacttgcaaatgctttattcatgctgcgatgggtcatggaacatgatatactgatgaaatactactgtgcaaataagaaaaatcatacactgttcatgactcgcatattggtagtcattccctcctcaatctttccaatctgggaaatataaggttatcagtatttgttgtaacatctaaggcagtgagcaagacctagtcaagcggttcaattttagctctgataagaaataagtagatcaatcatatgattgcaagcaactttccagtcccattatctccatttccgtccgctccaccaactccagcaacaagaatggacgaaggaaaatcagatgcctttatgattgtatcaatagtctcttgcaaatcagtcatcgcaccaccctggacaacaaagggaaaaacattgacaacatggaaacatgggttcagcgttatacatactgtgactattaacagaacgaagtatttctgctgattcatggcaagtgattggtttgctattgcagtagtagtgctaattactggacaaaatagtgttggccagccaatgatacattacgaagtgcactgatataaactgacataatcccttgtgttccttcaacctcaggaagtttaatatagtcaggcactcggccaataggcaaacagctaacatataatttcaagaagcattttaaaagcacaaaacactaagtacataatttcttacagaagaaaaggaaatgttctgtaaaccaaaataagatgggtgagaaaaggaagatttccacgtttgcttcccagatgtggtacttagaaattcttctacagaagatgtcatggtgattaaggtagcaaagagtaggatacctcaggttgatagatgctgccattcaggttgaaacagtggaaataggaaacaggacatcaataggtctagctccaaagcccccataaggggaatcgcttagcagggtcatagcattgtagtgcatctctgtttccagtactgcgtgccaaccaacaaaaaaacagtggaagtacttaaatcaatgttgtcatatgaccatcagaacacaagaactaagagattgttacaaaccatttggccgaccagtgggttcgatgtaatgcaaggaatctggaagccatgggatttccatttgaagctacagagcacaaaacatccaagatttcaaggcaacgacttcaagacagtatgcgtttatcaactagagagctgacgatgaaatagtgggagggccagcaagaactagcacacctgtgaagtctatggctaccatgaaattcaattgacacccccctaatgagagagcacaagttagcattagattttgtccttaagaaaaaaagatagaaactcgccaccgctgcgcgcgcacacctaacctgcgccaaaaagcatgcgggtgctgtggatgccgcgcccgcgcggcgcggcggtggagctgagcgccgccgcatggctcgccgccccccgccgcgaggagcagcaggctcaattagccggctagccaacggcggccgcggcgcgaggcagggtgagccggtgaggccgcggcgcgaggcagcccgtggcagtggagcggagtggccgccggtgatcgccggcggcgtaccacccggccgccggcgagggttttgtggatggggtgcggcggtggctttggtcggtgggtttgccttgcctttgcctcgcctcggggagacttggaatgggagggagtgggccccactctctccctctctctctccaagagagtagtagtagtagtaggacaaaacaaatataatatttaaaaaaaaacacagagagagacgtacatcaccacccttggccttggccggcatctttcgcaacaccaactccgcctcgcctaaaacccttcctcaatctcttcttctccggcgccggcgacggcgttgcaacttcaacgatgggaagaagaagaagatcatcaagctagtttttctagatcatttccacggccctatccacagtttcgtcaccactctctctccaatccagtgcttgaacacagcaaaagctcctgctcgctatatctatctactccgattcaaaccccccaaaccccttccgatcgatcccttgctggtaggggtgaaatcgggtcgggttcggtcggatctcatccttcccatatcctaacccacattttataatcggaatcgggtcgggcacggatattatcggatacgaatagaagcacggataatatcgggcataaatacggaacgaatacgtaccaagacggatacgaactctatcggttacgaatatttattcaaatatcaagtcaaagcaacaaccaaatataccacatagacaatagccattcagccatttcctatatgtctattatgaatatattaggggcttatggcatcataatgcctatcagcaaaactgtaccaaagtagtagcaaaagtagacattcattgcttgatagcttcagactcaatgctgtactgatctgaactgtgaagtgaaggctagggtttgtgcttggcactttgtttggtgggccttttggatgtgggctggctgttgcctgttgtgttggcctgttgggcgcttgcctgttgggctgttgtccatctatccgagtaatatacggatagattatcgggtaatacccgcataatttcccggataatccgtatccgtcggataccgctctcccgaacccgatctcatatccgcaaaaaattacccgtattcgaaccctgtatccgtgtaagggtccgggtacccaaattcccgacccgaatttgacccgaaataatgtggccgggcgggcggtcgggaaatacccgccccgttttcagtcctacttgctggtacgcaaaaatgcctccaacgaagaaggacaagggaaaggaaaagattaaggaggtagaatgataatttttttaaaaaaagcttcatgatctttattttttttctgtttcttcgcgcggtagcttgatgtgtgtttggtttgtgcatttgaaattttgcgtgtttcttcaacagcccaagccatcggatgatttctacttggatctgggtgatcttcctaagagctatgccaatctaatgaaagatattcctcgtcgcttggaagaaattatcaaagctgaggcgccctccaccagtaaggggaagaagctcttcaagaaaatctcggggaagctatatactgcccagagtggcacatttttggttcatctcacgcctgataaggatactgcagattctggaagagtgtctctgctattccgctggaaagacttgtatttcgagggattttactccaagggtacgtattacggtatatctaatctactcgctttatcatgcattatattactaacttattaagaacactagccatactgcctcttgcttgctggatgtgccaattgttgttggttgatttggtatgtatagtgctaacacatggagaatcggagacgcacgattgcaatggcccttgtccaggagtgttcatgcatatgcaccgcttttgtctggaattgtttcgaattgggaggttaaatcgttgcaaagttggagtactacaagtatttgaggcctggaatagttttgagtttccaaattaagggttgtagttctatgaggcatgattaatgctgtagagacttgcattagcattctgacatgaaggatgcaattaatcatgtgacagtactatatatatactcttgcttgcatgcatgcatgcatatgtcaattgtggttggttgcatgcatatgactctcactgctgggctacttactagcacactgacacactggtgtggaggagcattgcattgcaccacacccccttttgtcaatttggagttaatttgtttaatttgggaggttaattaaattgttgtacattaatgtgtacaatattgtgttaattgccctatctgttgctttcgcagggatttggttcaggctacaggattttcaggcagaactccctcctcagtctcagttgccatatgctgccaagggtgggaaaggagtggtgattctctcaatcgaatctaactatgcagggataggaggaaataccatatacatgggctctgatgcattcgacaaatgtctgaaagcaatgctgagagcacctgacctggaaggtcataggctctactcggttctaaaatcaaacagagttctagctgtccctgttgtaggaatatctgaacctttaaggttccctcaattccaggaatgggttctctcaaccctctcaccacctcctaccgatgctgaccactcctcgtcgtctgatgatccttctcctggaactgatgctgctgaatcgtactctgctggaatgggtacgggcagggacaagaaggttcctgagaaattctccttctacttcacaaaatggggcacgctttctgaaggattgttgaacaatagtgttccagaagaatttagcacgatgtccattgatgagatggctgcacttcttggcattctccgatggatggaggggatgtcattacctgcaccaaggagtggaactcatgatagtgaggcctccagttccagaccaagcagggctaccaagggtaagcataataccagtaaatagatgatagctaggcacaagatgtcaatctggaaagagtttgaagctggttgcggacaactaaggttgatgtttcgatcaggcacaaacgtgcttttgtgattgagtgagaacatatgcatcacacgtactaagttttcaactcaaaatacatgcaaataagttgtaaaaaatattgttcgaacatggtaatttgcgtgtgttttttattctttttatgatgcattttgagacaaaattttaaatgactgtgcatatcatcattgcaatctcagattattttttcttacaacaaaagagaatggcggacgcgacagggggctgcatgacccacgttaatccgtcttatatattactctctccgttttaaattataaatcgtttttaattcgattagaatcaaactattataagtttaattaaatttatacataaatataataatatttacaacaccaaattaattttattaaatctgtaattaaatatattttcataatatatttattttgggttaaaaatgttattatttttttcaataaatttaattaaatttaaaataatttaactttaacaaagacaaaatgattatagtccaaaacgagggagtactagttaattatctgagtaattaagcctactaatccactgcgcgctgttcacgtacgtaagccatgaccaccagtccgagtcttgcaagcaggcactaggcctcacccatatacgacaagacgttagttagacagtttggtgaatttaactaaactaaatcatttctttgattacttacagtaataatggtaatttaatcaaccaataaaagccctgatataaagccctcatgaattttagtccccatggtataatggcgaaacatgcccaaaccatctactctagtcgatagtattgtgttactagtttatttcataagcacacctatatttaatcatgcatgtgtgttcagtgttcgccacttaaaaggatgaccatttaagcgcatgtttatacattaatataaacacttcctgatccttttcaagtaacgataattaacctttgtcgtaagtagcattttttttactactattagtttctataaatccatatagtgtaacattataagatttatatttctaaaattcactagaagaaatttttttataatgtataattaaacaacattgacctgatcgatttgccctattaatctttagttatttgagtggttttacgtgtaatttcaaggttgttttgaaaacacccgatccactttgaaatctaacaaaagcgatatagatacctatacaactcaccatatatatatatatatatatatatatatatatatatatatatcttaaactttaacatgcaaaacatgtaatatgacatcttaataaagcacatacgcattacatcatcatccacgtttaatttccttctagtagctagcttaatttcacatctagtactacgaccttccatttcaaatatacgtaatattggattagcatacgtacgtaaatattaggggtggttggatgacctactagctagtagttctaaaagctaagcgaataaatatgttttcttgaatttaacacaattttattataattgactggcataagagagaaaatatagaaactgatttgatttgatttgaatgtctaaaacaactttatatttgtataagacttagcaaatctatgaaatcttgatgaggggatcggagactaaagtacatgcaagtcacttgagtacgggcaagtgcaatgtaagaataacaattaattaaggaggaaattgataatattgccactcgatttgttgggcttttcaccctctgcgtaaggaggatttgagccctttttttcactgattagtcacatatgcatgaaaggaccaattaccaatgactaccgttattagttgcgttaaactggtgtcagttcaaaaaaccggcacctataggagctttggaaccggcatcaataaaaatttttctactagtgatgcctgttcgatcatccacctgctgccattagcaccagctaccgactaggagaagcggctaagtgctaccgtcttgaagcaccctgcccttcaagctcctcaatattccccccactcccttctaactgagctccacttattgtcagaagaacacaaggagaagaagcaggactattgtcgatcaccccaagttcccctcccctaaggatgttgagatgcgccaccaccgtcaagagaaacaccaaacctcacaggcaggggtggatctaggatttgcttggagggtggactcatcctcttcttctcctttcagcccccctactattattcccccttccctctcatcttctttccgtggggatccaacggggttgaggggactcaagccctccagtattcacgttggatccgtccctactcatacagaagtcctctagcatcgcttgctatgtctactatgctacttgtactgtagtgtaggcaggtaagttagggcaagagtccggcgggagtataccagaggaaggccggcattgagatgggggctgtcaaatcttggcgtgcggcacccgagtcactcaatttgttctcggctggtcctatggagacatagaagaagggagggggtgcgttatataggtatgtatactattgtataggcatcatcctctctatgccgaatatgtgcaaaatagtaaatcttcaaggtaacaacgaagtgtagcaaataattcattaatttgagcgtggagggtgttattttatcaaggccaagtggcaaaccgtcgattttctcttcattaagcagcctaaagatgcatttattattccgtttaattagctatcctggtgtttacatccaaatttggcacctatggacgaaatagaggaaaattgccaaagtttggagagtgccgggtttccttcatagggccggtcagaccagaggtatatgggcggtctgaccggctagtagggccggtctgaccacaggtatgtgggcggtcagaccggcagggtccgagtccgagtctgttttcgtcgggtctcgggtttccttgctcgggaaggcatgtttcgtgtttcctttggtttctatcccgagttggacgtagagaagggcctatagagggtaagaccaacccctatttaagggacaaggccggttcattgtaaaacccccaaatacaatctacttgaatcattcttttactatgttttctattttaccctagttttagtccatctttgtcggtttgcgccgtaaaccgtccgccgccgctgcgagagtgcgacacctctttgtaggtttgtcctgaaaaccttccgttttgcccacgagacgggtagttatcctcatatcgatctaaatcagcctagaggctgattttgatctctaaatcggctccgctagccggtttagcttttctttttgcaaaacccatcttgatttggccctttggttagatcgaggtggttggcgactccatatcaccgcaaggcgtttaggtgttgcgatcgtgcttgtcgacttgtcacaaaaagttgccaacacgatttttggcgactccgttggggaagagatccgttcatcgtcaactcaacttcgacttcgccatgatgaagccgccatccaagacggaggtggagccatccaatatgatcctggtcacattggatgacttcgaaggagaagatcgtaaagctatggaggagtacatcaacgagttcacgcaggaggcgttgatgagggcaagcactaggactcgtcaaggcgtgatcatcaagcccgggccacgtcctaagctcactcccgactcggtaagcaatgatgaggtatcacaatctatccaacaacaaattgcatctacaatagattcatctatgcttgtttttaaagatcaattagatgcaacttttgagggtaaatttgatgagtttttaagggttaaattcggccctcttttggccgatcacatggtaaaaaataaagcctcttccactactaatcaacctcctataggtcaaaccgaaggaacggcgcacacggccggtcagaccgcgacacagccgtcggtccgaccggccagacggccggtcagaccgggtattaccccggcggtcagaccgggactcaggccggtctgaccgcgcctctggacgccggtcagaccgggcattgggccggtcagaccagcgcaattataccaatacaggggatagatccaatgactaatgctaggtatttgtatcatcttagaacatctgatcctcctatatctactactacaagcaatccccaagttcccccacatgttcctaatgcctataatgatgttgctaggggatatcctcccgatactagacaaggccaatataatcatattgcgccacaaacacaacctattaggccaccaaatctaccgctaaatcaacaagggcctaataatatggaggatataattagtgatattatgaggaatagattcaggatcgaaactaggaatcgtgctagaacttacaaaaagccgtatcctgattattatgacattatcccatatcctcgtggttataaaattcctgaatttacaaagtttagtggtgaggatagtaggaccacatgggagcatgtagatcaatttttagcgcaatgtggtgaggctaattggaatacatgtaaattacgcttgttttctttatctttgtccggtactgcttttacatggtttacttctttaccggcaaattctatttctacttgggctcaattagaacaaaaattttatgattattttcacactaatgaaactgagcttaagttgtctgatttaacatcggttaggcataaatgcaatgaatctgttgctgattatatcaagagatttatgaatgttaaaaaccgatgttttaatttgaagataactgacaaagatttggccaacattgcatttgatggattacttgattctattaaagagaaattgaatggccagatatttcttgatgttgatcatgtgttgcatgaagttctggctcaggaaagccgagtgaatgacgatagcttacatgctagtttagatgaaagtgcaatatcatgtatagccgaaccaagcgatgtttcagattgtgttaatgatttgtgcaatgataccataacgattatagccgaaccaaatgttggttcggattatcttgctagcttgggtaatgatgcaacaatcattatagccgaaccaagcaacggttcggagtgtgttactagtttagacaatgatggaatagccgaaccaagtgatgattcggattgtgttgctagcttagagaataatgccattgaagatatagccgaactaaatgacggtttggattgtatcacaagcgaaagtgaaatagcattgtcacctaagaccgagtcacaaatcggtcgtgtggatgttgaaaagatgatgacaatgtcttgcggaatagtagtgaaatagaatccaaagtagccatgcatacatatcaaaggccgtatcctgaacacgtagattcggtcccatacccgcaaggatttgaggtgcccaacttcacgaaattcacaggtgagaatgctatgactacaatagagcatatcggccgctttattgatcaatgtggtaaggccggtagtgatgatttgcttaagttgaagttgtttcccctttctttgtcaaactttgcatctacatggtatagtttgcttgctcctagttcaatttctacatggtcacaaatggagcatgagtttcatggttatttcaaagatgcaagcttgatggagcaaagaccgattaatacttcatcggtcacttgtgaaactatttcggttacacctatgctaagaccggaattgttagtaattctctccctattaatcctattgatgttgataaaaagaaagggaaaaatgttattgttaaggatcctcggcccaagacacttaggatcaataatgcgaaggccgaagatcataaagttgcaaaggatgagtcatctagtatccaaaggaccaaaaagccgaagctcacttttgatatgcttatggctaaatacaagaaaggattagccggtcaatgatttgacaaccaaactagtgattcgaaaagaccaagatcatctcgtaggaagagatttggtcaaacatcaaagcaatcggagccatcaaccataccaactccatataaacctccaattgtgatgccatggtatccatatccaatgtcactatatggttatccttttatgtattacatgccatggatgcctcaattctctacgccgtttcatcaaggatgggaggaatcacctagggcagtaccaagtcattctaactcaagacaagaccgtttcccacaaaagaatcggtccggtggatcaaaggtgaaaaaggcgaagaggtgtgggtgaggaaggaagccaaagctccggaggtcgttgctatcaaagaggagtctcaagatgttcatgtacctactggagatgcgatggaaattacgcaagcaaaggagatcgaagccgacgccgtgactgtcaacattggtggtctaaccgagatagctggccggtctaaccgccagactatggccggtctgaccaaccctcctggccggtttgaccgacggcttgtggccggtctgaccggacctagaggccggtctgaccgaggggcattagagaagagtgagaaaattgagagcaacacaggaggttccacttcgaccaaaaatatgaagaatcatcatttggctcctggaaaacaaccacagccgaagtggataccttccggcttatctcgctctcaaaacaggaggcttcagcgtcttcgggccatgggtaaaaaagaaaaggagaccaaagatgtggagaacaaaacatgtaacaatttagatcctcgaacgacatctaggcaagtgtggagacccaaagaggtaaaagttaagagaccggtgatttcccatagtagagataaatccaatttgatgagagaagaatcatcggtcattagagataagtctccttcgcatgatgctatggatgttggtgcggtgttcatcttgccttcgaaatcgtgcagtcgagaaagccgattttgcttgaggggcaagacattaatatgctcatgaagaaatcaagagaagatgaacggcgatggatacaacatcacatctttgagccgccgttcgtcggatgctaaggcaaggtatgggtttattgtgtttaccattatatgcctatgccatgttaaaacattgcttgtgtcagggttacgggttaggtataccccttacccttcgatatgcaccacatatcgacatggcatacccgcgcatacacgggcattatctgcatatactaaggaaatcttccacagtgtttaagtcctactcggacaagacagggtcgtcaatatatcgtgtagggtccgatgtctccgagttcgacttggagaccacttgatttgcgatataaaagggatcccctgggaggacctaaaggatggaatctgatagccaacacaacccccacagcctacgaagtcggagcctgcaggagccaaatcgccggggatctagtcgaatcaacttaattacgatctcgccgcttcatcgagttccattgttccctttgtaacatgtggttttccatcatataatcccatatcaactggattaggactattacctatcaaggggcctgaaccagtataatttttgtcttttattgcttgatgtcgtactacgtagatccttgtaccaacgtaccccaataccctctatatccggtctacgggtatcacccgtcgacagtggcgcgccaggtaggggggcttggtgctcaaggttttactactatgtcatccagcttcgtcgacaacagcgtcaacaccaacctcaaccacgggtttcctgcttcaacaacgttggtgtggactcaagtcggcgaaatcgtcttcccggtgtacaccacgatgccgatctcagccggtccatcaatgaccggaaacgagaacgcagtggctgcaacccaaggcgactccatgtcgaaggaccctcccgccgaagcagggaatggaacatcgacaacacccgagcttgagaaggattctaatgcggccgaaccttgtctttccgacaagaaccacgagccgacgagaacagcttccgaagcgacaaggtcctggtgtcctatccacaaaaccaggaaacatactttgcaagcctgctgggtcttcctcaatgcccacgccgaaattcgcgcctgtagagagcgtggaattcagcgcgtttctccaactcgtgatgtctattgtcctattcacaagacaaagaatcacgacctctcaagctgcaaggtttttctcagcgccataaagatgtcatctcctaaggtccagccatcaagcgtatcccttagagaggaagacaagagacagggaacgacgctgacctcagatcgattcgttggtgcgattgacatcgactcccacgaaccatcagttctacatctactcaaggactatggctcgtcatcaacgagtacaccatgcgaggtattggctatcgatgggaccagcacgtcagcacgcgctaatgccgaggcggagaatcaagtagttacaccggctcagcgcatcagtacccttaacacaatactgagggaggcaccttacgatcccgttctgaacgacgatcttgcgtggtggcaggaacggctacgagaatcagtaaccaacctcagccacacgttcgaaggggctgctgctgatgcacacccggaacagccaccaactggcggcgtcgatggcgaaaaccccgaacagcgggagtcaccctaccgagcaaccccttcaccccgcggcactggcgacctcggcgatcacctgaacggccgccgagaagcacgtcgcacacaggccaacggaagccgctctcgacatcacatccctttacggcatcacgataatgaagaacgagaaggccgctcgaacgaagaccgagaccgtgatgatcgcgacaatcgtgagcggcgggcgcgggcaataccagtcgaggacgccgccataatggcgaagacgacagagatcggccccgggacaacgacggagggcgacgatgggattctcgagaacccggccgatgtcctcgtaatcctacaccagaaccaagcgattcttcgtcatcgtcatcctcttcttcatcctcatcgtcagatagacatccacgaaggacacacgatcgccgacaacccactgcccccagcgctgggtgtagagctttcggtcgttccctgcgtgatgtccgatggcctgagagattccgacccggaacaatagagaagtacgatgggagtactaacccagaagaatttcttcaagtctactccatagtactttacgctgccggagcagatgacaacgcattggcaaattatttgccgactgcgttaaaaggctctgcacgttcatggctgatgcatctaccgccctactcgatttcttcatgggcagacctgtggcagcaattcgtcgccaacttccaaggaacttacaagcgccatgcgatcgaagacgacctacatgcgttgacacagaactcgggtgaatccttgagggaatatgttcggcgcttcaacgagtgcagaaatacaatccccaagatcaccgacgcttctgtaatttgcgccttcaagtctggcgtcagagatcactatactacccaggagttagcgacaagacgcatcacaactactcggagattattcgagattgttgagcgatgcgcccacgtggacgatgcgctgaggcgcaagaacgataagccgaagaccgggggcgagaagaaaacagccacggacgcacctgagttaagcaagaagaaaaaccgcaagagtgcgaaaaggaaggctcaagcggaagttctcgcagcagaatacgctaacccatccaagcgcccagacccacagggtagcgacgcaaggaaagcatggtgccccatacacaagacggacagacattctttagaagattgcctcgtttttaaaaagtcgctcgagaagcacatggcattggaaaaaggcaagcgagtacgcgtggtcgagaaggacgcggaggcagctgctcaggaattggactcagcatatccagactctgacctccacgtttcacacatcttcggaggctccacatcgtactcttcatagcgagaatacaagaaagtggaacgtgaagtctgttcgacatggcagggggctgcacctaatatgaagtggtctgaacagaagatagaattttcggaagaagagcatcccaagactgccgttatcccaggacgctatccgatcgtggtcgagcccactattcggaacatcaaggtcgcgcgggttctcattgacggtggcagctcaatcaaccttctcttcgccagcactttggatgcgatgggggtcccacgaagcgagttgacgcctaccaatcaacccttccatggaattactccccagtcctcgtccaaaccattgggcaaaattacgttgcctgtgactttcggccaagcaaacaacttccgaaaggagcagatcacctttgatgtcgctgaattcgatacagcgtataacgccatcatcgggagaactgcacttgcgaagttcatggccgcatctcactacgcgtatcaagtgctcaagatgccgggaccgaagggaataatcaccattcaagggaacgcaaagctggcggtacaatgcgacaagcggagcctcgatatggtcgagcaaacgcccaacccacccgccacaactgagcctcccaagaaagtgagcaagacaaataagacgccgaaaccagacggcgccatcaagatcgttccactctccagtgccaaccccgacaagaccgtcaagatcggggcatcactaagcgaggaataggaaatcgcgctcatcaccttcctccgcgacaatgctgacgtgttcgcttggcagctgtccgacatgccgggggtccccagggaggtgattgagcacaaactcatggtgcgacccgatgccaagccagtaaagcaaaaactgcggagatttgcaccagaccgaaaacaagccatacgagaagagctcgacaaacttctcaaagctggctttatcagagaagttcttcatccagagtggctagccaatccagtcatggtgcggaaggccaacgggaaatggaggatgtgcgtcgatttcatcgacctcaacaaggcgtgtcccaaggatcacttccctcttcctcgaatagatcaactggtggactcgacagccggctgtgaactgttgagctttctcgacgcttactccggctatcaccaaattagcatggtgaaagagaacgaagagaagacagcattcatcacgccgttcggggtattttgctacgttaagatgcctttcggactgataacagcagggaatactttccagcgcacggtccagggcgcacttagtgaccagctcggcaacaatgtcgaggcatacgtcgacgacattgttgtcaagaccaagacaagcgactcattgattgacgatctgcgggagacattcgacaacctacgacgatatcgcctcatgcttaatccagagaagtgcacgttcggagtaccgtcgggcaaactgctcggtttcctcgtctctggcagaggaatagaagcaaatcccgagaagatcaaagcaatcgagaacatgaagtcgccacaagactcaaagaagtacaaaagctaaccggatgcatggcagcactaagcaggttcgtcgctaggatgggagaacgaggacaacccttcttcgctctgctgaagaagaaagacaaatttgtatggacacaggaagccgaagaggcattcgttgcactcaagcgctacctaacaaacccccctgtacttgttgctccccaacctaatgaagaattatttctttatattgtcaccacgccatattccgttagcaccgtcattgttgtcgagagagagaaaatacaacgaccagtctactacgtcagcgaagctctccatgacgcaaagacaagatatccgcagattcaaaagctgctctatgcagtaatcatgacatcaagaaagctacaccactactttcaagcccacagagtcacagttgtctcctccttccctctcggtgaagtcgtgagaaacaaagacgttgtcggccgcattgcgaaatgggtagtcgagctaagctagtttgatgtccactttgtgccacgaacaaccatcaagtcccagatactcgccgacttcgtagctgattggactatgcccgacaacaaatcagacaaccaaatcgacaacgaaacgtggacaatggcgttcgatggtgcactcaacagccaaggagcaggggcaggattcatcttgacatctccttctggagatcaattcaagcacgcaatccacctcaacttcagggcaaccaacaacacggccgagtaagaaggactactcgccaggataagagccgcaaccgcatttggggtcaaacgactgatcgtgaaaggggactccgaactagtcgcgaaccaggtacacaaagattataaatgctccaaccccggattatccaagtatctcgcagaagttaggaagcaggagaaaaggttcgatgggatcaaggtccgacacgtataccgcaaagaaaacgtcgagccagacgagctagcacgacgcacgtccagacgagaaccactcgaacccggcacttttctggacatcctggcaaagccatcggtaaaagaggtcagcggcgaagttaacccagacacccccgacatcagctcggaggccacagaggcagaacgcgccgttgccgatatcaaaaccacagacgactggcgcaccccactgatcaaattcatcaacagcgacgagttgctcgaggacgatgcagaggccaagaaaataacccgtaaagcaaaaatctatggcacgatcggcaatgatctatacaagaaagcgccaaacggggtacttctcaaatgagttccgtccgacgacggcagacacctcctccacgatatacacgaaggcatctgtgggtcacacgccgtcggtcggacgttggtcgggaaagcttttcgacaaggattcttttggccaacctccctcaaagatgcatgcgacatggtccagcggtgcgaagcctgtcaatttcacagtaagcacacaaagctacccgcgcaagcgctccagactatccctctcacttggccgttctggtgctaggggctagatatactcgggcctttcccatgaggacagggcggctataggttcctattcgtggcgatagacaaattcacaaaatggatcgaggcgatgcccacgggagaaatcaaggccgacaacgccatcaaatttatcaaagggatattttgcagatacggactaccacatcgcatcatcactgacaacggctcccagttcatcagcgccgatttccaagattattacatcaggctgggagtcaagatatgcttcgcttcagtctctcatcctcaaagcaacgggcaagtcgagagggcaaatggcatagtgctacaagggatcaagacccgtgtctacgacaggctcatgtcacacgacaagaaatgggtcgaagaactcccatcagtactatgggccgtacgcaccacaccgacaacgtctaacaaggaaacacccttcttcctcatgtacggctctgaggccatgctccccagtgagctacgacatcaaagtacatgagtacagaagtactccgacgaggatcaggaggaacagcgaaacgacgatgtgaatctactcgaggaacatcgcgaacgagttgccgtccgagcagccggttaccaacaggccctccaccgttatcacgagaagcgcatccgagcacgcatactttcgacgggttcaaagccaagcagggcgaaacaagctctcacccaaatgggaaggaccttacatgatcacgcaagtcttgcggccaggcgcattcaagatagcagatggcgacggccgcgagttggcaaattcttggaacattgaccaactacgtaaattctacgtataggtcaatatcatccatacctgtaagacaccttacagtatcaataaagcctatgttcgggcacatattacaattacagtgttcatgcctgatgatcccttacccagatgatacctagcgttgaaacctatccttatgtccctttacaccgtcctgacaaggcctccgaggaacctaagggatcctcggctggggacgcccagagccgataaggtcttgtcggatcctgtagagacgaaagaccatgtaagacctggtcgtgtaagagttctcgccgtgcgtattaaccaagccgtgtaatcggaaaattaactttccaacttcacggctgggggctaggatcagtgctttctcaaccaaggcaggtcaaaggtctaagagccttgtcccccgagaagtatcctccgacgacaaggctgggggctagggagagtgtacgactcaaacgactgaccaaagtcgtgaactgaggaaacactcttacacactatatccagagtaagaaagattcaccaagatagatttcttccctacttcgcaaaatacttcttacaattatatacaaatccagaactttattacattctttccctaagatatctgtcacagggtacgaatactaccaagaaggccaacgccagtccatagactggaaaaccttctccgctaacggtgccatcgacttcgccaggtggtctatctccgcaggagtcctctgagaatgagtgaatccttcatggagaaactcgaggtgcagttgcggacgatgatctcgtacacaagccaatacatgccctcctgcatatcggctcgatcggcggcattcctgtttcagagcctcgtcaatccgcttgccaacgccctcaagctgagtacaagccccattcaaccacgggatatatccggctgctgactcctcgggatccccgcgaggtactcggagctctctgcaaacttgggccatggacgtgcagcaactcttcaggtatgagttgaaccacacctcacgacctcaaagtgtttccacggcctgctccttctttacttccaacatggctctctcgagttccaccacttcaaatttcgtcttccaatattggatacgacgatctcggtcagcaagtgcgttctcgaggtctgttcgacatggaaacgactacgttaggctgctcttctctctcgagaacacggttgatcaagtcggaggagcgaaaaggatgaaaaggccaccaaccaaaggaagtcgtcgccgtccccgctctcccgggtacaatgtcattcacatcgtccagcaacgcgtgtccctcaaacgcaagaatcggagggatcactggcgactcaggttgcccgcgctgctggacaccctcgtcatcagcatctctacaaaggacaaaaattcccgaggtcaacatacaagggcaaactagaatgataattgcacgtattctgaggcggtccaatttcaagttttacacagcatgtcttggaagtacaagaagacctactcttcaaatagggggagaacagattccccagatcaccgacttcttccatcacctccttacgcgtggtactagccgccccctgatccaagatctcgcgcagatcgagttcaggacgcgatagctttacgcacgcaaggacataacacgccccagtgtagatcccgttcgatgtctcctctgcgaccctggccgcatgcttggaggggatctccgtcatcgccgtcaatagtaccgcaagggaggaggtcagcgaaaattcgtcaggattcaccgggatggtagacttgatgccgcactccccggcaagctggtgcagcccagtgtaggtgacccgcaacgagccctgaatttccgacaggttgtgcccgagttccgacatgcggttctcgagcccctaccgttgtcgctcgttgccggccaccagttccctcatcttcgtgaggtcttcatgagcttccgccaactcgcgcaccaaccggtcagcacgcgcgttcgccaacgccgcttctgaccttgcctctgcaacctcgtggccaatgctgcgggcaccagcttctaggaggcgccccatttcgacttggagctcctcccaggcgaggatagcagtgggcggaccacgacctgccgcgggatcgctgactgggccactaggcgtcacctcccggctcccagctgcgagtacgacatccgtcgaggccgcggtaggcgaggcgctggaagcccctcctgacttgctctgcgcggcctttgcccacgcttccctatgggacgaccacggatcatacaacgcttgaacagaatcatgggaacttaaaaacccaactacttacttctcgccgatcgtcacaagacgttgtcgtcgcggaggcgggggagatgcgtccaaagcctgaaagacaaccaacgcgaagtaaggcaaaatccctctggctgcgcgatctggcgataggataacttaccgagggggtcggcgctttgcgacgatgtccgcttacagaggagaacttcctcccctttgtcggagcattgccaccactagtagtggccgcagcagcatcagacgcctccttgacaaccttctcttttagagacgccgccacctgatggtccgcgagcggcccgatgatgtcagtcagaggaagagcctacgcttaatcaagtcataagatgatctcaagaggaaaggcgggatgtccatcgagtatacttacgttaatagcggcatcacgctccgtcgcccccttttcacaaaggggcacggggacgtcactcgccgttgtcggtccactgatcattaactgcccgacttggcgctccacggccctactgctcaaacctgtgaatcgaggaccaagtttcgataaatcaagaggaatgcgaacgtgagtatgtcaagataaatacgagaaagataccccgaggagaaacctgggtcgcgtcctcaggcctggaatagttaaaggctagatgggcccgagcctggagcagctggatccgcctaccaacgaagtccgcaacgacttcataccccgacaagccccgcactcggagatcgttgatgaagtcgataaacgactgaagaaaggggtcaaaggaggcttggcggtccaagacgaaatcttgcccggttgttctgtgggaacgatgaagacagggttcgaatctttgacctcaagataaaaccatctattccgccatttgttgcgagaagaagggcactagaacgggatataacgcgacttcaggccatctcgaagtcggaacccaacggagccagataccctgttggactccatccaacgcagttcgtagtagaagcgaaaaagatcaagaaaagactctaccccaatgtaagcctcgcaaagatgagcaaagatgctaagaaaggcaatagaattggggttcaaatgaagaagagaaagaccatagaagttcaaaatcaggaggagaaattcggaaggcggagggagaaaaccgcagagaacatagtcttcgatcgcaaccatgcgacctaagacgggctggggattagtacctcctgcttccctctccatggctccacgaccaggaagggcgccgtcttcctgaagctccttcagcgatgcgctggtggaagatgacttgccgaggtccatcgctgatcgaagatcgccggtgaaaggacctaagttgctgaactagggtttttgcgggagtggagaagacgagaggcgcttgggggctggagaatttttccactacaggcggacttcaaatgaatccccaaaactcccttaaatagacgcacttccgacggtgcgaattccaaggaaagaagagagatggccgccggaaatttctgggtccgttacgcgcggcggtttttcagactttagtttaaactcactcgtgaccgttgggcttcacacggtgttctcgatcatgtcctgtctctacggttcccacaccgagaacgacatcagcctcgacatcagaagtcgttattggtcgcacgggttcatttaagcagaagttgggggctactgtcagggttacgggttaggtgtaccccttagcctttgatatgcgccacatatcgacatggcatacccgcgcatacatggacattatctgcatatactaaggaaatcttccacagtgtttaagtcctactcggacaagacagggtcgtcaatatatcgtgtagggtccgatgtctccgagttcgacttggagaccacctgatttgcgatataaaagggaccccctgggaggacctaaaggatggaatctgatagccaacacaacccccacagcctacgaagtcggagcctgcaggagccaaatcgccggggatctagtcgaatcaacttgattacgatctcgccggcttcatcgagttccattgttccctttgtaacctgtggttttccatcatataatcccatatcaactagattagggctattacctatcaaggggcctgaaccagtataatttttgtcttttattgcttgatgtcgtactacgtagatccttgtaccaacgtaccccaataccctctatatccggtctacgggtatcacccgtcgacagcttgatatttagcacatgtgtgttttgcttatcaaatccatattatacatacatgttgcaaatgccagttctaagtggtggaattggtaggttggcatataatatgtttgaagtatgatttggctcatcagtctttaatatttatttaaagccaaatcgtatgtgtttttatgggtcaccatataagatatagatttattgcaccatgaaagttttgcttattagtaattcggctaatatcaatggtcaatgtgatgatttgttttagagttattttatttaggaacattggcattgttaatattttgcatacacgctcaagccaattacttacatttgtagtttattggaatctatgcatgtgacacatatgactttggtgattcattattgattatacttcaattggctaagtgttttgatgccatgatgattattgttttaaaagccatttgaattagtattcatctagacatgttagttggatgttatagtttttcatatgtctatagagaagaaaatttggtccaatagtttgatacaccaagcatctggctattatgtgaagaaaaattatatactaaaggccgatgcttgatttcaaaggtttggacgaaattggcaaagtcatagaccaggggcggtctgaccagcattgcacggccggtctgaccggtggtaccggtggtctgaccggctctggatggccagtctgaccgggcagacagggtggtctgaccgacattgcgtggccggtctgaccgatcccagacagaaggctgggggcacattacagttgattaaaaggccgaattaattgtgaattcggacatttgtgcccatgagttagaaatagcttggagaattcctttgattagatatttgaaagatcctacacttaaggttgattggaagattcggcggcaagcattcaaatattatatcgccgaaaaatagatggagtattgttgaagtacttagataatgatcaatctaaagttgctaggagaatagtacatgaagggatttgtggaattcatcaatcggcccgtaagataaattggttgcttaggagagtggggtttcattggccgaaaataattgatgattgtttcaaatactatagagggagtgaagcttgttaacggatcagcaatgttcaattagcgcctaccgctgtgttgaatcctatcattaaactatggctgttccgaggttgggctttggatttcattggtcaaatttatccttcgtcatcaaaggggcatcggttcatgctagatgtaatggattacttcactaagtaggccgaagccgtgccgctcgagaatattacttacacggaggtaattgactttatttttgaagcatattgttcatagattcggtattccttaaactttgatcgaggagcttcttttatgtctaagaaggtgagaagttttgccgaaattttatgatattaagttgttgagttcttctctctactacgctcaggctgatggataagccgagtcgagtaataaaacattgttgaaattgccattttgccagttgaggtaaatcttggctttcttcggtattttaagaaagacgacttatcgattgaagattacaagaccttgatgggaagcaattttgaagacgtcatcgacaagcgtttgaagactttgaaggagatgaagacacttcaagacggtgttttcaaagagcaattaatgggaaatacttaaagaaatacttcccgagcatttggtaagatgcttaggaagtcctatggccggtaattggattatcgccctaagacaatatgttctatgcttttagattcacgatattcatcaaaaaggcaggggggcatgtgtttacaccaaaatttggcacctatggacgaaatagaggaaaattgccaaagtttggagagtgccgagtttccttcacatggccggtcagaccgtaggtatatgggcggtctgaccggctagtagggccgatctgaccgcaggtatgtgggcggtcagaccagcagattccgagtccgagtctgttttcgtcgggtctcgggtttccttgctcgggaaggcatgttttgtgtttcctttggtttctatcccgagtttgacgtagagaagggcctgtagagggcaagaccaacccctatttaaaggacaaggccggttcattgttaaacccccgaatacaatctacttgaatcgttcttttactatgttttctattttaccctagttttaatccatctttgtcggtttgcgccgtaaaccgtccgccaccactgcgagagtgcgacacctctttgtaggtttgtcctgaaaaccttccgttttgcccacgagacgggtagttatcctcatatcgatctaaatcggcctagagcctgattttgatctctaaatcagctccgctagccggtttagcttttctttttgcaaaacccatcttgatttggccctttggttagatcgaggtggttggcgactccatatcaccgcaaggcgtctaggtgttgcgatcgtgcttgtcgacttgtcacaaaaagttgccaacacctgggtccaagtttaactgattaattataaataatctttctaataatgagtattgtagtctctgtagatctacgtgagtacgtgcataccccctcgtcccaaaaaagacaaaccttgggtttccgtgtccaagtttgaccatccgttttatttgaaaaaaatatgaaaaaaattaaaaagataagtcacgcataaagtattaatcatgttttatcatctaataataataaaaatactaattataaaaaaaatttatataaaacgaacagtcaaaagttatacatgaaaactatggtttgtttttttaaggacgaagggagtatcatgcatggcagaacagattacgttatatgggctaagtacgtgtggcgcatgcacttaccattactccattctactcgtgtcccgatcgatcgagctggcaagtggcaaccacacgcaagcaatacgtacgtacggtacggacgtgtcgacgtgaccagagtgtcacggcaccacatgcttagtactgtttaaaacgttttgattttgatcaaagtttcaattttaaagtttaactaagtttataggtaaatatagttacattaataaaactaaattagtttcatcaaatcagtaattgaatatgacggagcgtggggctcctcaccgggagaccgcgcaggcccccctttgccggttcggccgggggccctgggtgagattctaagctcctagtctgtgtgtggaaggttcgcgagaatggaaaaagcacaagacacgggcgatgtatacaggttcgggccgctgaaaagcgtaataccctgctcctgtgttttggtggatctatgtatgaagaagctacaaaagagctggagaaccagaaagctcttactctctccctctctgatcgttctgtatccgaaaaaatcaatcccccttctaagtgggcaaggtcctccttttatacctcaaggggataccacatgcaccatctctctcttttttttttgtggggacttatcctctcttttcataaacagacggagacttgtatggttgccgtccgagtgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctctggctagggacgagtgcttggaggctctcatcctgatgggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgtggttaggtgagccctgctatgctcacctaccccgtatacgcggcgcaaaacccacaaggggtcggggcgcctcggccctcgaggccgagacgggagcggtccgacccctcggggagacaaagagaagggcggccgtatcaccctcgggcccgacccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggtaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccagcgtcatggcacggggctccgctccgcttgacggtagcgtgctgccgccttcccgcatcgtgagcgagagacaggccgggctgccgcgccgcttcatgccggaatctgccaccggccgggagatagtctcgctgggcgagagatgcccggcgccacgctactcggggtggtccgtcttcttcctcccttttgctatggcagggctggttccgccattttcttctttcttcatggatgttatggagttttacgatctccagatggcgcacctcatccccaacgcggtaatgacattggccatcttcgcgcacctatgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccagctggcgggcgccggtagatctgggagatggctatgtcacgtcccaaatcgaccctaaaattcatcctcgaaattgtgcaaagaataattaaaattcatgtgaaagcctccaacaattaaaatgtgcaaatctaaaagtcaaataaggcttggaggatttttgtatatttcctaaaagcctaaaatgcgtaaataaattttagtggaattttcagagcacaaataataattgaaaagaaataaacaaagtggaaaaggtttataaaaagaaaaaaaccctaaaagaagtcttctttccccccttcccttcttgggccggctcggcccaatcctctccttccctctctctctctcctttcccccgcggcccatcggctcctccccgcgcgcgcgccgctaacaggcgggcccgcccgccaccctcgctgacgggtggggcccacctgtcatcccccacctcgcgccgggcccgccgctcgcccgtgccctagcgccatcgtcgtcgggaatctcggcggcttccgccgtccccgcgcgcattaaagaggggggaattattccccacgattccctctatcttt

SEQ ID NO: 10850 - DNA, 12040 bp, Oryza sativa
catttgtgctttgtttctgctgttatgtggaatttattagagtaaaagccttttcttttccgttggtcgtgtagacgctgcagcttcggaagatccgctcttcgtggaagtcgaagccgtcggttgggaaagcgagcaaggcaagtcacatcatctttgagcatattgaatcccagtttataaaattatgttgatttaaattattgcattatcgctttatttaaattcccgcgttatcactgttttatttagccatgcctatttacctttgttgtgaccatattattattgttattgttattattattaccttgttcaccctagattaaacaaaacctcaactagtggacactctactcgtagtatccctagtttaaatttagatagatgcttcgcaatttaattaggtaacattaggtggtttacaactatagactttgggaaatattcatatcacctggacactgtggaattgttggatcattgtggaattggcttcacaccgccccctccattcaaaatccccaaaaatggttttaggctgggttcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcccgggggttccggccgtaggcaggattgggtcggtactcttgtttatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcataggccttgggttaaggcaggttcgtgtgggttcacggccttgattaataactttgtatagttctaggatcgcgtttacaaaatagccctgagcaactaaatgtctttaaatgctgtttactgcaaccctaaccctttacattataattcccttgtactcctttgcatttattctgcatttgtgggtgtgtcttgttgagtacggtggttgtactcagtcttgctcaatttttcccaagtccagaagaggagttccttgaagatgaaggtttcggtgtctagctcgtgcctgccgtcaagcgcctgtggtcgtcgccctagtcttccgctgtttctcgtttgtctctgtgtgtgctgggccttcgctgcccatgtaataagttaactatttacgcttccgcttgttaaactctgatttgtatcaacttatggtgtaccttgcctcctgggacaaggattaatgcacacacgtcaggaaagcccgttgggttatttccggtcgtgacagctatgacgccgtcctcgaccgcttggcgggcctgcgatcccaggggctcacaggggccatggtgttcggcgactaccttcgtcgccggattgcgccgctccagcggcgcgcccggggcgcctgggagtacaccgggtccgaggactgtatgaggacccaccagggggtcagatgggactgggctcctgaggacttcaagatagtggtccaacgggtgctgaatctcagctccgtggaggcatccctcattcctcaaggagtcctccccctctgcagcgatccagaccgcgcctccatcctgaccatcatgcaggtagtcggggcgttggaggagcgggctcctcgaggccacgatggcgcgggtgggagccgcaggggggaacaatctaccccgggagggggtcgtgcttctgggccccgcgacgggggcccggggagcggccgccctgccgacgcccgggggaagaggaagcaggaaggaacccctcccccatctcctccccgagggggcggggcggcgcgtgccagcagcaggcgcccggagggggccacgccgacgtcgcagcccgagggggagcggaagaagaaacggctccgcaagatgggggggacagaaccatcccggggaaacctcatttcccctccaaggtggtcgtttaaccgaccccctcgcaggttcgtcccacacccatcgtggccgtattcattccctcaacgcgagttttcactcattcatcttgtttgtcttctggcttttcttctgcttcagcgagatcccgttgcgtccttcttgccaattcaagtccggccaatctgaggccgagaatgcggcgaccacggaggctcggaggcgggaatctgaccggcgagaagccgcggatcgcctacgggaagccgaggaggccgcccaggtggccgtccgagctcgccaagctgaagaagccgctcgggaggaggccagacttcgccaggccgaggcggcgacgacttccgaggcagctcgcgacgaggccgcgggcgcatcgcttgggcccactccctcgggcgacgctcaggacaagccaggtccgggggacatccctgagtccggcacgtccatcggcgggccgagccgcgcggcatcctcaccgaggcggctcttccccacgccttccgttgctccactgagcgcagagccccttctgcaggccttggccgtcgcaaacaccacggtgttggacgggttaagtgcccaggtggaggccctgcaagcagagcgggcggagctcgacgccgcatgggcgcgtgtcgaagaggggcgacgctcggtggaggccatggtggaggtgggccgcaaggcacaccgccggcacgtctcaaagctcgaagcccgtcggaaggtgctgggggagatcgccaaggaggtggaggaggagcggggggctgccctcatcgccaccaccgtgatgaacgaggcgcaggacaccctccgccttcaatacgggagctgggaggcggagctagggaagaagctcgacgccgcccggggggtccttgacgctgccgctacccgagaacggcgggcggcggagaccgaggtggcatcccggcggcgcgaagaagcccttgaggcccgtgccatggcgctggaagagcgtgcttgcgccgtggagagggacctggcggatcgcgaggccgccgttgccatccgggaggcaacgctgactgcgcacgaggccgcctgcgccaaagaggagtccgcgctctgcctccgcgaggacgcgctcaccgagcgggagcgagctctcgaggaggccgaggccgtggcgcaacggctggcggacagcctgtcccttcgcgaggctgcgcaagaggaacaagcgcgtcgcaatctggaaagtgcccgcgccgagagggccgcactgaaccagcgggccgctgaactcgaggcgcaggcaagggagctggatgcaagggcgcgtagcggcggggcggccacgggcgatagcgacttagccgcccgcctcgcagctgccgaacacaccatcgcggatctgcagggcgcgctggattcgtccaccggggaggtcgaggccctttgcctggcaggcgagatagggcccagcatgcttcgcgacgccgtgtcccgtttagaccgcgccgggcggcaggcgggtctctggggcgggcggactgtgaagtacgccgccaaccaggggggcctcgcccagcgcctctcggagatggccgggactctccagcggctccccgaggagctcgaggggacgattaaggcatcctcgagggacctcgcccgaggagcggtggagctcgtactggcgagttaccaagccagggatcccgacttctccccatggacggcgctggacgagttccctcccgggaccgaggatggcgcgcgcgcaggtccgggacgccgccgaccatatcgtccacagcttcgaggattcggcccctcggctcgtgttcgccctcaactccgacgaggaggacgatgacggcggagtgggcgacagtggcgacgaggctggcgacccgggtgcatcggagtgagcccccaggcccccgccaatctttaaatagtttcttcttttcttcttccgaggccttcgggcccccttcttgtatagactgatttaatctgcaatcaaataaagaggaaattttttgtgtcaattctatttgttgtgtgtatgagacgaggatgtctgtgccgcggtccttttgtgtcttggcttgaacaagggctcgtgcccaggtcctagtcctcaaatggctcgggtcggggctagtgcctggggagatccacatgtcgagactagccaggccgggagcgtggtgaccgagggttatgggtgacccgattgtgggtttttgccgattcccccccggagttcaccacgccccggggcacggctcggttctgggccccgtttggcgattttagccgacccgagcccccgagggcaggattgaacacgagtgacctatttcaagtcaagatccttcaaaaggaaacaacagcacagatacaacctttaggaaatcgaaaatgcttttattgaaatacagatataagagaaataagaatatgcatatgtggtagcccccggccgaccctgcacgcccgaggggggtgcggggttggcccgagcccgaaacctgacacccgatccccctttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcagagggccgcgcgccgccttcgctcttccaagtagtcgaggtcatctatgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcaccgtgcttcttgaggatgttgaaggtcttggttttaaggtctctgaggatttccgcattggcgcgctccacttggccgttgcttctggggtgggcaggtgaggcgaagtagagcttgatgcccatgtcttcgcagtaatcgccgaaaagttcactagtgaattgggtgccgttatccgtaataatacggttaggcactccataccgggctgtgatgcccttaatgaatttaagtgcggagtgcttatcgatcttgacgaccggataagcctcgggccacttagtgaacttgtcgatcgcgacatacagatactcaaacccgcctggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccacattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactctcttcgcggtcctcgggtagagtcttatctgtgaggtatgcttggatctcagcgatccaagcaatcaatctaagggagctgggagcgctcccctcgggtcccgaggcctggactccgacgggcatcgggggcctgtcaggcgcgtccgtctcccctaaggggtcgggtcgcgccgacggctgggcaagcctttcttcaaaggcgcccggtggggtctgggctcgctaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccctagtccagctgccaccctgagtcccgcaaggagtccctcgtactctgccatattattggtcgcccgaaagtcaaggcgaaccaaatatctgaggacgtctccgttcggcgaggtcaacgtgacccccgcaccggcgccctgaagagacagggagccgtcgaactgcatcacccagtgggcggtgtgaggcagctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggcgctctttgtccaagtggcctcgcggagtgcactcgtcttctgtgccgacgacctcggggtcggaggatgataggggcggccttcccacagtggcctcggggccgtcctgggggtcgggggctcctggcgtcgtcggacaagcagggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcggggtcaccaggcaccgtctgacaagcgggcagagggcctgctccggtcgtcgggggccttgggccaccgttcggctcgggggcctctcctccctgctctctcccgggccaagccggcacagggtgagggtgcgcggaatgaggattgtcctcatcgcgctccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctgggggggcgcatccactctatagctcgtatcttctcggggttggcctcgatgcctcgggcagagaccaaaaacccgagaagcttgcccgcaggtacaccgaacacacacttatcggggttcagttttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacataccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggccttgcgcccgaccgcacggcgagacggtgctcaatcagctccctggggaccccgggcatatccgccggtctccatgcgaagacgtcagcgtttgcccgcaggaaagagacgagcgcgtcttcctatttaacgtccagaagaccaccgatccgtgtggtcttggacgggccgtcgcccagggcaacctccttgaccgggacctcgtcgcatgtgactatccgctgcctcggggcggcgggggcggaggtgccaagcctctcgtcgcctccctcgggcttggacgcggcggtgaggtggtccgcgcgctactccgtacaagcaagcgcgactttgaggtcgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacccgctccgtgcggaagttggcggatccaccgaaggtgaccgggaggtcgatatgacctagcggccaagtgtgacccggcgtcacaccgataatcggttgggacggccggagcaccatccccggggccttgatagcgtcaaaggcagcgggggaaaggatgttgagggctgctcccccatcaatgaggacacgccccagtttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatgatccctgaggctctggcgagaaacgtgagcacacgctcccccatcgacagtggcaatggtggccccaggctcttggaaacctaggtcatcatcgccgtcatcgatgtcctcggtgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcgtgaagggaggtgttgtggacgatgcaccacttgccggttgggcgctccctactgggagcgccggcctccttctttttgtcgctcgcaggcctcccctttcgggtggcccgcgaagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatccttccaagagtggactgacgcgggtggcaagttcattagccaaccccgtgcttgtcccttcagggccatgggaaagaaattcgccatgaccctgtcgtcacccccggcggcctcgatcccagtcgtgtagacctggagaaactcggcggggttgacgctcccatcatatttttcggcgatggtgggccggaaccttgggggccaacggacgttccgaaggctcgccacaaaggctctacagccgacaccaccaaccgggggcacggagggctgatccccgcgtccgtgttgatgtgacactccggacgagaaggcgccctccgttgcgtgggcagcacgtcggccattacgccggcgctcgatactgatgcgggcatccggccccccacgcagatcttcctgggtcggaggcgctgacgaaggagtggcggccgaatggcgagcaacagccgccgctcgccgcgccctctgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaagagcgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggttcggctgcccgtcgtcaccgctaactctcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgcgcaggcccccctttgccggttcggccgggggccctgggtgagattctaagctcctagtctgtgtgtggaaggttcgcgagaatggaaaaagcacaagacacgggcgatgtatacaggttcgggccgctgaaaagcgtaataccctactcctgtgttttggtggatctatgtatgaagaagctacaaaagagctggagaaccagagagctcttactctctccctctctgatcgttctgtatccgaaaaaatcaatcccccttctaagtgggcaaggtcctccttttatacctcaaggggataccacatgcaccatctctcttttttttttgtggggacttatcctctcttttcataaacagacggagacttgtatggttgtcgtccgaatgaccttctgatgggacggcccatacctacctccacttccgccggaagcaggcgcgacgtgggaacatggttgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgatgggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgtggttaggtgagccctgctatgctcacctaccccgtatacgcggcgcaaaacccacaaggggtcgggg

SEQ ID NO: 10851 - DNA, 9246 bp, Oryza sativa
ggggttaggccacgtgggtgatcgtgtctgcctcaagtctctaagtcatgatactcccggtcccatgtcaccgacagaatatatatcaaatcagtaattaaatatattttcataataaatttgtcttgggttgaaaatattattacttttttttataaatttggtcaaataaacttaaaacagtttgactttaacctaagtcaaaacatcctataacttgaaacggagggagtactcctactccactaatatactccttacgtcctaaaatataagcattaagatctcggcatgatcttcaagatgcttatgcttctttgaccaacaatatctacaaaagtaaaatgttttaaataaagagagttcatattatgatagttcgtttaatgataaatatgataacatcaaatttacatgattaatctttttaattttttttattaatagttaaaattttaaaagtttgatttataccatactaaaaatacttatattttggaacgaggacgggggagtacgcacttgatggagctgtacgtgcttcgagcggctatgaagacgtaatattatttgctccgatcttaaataacaaatattaaataagatatcattaaactcttgaaacattaactactacttttcatataatgaaaggttaatatagtgatactacttacgttttaaggtaaaatatacgtatgtaattatttttgtcaactatgaatttgagaagttactgccgatcaacgttttaaattttgaacaaattttgtcctaaacttaaatatttataaacaaagggagtatatttaattaaaagataagtccatttgatcctaattactacacttgtctaaaatacacctttcaactttaaaaccgataccccttctcgtcaaatttcaaaaccatttattttattccctcaattaaatcctgatgtttcttttgagaggcactcaagtcgggttccactgagcgatttattttttcttaaaaagaatgtgtgcctcacatggacagaaaccggctagcgcctagcctctctttctctccgacctgtatgtaccattgaaaaagttcactttgactctcttttaacttgatcaaatctgattcatatccattaaccataaaactggatatgacgacttctctaactattgaaaccgtcaaaaacgatgggaggccacttcgctgttggcgctggtgcggaaagggctgggatgggagagagagagaggagaaccacttcaccgctccccgtcatcatcctgacaccctgttgcgcttacgccgagaagaagaaagagggagagagggggagagagagaagagggagagaggttactagagagaagggatgacaggtacaagaaaacaccatatttatatggacttagtgcttctttaatcatttgtatttagaattttttgttagttagtgtttattattatgtttatatatggtaaaatggtaaatttgaaattataaaggtgaaataaacatgttaaggagtcagctcgtgagccaagcctagttaggcttttagctcattaaggttaatgaggtgaggttgttactgttatagataagacatacctaatatttttatgttagacttagcaggacccaccgtatattaagtcttgtacagaatcaagcctcacacatgtaagatgttttaaataaggaaagagaagcagagtcctacttaggcatgacaaggactactcggatcgtacttggcaccctagttatgattggacaaggggacacctaatgatataaatacaaaacgccacaggtgaagaggagagatgtgaagacatgccaatacagatttagacaattcaaggaaagcctagacaaacctaatatggagtcatagaggtcaacgagagggatctaggcgacctccaatctcaccaagttcatattcgaggaagcgtactatactagctgtcgaccacatgtgagagctctatgccgctaagctgaccaagactagattagattatcccaaatttagtactcgtgtgatactgatatatataaaggcaacactgacttcagccaataggaatagggctattaggggacccgaacctatataaaaacttgtccatatcggacacgacttaaactttacaaaaataaacacaccagcccattacgaactctaacatagatttctaaaactcataaaagaaaactgactcttatcctaattaatagatacgattgtctaaaacaaactccttgtttggcaatatctttaaatccttgatccgagctcgacttatagtcggaaactgtctgtatctgctatcttttccatatcggctaaccgagtctaattttgtatcgatcgatacggctctcagccgatgcgctgcattggccttggaaaccaaattaactccttcaaatccgctgttaacaggaggctgcgcgaggagatgggaggtgcgcagagaggagcggcggcggtcggtagggatatgtgccggcgaccacgccccacctgccaggatcatccaccgcgctggcgtcgcgccctccatgctgccaccactcctccactccatcgagcagcagtggaggcacgagaggaatacaagtgtcgaaacatgatttcggcaataataaaacggggtagcgcacgagacctaaaagtggatggatgcagagacaaaggatttagacaggttcaggccctctcaatgagaggtaataccctactcctgtttggggatttgaatccgccgggtgtagtatagatctgacgatcagtttgtctcatatgccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattccatagatataagttatcccctatgactagtcggataaccatgccgtatgggtatggggtacccataatatccacagtagcccctgagaccttcgtagtcgaaaagataatcttctctcgaatcagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaaccctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaaagaccacaatatatagtcagcctaagccataatattggtcaataaaaatgcacacttacgtggcaaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctataagaacgtgacaggccacacctgaaaatatgggctgcagacatattaggcctaggccaaaaaatatgccttcgacaccctttaaaggatgacgcatgtaacatgcttccgagtaataaatttggaacgggtgatatagaccaagtatagctcatatcaatcgcttctgatctgagtgattatcccttatgggatactccaaaatagatgtaacaattgaatcccgactggcgcaagtattcagttgataacccttacggggaataataaatagtccagtctttgagcatagaaaatagacccataatcacgaattcatattgcatatatccagagcaagtccaaattgaaggtatgatacttgtgtctgagctagtaagcccctgagcacgtagtcacaattgttcattgatggtagctgacgcaattggcatagagacaagacgacaaatacagagataatattgaccagcagaggtggcaaaaatattggtggtagtgaagatagtggtaccaatcaaaagtgatgaagttgcacagccgtggaggcgaagaaaccagtcggcagcagtcagatcagccagcaatgaatatgaaggcgctcagcgataaagttgtgtagttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaagtgctggtgatgatgtcagtgacaatagtccatcaaattaatgttatagctattgtagatgcttcacttggaggagagttgatgttgttgtccaactcgtccaaaccaaaatatttcaagttgttgaagtagaatgtctgctctgaatcaaagatgaagataatgactcctggagttgactcgttggttgatgaattaatttcttcagcttgacataaaatttgtcaaattttgagccttgtatttgtgtagcccccgactctttgattagttgggaaacaactgaacatagagtcgagaactgtagcatcttgtcgtcgaatagttattgcttgatttaagatatgtgttgaagatgtccaagtagaaatcatgaatgttggagagccacttgttgtagtaaaataacacggcatcgcctgccgagatgtcgagattcacaacaacgtcatggttggtgatgtagcaaaacttgtgaagtagcagcaatagagtttgctggtaccgaagataataaagatgaagtcgctccaccatgatgacaaagttgtgttgccgtgatgaagtgaacacgagtcggcggcaacagaagcaaaccggtagcgaagacgcgcagttgtgaagataaaagcaccagtcggcggcggcataatcagtcggcgacggaagatgatgatgtccatcagtagtggtagctgtataaaccagatgtagaggcgaggacactagtcagcagcagacgagacgaccagcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttagaacaggccagccgtgcaggcggtgataccagtcagcggcggatgcggcggccggtcggtgaagacgtagacgcccaacaacggcagcataataggctagccgtgcaggcggaaacaccagtcgacggcgggcgaggcggccggtcggtgaagacgtagacgcccaacaacggcagcataataggccagccgtgcaggcggaaacaccagtcggcggcgggcgaggcggccggtcggtgaagacgtagacgcccaacaacggcggcataataggccagccgtgcaggcggaaacaccagtcggcggcgggcgaggcggccggtcggtgaagacgtagacgcccaacaacggcggcataataggccagccgtgcaggcggagacaccagtcggcggcgggcgaggcggccggtcggtgaagacgtagacgcccaacaacggcggcataataggccagccgtgcaggcggaaacaccagtcggcggcgggcgaggcaagccggtcggtgaagacgtagacgcccaacaacggcagcataataggccagccgtgcaggcggagacaccagtcggcggcgggcgaggcggccggtcggtgaagacgtagacgcccaacaacggcggcataataggccagccgtgcaggcggaagcaccagtcggcggcggcgaaggcaagccggtcggtgaagacgtagacgcccaacaacggcggcataaaggccagccgtgcaggcggaaacaccagtcggcggcggcaaaggcaagccggtcggtgaagacgtagacgcccaacaacggcggcataaaggccagccatgcaggcggaaacaccattcggcggcggcgaaggcaagccggtcggtgaagacgtagacgcccaacaacggcggcataaaggccagccgtgcaggcggaagcaccagtcggcggcgggcgaggcggccggtcggtgatgttctgactgatccattcctggagcgtaagagataagcttaaagccatgaatcccttttatgcatatctggatctggatcctgcagaacaaacatataggatgagtagtatctgatataaatataatacttgagaaaaaatcaagtattttaaaatatttataaatatgtatttctcctcttgtcaattttgatttccccgagcagatgactctgtacgtttaaacactctgtccgactagtcatagccatcaagcatcgggagtcggcctaggcatttcccaaacatgcatatgagtgatatgagttcgtcattaatggaacaaagtttcacggatcagaatttactactcgggtacttttgcaattattaagagcagaaaataaatttatctcgtctctatgcttttgatttattccgaataatacttagcaccttgcgttactcggtccatcgaacgagcccccgggtgctaggaatcggcccaaaggcaaccatccaatggcaaaccaaacggaaagcataggaagatagaactccataactcgataggtacttttgtactcagattatgtcgcaagcaatcaagataaatattataaaaaatatgatataacatctatagccctcgactcactactcaatggaagaccaattggtgtagtgaggcagaggaaaaggaaaaatatcatataaagaataaaataaatgatgacttagctttgtaatattccccttggtgatggcagaagtgaccaatgtgggaacaaagtcgtccatcaataacaatgaagacaccagtcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgcaggcggaaacaccagtcggcggcggacgagacggccggtcggtgaagatgtagacgcccaacaacggtggtgtgaccaaccaaccatataggcgaagacaccagtcggcggcgacggaggcaggccggcggtgaagtcgtagacgcccaacaacggtggtgtgaccaaccaaccatataggcaaagacaccagtcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataacaggccagccgtgtaggcggaggcaccaatcggcggcgacggaggcaggccggcggcgtgaagtcgtagacgcccaacagcggcggcataataggccagccgtgtaggcggaggcaccactcggcggcgacggaggcaggccggcggtgaagtcgtagacgcccaacagcggcggcataatagaccagccgtgtaggcggaggcaccaatcggcggcgacggaggcaagccagtggtgaagacgatgtcgctatcggcaacggcggcggcacacaccaaccgtggcagcgaggccgcaagcagtgaatgattgtttgatctcgactgccatccaatgcatgcgaacaaccatcgctccagcatacatgtagattaaatcgacgtatacacgtgcttgctcctggtggccgagtatattcctgtgtcctgtgccaatctagcagcacgtccatctgcatggaagggaagagaggagcactcggacacggcaagaggcacccgagtggccgagtaggcgacgatggcggccgtgtcgtgatctcaaccagcatgtgaaaaacaacaaaaattgccaggaaatcaaaacggccggcggggattagggattaattaataatcaatctaataaaaattaaattggaacagccaacccaagttgtacggcgtggcttggatacgtcgtgcgcgtcgatcagcttgggtcgcaatgcctcgatcagcagtagccggcggaagccatcaacggccctgcgacctcggagagtcggcagcatgtagatgaccgaccggggcagctgtaaagcctaatgataacagctcggaggcgaccgactacggagacggtggagccggtcggcgctgacggatatagccggcagtagatacggccggcggtgtacatgcaagacagatagcaacaaaataattgctggttagaatcaactagtaaacagattaactctgtagatgtaatgtgcatggtggttggatcgtgcatgtatgttgatcagttgaatcaactcatgcagtgttttctc

SEQ ID NO: 10852 - DNA, 1484 bp, Oryza sativa
  unsure (1)..(1484): unsure at all n locations
caccagtcgccgccgatgaagcaagnccggtggtaagtcgtanacgcccacaagcgncggcataatagnccagccgtgtagccgaaggcaccaatcggcgncgacgaaggcaggccggcggtgaagtcgtagaccccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggtggtgaagtcgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccaatcggcggcgacggaggcaggccggcggtgaagtcgtagacgctcaacagcggcggcctaataggccagccgtgtaggcggcggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgcagacgcccaacagcggcggcataataggccagccgtgtaggcggaggcaccactcggcggcgacggaggcaggccggcggtgaagtcgtagacgcccaacagcggcggcataataggccagccgtgtagcggaggcacaccaggcatgcacggaggcaggccggcggtgaggggatcctctagagtcgacctgcaggc

SEQ ID NO: 10853 - DNA, 5422 bp, Oryza sativa
  unsure (1)..(5422): unsure at all n locations
tcgtcgccgacggaggcagaccggcggtgaagtcgtagacgcccaacagcggcggcataataggccagccgtgtaggcggaggcaccaatcgacggcgacgaaggcaggccggcggtgaagtcgtagacgcccaacagcggcggcataataggccagccgtgtaggcggaggcaccactcggcgacgacggaggcaagccggcggtgaagtcgtagacgcccaacagcggcggcataataggccagccgtgtaggcggaggcaccaatcggcggcgacggaggcaggccggcggtgaagatgacgatgcccatcaacggtggtgtgaccaaccgaccgtataggcggggacaccagtcggcggcgacggaggcaggtcggtggtgaagtcgtagacgcccaacagcggcggcttaataggccagccatgtagacggaaacaccagtcggcaagagtagtgccgcggcgttacatgcaaacagcagaaaataccaagagagattaatctgacatttagagatcaatctaataaacaacaataagttgaaaaggaaaaaacccggcgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgagctgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagtttattccatcgcactcgtcgtcaggaaactcggcgtttacccctacctggcgcgccaactgtcgaaacatgatttcggcaataataaaacggggtagcgcacgagacctaaaagtggatggatgcagagacaaaggatttagacaggttcaggccctctcaatgagaggtaataccctactcctgtttggggatttgaatccgccgggtgtagtatagatctgacgatcaggttgtctcatatgccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattccatagatataagttatcccctatgactagtcggataaccatgccgtatgggtatggggtacccataatatccacaacaagggaggacggcctcacctggcacgtccagcacggcctcgacgcggcggcggtggtggctaggtcacctcctccacactgtccaggtcgaagaacctagactcagcgttgtccacagggccggcgttgttgtcgtcatcctccgccgccttatcccttgcccgtgccgctgttgacgcaaaaaacacacactggcctgggagatctgcttagttccagtgcatatccaaaggacgatgagatgcgggtctgccagtcagtttgactctgcaactgacaaaatatacaaatagcatatcaatgagccgatcggctgacaagccgatggagtaattctagcccatgcctatgtcagccgatagcgatagggttttgagctatcgactatatatccaatgtagaatctgacacttgatgtaaacaacaatataaaggcaatcggttgatgataatataatatagcaataatatagtccagtagaaaccattcggctaataatgatatggtaaataagcatcgatccgaaggttaaagcatacatcggctggaggtccgatagcattaaatccacaagattagataatcagtaaaatctttgttgccatcggctaaatccaatatgtatgcaatccttgtaagctgatgcaacgtctagataactcattggctgaaaccccgatgaaacacttattggcagtcaaaaagcaggctagggattatggttttaaacacgacttagtagatcaaacttaacttatgcagcactaagtatgaatagaaacataatatctagacaatcaagcctttgactaatttttgggtggtagatgtcttagctaatctaatctagtaaaacaatttagccggtaccgacaggaaccctaaagcgagaaacaactgatagagctaaattgagatactaagactagattaactaagacatatgataaataggcagacaaatatatcatccaaaccggagcaatccaagaggtcgaacgtactgatgcagtcttgaacgacgccgacgtagactagacaattgcctgggccggcgaaacattggacttgccccttcgccggagatcgaaaaccgatgcagccctgtgtcaggtgccaagttccgccagatggtaaataaagtagaaaagtataaatgtgtggcgatgcgccgaattgtattgattgtgagatattttacaatgaccccgggtgtacatatttatacccatggggagatactagtcattgtaggacaagaaagaaactttcttaaagataaaaggaaaatataaagtccttataggacactaaacacactttcctaaagataaaaggaaactaacaaattattcctaattaatagataacttgctatgccgcatcattcttgaactcggtcacttttagataaatagatcaatttccttaaccgaatatagcaggaatccgactattggcgatgcgataattctcctaggggcttaccaaatttcaccgttaatagccgcaaccgccgcatgctggagctatgcgtggagcgccaccacggtggactggtcggcaagcgccttcgcctgccacgccaccgcctccgcccttagctgcacgacacactccaactcggtgccgtgccgcgtgacattcaaggcctccgcctccttctccctcattcggcgtgcctccgctcctctcctgcgcgccacccatctccttgccggcctctccaccccgcctctttcgagaaccctcccccacctttgactcctacgacgaggatgcgcggtatggagtaggaggtggaggggacgaggagctcgctcgccgctgcccctttgctccgcccatcgcccaccccgctcgtcgcttgctctggccttctccttgcaaggaaaagagaggatagagagaagcagagagtagcgaggatgacatgtgaggccacatgggcctcaccattgtttttattgttttgtgtgtgtaactaatatgtgggcccatgatttttttatttttctggatcaaattgtcacgtaagtgtcacgtcaatgctatataggatgaaaaccttgttaaaagatctatgtaggttccatattagccaagcccgggtcaatactactgagggatctcatttgcatggctttgtaagttaaggatgtgttgtatctggttttctggattgtttgcatgattttgtaattgtgttgtatccggttttccggattgaggacgaaaatgcgataaatggagggacctattgtgaacttattcggcctccaaaactagaaagccgtaacgtgccaaacgggcccaggaaaggaaggagggtatgcctttagagaatctggcctgtccgagagagacggaatagcccatctgacatctttgccaaaccctaaccgcctctggctcggcggcggcggcggcggctcgtccccgaagagcagccggagttggagaggatcggtgttcccgctacggtatgtacgctctctcacgccaatcaatcctctatattcggatgcaatnnnnnnnnnnnnnnnnnnnnnnnnnnnnnnnnnnnnntttagattaccctcagtcttatatcatctcatctggcagcggcggcaaagatcgatggtggacaccgatgagcggtggcgcgctgcggtgattggcggtggtggagatgctgctactgcgacggagcctagtctgcccgccgcgataacgcggcgtctgcgggagctcgcatgggaggacaaggacaaggagaaggctcgcacggtcgttgatctagtcgactccgaaacccctatcgaatgcgatcacgaagagggtcatctttgccctagtccctgctccgacattccttctagtaagtatttacctcaggaaatatccctctccgtttgttcattgttttgccggatacatgatttttttttttcaaaattccctagtggttgcagctagcggtggtggtggtggcaatgaagagatgggcaaggtgaattgtaatgagaagcacacatatggtgaggagaaggagaaggagaaggagaaggtggtggagactaagtcggagctgaagcctaaaccgaggaggaagaattgggaggaggaggagctcacatgggaggagaaggtgttgaaggttcttcacatggttcgtatatgggaggtgactgaattcgaccccaagatggagtggtttgagcctacccgcctttgcctcttcaacaccgccttcttcgacctcgacaaagagtgtgagtacatgcattcaccatgcatcaatcccttaacctcaattccttgtatatgatctaattcaacttaacattcgtatgcggcctctctatccattcatcacatttgttgatggatttattttagtgtgtaaaaaccatacatattcttttgtctgattgaagtctcatgtctctgattttacagctaaggctgggcttgggccaccgattcactcgctcacttcctctgattatcgccatttggagacctccatgaatatcatttcaatcaaggttgtcgaatctgacgtgggttaccctatcagcatcttcggcaccgtgttagcgagagatcagtatgactataggtgtgtgtatttgttcaggcgtagcagggacgatccccagatcatcacctcaccggtttgtattcgattcgtcctccctcttactacactgccattcactactcaatagcatatttccttatttttatgagattagactgtttctgtcaatatgttctggttttaagttttaccgggatggaataatggaaaccatctacgtggtcaaaacaaccgtataaaagttcagggaggtgatgttatagaaccatgtaannnnnnnnnnnnnnnnnnnnnnnnnnnnnnnnnnnnnnnnnnnnnnnnnnnnnnn

SEQ ID NO: 10854 - DNA, 7761 bp, Oryza sativa
  unsure (1)..(7761): unsure at all n locations
tctcatgtctctgattttacagctaaggctgggcttgggccaccgattcactcgctcacttcctctgattatcgccatttggagacctccatgaatatcatttcaatcaaggttgtcgaatctgacgtgggttaccctatcagcatcttcggcaccgtgttagcgagagatcagtatgactataggtgtgtgtatttgttcaggcgtagcagggacgatccccagatcatcacctcaccggtttgtattcgattcgtcctccctcttactacactgccattcactactcaatagcatatttccttatttttatgagattagactgtttctgtcaatatgttctggttttaagttttaccgggatggaataatggaaaccatctacgtggtcaaaacaaccgtataaaagttcagggaggtgatgttatagaaccatgtaaaatttaggatcaaactcaatccgttttgtgagatatgaaattgagaaaccaggaaaaaataagtccttttcttgctgtttgcctgtttcatatctcacaaactagattgggtttttttcttgaacttttacatagttgcataatatcacctcacccacacatgagataattttcagtattattggaaatatcaaatgtttatcaagtggtttgcacgtctgcacatattttctcttgctttaacctgttataaacactgtaagaacaaatcggcttggctacataccaccaaaagattcatcaattcatctcagaaaatgcatttcactctgttatattctttttttcttgcacattaaatcgtgtaaatgaacagttggtcctcaatgtactagtgagcaagtttgattcacacatacacttaatgttttatctcattttgtgaaaatagaaatgaggcatataatgtgattaacagggcatgatggaagttgacagtgctaaattatcaagtcttggatcttctaatgacattaactgaattctcataagttgcttatgattaaattgcatgatctagagaagtatatctttgtcatttaatcggtccatactgcccataaaatgcatgagttggctttcatttttgtttgatcttttagttagactatgtcttattttagtctaacaagcacacatacatgagagaccgaccaatttatagaaattgggttggtgtcagactcaccaccaccgaaggttttggtgagcaactgttttggttgtaaacacttaaatatcaaattgttggtatcttctcaagtttctgttgaacctggtcttgacatcatctgaattatgcttgattactgagcttggttccttttatgtaattttgttatgttatttccctaaatccctttgcaggaggacatgctaactttgacaggcccaaagcgaggtcttggtgcaaaagattatatgtttttcgagttcaatttaaagatgaagggcgatgatggagttgacaaagattttagcaaaggtttgctgccatacaatgtcgtctgtcgaacagggagactcgagactttacatctcaggagctggctaagtgtagtggaatttgcattcgtgactgttcaatatgccgttgaagctacccttgcggtgaaaatgttagggggggcatctgttttcactggtagagtgactgcttggactactggaaatgatgaagatgaaatagttctctatgacagtgaagttgcagacactcggacagagattacagctgatggatctgttcagctaaatcgtggtttagtagttgtcccattggataaggagctggtgctcaatatttgtgtgtttgagggtgaagatgaagctcaaagctttgagttcattctagggcactatgatgaagaatttacctgcaagcaaggctgttatgagtttcaagttaatattatttggacggcagtaaagactcggcgacggcccaatatgtggaagcgcattggttgcattgtactgttactttgaaggctgtaaaaagggtgcacttatcagagtcatatatgatcggtgcactcaaaacatatctatctatccataaaatttcctaagaatattctcttagatatgtattgctagtctcagtctgtaaatgatgatcacgcttatcttaattagacacatgcatgcgtggtattccctccgtttcaggttataagacgttttaactttggtcgaagtcaaactgctttaaatttggtcaagcttgtagaaaaaaaatagtgacattttcaactcaagataaatttattataaaaatgtattcaattattgattcgatgaaactaatttagtattataaatattattatatttatttataaacctagttaaacttgaaataatttgactttgaccatagtcaaaacgtcttatgacctaaaacagagagattaatatctgagatgcagtgacagttgccaccctcctgccctgaacctaatccagcggccatacaattgctacgtcgtctctcgagtcaagaagttcaccataggaactggatggcattgcgcacgctctctatctaagcctgtttttttttaactacttcactgcagagtatatatttttgttataaaaagaaatcttatattagattgcttaaactaattgttttcagcatggcagacaggtcaaagcctgctgccctctgaagttttcgtttgccatcccaacacaaaaagcgaactcatgcaatttgaatcagatttgataaggaagttaaagtgaactttttatttttaaattttacaaataaactctctcaaaaacttatttccacgaacttttggtcacgccagacagactatcttaacccaacgtggcaatattgtttcaccacgccatcttaactggggtgccaaaacaaaatgctgttttaccacgttagacggggtttggcgtagtgaaaaagatttattttttggaaacaaattttacgagagtttattttaaaaattaaaaaaatcaaaaaatcaaaaaatgataacaaattgtctcacgagtgatccgatccaaccaagtagtttagtccgttatgttcttccgccacatcacaataattatattaccctagttttcctttccctctctctgcgggcggcggccacatctccctggtacgcgcgcgcacatcgatcccctctttttttttttttttgacgctgcatcgatcccctcttcttccgaattcgatgcaatcgcctcttcttctttttttgttcatttatctccatcatatcgcgcatcagcagcaacgctcgcagatggcggagggcggcaacgacggttcggttgcgggggatcggctcatggttgcaacaatcaagcgcaagcgggagcttgccgaagaagatggagattcttcttccccttgtagcgctaatcgatccctcgacatggaggtagtggaggagaaattgtattgctcttatggtgagtactagtgtacattattattattccataattaattcgtcaatatatctatcattcagataactcagacattacaattagtatatgtgtattgattatgtgagcagcctgatatatatgtatagtttaccctgtttgattcctgattacttgcttggttgctgctggatggatgtaacatatataagataataagaattacaaattataagataaacacatcaccttgagcgcgcggcacatgtcgttctaacctgagctgcagcgacgacgacgacagagagacaattgaaacaatgttcaaggaacttccaattggaaaccccaccataagcatggatgaggatgtggtttacttgctctctataactagccccatgaaaacggataggttagaagttgtgtttgctgtcccccgcaaaaaaaaaaaaaaagaagaagttgtgtttgctgttgatgtgaggaagggtatgcttcaaggattagctaagcttgatgttcgcccgaagaacttggctatcatggtcactttatggaccagtgagatttgtaggtatctagtctgaggaatattattacaggtaacttaattctctacgctggtaattaactttattgtgtgtttttatgcgtgatcaatatgtgtgagtatgaatgccatgcttgccatttttaagatctagggaattgttgtgttggtaattttctggtttcagtagggtctagagcttaattcagaagccatggcttgatgacagtgttatgccacaaaaagattgaatccatctcaaaatacaccaatccgttacaaaaagattgaatcttgttggctacattgttcttgattagtgagacagtctgatgtgcagatgcacaataatgttctctcatttgaagaaaagaacaaatcatgtactttactcgcttggaaccattagttgagttgtattttctatttatgcaaacccaactttgatggtaaaatacttaaaattattatatgtacgtagtatgtgctccctttataaatatttaatgcagttgattttgatcataaagtttgatcatttatcatatttaaaagtttagtgtaaaaatatgcaaaaatatcatgtttaaagtacctttaacaataaaacaagtcaaaaaaaataattgtatttttttaataagataaattatcaaattttgttgtcaaagtcaactgcgttatgaccagaggaaagtacccgaatctcttaacatacaggtggcattgtcttaattgtattggacttgtcgagcttggtgttttttgcgggcatttctgacatgatttttcctaatctatttacaggaggaaccattaactttgacaggacctaataatcgagtacttggtacactatacagaattgagttacatttaaagattagagacgatggtggtgttgaccaagatttctgcgagaagccgagaacacaatgcatcagctataattttttaggttcataatataaatttagtgaaagtggcaacaaaatgtccggaccagtatgtgaacaagtagaatcgaatggcaaattaatcttctgtagctgccataaaattaggaacaaaattatgtagctctgtgatggaaagcttgaaggagctcagaattccagtcaatttctagtatacaaaagaaaaactaaaaaaaagtttaaactcaaagcccactagtaaatactactaatacaactaaggcccatattgggcccacacggcccacgaacagcaacctaatcctcgcgctggaagagacgagacagtacgccacgcgccgcctgagccctcgcgtcgcgacaccgctcgccgcggcggcgctgctcctctccagcgaccacgcgaggagggagaagaggaggaagaaggcgagaagggagcaagctagaagagtgggagagggggacatctaggtcgtcgacggcctcaatggggtggggcataccgacgcggccgccggcgacgtcgacgccgtcgcgggtgcaggcgctgtacgagctctgcaagcgcaccttcccgtcgccgtcctccgtcgccgcgtcctcctcgccgtcgtctccacctcccgaccacgccatccgcgccatctcctctctcatgggtaggtcacctgacctccaccaactcctcttcctcccgacctcggcccaatttttgttttgttcttgtgttcagagttcggacagccaattgattgctctttcctctgcaaaatcgttcgtatgctgatgtattgaggaattggatgtgagttttgtgttcagatacaatcactcctgtggatgttggactcagagatgataatcttgaggatggaagaggatttgggttctttgaatcaaacttcttgaagaattcagcaagggttgctagatgggcgcaacccataacctacctgcatgtctacgagtgttacgccttctctgtatgaggatgctcaacttggtcatcttcttgtattgtaacacttctgtgaaagagtagaatttaatgaatacttgtatatcttctctgctaacctgcaattgtttcctgtatgttccatagattggaatattctgcttaccaacgtcggcggtcattcctctccatgatcatccgggaatgactgtattgagcaaattactctatggttcgatgcatgtcaaatcgtatgattgggtagagcctgctgttctagcaagtggcaagccaggttatttttcataccctgtttcaaatatttgtttttatttatctactagtatatattgcattgcagagttatgacttaatgagcttgttgtctctgagaatagaagtgtaaaacatttatgcttcagatggtttctagaatagcaagttaatgaataatagcggttgtggcatagtatcgatactacccagccctattggtcactagtgttgcactgttgctcaggcatcattttagattgctcatttctatgccttgatgatttttcgggttctggtatattaaggattttttttttctttctcctgatgtgcagtgaaacttggaaagttacatacggatgatgttctgaatgccccttgtccaactgctgttttcagtggcggagacagcgtgggggcgccaattttaatcccaagagggtctgaaatagactttgttctgagattttagaaggcccaacaggctgagaaggcccaaaatatcccacaactctacccaaccggccaaccctaatctctttccccaaccgaagagaggcggagactcgtggcggcggcggcacacgagcgcactcgcgcgcgacggcttccagttcaaagcgccggtgaggcggccggcggtcggcaaggggacgcgacgcgcggcggcggcgcgccggcactgcagcagccagcagcagctagggcacgcggctcaccggccgctggctgctggggcctgggggcgccgggcggcagcaaggcagccaggcagggctcggcgcgcgggcggcctggcgggggnactcggcggcgcgccggcacagcagcagccaggcaactgaggcaaggcaacaaggcaagtagcgccgggcagcaacaagccaggcggcaagccggacggcaccaaccaccaaagcagcaaggcaagcagcagcaagcgtcaaggggcaaggcaacaactcaacaattgaggatttgaacaagtgaggtatataaaatttctgatttgtcatttaaaatcaatttcaattgtcatggctagttgttattgatagttcaagtcttcaaaaaatcatagattttgattcctagtttgctactttgttatattgctagattgcgaagatgtcaaaaagaacactgctcacatgttatttgacatttcttttgtataggttaccctgatgaagaataattggtgatagggtgtactagtgtcgcacatcatgtcattatctattggatatttcaatattgttttggtatggataatgcttatttcttgttaattctatatatttacactttgtattagacatatagtcaatttacataagacatgtctcaacttttctcggccacttttagttcagcccccactataatgtaatcctggctctgccactggctgttttgtatccccaaagtggtgggaacatgcactgcttcacttcagtaaaatcttgtgctgttcttgatgtcattgccccaccatactctgaatcatctggccgtgtttgcccctattttcatgattatccattttctagcttctgtaagtgaaatccctcactgtcgtcatattacatattt

SEQ ID NO: 10855 - DNA, 953 bp, Oryza sativa
taaaaaaaagttttaaactcaaagcccgttagtaaatactactaatacaactaaggcccatattgggccgcccatcacggcccacgaacagcaacctaatcctcgcgctggaagagacgagacaatacgccacgcgccgcctgagccctcgcgtcgcgacaccgctcgccgcggcggcgctgctcctctccggcgaccacgcgaggagggagaagaggaggaagaaggcgagaagggagcgagctggaagagcgggagagggggacatctaggtcgtcgacggcctcatcaatggggtggggcatgccgacgcggccaccggcgacgtctacgccgtcgcgggtgcaggcgctgtacgagctctgcaagcgcaccttcccatcgccgtcctccgtcgccgcgtcctcctcaccgtcgtccccgccgcccgaccacgccatccgcgccatctcctctctgatgggtaggtgacctgacctgacctgacccgccgcccaatcttgtttttgttcttggttcagagttcggactgcaaattgattgctctttcctctgcaaaatcgttcgtatgctgatgtattgaggaattggatgtgatttttgtgttcagatacaataactcctgttgatgttggactcagagatgataatctcgaggatggaagagggtttgggttctttgaatcaaacttcctgaagaattcagcgagggttgctagatgggcgcaacccatcacttatctgcatgtctacgagtgtgacgccttctctgtatgtggatgctcaacttggtcatcttcttgtattgtaacacttctgtgaaagagtagaatttaatgaatacttgtatatcttctctgctaacctgcaattgtttcctgtatgttccatagattggaatattctgcttaccaacgtcggcggtcattcctctccatgatcatccgggaatg

SEQ ID NO: 10856 - DNA, 1197 bp, Oryza sativa
ttaggcttaggccaaaaaatatgccttcgacacccttaaaggatgacgcatgtgacatgctcccgagtaacaattcttctgggtaatatagaccaagtgtagctcatatgaatagcttctgatctgaatgactatcccttatgggatactccaaaataaatataataattgaatcccgactggcgcaagtattcagttgatagcctttacggggaataataattggtccagtctttgagcatagaagatagactcatgactatgaatccatgtggaatgtatccggaacaagtcccaattggagatataatcctcacgcttgagttgatgagcccctgagcatatagtttgtccttctgtcatagtcaaaattgtctattggcaatagctgacgcagtcggcatggagatgaaatgaccaacatgaagacgaaattgctcatcagaagtaacggaagatgtcagtggtagtaaaaaacagtgacaccaatcaaaggtaatgaagttgcataaccatggaggcgaagaaacagtcggtgatgacaaaagcaaaccgacgatgaagacgtagacgcgcatcaacagtgatggcgaaatccaccaatcatgaagatgaagaaaatagttgacgacgacaaacgcaaccgacatgatgaagatgacgatgtcggtgatccagccaatagcagtgtagcaaccaatgataatgacaaagacgctcatcagcatttgcatagtaggtcaaccgtcaaggtgaaataataagtcggcgaaaacataatcatccattagcaacagcagagatgtcagggtcgatgaagcagaggtgctggtgatgatgtcagtgacaataatccatcaaattggtgttatagctgttgcagatgcttcacttggaggaaagtagatgatgttgtccaactcgtcgaaactgagctgattggttgataactctgctctaaagcaaagacgaagataatgactcctggaattgactcgttggctgattaattgattgcttcatcttgtcgaattttgagagtcttgtatttgtgtagcccccgactctttggttagttgggaaacaactgaacatagagtcgagaattatagcttcttgtcgtcgagtaatcattgcttgattgaagatatgtgttgaagatgtccaagtagaaatccggtagtgaagacgcgcagt

SEQ ID NO: 10857 - DNA, 966 bp, Oryza sativa
  unsure (1)..(966): unsure at all n locations
gttactttgaaggctgtaaaaagggtgcacttatcagagtcatatatgatcggtgcactcaaaacatatctatctatccataaaatttcctaagaatattctcttagatatgtattgctagtctcagtctgtaaatgatgatcacgcttatcttaattagacacatgcatgcgtggtattccctccgtttcaggttataagacgttttaactttggtcgaagtcaaactgctttaaatttggtcaagcttgtagaaaaaaaatagtgacattttcaactcaagataaatttattataaaaatgtattcaattattgattcgatgaaactaatttagtattataaatattattatatttatttataaacctagttaaacttgaaataatttgactttgaccatagtcaaaacgtcttatgacctaaaacagagagattaatatctgagatgcagtgacagttgccaccctcctgccctgaacctaatccagcggccatacaattgctacgtcgtctctcgagtcaagaagttcaccataggaactggatggcattgcgcacgctctctatctaagcctgtttttttttaactacttcactgcagagtatatatttttgttataaaaagaaatcttatattagattgcttaaactaattgttttcagcatggcagacaggtcaaagcctgctgccctctgaagttttcgtttgccatcccaacacaaaaagcgaactcatgcaatttgaatcagatttgataaggaagttaaagtgaactttttatttttaaattttacaaataaactctctcaaaaacttatttccacgaacttttggtcacgccagacagactatcttaacccaacgtggcaatattgtttcaccacgccatcttaactggggtnnnnnnnnnnnnnnnnnnnnnnnnnnnnnnnnnnnnnnnnnnnnnnnnnnnnnnnnnnnnnn

SEQ ID NO: 10858 - DNA, 1112 bp, Oryza sativa
  unsure (1)..(1112): unsure at all n locations
nnnnnnnnnnnnnnnnnnnnnnnnnnnnnnnnnnnnnnnnnnnnnnnnnnnnnnnaagacttaatccgtgcatggcaatccacatgaagcacattaactcaacctgacaatgtgtatcgagtcatattgttggaatcggcttaatcggctaaccttgtctgactcgaactctgccgactctgattgcagccgattcttgctctgttcccagaacgatctccatcttggattccgcttcggttttatcttcatctccgatacttgaattatcaaatttggttgttaacaaatatgtcggtgatttattgcaaaagaatgtttcaattcactgcaacattagatctatacatagtgaaacattatgagtacactaggtgaaatattttttgtggaacaaaaaatgaaacgataaaacgaattcccttaatagagagtttccaaaatacgtgggtgatttgttgcaatggagtatgtggtgtacacatagcagggtgggggcagagacacgtgggtggggccagcggacgcgtccatcgtttgggtgggagcgcccgatcccccccccccccccaccgagcgaccgacggggaggattcccggtttgcaatcctaatgctatattaatcaaggtatgcagattggatagtaaaatctataaggcgtgcgaattgagtgctatattctctaaattctcgtcgtcttcctgtctcacgcggaggcagcgatattccccttctcccacgactttcttcgtcttcttcgtctctctccccttctcccacggcttgctgctgctgcccatatcagcaggaccccatctccggcgacatccctccccaggcggcaggcggcggtgtgtgctgatcagctgatgcccccacgtcggcggcatcctggcggtcggctcccatggcggcggcgtcctatcctgtcgggcagcgtgctgacaacagaaacacttataggatttggcgctgaaaattgtttatgccctttgaacaacaaagcatgttcattatattgataaacaaaaatttctgctatcagatgtgctgcaaaaatcgagatgttgaggttatataatttagtgctgaaaagttaatgttctattt

SEQ ID NO: 10859 - DNA, 720 bp, Oryza sativa
  unsure (1)..(720): unsure at all n locations
nnnnnnnnnnnnnnnnnnnnnnnnnnnnnnnnnnnnnnnnnnnnnnnnnnnnnnnnnnnnnnnnnntgttgcatcaacgggaggtgccgtgctatcacggctcaccttgagcctttcttccattggagtggcgcaagggttgcagtccttgaggccagccgactccacaatgcgctgagcatagcgcccctggttcagggagattccatcatctccttgcttcacctcaattccaaggtagaaagagagcaagccaagatcactcatctgaaactttgccttcatttcttccttgaattgttcaattgctcttgtcgatggcccggtgatcacaaggtcatctacatagaccccgacgagtagagcagagccaccattgtttcgtcggtacatggcgtgctcatgcttgctttggtcgaaaccgagctccttcagagtacaatcaagcttcgcattccaggctcttggcgcctggcgcaggccataaagagccttgcgcaggcggaggaccttgtcttcttctccggcgacgacaaaaccagggggctgcttcacatacacctcctctgccaaatcttcattgagaaaggcagacttcacgtccatgtgatggacgtgccaccctttttgggcggcgaccgcaagcaggagacgaattgactccatgcgcgcgacgggcgcaaacacctcgtcaaaatcaatcccagggtggtggacaaa

SEQ ID NO: 10860 - DNA, 776 bp, Oryza sativa
  unsure (1)..(776): unsure at all n locations
nnnnnnnnnnnnnnnnnnnnnnnnnnnnnnnnnnnnnnnnnnnnnnnnnnnnnnnnnnnnnnnnncatttgagaagtaccccgtttggcgctttcttgtatagatcattgccgatcgtgccatagatttttgctttacgggttattttcttggcctctgcatcgtcctcgagcaactcgtcgctgttgatgaatttgatcagtggggtgcgccagtcgtctgtggttttgatatcggcaacggcgcgttctgcctctgtggcctccgagctgatgtcgggggtgtctgggttaacttcgccgctgacctcttttaccgatggctttgccaggatgtccagaaaagtgccgggttcgagtggttctcgtctggacgtgcgtcgtgctagctcgtctggctcgacgttttctttgcggtatacgtgtcggaccttgatcccatcgaaccttttctcctgcttcctaacttctgcgagatacttggataactcggggttggagcatttataatctttgtgtacctggttcgcgactagttcggagtcccctttcacgatcagtcgtttgaccccaaatgcggttgcggctcttatcctggcgagtagtccttcttactcggccgtgttgttggttgccctgaagttgaggtggattgcgtgcttgaattgatctccagaaggagatgtcaagatgaatcctgcccctgctccttggctgttgagtgcaccatcgaacgccattgtccacgtttcgttgtcgatttggttgtctgatttg

SEQ ID NO: 10861 - DNA, 653 bp, Oryza sativa
ggctcgctagaaagatgggccgacaagagctcgtgcgtgcctgcctcgactgaagcatgtcgagcagctttgcgacacgtgtgtcatcaccaagcatcggcgcgctgcctttccaaagcagcaaagtaccgcgctcagaagccgctagatctcgtccatggcgacatctgtggccctatcacgccggcaacgccaagtggccggcgttacttcttgctgctggtcgacgatgccacacgatacatgtgggtggcgctcctagcagccaagagcaatgcacctgacgccatcaagaaaattcagatggcagccgagactcactgtgggcgcaagctgtgtgtatttcgcacggacaacggcggcgagttcacgtcgcttgagttcgccacctactgcactgatgagggtatccaacgtcatttctccgcgccgtacgccccacaacaaaatggcgtggtcgagcggcggaatcagacagtggtgtccatggcgcgcgcccttctcaaacagaggggaatgcctgcggagttttggggggaggctgtcagcacggctgtcttcctcctcaatcgtgccccaaccaaaagcctcactggcaagacgccgtatgaagcttggcacggcaagaagccgatggtcagcttcctacgtac

SEQ ID NO: 10862 - DNA, 770 bp, Oryza sativa
  unsure (1)..(770): unsure at all n locations
cacggctggcctattatgccgccgttgttgcgcgtatacgtcttcaccgaccggccgcctcgcccgccgccgactggtgtctccgcctgcacggctggcctattatgccgccgttgttgggcgtctacgtcttcaccgaccggctgcctcgcccgccgccgactggtgtctccgcctgcacggctggcctattatgccgccgttgttgggcgtctacgtcttcaccgaccggccgcctcgcccgccgccgactggtgtctccgcctgcacggctggcctattatgccgccgttgttgcgcgtctacgtcttcaccgaccggccgcctcgcccgccgccgactggtgtctccgcctgcacggctggcctattatgctgccgttgttgggcgtctacgtcttcaccgaccggcttgccttcgccgccgccgactggtgcttccgcctgcacggctggcctattatgccgccgttgttgggcgtctacgtcttcaccgaacggccgcctcgtccgccgccgactggtgcttccgcctgcacggctggcctattatgccgccgttgttgggcgtctacgtcttcacggatccgctagcctcgacctccaggactggtgtctccgcctgcacggctggcctattatgccgccgttgttgggcgtctacgtcttcannnnnnnnnnnnnnnnnnnnnnnnnnnnnnnnnnnnnnnnnnnnnnnnnnnnnnnnnnattatgccgncgttgttgggcgtctacgtnttaaccgaccgg

SEQ ID NO: 10863 - DNA, 850 bp, Oryza sativa
  unsure (1)..(850): unsure at all n locations
tctctcaattctccccctcgaaatatggcctaaacgatagtgccataatttcgatgagacatcaggagttctctttcttttcttggtttcttttgtcaacgaggacacaacattcacattctcagaaagagataacaaataaagctcatcttgcaacacaacaaagaattgggctcaatcccagagtgtgacaccgtctctgagtacctcgaaagaataaagagccagtttactggttcttcaaagacttatgcgacacagctgataaagcagcttgtgacagagaggtaccatgggggtggtgtaagagaccacattcttaggatgagcaacatggcttccaagttgaagccaatggatttgggtatcacagatgactttctggtccatctggttatggcctcattgccaaagcattttgacaactttattgtcaacttcaacataagtctagagaaatggaattttgaaaagctcatcgctaattgtgtgcaagaggaggaaagaatcaaagagtccaatggtggctctattaactatgttaaagataacaagaaaaagagccacaaaccatcccctcaaaagggaaatagcctcagcatctgcctcagcaacaacatttcactgttgaaaaggatcagtgtctccactgcaagaagacatgacattacaagaaagattgtcctgacttcctgaaaatgatcatggcaaagaaaggtgagaacattattacatttgtaaatgaatctcattatgttggttattttagatccacatggtggattgatnnnnnnnnnnnnnnnnnnnnnnnnnnnnnnnnnnnnnnnnnnnnnnnnnnnnnnnnnnnnnn

SEQ ID NO: 10864 - DNA, 883 bp, Oryza sativa
cggaaagcataggaggatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggaggcataataggtcagccgtgtaagcggaaacaccagtcgacggcaacgaaggtgagccaacggtgaggatgtagacattcaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcgaaggcaccactcggcggcgacggaggcaggccggcggtgaagtcgttgacgcccaacagcggcggcataataggccagccgtgtaggcagaggtaccactcggcggcgacggaggcaggccggcggtgaagtcgtagacgcccaacagtggcggcataataggccagccgtgcaggcggaagcaccactcggcggcgacggaggcaggccggcggtgaagtcgtagacgcccaacagcggcgggtaccgag

SEQ ID NO: 10865 - DNA, 769 bp, Oryza sativa
  unsure (1)..(769): unsure at all n locations
ccggcccggcgcgcgcgcgcgcgcgtgccaatccgacccccacctcaactggtcaacagggagcctccaataattccctatttatgttgagatattcctcgcttaaatcctgaggtggtattattatccttaacacttattatgggcctttgagatttaataggataagttgggcctaacccaattattctaacaatccccaccaaatttcaaggctcataagaaatgttctcaatgttgtgcctgtttgatataccagggttttggtggagactgttaagttgaacttccacctaggaaatgagctacatcagaccacaactgaacaatggactatgccttgaattgtcagttttgtgttatcaggtttcactcagaaccttgactggtactgggctgccgttcgcatcccctctgtttggagcatataagtcaaactccaggcctttcataaatatctagagattgtccaaacctcatagactgtgactagcagtcgaactcatataggtgtgttccttctaagatgttctgcaggtcaacatctctgcttggaaaagccactcggatcacattaaggcatgagccatcctaccatgcaggaaagaagagaagcacattatgaaaatgagcccttttcaagggtctcttctctcagtcacacaatagtttgtttcgctatccaaattcacgggatctccgatnnnnnnnnnnnnnnnnnnnnnnnnnnnnnnnnnnnnnnnnnnnnnnnnnnnnnnnnnnnnnnnnn

SEQ ID NO: 10866 - DNA, 725 bp, Oryza sativa
  unsure (1)..(725): unsure at all n locations
nnnnnnnnnnnnnnnnnnnnnnnnnnnnnnnnnnnnnnnnnnnnnnnnnnnnnnnnnnccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataatcaaccagccgtgtaggcggagacaccactcggcggcgacggaggcaggccggcggtgaagtcgtagacgcccaacagcggcggcataataggccagccgtgtaggcggaggcaccactcggcggcgacggaggcaggccggcggtgaagtcgtagatgcccatcaacgggggtgtgataagccgaccgtataggcggagacaccaatcggcggcgacggaggcaggccggggtggaagtcgtagacgcccaacagcggcggcataaaagccagccgtgtaggcggaggcaccaatcggcggcgacggatgcagg

SEQ ID NO: 10867 - DNA, 523 bp, Oryza sativa
  unsure (1)..(523): unsure at all n locations
nnnnnnnnnnnnnnnnnnnnnnnnnnnnnnnnnnnncggcataataggccagccgtgcaggcggaaacaccagtcggcggcgggcgaggcggccggtcggtgaagacgtagacgcccaacaatggcggcataataggccagccgtgcaggcggagacaccagtcggcggcgggcgaggcaagccggtcggtgaagacgtagacgcccaacaacggcggcataataggccagccgtgcaggcggagacaccagtcggcggcgggcgaggcggccggtcggtgaagacgtagacgcccaacaacggcggcataataggccagccgtgcaggcggagacaccagtcggcggcgggcgaggcggtcggtcggtgaagacgtatacgcccaacaacggcggcataataggccagccgtgcaggcggaggcaccagtcggcggcggacgaggcaaccggtcggtgaagacgtaaacgcccaacaacggcggcataataagccagccgtgcaggccgaagcaccagtcgg

SEQ ID NO: 10868 - DNA, 2162 bp, Oryza sativa
  unsure (1)..(2162): unsure at all n locations
aacgtacatgatcccagagcactaccgatgcactggattaacaaaatagtataacaggtaaaagtaccaggatcttgggatatggaaactaaataagtaaatcaaatctcacaaaaaaaaggggaagtcatggattgattgatgttccaacagtaactgtcctgaccctcttagacagcaggaatggactaccaggcaatcagattcagtggatatatgatattgacagcaaggtttaagatctggcagtagggattttaatggccaggaaacaggatttctatcgtatcaggcatttcaccagccattatggaactatgcaaccgtccacatttcacttaacaatgtgagcctaattaacaggtcatttatagtgtagaatatcagacagcggattgaaaaggcaatggcatatggatttgaacaataaatagtattaatctagcaaggaggaggaacgaatcagtaacataccggcgaggtgatgatctgtggattgttcctgtcacgcctgaacaaatagacacacctgaaatcgtactcatccctggccagcacagtgccaaataccctgatagggtaacccacatcagactcggccaccttgattgcaatcacattgacagagtccatctcccaccagtagtcggggaaagctagtgacttgataggtggtccacgtgcaagctttgctgcaaaatcaagccagagacataaatcaaaccaggaaagtaaatttttttaagacatgtacaataatcaaagaatgaacaaggaacaaggatgatattataacaaacaaatggatggatgtactcacactctttgtccaggtcaaagaaggctatgttgtaggcacaaaatcgagtaggaattgagcaaaactgcttggggttatattcggtgatctctcggcgtcgaactatgtttagaacttcaaccaccttctcatcccatgtgagctctggttcactgtccagctcccaattctcctcctccttcagaggagccacatcactttgcttggcatcatccttagcacacggttcatcagaatcatccccattcttgtcaatgccaaatatactagcgtgttctccggcctggcagccggccatagctgcaaaacaagcaaagttttggttttgatgtttcccatccaacaaacaaaaaaaaaatactgcctccgtctcatattataagactttctagcattacccatattcatatagatattaatgaatctaaacacatacatatatttagattcattaacatatatatgaatgaatgaatacaatgctagaaagtcttataatataaaacggaggaagtaccaattaagagggatatactgactgatgcaaacgagtgaacaaagcagaacagatgtacatgaatgatgaatgatcgatcgattagttgtggattatatatacactcacatgagtaatctttctccgagtctatgaggctgcaatcacgctcggcaggaatatcaagaactgtcaacgccgccttctcttcccatgtgatctcccgcttacgcttgcctgcaacaattgcaagattcagtccgccgccgccgacgtcgtcgattaccataccgcccctctcgctttcgtccgccatcttgacgctcatgcagaagaagaacacggaaagaaagggacacaggtgagattaggtgcccatacaatgcgatttcgtcgaatcggaagagagaatcgaggcgatcgaggagtgtaccgtagacgtgttcgctggcagccctgatcgccccgtcgccgccggaggggagagagccttagggttttctctttctgtttccccgattatgaagaggctagggtttgtttggtgaggacgaacggcttgtttggcaacttgagggaagggaattgggagtttacaccaaggaattaatggtgagattaagatgggaatttgatttttcatcccagtctcttgtttggtagaggtggtggaaattgatagggagtttagttggtgattagatcattaatgaaaatggatggctgagatttgtttagacgaagtaaaggaggaattccctcctaattacctgcccctannnnnnnnnnnnnnnnnnnnnnnnnnnnnnnnnnnnnnnnnnnnnnnnnnnnnnnnnnnnnnnnnnn

SEQ ID NO: 10869 - DNA, 836 bp, Oryza sativa
  unsure (1)..(836): unsure at all n locations
cggcgtgctagggttcaagagattcgcactcgcaccacgtacggtacgctcgcctcctcgatcgatcccctcttcctcttggtatgcgatgcataaaagaacaaatctaaatattgcaatttttgcttctcttctgaatttatagctgtggcgatgacagcattggcaagatgggtgaactaaccaagaaggtcaccatggagaaggaggaggagcatggaggtggtatggctgctgggaaggaggagaagcagcagccaactctgaaaaagcagcagcaggtgggaaaggtgaagaagaagttcctggattttggacaggagttgacatgggaggagaaggtggtgagcgttcttgacatcgttcgccgctatcagttaactgaatacgaccccaagttaaaagaatttacccctacccgggtcagtttctgtttctgcaacatggcattctttgaccacgacaaagagtgtgagtatcctttcacttattctaaatttctaaatttgcacgtatcatttcattcacttgtctaattagttctcgatccgtttattcctatgaatacatgtaaattcaagcaatatatacttgtgaaaacttcttcctccctatctgttgagtctctagatcgatgtcatgtgtagtaataataatgttcttgtttgatttctgtttctggccctatttttgcagcaaaaattagtcctgggtctccgattcgcactatcccttcctccaagtttgtgatgttggaaggctctgttaatgtcattgcaatnnnnnnnnnnnnnnnnnnnnnnnnnnnnnnnnnnnnnnnnnnnnnnnnnnnnnnn

SEQ ID NO: 10870 - DNA, 736 bp, Oryza sativa
  unsure (1)..(736): unsure at all n locations
acacggctgacctattatgcctccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcctcctatgctttccgtttggtttgccaatggatggttgcctttgggccgattcctagcacccgggggctcgttggatggaccgagtaacgcaaggtgctaagtattattcggaataaatcaaaagcatagagacgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaannnnnnnnnnnnnnnnnnnnnnnnnnnnnnnnnnnnnnnnnnnnnnnnnnnnnnn

SEQ ID NO: 10871 - DNA, 705 bp, Oryza sativa
  unsure (1)..(705): unsure at all n locations
tggtgtcttcgcctatatggttggtgggtcacaccaccgttgttgggcgtatacgtcttcaccgaccggcccgtctcgtccgccgccgattggtgtttacgcctgcacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgtcttcgcctatatggttggttggtcacaccaccgttgttgggcgtctacatcttcaccgaccggccgtctcgtccgccgccgactggtgtttccgcctgcacggctggcctattatgccgccgctgttgggcgtctacgacttcaccgccggcctgcctccgtcgccgccgactggtgtcttcgcctatatggttggttnnnnnnnnnnnnnnnnnnnnnnnnnnnnnnnnnnnnnnnnnnnnnnnnnnnnnnn

SEQ ID NO: 10872 - DNA, 742 bp, Oryza sativa
  unsure (1)..(742): unsure at all n locations
nnnnnnnnnnnnnnnnnnnnnnnnnnnnnnnnnnntagtaaaagaacgattcaagtagattgtattcgggggtttaacaatgaaccggccttgtcctttaaataggggttggtcttgccctctacaggcccttctctacgtcaaactcgggatagaaaccaaaggaaacacaaaacatgccttcccgagcaaggaaacccgagacccgacgaaaacagactcggactcggaatctgctggtctgaccgcccacatacctgcggtcagatcggccctactagccggtcagaccgcccatatacctacggtctgaccggccatgtgaaggaaactcggcactctccaaactttggcaattttcctctatttcgtccataggtgccaaattttggtgtaaacacatgcccccctgcctttttgatgaatatcgtgaatctaaaagcatagaacatattgtcttagggcgataatccaattaccggccataggacttcctaagcatcttaccaaatgctcgggaagtatttctttaagtatttcccattaattgctctttgaaaacaccgtcttgaagtgtcttcatctccttcaaagtcttcaaacgcttgtcgatgacgtcttcaaaaatgcttcccatcaaggtcttgtaatcttcaatcgataagtcgtctttcttaaaaataccgaagaaagccaagattacctcaactggcaaaaggcaatttcaacaatggtttattac

SEQ ID NO: 10873 - DNA, 1244 bp, Oryza sativa
aatatacatatccagaaattggaatggattaaaaaaaaccatatatgcacagcatccctcatttggatgggtctaaaacatagcatatacacatgggtataggcctatagggcaggcattgaaaaaaattccaataaatatggattgacatgtatgggcttgtttggatccttcgggctattaaatagccctatggaattttgctatctagaattattaaacgtagattaccgacaaaaccgattccataacccataggctattttgcgagacgaatctaatgatgtatattaatccataattagcagctgattactgtagcatcactgtagcaaatcatggattaatatacctcgttagattcgtctcgcaaaataggctaggggttatggaatgggttttgtcagtaatctacgtttaatactcttaaatagcaaatagccctccggatccaaacagggctatatatatgagccggagaaagcgtatcacattttcattctacaactcatgcaccacatgaacaaggctaactaatggtccttggctccttgccacaacctgtagagaagctagcccacctctaccggcctagcagatcaaaagcctgttaaacagccgaagcccctgttgaaaatatggtcatattcagcatattttaatctaaaatataaagacaatgaacatgacatttttaggaaatgatttgcaagtgttaaacagtagcaacatcatgaacatgcttaatatacagtaagcataggaatagatatggcaatgcaatgctaacattgcaactaacagtaccagtaaacactaaaataagacataaagagaagatgtgaggagattatactccaagaatgaccctccgctggagtttggggcagtattgcctccattggtgttgacgttcccgttcacctccttgtctccaatgttgctgttgtctttggtattgcccgacatgttggagagacgatgcagaggaagccagagcagttgcgtcgagacgctcccaaaaaaccttatcgcctgcctacccgtgcaggcactgaagcggacgggttccggaggctctactcgtcccgtacacctatgcgcacaggtgaacagaaccggggaaggatcttgcagcacaagaggaagaaccgagcaagagtcaggaagaactgaagacatctgtcttctgttcattccaattggcggagtatatgtgcacgccggagtaacgttcgggatca

SEQ ID NO: 10874 - DNA, 9108 bp, Oryza sativa
  unsure (1)..(9108): unsure at all n locations
atgaccctccgctggagtttggggcagtattgcctccattggtgttgacgttcccgttcacctccttgtctccaatgttgctgttgtctttggtattgcccgacatgttggagagacgatgcagaggaagccagagcagttgcgtcgagacgctcccaaaaaaccttatcgcctgcctacccgtgcaggcactgaagcggacgggttccggaggctctactcgtcccgtacacctatgcgcacaggtgaacagaaccggggaaggatcttgcagcacaagaggaagaaccgaagcaagagtcaggaagaactgaagaacatctgtacttctgttcattcccattggcggagtatatgtgcacgcgggagtaacgttcgggatcatcaaccgcgcgtgtttaattcagtaaccgacatgctctttaatacagaatcgatttccataaccgacatgctcgttaatacagaatcaatcaccatgtgttattaccgtatgttacaaaaagagagagagagagagccgcccacccgcccctagtccggcacgcgcgcgtgcggctgtctgcccacaatatcaaccggtgagactctccactagctccatgtttaagttgagacctcttcacttagatttctaaggtggtactattacccatagcactaaatgtaggccattggaatatattgggacttaattgggcctagcccattaatctaacagcccctagcaaggcaaagctaaaattaaatcgtcgtcatcatgatttgacagataatgtttaagaacaagtctggtcaaactttaagaaaagagtaattttatggttcttgaggaggtaccatgaggtatcactttttctattgttaatttgatacctttaggtatctaggtaccatgaggtatcaaattttacactaaacttttgtacctcatgctatctactcaagaaccgtagaattgctcgctatatgtaaataacagaggagaatggctatatataaatgaacaaatagtaacttattgtcaggagtacttgtcactttcctagcccttctctgtcatttatatatagcacaatgcattcatcttttgtcattgtaatcacatttatagagttcaaagggatagaactgagtaccaaaaaagccgatcacaaacacttgattttctcatgcctgacaagaatatgtagctactccgccgatctacactgtttttttgcattgcgaatttcataggtggaaatgggtggcgtccgagaaagaacatacaaagtttgaacaattcatgttgcgcgtggcgtcgttcgagcagaagggagaggcctgctagcgatgccgatcagacatgagctggagattttctttacgcatcatgacgctgcgtacagagatcgggtaaatcaccctgtacccccgtctgatcaccatcgcactactactcgtaggtttagtataactccaacttctaaatttaactttaggagcttcaatttctaaatttaactccaagagttagttctagagtggtgttatgaagcagtctaaacccagctctatctttctagtttattttgtgagaacgtttcacatagctccactatcattcattttaggtagaactgaaagttaactgagtctaaataaagtttccattatcttaaaaaaaaggtagaactgaaactatttggccgggctccaactctaaaatagataaagtttaaactgaagccatgccaaacagaccctacatatgtttacattggaatatcaccaagatctgtagcagccaagaacctgtagctaataaacaccaggcgatcagcgagcgtcctaaccatatgtcccattggttcatgacacggcatctgccaagaaattccagcacagctagcgaattactaactccaaatctcttagttcggtcaaaaagctctagcggcaagcaaacaaatatggcggtcctgtcgcactgaaaaaaaattgagaattaaatttattcagcagcacacagaccaggatttaattcaatagcaacaacataaaatgcaggaacagaggaaacgaaccaaccaccagccactctcttgtgtctgaaccgcttgcaggaaccaggttgagcacctcgtgtgcacactgtagcaagtacggcaaaaacaaagcagagtgcaaacagagagatgaggagcagagttcggggcaattttcgttggttttctcttctccgaaagtaaattgcgtgattacaactaatgcatgagctaaactatttatggaccatatgccatcgtcgatcccacgttcaccacgcaaccaactcacgccacatagatcaggtgcacacacacgcagctggtcgacacggtcaccttgcgatcatgaaactttggcttcaataacacattagtttttctccatacttgtctggtttgatggccgtaaaggatgctaatgccttcttacctgagaatcgaaatttgctttcatacggtacgatcttgattcagcaaaatgtcataaaatgccttggctcaattgaccttctgtgtttccatatgttcagaaacttgacaaattcagggtgttattatctttctataataaaatgtaacgtaccacttggttcttcgctatttctcagactcaacaagcacaagcagtttcaggtaaagcttgattcttctcgtaagtgcttcagaacaggtttgccgttcaccatgttgtttgagatgtttgcttgtcaggtatatatagacgtatagtaaaccatgctttggcctgatcctttttcttcgtgaaaatcccactaaggatttcagcctgtgatgcaaaactctgatccaaagtctttgaattgcgtttaatgtatagatgattattatgaatagtagaataggtgctccttgtgcgcttgtgcccccaaatgcttctcggtcatgtttttacctgcatgcacatttttccttcattagcattaaatttctgggttaattaggttcgtgtcattacaaattttctgatatgagaaaataccactactttcgtgaaacctgtcgtgtgccattgaaattttttaaaattcgaaatataccatcaccattccttttttgggaaattttgctacagaacacttgttatatgtgattttagccctaggacactatccaaactcacttttgggggaaaacactccataaatatggtaatttgccagtggacaccgcgctgattaaaataatacttttcggttgggagagggagaaatcgcgtgaaaggtcaaaaatgcccttgggcccacatatcagctctatctcccatctctcttctcatctctcagaggcgcgctcgcacagggcagcgtcggtcgcggcggagatggcgaggacggcgaccggcggagtggagcggggcggcggcggcggtggacgacgagcacgcggccggcagagcggcagcgtcggccgagcggactggcggcggcggcgagcgagcgcgcggtaggagccacagcggagggcggctggcgagagcggtggaccccatggcgacggcgatggcgatgcaagctcccacctcgctcgccagatggtgttcaccgagaagcctcgcggccgtggctccgtcctccccctcctctgtggccacccctccacccacatccgcctcgccgtcggctgccgaccgccaactgccctccgcgcgcagcagccggcggcggcatccgcccacgccgcgcaccccgtctcccttgccgtggcatccgccctcgccgcgcaccccgccatcctcaccaccgccaacccgctcaataccaccaccgagatcgccaagcaggtcgccgacgcccgtcccatcctcgcctgtcgcgcgctcactgtcgctgccactccgctaggccaacgctgccactccgncagccacacgctcgtncgccgccgccggccgccgtcctcgccatctccgcgcgcgaccgacgctgtcctgtgcgagcgcgcctctgagagatgaaaaaagagatgggagatagagctgacatgtgggcccaacggtatttttggcatttcacgcgatttctctctccttcccaaccggaaagtattattttaatcagcgtggtgtccactggcaaattaccatgtttatggagtgctttcccccaaaaataagtttggatagtgtcctaaggctaaaaccacacataacaagtgtcatctagcaaaattcccctttttctatcagctccttccatcgtcgggcccacttgtcagggtgtcttgagtctccagctgagctgctgcctcctctctccccagtaaaaacctagctagcctagcgcctcctccagttcacctccctcaaccatccttcccaacgaggccttttacaataccttccactaggagatggtagtagtgtagtaggaataaatccaattgattaaggggaattactcctctcaactccctctgcaatgcccccacaaatcccctttcattagggtcccgaatcgtttgccaatgatagtgccttaacccgtcatcttcatggccaaccattgagttttttttggcgcagccactagttcgggcgcacttcgttgctgttcgtttccaggctcttctcctcactctgctgcatcctggaagacatgggaaactgtggtccggtgttggaattgacctggtatatgatggatttcttttagtccatgttcttggatttcttttcatggattttttttacccatgtgtgtttggatttgatcgatgctatggttgaggctttgagcaatccacgaggagaaatcggaatccatcgagatgacgctttagtgaattcaggagcaaaaactggagtagcaattcatgagtagaaactacatagttggtgctttcgctttgcccaggcacgggagatggctttggcagagacgttgctgctggttcgccgaggcatcgcggagtcagtcccttcacacgagcataccgcggctcgaggtggcggctgaagattgaagacacctgacgagtgcatggatccatcgaagacggaagaggatgctaacagaaaagatgacggagatggcatggttcgaattttaaaaaatatatatatagtgacacataacagatttcacaaataatactggtacttttttaaaacggcaaatttctaatggcattgatccaattaacccttaatttttcgttgtagtttaccgcatgggtcttggacacgattcttattttttgttatattaaatgttcatttttccttcatttcaggaataatagtcaaggtgttccaatttgggaaaaacagagcagcagcataatcaattttgaagataaaaaatggaatatgtacattatcttgacttccacacaaatttatataaaatggaacttcacaacgagggtttcatgtgcatggttacaactttagtaatattatctaatgctgtagtttactgtgcatgtcaatctactgtaaaatgaatcctgattcagtctgtgtggattatgctaagcatatgtcatcctatagtgacgcataggtgaataatagtgaagattattaacctagaaccatgaaggatgttaagcatttggtatcaagtttcgttcagttgctggaaatcaagtttctaagcaataggtgatgaatgtttcattataaatttcacacacctggaattgtatatagaaattttatgaatatatagtcaggttatataagtgtcatgtcatgtaatagagagatgaataatgatttccattgcttgttgatactacactttgcagaagtaagaacaatgttgttaaagttagaatgttgctattagatgatattatagttttctgaagttcaaaatcaactaaaacctgaacggttttcttatacaattgactttctttaatatgatctgttgccaggaagtggtatttaatgtttgtgttgtggtcaagcaaggataaaatatgtagcttcaaacggtaatatttagcttctagcattggaaaggccagctgattaaagggttaggttgaattaaaaaaaaattcctttctcccccctacgttcactatttatcctttactcccaagagctttggttatattacctccatccaaaaaaaaacaacctaggaggagatgtgacctctcctagtacaacgaatctagacaaaatgttgtgggacggaaggagtatatgcttgcagggccatctatattgtcattccacagtaaacagcaatatcgttaatgatttggaaacaattgcaaaccttgtgtcgttaatgtgtttcttttcttcttaaatgggaaatgatatgctaattgtccaagagtttaattaaaccatgtgtaattcttgttatggggaatatattgtcaagatattaattagtagtcaacctatgcattgtactgctatttttattgattatttgatgaaggccaagattagattaaaagaacgttcttttccataaaccttgcaacttttttaatgctatatatgttcccttgtcaaaacatatatttttcagatgtcttttagtcatttcatttacaacatcaattattgtcgtagcattagcacggacatattactagtcaaaatagtatatacttcattaattgaggattgtagtatatattgaccaaacaaaaaagatttagtacaaagtacaaactcttttaacgagaaaacattttggttaaaatgtcaaaatagcactaaatttttgtactagtacgtctgtaaaaagaaggacatttaaaatttccatgcagacatgcaagaatcaattatagaataaatatttttttggccaattttcaattgaatagttgtcatattataactagttgataaatcttagaggggtaaatgtgttttttttaagagtaaatgtgtttttttaactatggatgtataacgtcaacgcacggtataagtcgatggcatataagaaaaagagctaatttcatagcatgaaagagctaatttcaagtggaatataaggccaccgataaattttcagtggcatataagaaattccctcgtatattaatttcatcactctaatggaattatccatgtgcctgactacccacagggagaattctactagcctttagttcagttcatggtaattgccatggaattattcatgtcaagtgcaatttatccgataattaattgtatgtaaattgatcacgtaacacagttagtaataataaaaaccaagcatcatatacagaactaataattagggttttacctcgaattgcacgcaatgatagtccgactgaagaccatgcattcctccatcccatgtccatttatcgtgtcgactacaggaataattccatcaacatatgcagataaacattgagcggaagatgtaacagccaaaatggacaaacgagatagaggcatagagctctgcaccaatccagcaacctagcttaaaactcgagacaattttgagatcgaattggcaattatatatctaactataactctaactttaatccctatcacatcagatgttttggacattaattttgagtattaaacataaactacttacaaaaattaattatataaataaatgctaattcacgtgataaattttaatttttaagcctaattaatccataattagcacatgtttagcatcacataggctaatcatggattaattaggctcaataaattagtctcgcaaataagtccagaattatgaaatggattttgtcaataatttacgtttaatacttctaattaatgttcaaacatccgatataacagggactaaaaaatttagtcccaaccaaacagtcccataatgaattaagtagggaattactacaacatatttagtttttcctagcacccccactactacatgatagttttacctggacgccaccccttttgtttccatgcggcccataactagaaccgcacgaaaaattgggggggggggaccggcgctggactgtcgcccgcacgggaaaatgcattttcccatgcgggcgtcttaacccgaccgcacaggataatctttattatcccgtgtggtcgacttaagagggctgtacggaaaaaatcgattttcatgtgcagactttttaagtggaccgtaaaaaaaatatctctcttttccctctcacccacttcaaattttccacactctctctctctcttcctttttcgtttttattctctctccccctttactctcctcgatctcctcccatcccctctctcggcctctttttctcctccccacccctctctctctactctctctctctgcgcgctaccgtgtcatgacgactacttcacctgatccacccaaaggcacggatgatcaaggcgacgaaccaatctcacacaatgggcagagaaggaagtctgcgcgggagagacagcctaatagattgtataactcgagtgtgtggacccagtgatgttgggctgggccacggggagtgagagaggcccattagcgcagtgctataagaggccggcagggaacagattgaagcgaacattgtagaaacacttttctgaaactacttcaaatctctccctgttcttgctattcttccccaaattcctcttcctctgctgctctcgttctcatctcaatcccaaaattcctcctcgctaaaccctaattcttagaagtcgtgacaatttggtatcagagccgctaccctggagaagccacgctacacatctcgattgcaactccaagtcgaagctatggagaagcagaacgtggatttcggcaaggtgctcttggagatccaggagtcgttggtggcgctgaatcatgcacaagccgagactcaagcggcggtcgtcaagttggaacaaggagccagcagttggaaacctcaagtggaagcccggttcaagagctgcgtggggaggtcgaagagatcaagcagcaattggatctcattggcaaatcacagcaagcttccgcatcggcgtcttccccttgggttccgtcgacagacggggaaaggaaggcgccactgctgcccacgccagggtaccgagctcgaattcgccctatag

SEQ ID NO: 10875 - DNA, 6077 bp, Oryza sativa
cccggtcaagggtacgtatgactccactccttccagtttccaaaatttgagagttcgggggttgaaggtggagaaattgacttcgaatttggggagagacaatataatcaccgtgttccaaagttggatttccctaaattcgatgggttagatccccaggactggcgcatgaagtgtgagcattatttcgatgtgaataacacgtttcctggtttgtgggtgagggtagcaaccatctactttgtgggaagggctgcatcttggttaagatcttctagagctcatttgcgttttcctatatggggggatttttgtgctgctgtgtcggaaaaatttgatcgcgaccagcatgaaaatttgattaggcaaatggatagtattaagcagtcgggaacggtttgggagttttatgagagatttgctgagctaatgaatcaactattagtttatgaccctggggtgagtgcaaaatatttgactcatcgattcattgaagggctgcgaagagagattcgtaatcctgtacttttacagagaccaaagaccctcgaaactgctctgtctgttgctttgttacgggaagaggtgttggagaatcctcaagtttccagtgttaaggaagtcaagagaatggaaggcaactctggttttcgatcggcaggcaagggaccgtggccgttgccgcaaccaccagggaagagtggaagtttctctttgatgaatcgtcctaaagagaagagaagcactgatactgttcgcagtccaacaaattcgacagataaagtgactactctcaaggcttatcgccgagcccagggattgtgttatatttgtgcagagaaatggtcccctactcataagtgttcagcctcagttcaactcaatgtggttcaggagctgttcagtctctttatggaggagggagctcaggaaagtcgggaaacctcaattatatcagatgctgaaacgggtgaactaatggcaatttcagtgcaggcagtacaaggttctgagccagatggaactatgcgcattttaggacaagttcaaggaaaacaagtgttaattctagtggattcaggcagctcagtgagttttatcagttcacagatagcagctggtctaaaagggatacaatctcttcctcgacaattgtcagtcagagttgctaatggtggtacactctgttgtgatgctatgattcctcagtgtgaatggcaagtgcagggtcacagatttagaaccactttgagaattttgcctcttaacagctatgacatgattttgggaatggatttgctgaaggagcacagtccaatgttagttaattggtctcagaaaactatcagaattaatttgctgggagcaatggtgactctaacaggggttcagtctgaactgtctaggtgtgaattgttatcagctaaggagatgcagcaattgcaacagaaacaggcagtagcccatatggttcagctttgttctctctctcaagatgaggaatctgaagaaataccaaatgaaattcagttattacttcaggagtatgcaactgtttttgctgaaccaaaggggttgcctcccacaagacaattcgatcacacaattcctctaataccataggcacaaccggtgaatgtcagaccctatcgttatacacccgcccaaaaagatgagatcgaagctcaagtgactgaaatgttacagaatggcatcatacaacacagttctagtccttttgcatctcctgtactgttggttaagaagaaagatggatcatggcgattctgtgttgattatcgccatctcaacgcgattacagttaagaataagtatcccttgccaattattgacgagttacttgacgaattgtcaggtgctcagtggtttacaaagttggatttgcgagcgggatatcatcagattcgaatgaagactgaagatgaacacaaaacagcatttcgcactcataatggtcattttgagtttagggtacttccatttggcttgactagtgcaccagccacttttcaagggatcatgaacaatattctatcctcattacttcgacgctgtgtgcttgtgttcgttgacgacatcttaatctacagtcgcactcttgctgaccatatcaaccatttaagggctgttttccaaattttggttaaacatggtctgaaagttaaacagagcaaatgctcttttgctcaacagaaactgtcttatttgggtcacagaatcagtccaaatggggttgctactgaagaagataaaataaaggctgttaaagattggcccactcctaagtcactaaaggacttgagaagcttccttgggttagcaggttattaccgaaagtttgtgcaaaattttggtattttcagtaaaccattgacaaatctgttgcgcaagggtcagcctttcatttggaatactgtgacagatgcagcttttcaaaccctcaagcaagcactgatgtcagctcctgttcttgcaatgccggatttctccttaccatttgtggttgaaaccgatgcatcagataaagggattggcgctgtgttgatgcagaatgatcaccctatagccttcctcagtaaagctttgggacctcggcattggggtctttctacctatgacaaggagagtttggctatcatgatggcagtggatcactggagatcatatttacaacatgatgaattctttatcaggacagatcatcgcagtctctcatttttggctgaacaacggctgaccacgccttggcagcataaggctcttacaaaattgttgggacttcagtacaagatcatttataaaaagggtgctgataacaatgctgctgatgctttgtctcgctgtcctgtacctgaatctgttgctctatcagctctttctgtttgtgttcccgaatggacacaagaagtaattgaaggttatcatcaggatcctgattctgccagtaaagttcaaacgctgtgcatcaatagttctgccattcctgacttcacacttaaaaatggtctgctatacttcaagggcagaatgtggataggacataatgtgcctgtgcaacaaaagattttagccaatttgcatacagctgctattggtggacattccggaattacagtgacttatcaccgaatcagacaactttttgcttggacaggtcttcgtgcagatgttgcaaaatttgttcaacagtgtgatatctgtcagaaggctaaggtggaacatgtcaagtatccaggtgcattacaaccgttgccggttccggaacagtcttggcaaattgtttctttggacttcattgagggtctgcctcgctcatccactttcaattgcattttagtggtggtggataagttttccaaatatgcgcattttgtggcattggctcatcctttcacagccttggacattgctgaggcatacatgcagcacattcatcgcttacatggattaccagaggctcttatttcagatcgtgatagaatttttactagcactctttggacgacactattcaaattggctggcactcaattgcgaatgagttcttcttatcaccctcaatccgatgggcaaacagagcgagttaatcagtgtcttgaaacctttttacgttgttttgtgcactcctgtccctctcaatggagcaaatggcttgccttggctgagtattggtataatacttcatttcattcttctttgggagccacaccatttgaggtattgtatgggcacaaacctcgttattttggtctgacagctgcagctgcttgtacagcaccagagttggttgattggctgcatgaaagggataagatgcaaactctcattcgagaacatgtgctgcgagctcaaatgagaatgaaacatcaggctgatttaaagagatcggagcgctccttctctgttggcgattgggtctatatgaagcttcaaccgtttgtgcaacagtcggtcatcactcgcactaatcgcaaactttcttttcgtttttatgggccctttcaggttttggccaaggtgggaactgtggcttaccgtctggcactgccagattccagtttaattcatccggtggttcacgtctcccaactcaagaaggctttggctcccgtagaacgggtacagtctcatttacccgttttgcctgctgatgaagctgcagacatttcgccttgtcaggtgttgaatcacaggcttgttcgcaaaggagctaaactggtgaaacaagttcaggtctgttggtcccgccaagatcccgccgccgtcacctgggagaatcttcaggaactacgtcaacgctttccacaggccgaagcttggggacaagcttcatttcaagggggggagaatgtcatgacgactacttcatctgatccacccaaaggcacggatgatcaaggcgacgaaccaatctcacacaatgggtagagaaggaagtctgcgcgggagagacagcctaatagattgtataactcgagtgtgtggacccagtgatgttgggctgggccacggggagtgagagaggcccattagcgcagtgctataagaggccggcagggaacagattgaagcgaacattgtagaaacacttttctgaaactacttcaaatctctccctgttcttgctattcttccccaaattcctcttcctctgctgctctcgttctcatctcaatcccaaaattcctcctcgctaaaccctaattcttagaagtcgtgacataccggctccgagatcggctccgcgtgcacacgtggcgggcgcagacggcggcggggccagcagctcagcggttggcgcatgtgacaacgatgacgatgaggcggcgccgccggctccgcgtgcacgcgcggcgggcgcggacggcggtggggccccgcacggctctcggcggcgggcgcgacgacgatgacgacgacgaagcggcaccaccgactccgcatgcatgctctggatctcaagcatctcctactctctttcttctctatggctgctacgatagcaaagtggtgtggttgtgatgttgaactacaggcttccagtctcttgacaattgctctcaagcttgagttgaatccccagccaaaccgctagtggtggctgctattgctaatgttctggtagttgagactgctgtgctactaagagcatccacagtagtaaagtaaggtgttctctataaaacatgtatatctcagcaataaacttgattaataataaaccaccttaatagattgtctacattgatatctatagctctctcatgcattgcctcgtttttctctataaactatctctaaattaatagatagctttgctctctctcttcatttaatatcttaaaagtagaaaaatatgctgacatggatctcttgtagagagcctatagataaccattgtgggtcccctaatttctccatgccgatataaacggtgcttgagttcttgctctcttcttgctttgatctcactcggctgtttttcctagagagggtttctctggctgtaactagtactactgcaggctgcttgtttttggtttctactaccaaaatgacttggtcacgcggacggcggcgggcgccacgacgacgacgacgacgacgaggcggcgcggccggctccgcatgcacgtgcgccagcaggccgtggctggtcgcggcggtggcacccgggtgcgtgcggcgcccgcggtgattttcgcttttttttaattatttttggttatttttgttccgtgcgggtggtataatttcaccttacgggataatcgattatcccgtgcggtccacttaatccgaccgcatagaaaaatgattatctcgtgtggttgggtcgcaatatttccagacgttttggtgtagacggacaaatcctccacacgaaaaaatcattttaatcgcacggaaaaatgcttttcgtagtagtgtcgtgttactacacagattagcagaaagtagggtaacgttcccggatgaaattaatctttaggtgacaacatcaaatcgatcactcctaaattgaaccaaattaatatgtagtatgtgtagttcat

SEQ ID NO: 10876 - DNA, 5143 bp, Oryza sativa
  unsure (1)..(5143): unsure at all n locations
nnnnnnnnnnnnnnnnnnnnnnnnnnnnnnnnnnnnnnnnnnnnnnnnnnnnnnnnnnnnnnnatccccctttcaccgagatctaaagcaagttttaattttcaataagtgcaaatttctctccccctttgtcaatgatgccatcaagatcaaaagagacaaaaatgcaagataaaaatgagatgaaacttgcaaattttagtgttttgagagctttgagagttatctaaaggcatcaaaaggtagacatggatcacacagatacaagcatgtgctcaagcctagctaagcatgtgcataagaagtatgaaacatgtcatggatatcaagttagtatccccagcaagcaaaaagctttcaagtgaattagtgatttagtgtgcaaagctatttctagaagaagcttaaaaggaagcaaaccagctcataatcatgcaagatttacataatcaaagcaatgaatccatgctaatgtgctaatgcccagttcataaagagtatcaacatgataacaaagcatagaacatgagattttaatcttttctcatgacttttatttttatgattttttttaatttctttaaagacaatagcacaatcacgacggtccacctgatcttatcagtcagcaagtgatggttgtgccaaacactgccgtctgacctcaatcaagttttccagctaaagttcccattacaggctgtctcagtgctatcttcggcactactcatgcgtaaacgcactcagtagcccggacaaaaacagagataaagcttgtaaagcatgattgatacaaagtatggacgcataagcatgagcattcataagcatgtactgacagttattgcaaaaagaatataaacatggcatgagtatgagatggatacttcaatttaaacaaacttctagagcaatcattgcacattgattaagttcaaatgaatagtcaatttaagcaggtttcaacaagcttgaacagcataacatgatcacataagctacttaagcaaatgaaagctagacaagagatcaaactagcataagagtgacacatgcatagcatagtgatgaccaagagataacaagcaaagctcaattgaagaatgtataatacaatgcataaactaaacatgatgcaatatgttacaaatgcatgcaaaagaaaaacaactccccctcaaatcaagccataggggtggatcacccctaactcactccgcaagaactcaaaacgagagcgatcaagtggttttgtaaaaatgtctgccaattgtttttcagattcaacaaactctagcacaatggtacctttctcaacattgtctcggagaaagtggtaccgtatctcaatgtgcttggtcctggagtgttgaactggattttttgcaatattgattgcacttatattatcacaaagcaaaggaacaccagagaaagacagaccataatcttttagagttgaaatcatccaaagaacttgactacatgtactagcagcagctacgtactcagcctcagctgttgattgagcaatagaagactgcttacgagaggaccaagagaccaaagaagtgccaagaaaatgacaagtgccagaagtacttttgcgatcaatcttacacccagcaaaattagcatctgaaaaagctcgaactgaaagggcagaagagcaggagtaccaaataccgtacttaagtgtagacttgatgtagcggaagatgcgcttgactgcttggcgatgtgatgttcttggagaagcctgaaaccttgcgcacaggcacacggagaagtggatgtccggccttgacgcagtcaagtagaggagggagccgatcatgcttctgtactcgcgctggtcaacttcttcaccgtcctcatcaggaccaagcgatgaagtagttgccatgggagtggcgattggcttgcagtcggccatgtcgaacttcttcaagagctctttggagtacttggtctgatgtacaaagattccttccttggtttgcttgatttgaagtccaaggaagaaagtcagctctcccatcatgatcatttcgaattccctgctcatcacatcagaaaactgggcaacaagtgcatgagaagagccaccaaatatgatgtcatcaacatatatctggacaagaagaaaatcaatgccactatgaagagtaaagagagttttatcaactgcccccatttcaaaaccattttgaagcaaaaaggttttcaatctttcataccaggctctgggagcttgttttaaaccataaagagctttatcaagtttgaacacatgatttggaaattttggattttcaaaaccaggaggttgtttgacatagacctcttcctcaataacaccattcagaaaagcatttttcacatccatttgaaaaagcttgaaaccttttgaagcagcaaaagccaaaagaattcgaatagcttctaatctagcaactggtgcaaaggtttcttcaaaatccaagccctcgacttgggtgaaaccctgtgcaaccagtctggctttgtttcgaacaattgaaccatcttcacctagtttgtttttgaaaacccattttgttccaatcacattaaaacccaagggaggttctaccaaagaccaaactttgtttctttcaaaattttctaactcttcatgcatggcattaacccaattctcatcagataaagcatgacaaacatttttgggctcaaaagaggcaacaaatgctgaattgacaagatcataagaccgatttctagttaccctttcacccaggcggatgtcggttctagatgtgtcggggagctgtcggtcctgatgtgccaccattaatctcctcagctgctgaagatgatgtagttggtgcatctcctgaaggcgatgtagttgaaggagaacctgtttcttgcactggtggtgtactgtctagaggtggaggaatggaatcatcgtcatcatcatctgaatccttatccacaaagatgctttcatctggaacacctgaaatttctggtctagctcctgggctagcctcatgaaaagtgacttcacaagtctccacaattttgttagttgaaagaacataaactcgataagcccgagaatgagtagcatagccaaggaaaatgccatccaatgatcgagattcaaacttgtccaaatttccagatttaagaacaaagcatttgcaaccgaagaccctgagatgtgaaacttttggtcgacgaccaaatctgagctcatatggcgtcttgtgcaagatagttctcaaaaacacacgattggagataaaacaagcagtagaaatagcttcagtccagaactttcttggagtcgtaaactcatcaagcatagttcgtgccatctccacaagggtgcggttcttcctctcaaccaccccattctgttgtgggacatatggtgaagaaaactgatgttcgactccagaagaatcacagaaagattcaaatgcagaatttttgaattcagagccattatcactgcgaatggctcgaagagcaccaggaaactgcaaagccaaactacgagcaagagactgaaagaagccacatgtttcctcctttgtttcaagaaaatagacccaagagtagcgagagaaatcatccactacaaccaagacataccacttccccccaactgactggacctgagcaggaccaaccgtatccatgtgaagcagttgtcccggtccatctgtcataaccattgtaacaggcttgtgggaggaagatgtcattttcccatgacgacatggtgcacacacaagatctttcggagctttcaacttaggcaaaccccgaatcaaatccataccactaatgcgagacaagtggtcaaagccaatatgaccaagacgtcgatgccagaaaaacaaatccctattctctgaggcaatgagacaacgagaaggaccaggagcagaagagtcgaagttagcaaagaaaactcgaccaactcgagaaatgtcaaaaacaggagattcagaagcatcaagaactcgagacctgtcctttttgaaacgaacttccagattttcatcacagagttgtaaaacagagagcaaaatgtacttaagcttacttacaagcgcgacatcctttagcatgaatttgtcattgaccttgattgttcctttagccatcacgcgtccactgctcgcatccccaaaagtgatggtctcatcaccggatgcacgagtgagagaagtaaaccacttggcttcaccggtcatgtggcgtgagcaaccggagtctacaagccaagaattacttctccccactccaaaatcctacaagaaagacacagcagatctcgatgattcagtactggggttagtgagaaataacttagtaatccagtactgaaccatgcgaggagtacaagcatctttagtgttatgagcataattatatgcaagatgaccatgtctgttttgccccaaccatgctaggtcacatcgagggtgcacatctcggcgaggaaagcgagatacaccacttgaatgacaatgacacgcacactcgaacctctcagggactctagcagctcttctagtcttaagacgttcttgtcgcttttttctagcctttctaaagcagaaacctaccaaatgaccagctttcccacaataggtgcactcatacttggttttctctacaggcttggtttgtttctggttttgcttgtgctcaacttgttttggatttttgggtctaggtaactctacagacttagacttgctagtcataggtaccatctttggttctgaggttttgggtgtactagaactagtgtttccaatgaaacctgcagacttgaaggttataggtttttgagctagttctatcatcccatctgtgacacctaaaatctcatgggtacctatcctcaaagactcagcaaaatcatagcctataccttgattgtttatggacactttggattggtctaggatcatgttcaactttttctttccttgagcaaacctctctaaagattgttgtaggtacgagttctctctcttagcggactcaagatcaactttcagagaaatgcatgatgaacatgaatcaacagatttgacannnnnnnnnnnnnnnnnnnnnnnnnnnnnnnnnn

SEQ ID NO: 10877 - DNA, 567 bp, Oryza sativa
ggccctatgagccatttgaaaaaggttaagatatggtgctcgtcatcaactgcaggagatcatgatagtatctcggctcgtaagctttcagaggccatccaggagtacatcaatcctcccttgtatattggcgataaccctaaactatcaatctgcctgcaaacattctccggcagcctcctcaattctctcgatactccctgtgagctcacttcgctgaaactacatggcgagcttcgttcgttgccccgttttgtcaaatggcatacaggtctcgttgagctgtgcctttcatcaattaccgtgacacgggatgttctctctgatctgtataacctaaagtgtctgttatacctcaaactgatcagcgattgccttgacgaatttgtgataccacaaggggcgttccgtagtctgcgacgcctgtgcttcaaggtgcaagtctctgtcttcccgaggattgaagcaggagcactgcgggacctggtgtcactccagctgctctgcagacacctagtaggtttggctggtattgaaatcgaagatcttcgagaacttaaagaagta

SEQ ID NO: 10878 - DNA, 3013 bp, Oryza sativa
  unsure (1)..(3013): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccgagtaatatcatcggtatataggagtaccttccatgacaccaccgattcccatacataaatttaaaatctgtaccatacaaactagtgggagaagagtggttatgtactccagtcaaccaacaagtgtatgctatatatcgttatttgtccttatatagactgaagagggtgggacaggaaaaccacccaaaacatgtttaactgaaagtatagaggacaataatgcatggtgtctgagacttattggcttcagtcggattagagagagttctttattttgtcatgtcaaggaataactaaaacagagtacaatggattggtggaatataaatgtagttctatttcctttcatattggtttttactcccaagtagtttcccctctctactccaaatcttcgagtcatccacagacacaaagtcacaaacaatgtgcaataaccagtccttgatcaaatcctctgatttatgccttcctaaatcttaagcagattaccttgtgcatgtaagtcccgaaattagatgatttttcaagcacattcttatcaataatttcgtaaaaggtgttgatgactcatttgaccttgtttcgtatgctaagtatcaatctgaccctactttttttaatttacttatttgactccactttttgaaattaaagatgaaagctgaccttattccgttaaaacgagttaacattgttaaccaaggggcaagtagtccttttgcccttgcttatttaaccatattatataaaaacatccatatattccaaccttttgacataattgtaacgaatttgacatatctttcacatttgacacaagtttgatagatttggcttcaatttgataaatttgaatcatattgaaaaatttggcggagtgcaccaattttgacacaagtttggtacactgattttgctcttgtggtggtgagaaagcatagccaacaaattagaagaggaagccgagaacaacaccaccataatcttctccccacgctcgtcctactcgtccctccgtgccaccgccgctctctccctctgtgtgcctgcggagccgctgcctccatccatccacccgcctgcgctagcaccaccgccccctcctccctcagcatgtcggagccaacgccaccccctccctctacgcaccggcgctggctctaccgttcatgccgagagagacgagagagcgataagggtcaggcagggtggtacgagatggataagattgaaggagggtattttggttagtttgaataataaatagatttattttctttttcctaaatgaaaccctatcagtatattgcaaatatagtcaaacggtaggttcaattgtgaaaagcagggttaaatcagcaacctagaaaaaaataagatccgattggtagttagccttcgaaatagggtcaaataagtaattattcgtttcctaaaagtgatgaactactcgtagtagaatatttcttctactggtaatataactcacaaatgaacggttaccatagtagtgataatatgggtagaacgataactaccggcagatacccatgtaaaagtactccaattggaattatttgtagcaaatattacgaccatttttctgtagcactaaatattgaactagtctgaaaatggttgtgactttttaattaatttccaaacaatcctaccacaattggactccattgaagctacaattaagttttttgttcttcacatttccgaaagaatgatcaggttatctgatttgaccattaattccctatggagatatacattccaatatcaatatgcttttgttctagagtttgacaatcactacacaatgggggtcttggttctattaacatatatactcctacatctatgtgccagttacataccttgtgatgtataataagcccattaattgatgcaaaatgcatgcaattcggccgtggtaagagaagtcgtattatttctacagaaaagcaagcagagggcaggagtgattctttattaagacgactgaatttttccttctgccacgtggtaatgcaattcatttcattttattgtatttgttaacattattggtgacttcaataatatcgatctccagtatgtattaattaagaccaataatatatatatagtaagtggagttcaattctaaaaactctgaaaaaacaataacaaaataagtatgtgctcttgtgtacctctcgttgctcaatacaatgaaataattatataaaactatggaaaataatgacaaaagttgggctgtgtttagatccaaaatttggatccaaacttcagtcattttccatcacatcaacctgtcatacacacacaatttttcagtcacatcatctctaattttaaccaaaatccaaactttacactgaactaaacacagcctcgaagagagaaggttacgatggttgcagtgaatctccaattccactacctacctaatggtaaattttgcaggttagcccttcaattttatcatattaaaaaacagtgaaatctaaatgaaggtgataatataccctatagaaaaatatggataacacatttaatgaaaatttggtactaccaacactttggtagatatttctattgatttaggaagttctggaatcaatccaaacaacacataagtagtatttagactnnnnnnnnnnnnnnnnnnnnnnnnnnnnnnnnnnnnnnnnnnnnnnnnnnnnn

SEQ ID NO: 10879 - DNA, 2434 bp, Oryza sativa
  unsure (1)..(2434): unsure at all n locations
gcnnnnnnnnnnnnnnnnnnnnnnnnnnnnnnnnnnnnnnnnnnnnnnnnnnnnnnnttgcttgagggaataagtgaataacaacccctactgcaaatggtgcaagcgttgtacgttcttcccatgacaccacccatttccatgtaaaactaaactcgcaagacaaacctaggtttaacaaggtcaggcatgagaagagtgtacaacgatcactgtttgtattactcagctgatcttcccctttgaactgtgcgtgtcaaatctctctctctatatatgtaacaatgacaaaacatatagatacattgtgttataaatagttacagagacttaatagcagagtgaaaagctaatagcagggtgataagcaagctggctgtcagtggggacagctatgtgtatctattgttcaagacaattaaggggatgtttaaatcagggtctaaagttttagcgtgtcacatcgggtattatatagggtgtcatatggggtgtttggatactaataaaaaacttaattacagaatccgttagtaaaccgcgagacgaattattaagtctaattaatccgtcattagcaaatgtttactgtagcaccatattgtcaaatcatagagcaattaggcttaaaagattcgtctcgcaaattagttgtaatctgtgtaattagttattgtgttagcctatatttaatactttatgcatgtgtttaaacgttcgatatgacatggtgaaaaatttttgggtgggatcttaacagggcgcgcgtaagttagattggttcatgattggctgtaacttttaggacgctataatcttgttcgtattggtttattacaccagattaaatcactctgctcgtatcaaccactgaagtagaacttcgtactgtgctatctgttctcatatcactactgatctttgctgggtggtgcaaatagtcccggttcgaatagaaaaatagactaaacatcatttttagctctggttaaaaagccaacgaaactttttgatctttagtcttagttggtgttaacaaccggaactaaacatcatttttagtctcggtttgaaaatttgtcaggccgtgtcaggtcccattatttttagtcctggttagtcaacactttagtcccagttgtttataccaaccgagaagaaagattgaaaagaaaactaaagatcaatactttagtcccggttgtttgtaccaaatgggacaaaagattgaaaagaaaactgacagccgcacgccaccccctccctcgtccttatctccttgcacgcacaagcgaaactccctccctctttctcgctcccgccctccccctccctccttatctcctctccctgtgtgctccctccacctccctcgcaggtgactccctcgatccgccccctccacctttccttaaatcccccctcctccttttcctttaaacttccccgcccccttttcctctccctccaatccctccgcctcccttgctgacggcgctcgccccctcctgtccgactcacctccctcttgcggtggatttggcggcggtgacagcgtctccggtggcggtcgcaggtggatccggctggatccgggccacggcaggtactagcagccacatcaagcagatggtggctcgcggtggggagaagaagaagaagaagaagaagaagaggaggagtggcggagagcgtggagaggatgaggcaaagggggcggccggctgtagtggtggcggagcagatgctgctgctcatggatttgtgattgtattcatgaggcgattgtgttcacgaggcaattgtgttcatggattttgattttttttttcatgattgcgttcatgagatctcatgggtgatgtttatgattaatatgttcttggattggatgaattgatgatggtatgtgaatctgtgatctgtaatgtatttgttttttgagaatttgtgatgtgaatccatgattttatatgtgaatattttatttggggaaatcaatatgcaagccagcaaaaaaaacaaaaaaaaaaccctttagtcccggttgataatactaaccggaattaaatatggtagcgtcagtcacgtggcgctaccatctttagtcccagattcggggtctcagaatttctccagtagtgtgtcgatatcaaccgaatcaaatttttattagttggaaatgtgaagaagctggtaaatctcgtatatattaaatcacattaatgtgggtagcgtctaagcgatgtcaatattaacaacaaaaatagtacggaagacaggtactgcctttgtttcctgaattggccattccaaatttggacctgtacactatgatttgtatttttttcttatggaacaaacaaatatattcaaataccgattctagaaaagatcattataaatcgggtaccgagctcgaattcgccctata

SEQ ID NO: 10880 - DNA, 2993 bp, Oryza sativa
cctgtgcttatcttgtccttgatggcacccatttctattaaatagccccacattggttgtggaagggtaaggaatattatatgtaagtgggagacctcttcacctaattggttagcttttgagatgtgaaaggccctttacgcgcaattcgtactattctataattgctacacagtgcttgcacaggaagcacgttagacactaatagaaaaaatgtttttgcacagtcaaaaatagtttttccaggcgggtgtaaggaccgccggcctgcttgcgaaaataatttttgcaggcgacatctccattttcacagctggtagattcactcgcctgtgaaaaaatcacagcgaataaaaaaaaagggtgccgccgccggcctcccctccggtcgacggctctccaccttcatccgctggccactgccacagccgctggtatcatcatcgcgcatcgccgcctctgctccgtccgccggcttccccgcaggcgtcgtcatcatcgtgtcggcgccgtcgtcgcgcgtcgccgcctctcctcctccatccgctggcttcccacaggtggagctgtcgtcgtcacgcatcgccgggagagggaggagtcgagccgccgcctctcctcctcgttggcacaaagaaaagcataagaaattgttcttttatccatgaatcatgtgatccatgccgacaaggctgccacatatctctactattataaaaattgaagatgtttttaccgattactttgatacgttatccatgtatgaatcgatttttaagtttgttcgctttcggatatacaaaaggagttgtacaagaaatccctttaaaaaaactcgcatgctaacttgacactatcggacttctaattgaagttcatgattttctaaaaaatatatatatccaagtgaattcccacaatgaatttcaccttagctaaatcgtataataacaataataagattaaaataacattcacccattgcaacacacggttatttttatagtttgtaaaaaataaaataaatccagtactgttcaacacggacagacaggtgtctcggcagtggttaattgcttctagcaatctagcttgatgatcaaatgaatgtttgctactccatcaagaaatcaatgcagttgtagtgcagcgatagcgcgtggaggcggctactaagtgagatcacagaggcagcacaaggtgattttccagatttaattaggaaataacaccggtataccacccagtagaggtttcaagcatccctgctcacttagtgcaatatccccatgatattctttccatgacaccacccaatcccaacttagggtgtatgcttccattaagggatgtgcgtggaattggactgtgataagagaagtcgtattccaagagaaagcacgcatggggtgttgaattgtggcagagggcaggagtgtttctttattatgactgaattttctcttctcctatggtgtaatgcaattcattccactttattgcgccttcgaatacaactatatacctccagtgtgtattaattaatgttaacattggtatgtggagttccgtccttacaactcaagcatatgtgctctcatacctcaaaatataattaaatagaaaatattgtcaaccaattaataggttgtagaatcgaatacaataaccaaacgtacaagagggggtgaatagtagcaacacgaaaaacaaaaactttttacagagctaaaaatttaccctccaacctaatgaagcccttggcgtagctggtctgactgtcgtgtacacaccagcctgaccgcaacttcaccgcctgcccgaccggtgtctggatggttgaaccactgcctccctgtactgccttctagctgtcgctggttagaccgcccaatgaactccggtcaaaccgttgggatccctaaaaacgcgtatcgacaaaactcttgaaagtacatcaactttattttatcaatatgtatttacaaagtgcacctaaagtactccactcaagtggttgtcacatgatctaggatgggatgctcccacctggcaatggtacacctattatacggtcaagcaagacagcaaatgcacagtgtagaacagtgcagtacgcatagacgcaagtagcgacgtacgtgggtgtcgcgataagtactacggccaaatggagcaaatactggagctataactagcatatccacagtgtgggtctagaaatacctctacaagaggagtaggaagaagatgcggtctaacatgcatgtgtcgaccatgaggaaggactatttttgaaacataggcccaatttgatcatatgcctaattttgtgtagtatatgtgttatcttggaaatggactggagagctataatattttgagataagtttgaaaatttttgaaatacttaagagaaatgaaatattgcctttgaaataaataaaaaaatattatattactggttacaataaataaataaataaataaatagttaaaaaaaatgttagagcaattatgttgaaataggtaaacaaaaatcaaaataacttgaaaataagactggtcaaagttacctgtgacgggtgagagtaatggcgccgtcacaggtgacctcacctgtgacatgccctactttccggctgatcacatatgacaatacctatgacaggccggtgagcagggcccatcataggtgatgtcacttgtgatggcgccaacactcccgtccgtcacaggtgactttgaccgggataagtagggttggaccgtttcccatccctctcagatccagatctcttcactcactcactcactcaacactcgtcaatagccacctactccatgccaagcacctcccttgctttctcgacgtcaaccgttgtctcccgccatcatcaaattccaccgagcagcacctccctgccctcgacctctccatatccatgacaccgggctccacctccccgcccttgactggcggcttccattga

SEQ ID NO: 10881 - DNA, 7936 bp, Oryza sativa
  unsure (1)..(7936): unsure at all n locations
cttttttgaaatggttggttgtcgttatttttctaatggcaaaggctataagtaacttgggtaagtttgcggcaagaaattgggcaagtttgtgtcttcacaggttcaaaagaaatgtgaggtgggaatatgtgactgtctatgtaatttatgtaaaaatttggaatgcatgtgtgcatgatgttaattttgggatgcatctgtgctaaaatggagaatatgtgatattgggtatggctaggatatatgtgatgtttcttttttcagagagtgtggctagcaaatcatgagtctagtcaatatttagaaattgttgtttttcgaaaatacctcataactgaagggtcgtaaacaaagaccgtcacatgtgagctcatctgtgacggccttgttacttcaatccatcaaaggtgagtcatccgacaggtacaaactttgcacccgtcttaggtatctcactgtgacgggttgcaaccaaacatgggcatgtggagacgctcacctgtgacgggaaattaaaatactggcccgtcaaaagtgactagagtcaccagtgacccctaatccttgaccgggggaaatccatcgaaggtgagggttagtgtccatctgagatgacctgatacggcatagtgatgtggaaatatgctttttttatttattttatttagattagggatatgccactgacctccgtcattaatatatgttcagagcatgttaataccagagcttgctgatggagttcagtacaaattacctgctcttactgacttaggctccgttcaaccgggaatagtacgcacagaaaacagagcgatctattagcacgtgattaattaagtattagcttttttttttcaaaaatggatcaatttgaattttttaagcaacttttgtatagaaactttttacaaaaaatgcgccgtttaacagtttgaaaaatatgtacgtggaaaacgagggagagggattgggaaaagggtgtaccgaacacaaccttagtgtgtaatctttgtattgtgcttgcaacttccctgcacacatactgtagtgccttgccaagttgcttcggcaccccttgttcccaactcgtctccttgttttccgcttgcacacttttcaaactgctaaacggtatgtttttgcaaaaagtttctatacgaaagttgcttaaagaatcaaaataatttatttttgaaaaataaattagctaatacttaattaatcatgaactaatggatcgctccgtttttgcgtgcggagggaatgagttcccatcaagaacatgcgaacacagccttagtatggcacttctatgcaaaacatcctcatacacaatatttggctgtatttctaccctcaatccctaaacgaagtatgatccatgtacacatccaaattaatttggctcaaatataaacataagtaattgttcttccatccatgaattatgtgatccatggcgacaaggctgccacatattcgtaaaaggatctactgttcaacacgatgtcttggcagtggtagcttgatgatcagatgaacgcatactacgatacggaagacaacataatggtgatgcagcgagtgcgtgtgcacgcgggtactaagtgagatcaaggaggcagaacaaggtgattttccagaactcatcagggagcaacaccggtatactgcgcagtagaggttccagccgaagtttgacacccatctctacttgaacgaggcaagtataaaatcatccttgctcagttagtacaatatctccaccatattctttccatgaaaccacccaatcccaagctgcaaagagatcgatgcaccacaaaaataagggagaatagagtggctgcatattctatttcacagcaaagcatatatatgccaacgatatttgttcttatataggcaggatgaggaaactacaccaaacgttcatatccctattaccttggtagcttgcaatgagaaaactcggagtgttaggcatgcttgtttcagcttataattaagattatcataatctagattattgtgccaaattactgtaagctagattataataaactagactagaataagatgcgagctaaaatatgtaatgccctcaattgtaagattactgtatcaacaaattttgtaggacaacacaccaggttctaaataagaggtgtgcatccaccatatgatggttcatcgttcacaacaaatcatccacgtacgaataaatcgtccacataggttttaggtacctacatttacccctttataaattgaagggtgatgcacttggcagtatagttcaaaactggaaggtgtccacaaccacctgttgttacatgaacttactgcatgaccaggggatgcacatgctttgcgcagtatcaaattaatgtcacagggtcaatgatggctgaattattgctatcaaacaccgttgctaaaagcacagttgaatgagacttcaaattcagattttggatattgaacatacattttgattctggtgccaacaaaaatattaactcatccatacattgcatgcaaagctccatccaaaaatcagatgtatcaaattcagacccgttccctttcccttcgaacaccttttcctaacataaatccttaaaaactatgatatggcaatgttcaattggtccaagcttttctccgcccgaaaccactccttatttatttttttgtttttggaaaaataatcccaaggtctctctactagtcatcgagttacaaaatcgtccccatcagcaaaatcagatatatgacatccctcaacttacaaaaccgttcattttagatccttcggtggttttgaacccagttttatccgacatggcggctgagtcagcatggccccacatgtcagcatgccacatcatcaccctctctctttgccctcctttcccttcctcctcctctttctctctctctcacttctctgcgcaggctggtcgacaggtggggaggaagccggcgtggtgaggccggagaggaggaggaagtcagcggccgacgacgggcgatgcggcggcgatggtggcggcaatgttggacaagggacaggcgcagcttctccagcgcatgcgaggcgcaggacgagcggcccacggttgtcacagcaaggaggggaacccggtgccgtgggtgcacaacggcatggtggaagacggcggctcgtccagcggcgcggccatccggtgctgctccttttttttttctttttcttcttcctctcctattctttttttgttctttccctccaacggagttgccagatcagcgcttgcagccggtgcggcgaccctggcgcggggtggagtggctgtgcaacgtacggcattttccgacggaggagggcggcatcagcatggccatgcaagtctagggtggcggttacggcatgggctacccggcagcgaccgtgtgcaatggcagcgcagcgcggcgcctgagatggcgtggcgtgctgcttgtcggcggccaggacagcctgcgggctgctcttcctttttctcgtttctttgatttgctctttctatttcatcttcctgatggccaccgacctcctccccacccgctggccagcctgcgcaaagaagtgagagggagaggaggaagggaaaggaagaggaagggagagggtgatgacatggcatcctggcatgtggggtatatgtgggtcctaagctaactcagtcaccacatcggataaaacggggttaaaataaccgaagaacctaaagtgaaaagttttataagtagaaggatatcatatatatgcttctgcagtttgggaacgattttttaaatcgatgacaagttaagataccttgggtgtactttttcctttttttttcctctcttaggctacgttcgttttcagtggttaccaactccccctctcgttctccatgtgcatgtttttcaaacggctaaacggtacgtcttttgtaaaaagtttctatacgaaagtttcttaaaaatcatattaatccatgtttataaaaaaatagctaatggaccactctgtttttcatatgggagggattagttcccatcctcctgaaacgaacacgccggaccagcctttctctctctcggcccatttcaacttttcacccttcactactgtgcagccaagttcagcacctccaattgtttcttgtcgatctctgtcagcttttgtcccaaatgtaacgggtggcgcacgagttaactgcgttggtttgtaagctctagatcggttctactccctccgtactataaaataccaacttactatcaaatgcaaaatattttagtattacgaatttagacatatatctttcaggtttagattaatagtaatagaatatgtcacacgtaatcctagattcattttttaatggaagagagtagttggaacagcacgccgcctgctgtgaaatagttggtgtccagtgatattgctggttccttaaattaaaaaaaaaagattccccagaaaaatatgatcagccacctccctgatctcctcctccgaaccacaccgttccagcacagccgggccgatcaccatggcgccccggccgccgaggcttgccatgctgcacacgaccgcatgctacgctcgcagctgcaactacctagctaccacgatccacagtggtgaaagctaacacaggtagagaaaccatctttggtcagtcgatcaaattccacaatagtcccggttccattaaaaaccgggatctggttaaaaaaaatttaatctttacacaccaaccgggactaaagatgatttttagtcccggttcatcccctgtcagaggcatgtgagggagccgagaatctttagtcccggttgatactaccaacgggactaaagattaccattttagtttcggtttattaccaactgggactaaaattcaacatagtatataatccctagtccttatcctctactccacaatcacaaccactttctcacacacacagatcgatcatcctctcttctccccctccttccctctcctatcttacacagatcctccccttcctccttccttcccccttcccttcctcctccctcccctggagacggatgaggccgctcctccttccttcccagccccttcccttcctcctccctccctggagacggatgaggccgcgccgcgcggacgcggtggacggacggacacgcggcgtgcggcgcagacgtgcgttgcagggtgagcacatgcgcgcaaacgtcctccctcccctaaagttacttgttgtctctttttttttatattttttgattcactaagatgtaattttgtgattcattgtatggatttgagatgtataatctgtgatgtatttgatttgtgtgtaaattttttaggatttgcgatattttagatttgtgtgtataagtaactttaagatttgtgatgcagatttgggatgttactttatttggggatttggggtttgatttgggatgtgcatgccatccgattcgggagaaaataaaaaagtaacaaaaaaaagaaaagggtaccaacaccaaccgggactaaagatagatctttactcccgattatttcacccgggactaaagataacgatgtttagtcccgaattcatagtctcggttaaaaacccgggactatagggaattacaaaccgggagtaaagacagtttctctaccagtgtaatcacaagccacacacacatgcatctatccgaagactaatgacatctaccaatgctaagcgaaggcgctgggacctttcgtcactggcacaaatcgcagagaaccatactgttcacatgcaatgtccagccaacatgatcaaagtggtcaaaatcaacaatctcgtacttgccctttccgtgatgacacccattcctcagcgaagaacacacgatgctgtcacatcaagtactgttttgattactgctaattaagtatgcaaattaacggggagacaggatgaagaaagctagagggagaggcaaagtaatctactgcaagtagaatacaagaacggatcggaggctcgggaatcaatatggagtatatatgatgtgagttcgtgcatatagggccttgaattctaccaaaggacaactgcgctaggatcagctgaatttcatttggttcgcattcatggctgaattctttgataactactggattttccactcatggtggggatttctcaccggcccgttattacatggcaaagattatttttcgttcattgttttgcttctcttttctttgtcttcaaatgagcgcctttggtaagatcttaaaccactgtgtagtgaaagcaagatcatcatgtacgtacgactacgattagaacacttggatcaccatgggaagaaaactcatttgcggtcatcaaaacaatttgtgaaattccggcgtttagttaatcaattgaaccaccaaaaccacatcgacactagaggtttctggtttgggaaggagctatctcgggatcgccggatagtccggccactgtggattgggagagagctaatgatcccctgcgttgtcctcattttgatgcggaagagaagaactacggtagcacattggcatactagagttaacaggggagatcgagatgagattggggaattttttttaccgttttgaactagtttgacaaaaaatatttgaccagagcaactgaatatcgggacataccagtgaatccaatatttcaaaaattttcttttgaaatattttattatgggttgacgacaagtcgttaggtccgatgaaaaatattagctatctatccactactatctagcggtgaaagtggttacagtgaccttagtagcaacctaagtttttgagttcaaatccccataagaacgaattttaaattgggcgcgaagtcatatgagcgcatatatcctgttgggtgtaatacctattctctaaaaaaagtatctagcaataattgatatggaaattaaattagaattttatgctctgcggtatcaaaaggttcctgggctccaagaattatttttagattgtgcagttttacccctctgataaatctaaatgttatgctataccattcacaaacttaatatagagattgtgagccgttcacattaattacatggttgtaccttggaacaaactgtcttcagtatatggcgttttttggttcttgtcgtggtgccctcaaccagggtttgcaaattaatttgttttgaacttttgtgttggggttagctgaaaatttttattatttgaacaaattttagccgaatttgaataaacttttgaccaaattcataaaaaactgaaagccttgaaaatttcgggctaaatagtttcaagtgcgggggaggggataccaaaattgccaaactgccctcaaattgtaaattgcaaattgctcatagttccgatatttgaaacaaaaattgcaaatagtgcgctcaactgaagaaccaatccatgtatgtttgatgtttcactcaaatttagctggaacaacctaatcacaaattgctgattcctccacggatcaagtgatgcctggatacaggttcctaaaaacgtccaatgcttcaatcttgacttaacgatacagggtagtcaaactggaccagtcagttacaaaacattggtttcagccgcagttttgcagccatctctaacttgagtcggttatctatttatctgtattggagctcaagctgatcagtgtcatgacgatattcttttcacgacaccacccattcccaactaatgggatgcaccacacaaattaaaccaacgagaacaaaacggtcattatatgttcctatctgaaagaaactgtgtgtatgcattgatattnnnnnnnnnnnnnnnnnnnnnnnnnnnnnnnnnnnnnnnnnnnnnnnnnnnnnnnnnnn

SEQ ID NO: 10882 - DNA, 3933 bp, Oryza sativa
agctccgtacccgggtgaagaaagctacagggagaggcaaggagtaatgtactcctaggatagaggctcgggagacaatatggagtatttatatatgatatatgctaccagaggagaactaggatatgctgaatttcattttgttttgcgttcatggctgaattctttgatgactgaattttccattcatggtggggatttctcaccgtccccttattacatggcaaagaatttcgttcattgtattgcttctgttttctttgtcttcaaattagcggcttcggtaacatcttaaaccagtgtgttgtgaaaacaagatgagatcatcatgtacgtacgactacgattagaacacatggatcaccataagaaaactcattttttaggtgacttgatataccaaccaggctccaattaatgtattggaaaggggggaaattatgtgggtcaccaacaattccagcgtttataatcaattgagccaccaatgcggtcagggagagaactaaattaagttacccttgcgttgtcctcatcttgatgccgaacagacgaacaatcgcacattggcatagaagagttagcagaggggttttgcagccatctctaccttgagtcggccatcttttgataagagtcggtgctcaagctgatcggtgtcgtaaagatattctcttcatgacaccacccattcccaactaatgagatgcaccacacaatccaacaagaacagaaaggtcacttattagacccacccggtcaacacattcaagatattacttccttcgttttaaattattggttattcagttttgtcctaaatcaaaggtttgtttcattaatcattaatttctaaaattaatatagtttaatatgattcagtgtttgacgtatgacagaactgggacagaggatgcagtaattattctggttgggccatgcaaaattgcaaattagctaggaccaatcgaaaggtgattccacatatgagttggtgcatagcatgctcgcgctagcacatttgacgcaaattaccaggtggaatcctatttcgtcccatattgttctttctttcccatgtgtatcctctaaatccctcgttttatccaaatattgttgaaaaggtgaaatatacccccacaaaaaaaaaagaaaaggtgaaatatgatgttctcttcaaacaacaactcatttttacctacctacctaagtagatcatgctagtttgatattggatgatatctctttcctttttctttctaacaattccagtgtagattacctcttcatgactgaagcaacaattggggtgatttggagcaaatcttatgttggttttccattagaacgaaagtgtatcacaattggcataacactgccaaaaaaaaataagaaaggttaccagttttgccatccccatggaccgtattccggtccaacatctagtcaagagttttacgtatacactctagtcaattgaacaagacaatcactagaatccaatggagaaaatccccgtgtacccctaaaaattttcccaatctttttatatttctgaattttgcttattcccttttaaaccgcaaattttagtttggatatcttcctaacctttctattagttgaccattattaaactcttatgaagaagtctaatttacccctatggtatggaaaataaataaatttatagagtatagaaatttgttgtatgagactttattgagtttgtaaaatgcgaggtagtatttatgaaaaaaaatatttttaaatatgaaataaaaattaatatttatcttctaattattaaaaattttgttcgtagcttatttattggttagtagaacaacatgttttctatatatagatatacgctacacaaatgatttttcataactaaataactaatattaatttttatgtcatatatacaaaataattttatgataaataatacctcgcataataaactcacagatataatagtctcaaataatacatttctatcttccaatactatacttcataattttatatgtttcttcgtaccaaagggcaaaatagatcttttttttataggaatacaacagtcgacccacgattagctaacgaaaagtgtatgaaaaggatccaaaactaaaattcatagatatacaagagaatgagcaaaattcagagacatggtaggaattacgtagagaaagtttaaagggtacgtacgcagagaattttctcaaagcaatgtgtatgctctcttagccggcgaacagaatcccggcgtcctcaatctctcttcaactcccaaactgaaaaactcaacaatgcctctgaacttgaagacaagtgcattggcgctgcaacaccttcagcagtttttctgggttatattcatccccttttatttggaaacaacgctagtaaatcggccgtagtggccatcatgcacgcgacacgatccgcaccgacgtgcgccatcccacacgtcagatcgtgccgtgcgagactcggactccacaacagactccacgattttgacgtgaactcacacacctaaagtcttacacacgacgtagctgctagccagctggcccacaagcaaaacaaagaaaagaacgacaaactacccgatgaggaacagtgaaaaatagaaaatgcctaaaaagacaacgccacagacggcgagattgacaacatgctctagatcctattcctagtgtgacatctcaaatgaactttgctgcgagagctataacataggtcatcagagggaagtgagaggcatatgtggtgatggagttagttgtaaatttatctcctttgaacttacgttagaggtaggtacgatagacaaagtagtaatgcaatggcggtgcaacatatccgcgaggaggcagcagcccaatgagatggagatggaggtaggctgctagcacatagcatagggagacttttaagagctatgtgaacggcaacaccagtcgaccacagtacaggttccatccgtattcttacaggtatctcttccttattttggtcagcatgctcagcatatacgactccatatcatgatattctttccacgacaccacctattccaagtaaagaaatgcactatactaatataacaactgagaatagagtgacttcacattcctatcagacatgaagtgtatgcttagacattagtccttatataggctaaaggaggtagcatgaggaaacaaacccaaacatgttaacataaattatgttgcgccagaatttgtgatgtgtgagcagggttttcaattttgaaattgtatttttgcctgggaggaccaaaatttcggaaattttgtggctgaaattatttgaaattttgacttattttgaatgaatttgaataaaatttgaccaaattcacaaaaatttgcaaaacaccgaaatttcgggcgagatgtgagcctttgcttgcttcagttattggcctacggtaacataactcttatattagtcacttactccctccgtcctaagaaaaacaatctctagctttaaacctggacatgcccatatacatgttcatagctaggaactgacttttttaggacgaagcatgtaaggaagaagtaaacatttggcctttttttatctcataccatcttaattgaagccctagttgaactggcttttttttttaatctcatacggtcataccatctttcaacatttggccgacattgaaaaaacaatcaggattcttcatacggccaaaagagtgatcagcttatttgttttcaatcatatctagtatggttgttcctttccaatattaatatgcttttgttcaacagtattgagtaaaaatcctcctgcctatcttaagaaaaaagagttttgcaatgcatactccagtcaatttctattcatcgagacacaatcacgagcaagtag

SEQ ID NO: 10883 - DNA, 6753 bp, Oryza sativa
  unsure (1)..(6753): unsure at all n locations
nnnnnnnnnnnnnnnnnnnnnnnnnnnnnnnnnnnnnnnnnnnnnnnnnnnnnnnnnaaaagagttttgcaatgcatactccagtcaatttctattcatcgagacacaatcacgagcaagtagcgtgtatgctctagatctcaaatggttcctgttgtcgaattcggatcaactctttggtggggctgtattaatttggtccgctgctatataatgtgcgatacattatcttcaacttgctccctaactgatgatatgatatgagaaattaatggtataatctgctccatatagtgaagtacgtacacccaagacctgtgtgtctgtgctatatatgtgttttggtatcatcagcaattcagctttagtggctagtacccgcaaaactcacaagtttgtgaatctcacatggcctagacgaatgcagagttgtgtgtaccaccagatcaaagactacaatcagaacactgctgagagatcttgtcttggcattcttcctggttcctttcattcctaagaaaacaaatatgcttcaaggagttccagtggtgcacaaacaagcaaaggtagactactctggtatagcggcccgccggaaggagatagagcatatacatgaacctaagagagaattgttttatctctctagtctgtaccaatttgcattaagttagtacaagcgttcaaggctactcgattttaatgtgtacatcccaaactgatcctatacaaatcgcgagtgaaaagccagacaatctgaaggaagtgagaggcaggtaggtgaggtaagaaatcaatgctactccctccgtttcataatgtgtctaattcattaacatctatacgaatattagcaatgctagaaaaatcttagattattatacgaatggagtaggactttgtgataccagttcccagctcaagaacaagcaaggaagcaacctagctgaaacataattctgggtattgcaataatttgatcaaaataggaatctgccgaacaaaagaaggtatcaaatgattttgttcaacttaatcttcattttctgatcgttgtagtagtctcttcttgagatatccaacgaagcttgcacgttttgaagatttgggaggcttgactccccactgaagcattccacttcataccatcatgacacgccaagtcccaccagatctacacacaattttcctggtgcctcttattcataacaaattgtatccatgtaaatgtaaatcattttttacaacacaggaaaggacaaaaaaaaaccgagtgttccatgatgtcgaagatatagaaatttgtacatgtgtctggttatataaatttggaagtcagttaaagatatatactactacaaagctttgtacatgtgtctggttatataaatttggaagtcggttaaagatatatactactacaaagcataagtaggggaaaggaataagttttccacgtgttttatatgaacacacaccaaattgtgaagaggaggtgcacatttacttaaatatggtatttacatgagataaaagggtttagatgggatttggatataacattcaccatcttatttaaaagggcgtcagttagtgtataaatacactaagtatgcgatagatgactaggaacacagttgttacatactccatccgtttcagattacaagtagctttaagttttttctcggtcaaaccttttcaaatttgaccaaatttataaaaactatagcaacattttcaatacaaaacaatcatattatcaaattatattaatgttagatttaatgaaactaatttggtgttttagatattgctaaatttttaaacttggtcaaacctaaagaaatttgacttggaattttgtactacctccttttttaatagatggcgccgttgattttttctcacatatttgaccattcatcttattcaaaaattttatgcaaatgtataagatataaatcacacttaaagtactatgagtgataaaacaactcataacaaaataaattataattacgtaaattttttgaataagacgaatggtcaaacatgtgagaaaaagtcaacggcgtcatctattaaaaaatagaggtagtaaattttaggtttattaattaataaaaaatatttatgtagcgtataaatatatttatattatatagaaaacatgttttagtactatgcacaaaataagctacatatatgtattttaaaaattaaaaataaatattatttttatgtcctatctaaaaataaactttgtcacaaataatatcttgcgttataaaatgataaatataaaagtatcatacaacaaatttccatactctataagtttatttggttttcataccatagggcaaattggacttttacacaagaatttaacggtcaactaacagaaaggatatggaagatatccaatccaaatatacaagagaataagcaaatttgactaggaatcctatatattttaggaactgccaccatctctatcgaggatggcccccaccgtcaaccttgtcgtcggaacccaccgcctcctcgtcggagcccacccgtgtcaaacttcactgacacctacatgtcgaccacaccaagacgtgctcctgctgcccggacttcgtcacccaacaaatctgttccaacctatcttagattgaccacctatcaatctagtcgttagccaaagccgacgaatcaccatgttgccttcatagttgctgaatgaccagagcgccacgtttggccatctctttattgaatgcaactcgccaaaaggcccgacccacccccgccggtgtgtttgattccaccgaccgagaatggcaatcacctccagcttcaaccaagcccgagtgtttggcctcatgtcaccttgttgaaagtagctttctagaaagttcgagtcaccagcccaaagtgtctgaatccatctattggatcgcaatttgcttctgccaccatcaacccgagcactgcatctggtcatctccttgttgaaaacatccatcgaacggttcaaaccaccgcctgaaatgttatatccaccgatcaaatttcgtttatcaccaccatgctccaccttgcgtgcacattcgtcccttcacatcctgtgtaatcgttgtagcgtggagcacctcccacgtacctctaccatggatttcccataagctctcatacaacttgttctaaagccggcccccaaatcacaattggaaactaaacatgaaagaaacgccatagaagagccaaatttgatgatgacaccgatgaatgatatttgttaacaaagttcaaccgaagcctatatccttgtggcactgattatgggtgctccatcgattcaggcatccaacattattacaatgtattagagttacaacgagcctcagccgaacgtcggcagccactccctctcgcctatggtaagtcacgatgcggttgcaacatatctacccctttatttaagagataggctagaatagagtccgacgcttactctattcctaacacctagtacaactctatgtcctaaactgtaaccgacatattcgacacaaactctaacaccattcaaccatgattggcctccattgaagccacaattaggcttagttttttaacactgccaaataataataagtttaccagtcaccagccagaagcactacaacatatcctcaccaccttcatgcccggcagccggcgacggtgctagctccgatccaacaccggataccagcatcatcaccacacacacagctccatcccaaccccctggtgcgctagagcaggctgagatgcatatgcctccttcttgcccagtcatacaccaagatccacaccatcaggttgaagtgtacaacaccatggatcatctgcgtgccggcacttccaacccacgacgacctcagcagccgtcggtttaactgaggattcaactttgcaggacgggccctgcacgagcatgaacgggatgagacggcgagttgagcgcgcccagttgacgtggtgggcagcatcatggtgatggcgaaggtgaagtagtacaattgacaaagcgaaaatgctgaggagggtggcctctgcaggccacagtgaaaatgttgcctggtgtgtaaagaagaggaataataacagacgctgaatgatgagcctttggagcctggaaggaacaagcaaattgtagggaaataaggcacgtatatatgcaaagaaattggatgagtcaatccatgcaaacaacgcgtgtcgctgtaaacaccggccagcaacgcaagcagatagctatcaaagacaccaaacagaaggaagtaacacaaaaacgagcaagaaaagacgaacaattaataaaggaatcagacgatgagattattggcagcggcattagacgacaccaacagagaacgcagcaacaagcaggcatcgatttgccaacatccttcgttcggacgaccataaaataaacagaaactaccactggtagaacggtacgtcagtaaatcaagaggagagggaaaaaattctagaaaaaagcagggaaaacggaaccccatgggacttagggagttttatgatgcgcgcgaggaggcagtggcccaatccgtcagataaaggcagggctgcaggctgctcgcactagaagactttacggagttccaggagcagtagcaccagttgaccacagaaatacagaatatgtttcatccgtagtctcctggggatctctaccctatttaggtcaccatgctcagtctgttttagcatgataatttttccatcttggttcctgttatggcattcagattaacgctttgctccagctgaattaggttggttgctatattatgggtgatacattattcttcaacttgctccctaactgatgttatgagaaatggtataatctgctccatatagtaaagtacactgagacttaaatcttctattccttcatcttcttcgactcaccatcatcgattgcatctctaattgacggtcctccacctggtgcatgcgtccccctctgtgtcgtcccttgactctcctctattaatttgttaagctttttggttatcataagcaaatcgatattatcagcagctagtactccaatcacagtttgtgaatctcacatggcctagacgaatgcatagctgtgtgtgtaccaccagaccaatcactacaaagtgaccactgcgataacctacttgtctcggccctcttcctggttcctctctcattcctaaggaagaaacaaatgcttgcagtggtgcccaaattaacaagcagagatagagtattctaatctgaaggggtaggagtatactccctccgtttcaaaatgttgacaccgttgactttttagcacatatttgaccattcgtcttatttaaaaaaatttgtgaaaaatgtaaaactatatgtgtacatgaaagtatatttaacaatgaatcaaatgatataaaaataataaataattacttaaattttttgaataagacgaatgatcaaacatgtactaaaaagtcaagtgtcaaacattttgaaaacggagggagtatatatgaacccaacagatcgagaattgtttgctctctctagtttgtatattcgtaccaatacacattaaagcagtgttgaatgtgtaatttcagctgtggccccccaaagtgtttcaattgttagagcatctccagcagggacctcaaattcaggccctattcaatttttgagagttaagatcaaaaaactagatccagcagggaccctactagagccccaaaagtgaggaggccctcgaatcctcccccaaggccccagtcctgggggctccggagcacgcccccatcgtcattttttttggcgcggataataattttgcttcgcgcattttcttgttattcctgcacggctgcgacgacggatcttctccggcgagcaccgacgaattcccagcacctccgtcaagactgcccccgaaaggtaagacttttccatacctttcttgcccgtcgatctcaaggccttcggcggcggtccatgcgcatgcccggccgccgatctcccgccatctgcctggccacacgccggccgtcgcgtgccctccaaggctgcccgcacacacgtcacccacctgcacgctgtctgcccccacgctggcctcctgcccccattgacttttctagagaaactctaagtaggtcatgtgctgcgggggttcagtggtagagtactgatcaattttctgaataactctgttcttgacacaaatggacatgtggtggtagatggttctggtggagactgacttgtttttaataatttttttggagaattgtagtggactttgtcgtcaaggaaaatctaaattctcaactagtaatggttgtgtttagttcacactaaaattgaaagtttagttaaaattggaacgatgtgacggaaaagttagaagtttatgtgtgtagcgattgcaatggcttggagaataagtctgctggagtttgttagcagatgcgggagatgcggggatcaggatctgaatgaccgcatcagtagcgtccgtgtgcgtgagtttagcgcaggtgtgtgtagctgaattcagagatttgcggatcgtgggatggcacgattttgcctcggattcgtttatttgtatcgagtataagtaggagtcttagctcagnnnnnnnnnnnnnnnnnnnnnnnnnnnnnnnnnnnnnnnnnnnnnnnnnnnnnnnn

SEQ ID NO: 10884 - DNA, 15464 bp, Oryza sativa
atcgtgggatggcacgattttgcctcggattcgtttatttgtatcgagtataagtaggagtcttagctcagttttttcatttgtaagttctttatttagttgaatgaaaaaccaccagaaaattgccccacatttgatcgttctcgcggagaattttaaaatttctcagttttttcctctgctctgaatttcctttgttcttcgttactgttttagtctgttgccgtgccggacatctgcagtttgcacgcaatgtgttcgatcagaggttatcgccaacaaacagcatagagagaagttaaaggctacttcatccttatgggtatactttggactgaagaaaacaactatccgatgcaaacagcgattcagcgagtgaaaagccagacaatctgaagtaagtgagagacgggtggtgacgtcgtgtaataagttgtggattaatcttccctgaagttgagaggtaggtgaggtaacaaattattgctagaactttgtgttgccatcccaagttcccaactcaaaaaactagcaaggaagcaacataaatctatccctatactaattgggcactttctacgaactctcacgttaactataaagatctaaccattagattagattgacggtaatatcaggaccgtagatttaaactgtaaacatggacttttaaagtccaagcaatctagcgttagaaattggtccaccatccaatctctttaactgctttaaaggcccaaaacccatatatgtgcacgtattaatctcagccaccacattagggtattcacctacatcgatggctgccacggtattggcggacatcgctcccgacaagacggcggcaacttcgacctccttcatcgtgcacccgaggtttggccgcaattgcatgcaggcaaagctccatatcgatgtcgaccgaatgcatttgtccttgcggggtctcagctcatctattaagaattgatctaaactgatcctacagctacgattgctgatttacgtacacaagtaagattttgttcgaactttctccaattctagctgttcatctgcatgctcttcatctggctatgccaacatatgacctaataaatttcaggtgcattgagatgttataattcacccaaacaaacaagttcgattgcacccaaagagatcgatccgtggtcgtctcatctgctctttatgaaggtacgtaatttgtcaatttggatattctatgccaagttttgcttgcacctaggaaacatccatcgtaggcgttgcatctgtaaaccatgcatgaagataattcatgcatggttgatttgtatggtctcttatatgtatatatattcgaactttgttgttctatagctttctgcacattcaaactaattaatccatgcgtgctgcttcgttgtatccgctcattgttatttaagttgatgccatatatatatatataatttccaaagacaaataacacaacttatttgtctctcgacatgatataaatatatattctttctcacaaacagggatgatacaaatattttcttgagagttcaagacaagtacaattttatattaataattagacaattaaaattgtaacttcaagtttgacaagcagcagccataaaaatatttttgcttgacagtccaagacgagaacaattttaaatttaataattttgattagcaaactttaactaggactctttttatctaatccactataactccctattctaattatgacagagttctaaacatcttcgactatcaatatcaatgtagcatttattagtttaatcatcataaaatcgtacccattgattatgttggttttatattaaataaaacaggccatatgctctttacatttatagattttctaaaaaaaatgaaattaataatatggagctgtaccaattaaaccttggactacgtactatttagcattgctattaataatttatgaaattcaaaataaaaaatagcagattgtaacaggtagggattgattttatctaatcccactacaatgtgaaaataaattcaaacttaataactatatatcgatttatgaccatgctcaactgtcaatttagcacttattaatttaattatttaattcaaaactaacaagttattttaattctaatctactatattttaaaaataaacaacacatctgtagcataaaactgttcatattattgtaacaatatataattatacccgtgcaacgcacgggttgacgtctagtaatatgtaattctgggtattgcaattatttgcataaaaacagaagctgctcaagaaaagaaggtatcaaatcaatttgttcagcataatcttcaatttcagatcgttgtactagtctcttcgttcttgagttatccatcgatgcttgcaggttttgaagatctgggaggcttgactccccactgtagctttccacttctcaccgtcatgagacgtccagtcctatcagatctacactcagttttcctgctgcctcctattcataacaaatgaatatcaatataaattgtttttgagaacacaaaaaaggacaagtacaccgagtgttccatgatgtccaagagatatatgtttggttatataaattttttagtcgatcaaagatatatgtacaactacaaagcataggtaggggagagcaataagtagcaacatattttatatcaacatcatcaccaaatcgtgaagaggaggtgcatatttactatacgggatttgcattagataaaagggtttacatgggatttggttataacattcaccctcttctttaaaagagcgacactttggggaccgcagatattacatgaaacaactaccaatgcaattataaggcattggtatataaaagaaaacattagttcagggtggtcaataactcgtgttcacacgtattttttgaaccgtcgtctaaaagtaagggcatgtagaaatcaggatttttctcaagcagattccatgaccacccgtaaaaatcaattttcatgaatggccggtaaaaatgaattaccagattttgactttcgtaggcacaaaaggtaccaaaaacatattttaggcatctatacatggcagcgaaacataaatcacaagtcacatgattttacctatgagcttttcatgattgttggaaggatatgctatttgtttctcacttcaccattctaaacttggaatatacattttgcacgttgaataacttcaaatggaaatgtcatcagatgtaaacttgtagatcgcgttgagttatacacttttgacatagaacatgtctctatataaggtcatttggaaaactcaaaacttaattttcagtcactaatccataaaaaaagttgattcaataataattagtgaaaaaaaatgaaaactaataaacaaccatttctgtcagatggattaatgcgtgcaatatatatatatcgtcaacattgtcgaacaagcattatgcaaatactacctccgtcccataaaaattgcatttctagctaatttaggacaaaatagtaggattggaaaattaccacaataaccttatttaatgaacccactgtatgcacacattccatatatacaaatgattaaaaggaagtttgagagaattaacccatataattagcatacttaataaaattacaagcattagcagctcaaattatgtgagatggaatgaaacttatatagatgaatcaattggttaggccccacatggctagaaatataattttgtggaacaaagccttggagctagaaatgcaatttttatgggacggagggagtatatgcatattacacacaatattttacactgaaggaaatacaagtccatttattccaaatcccagaaaatatataagcaaaagtaggtggaaaaaaaacaagccaacagacacctcgatcgattaattatctgtttgtttatttacttacctgcagttatttatttatgtagcatcctatgaatagatgagcgagagaaacacacaccaatcgatttatctttgaacggtaaataaatttgtcagccatgggagacctaaagctacccaagagctgatgtctccctccatggctgtcctatctccaaatatcaccgcgatgatgacgcgcaccaccgcgccgacgatgttccgatctcgctccgacggaatgccatggagaggaccaccttcaccgatcatctcctcgctgatcgccagcatgatctgccctccacatttcatgtcccgagctgcctgccatctcctccgtgcgatctgcttgatgcaggacacgtgcagggacacggcctcgccgccgccgtcgacgacgtcggagttgtagtagcaccattgctcctggcggcggaggcggcggcagcagtgatccgggccctcctcctcctgtctgctgcataggctgcacttgctgaacgccgcgatgtcgaaggcgaccccgtcgatagtgatcttggctagtccctgttgagaatagtcccacgttacttatttatggggttgagccaacttaaaagtgagggaatctctcacctctttaactagcttttgaggcgtagcaagactttctttcggttggtccaacgtctcccggttttggaccgggagttcctgcaggctcgcacagcatgggtggaggtcgaggttggcgcctgagcagtggtagacgagaccgaacacatggtcgccgcaggtgtcgcaccacctgccgccgctttcgcctctgccaccaccggtggcggcggggtgcggtttctccggtcgtccttgcggtggcttggcgagaagctcgaacgtgcggccgaagagatggtggtagagcgtgctcggcgcatgggcacagaacttgtgcatgttgaggtcctcgcaggtgaggcagtggtacctcggcccgtctccgggctccttgcaggcgtcgcacttgaacggcgcttcgccggtggtggtcaccattctaagcttgtgctccgggtggctggggtgggtgatcgtcttcatctccggcaccataccgttgtttgttccattctggttctcgaactcctccgcatcaccgttactttccccactgtaactagcgcattcaatgatcccgatcagtaaattttttttattatttgggacaaaactcgatcaaactttaaatatcctgacaaccatttcttttttgttagaactacttgatagtatttatagttttgtacaaggacacaaagtctccaagaaacaacactcaagaaataaccttaataacacttttctactatactttctccgcccatttttaagtgcagttgtggttttttttttccaatgtttaaccatccatcttatttgatattttttatgattagtatttttattgctattagataataaagcatcactagtactttaagcgtgtcttattttttttcaattttttcataatttttcaaataagacggacgagcaaacgttggacacagaaatcaacaactacatttaaaatagaacgaagggagtaatattcgtataaatatgaacaaatatataagtttattgaagtacttttcaagattaatctatacatatggtctccatatctgtatgagaaatatttcatagtcaaatattttaaattttgactttagttttatccaaaacgataagtattatcgtttcggagcaactaatttataaaataataagtttttgacatctatccgttatattattaggacgctcttctaccgcattcattctagaagctagaaatttctagaaaaagaaaaaaatcttaacagttagataacggtacatatagttgtataaaaatacaattatatctacagaaatataattcaagagttatatatgaaatctaagcctattgaaatagaagttaagagtggtatatgacattcaaaccttatagaaatagaagctaagcattgtatatataaaatctaaatatatttctacatacaatgttaccaatagaatataaaatttcagaattgtatactaaatctcactctatacgtgaattatctaggggaatcccctagctcgttatgataatttccttatgacataataattgctggtagtttttcatgtacggcgttgtactttccaatcataaattaataatttctatcatttaacacttttttcagcgtaatacatatcgttttatatttttttaaaaaagaaataactgaattatttgcacgtggcttttttattgaaataactgcataaatgtaatactatggaagttctcgctgtagcaacaaatttagctatatgatttccatgtgcctcaaacatatgttctgaacaatgattatggtcgaaaatcactgcaatgattctaaaacgaaacttatttatcaggagggaataaattcatatatacacacctgctattatcttgtgcagatgcaccttcaccacaatcatttgtcggcgtcccgtcctccattagaatctcatacaaattagtcagagtctcgtgtgagtgtgacatcaactccttcaagcacgacaggtgcacgtcgacgagctcgtcgccgccgctgcggcggaagcggcaggtccagaacccgtgacggtacccatcctcgccggacatgcagacgccgcaccgtcggcggggagccgccctgcggcagagcttgacggcggcggcgccgcgagctgccgccactggcagcctcagcctcgcgcagcgcgggtggaggttcaggccgacgaggccgtgcccatcggcgcagtggtaggcgaagccgtcgccgcgcaggaggtcgccgcacgcgtcgcacgccggcctccagccgccgccgccacggtcgtcggcggcgagccatggcggcggcggcggaggccgctcgaggaggcggaagtgccggcccgggagcagcgggtgctctagggtgagcggcgcggtggcgcagcacgtgtagagggtgaggtcgcagggctcgcacctgtacctgcggcggccggcggcgagctccttgcagccgccgcaccggaaaggccagtgaccgtcggtgacgttgtcggccagcctcagcttgtgagggtgaaacgggtgagtgatctccgccaccggaggatcacccaaatccggcgtgcgtaacatgtggttgtcgttttctgttgaaatcagcaaattcaagatcattaattcattattgagcaagccatgcaaatttgagtcactagaaaacctatcggtatagccgatttgatcggtgctcaccgaaatttccgaaattttgaataaagtatagttgaatttgaacaaataataccaaaattcacggaaaaatttaaaatttaaaaatttcggccgaaataatatcgttccggaatttccaaccctgcactcgatctcgttagtgatacacatatatactcgcttcaattctgaacatttgaaagtttaggacaagatttgataaaaacatttaaaacttcgaccgttaatgaatttataaatatttacttgaagagatttgctccggttcaataaaaagtaactcgagttaccggtattttacggtactaaatcgttttcgatcgttggatctagctgggcaggatgggcgttgttagatccaacgatcgcaaacgatttagtatgagtacctcgagatactttttgtttgaccagagcaaatctcttacttaaaactaaaaagtataaatatggtatgagcatatttgactccaaaagtattatatattatcagttgtcaaagttctagaaaactaatttaatcctaaaaattaatgtaaactattgtcccatgttgaattaattatattccaataaaatttatgtccatgcggttatatgatgaccaattcaaaaaattttggattgtattatatgatgatcaatttagaaaggaggatgtatatagtaagtgaggattcttaaaagtagttatgttcaaattaaggatcgatggatacctctggatcgaccgagtcagcctcggagaagatcggcgtgaaggtttatatcctactcctgcccgtaccacaagaaggccaacgtacaagctgcagatcgaaggaatatgagagagatagactgagactggatcttctatttatacaccaattcaccagccggcatgattcctgtttcaaactaaactatatgcgcactcagaatctttcactaattgtatatatgcaaatatatacgtatacgtgcagtgtcctagtccgagaagtctctcttaacaataactggtagatatttatatttatctacacatctacgtcctgaacagcttgctctacttcttccggaaaaaaaattctggacagctaattatgcttataaattattactcgtttttattcattcaaacttataacggaattagtcttccctttcacttcattgaaaaacaaaatttacaacaaagtgtcctggatttcataaaattaaacgacatgtcgatcaatactcacacgcacactagaaaagaattggctataactctttgagcaaaagctgagattctattctattatctaaaaaagacacactagaaagaaatttaactttcagaatattcagcctgcccatatctgtaatagcgcgcacctctttgcaaaacaaatcaacaaaaaaattctctaattatttatataaaaactattatatcgctgtttctcaattttttatctcaaacaatgatatatggaagttttccaaaaaattgaaaaacctctcacaaatagctaaggtaatattagacaaccatacaacctacttgagtttgtgagatataaaattgagaaatataagataaaaagatataaacacgagcaatggtatttattaattttatatctcattaacgaacatgagtttgttcgtataactttgttcggttgtttattatttaaatatcacctatgtgtgtaattgttttgagttttcaccatatatttgccctagataaacaattagcaagttaattgttaattagcccatccattcgcaaaggctactgatgttgtcatttgtataacaaaatacatatctatttaagtttttccaattatatgcaactagttaatatttttacttcccatatttttttattaaaatggcagttgcattttctaattattaaatgattgtttttacatatggaaattatattcagttataaataaatctactttgtctaaattaataattctaaagttgtatttgttatagttataaaattctaaattaataattacatagtgtttttccttctaaattatatatagaatcaattccgagctagtcacataactgaaatattagggaaaatatgtggtggaaaccacttatgtagtggaaatttgaaaactgccactggatcgaaaaatagacgctggaaattcatccacgtcactatgagtaaaaaatttactcactgtaaaatttttactcatgagcaaatccgtgagtaaatttttacttgtgatgaaacgtacgaatcttgtatgtctatttttcaatcaatggtactttctaagttttcatttcatatgtgattcccaccacatattttcccgaaatattacgccagcactacctagataattttctttgactaatttagttaaaacgacatgcgcaaagttagcatagttgagcggattaggtttatggtggtggaaacttttgtcgactcaggttgagtccgcgactaagaacatgtacaggttcttatatttatgactaatattctttcggtaacatgcgatataacagttaaccatgaggcacatatatatagtgagttcgccaatctcaatatatgctgaccttatctctcatctcagaagtcagaagtactcataggaaaaaacgtatacctgtggacgtttatatagttgagtgtgaatgagaccctaggtgcctatgattgcaatgcaatatatatgttccccaataaataaataaataaaaataacacgtatctgttagtgagatacttgaatgacttggcactctagctagctagttataggtttagtgaatcgcagaaattatatacagcagattccgtttgacatggattatatacaatagaatctgtttcacatgggtacgttaaatatcagagattctgtgggacatggattactatatatatctaccagatattcacttcgccaagcaacccattacgtataataaccttcttctggacgtggatcgtgtttctctaaccctttctaacctgatatatattaacaaataaccaatttgaagtttccatttgtttctatatatatagggaatttggaaatattagttgctggtaataaactgcagagaactaattacgatgccaaggaactgcaggtacatcagatccgtttaattatttgctgtcaagtctcaataaaaaccagtgaacaaagttacttcgagaaaaaaaattagagtatatatgtttgctatattgtcacagctttttttttttaccggcaaaaaaagtagtgacgaactgttgattatgaatagcattgccttcactggtagagaaagcgtttgtagttccggttcgtaacccccctttaatccctgtttccaaaccgggactaccaatccgagactaaagatcgctatctttagtcccgggtgaaataactgggactaaaaatcgatctttagtcccgattggtaacaccggcgtcccggttggtaacaccaaccgggagtaaacaaccgggactaaagatcgagctgaccttttttttttcatgtccctgttgctgcatggtttatatatatgcatatatatgtttcaatacatatatatgcacatataatatatgcatatatatatattatattatatttatatatgtttcaatacatatgtacatatgcaaatgcatatgtatatatatatatatatatatatgaccaaaatatatatttacattatagaaaatgtgtacacatgcatatagaaacatagtcatgtattaattacaatccattatatgtcctagctagctacgatttcgacgtagtagtagtcgctagctcagaagctaaggacctatgaattgtgtttccgtcgtagtagaattcacccttgggatcaaggatttgtttattgatgaatcccatgagttgttcttgaaccgccgcgataaattccttgtgtgtgatcaggttatccctcatacgaataaactatatgaatgtatgaaatttattagtaattaaacaacaaatcgatacataatgaaattttaaatttatttgtacgtacatcgagctctcttgtggtgatgatttggtctgcaaggcagtggcaatactcgcacacgtagtagccgcacaagttagttccctgcttttgctttgcgcactataaataaatgacaaacgacgagagatctaattaatgtacacttgtatgtatttgaatcagagaaatataaatgtagagcatatgtactcacaggaaatttgaacttccgcctaagtctttctctccatttgccgcggaccaaatgatagaaccgataccaagccctacatggagtttaaagctatgattcgtagtagcaattaactataacaagattcttaattaacataggaacttatgacagtacctgtctataagttcgaaaaccttgtcaaacgtagactcttttttatccattgagtcatatacgttgacgttacaggcttccaggtcgaagagtaaaagcacccagtggaatctgcaatgtgcgtgggatgcattacatatgaaacacttagcaagttcatacgggaatgaaatttggtataggaagacagtaaaattaaactaactctgtgttgtacggcaacagtatgaacgtcttgtaatgctgcgccttcaggagatggacgagattgtcctctgtggcttgcggatattggtcgagcattgcgacgtttactttccgagggtcgatgaatccagtatcgaaaaccccccgccgttaggccctttgaatctccattctacaacgataaaagggagtatatattatatatagtctacttatatacaaggacctaattacttaaaggagacgtagtaagaaatctaactgaatgatatacttacaaaatccagcaactcataatagagacgtcgagggcgtccagctggtatagttcgtagattcccttgaaattgatccagagaatgtcatctccttgcaagaagtccgtgtccctgatccttgctccaatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgtctcctagcaattgatccgtagttagcccggtgtcattaataaattcttgtattccaaaatcttcaccagtcaccaacggctcgatctcctggtttggttgctctccaagctgagggactggtttggactttccagaagatgctttcttgagcgttcgctcatagtccgatagctttatggcctccttggcaggtgcagacatacccctgaagaagttcctaacactcgggtctataggaatcttcttttctggacttcgaggcttgaattgtctgttgacttctgatgccacgtaagcttcaagctcctcttgcgtgcaatcgtaccccgggtccttgttcttggcggtgtcaactttcgccttctttattgcccttgtgggggcaggcggtggagcttgggttgcccttgacttggaaggtgccggaagaggagcctaaggaggagtcggtgcaggagcctgaagaggagtcagtgcaggagcctaaggaggagtcggtgcaggagcctgaggtggagacggtgctggagcatgaggaggagacggtgctggagcctgaggaggagacggcggagccagaggagatggtgcacgagacgccgcttgtcgcccagggaggatgatgtatcgcttgcgccatagaataatggtgtggcttgtgtctcgtagatgcgtctcaccatctcctccagggtaatccagctcgaggtcctcgtacgcgtcttcgaccaactcaacttcgaccttggagtatcctgctgcaatcggcctacagtggtaagtacctgaagggtccgttgggatggccatgcccgacgccaccttcatgtggtgagtggttatttattagtaatcaacatatataagcaacaactagcggaatggccaaatctaaaatctataaactatgggcttacctttattgataagttcttgaaaggaatatgcagctcacatggtgtccgctgagtgatgtcatcaacggggcaggtggattcgtcctgcgtttgcatggcgtccatgctctatgatcctacctgcccctttgaggcgcagctgctacggtttcctgacgggctcaccattgcaggaggaatggtcggctggggatcatgggaccgatgtgcggccatgcattcatcaaccttccttgccacctcctcttgcatgctgagctcgtagctcgataccctgaactctagatctgcaatcttcgcctcggtatctctcttgctcctcatccgactcctgtacgtgtggatgtcctccttgaacccaatcttccaaggaatcacccctttccctcgtgttcgtcctggatgctctggagtctgcagggtgagtgacagctcgtccttctctctgttcggtcggaacgtgccctaagaagaggcttccactgtgtctgttagtcgacgcgcagcctcgcgtatctgatcgccgaagaccagggagccatcagctgggttgagcattccaccgtgagcatagtaccagaacttcgatcgttccggccaattagcggtggccggttcgatacccctctcaagcaagctagcctccatctcctcccacttcggcatcgcgacgctatagccgcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcaagatatatttctggtacagatctcccttgaagctccgaaactgttctgccattttcttcagagtccaccttttcactttgtcctctgtacccgcgggaagggtgaatgtctcgagcattgtggtccacagcatctctttctccgaatctgggacaaagctctcatgatctccgcgtgcccttgttctgcgccagtagaccgtactaacaggcacgttatcccgcgcaacccaaccgctgtgacgtacatagttcttggcggcttctgccggggcactaggtcggccgtcttcgtccacttccgttatgatgtgccgaccctcaagcttcttcgtggcacctcgttgcccgcgtcccctcttctgtccaacggagggttgacttccactagcctcctcctcctggttcccctccacatccctttccacgtgcccctcctggttcccctccgcatccctctcaacgctcccttcctcgttcaaatactggtttggatccttgttcccctcttcttcgttccagttctggctgcttccctccgcgattgtatcgtacaatatctgttcctcattgcgatcagccatctgttcatacaggaaacatctgctaagtcatgagacatttatgttttaacaatcttatatgctaacaatcatatgctaagtctaggtgacgtatattataggaccctagctagtcaataaattatatagtaagtctaattacaaatctaataatcttatattaaaactcaaataatcttatactaaaactcaaatagtgataaatgctaagtctaggtgacgtatattataggacgctagctagtcaataattatatactaagtctaattacaaatataataatcttatattaaaactcaaataatcttagactaaaactcaaatagtcatgtatgctaagtgtaactgtcgtatattagaaccctacacaatcttatatgctaagtctaattacaaatctaataatcttatactaaaactcaaatagtgataaatgctaaatctaggtgacgtatattataggacgctagctagtcaataattatatactaagtctaattacaaatataataatcttatattaaaactcaaataatcttagactaaaactcaaatagtcatgtgtgctaagtgtaactgtcgtatattagaaccctacacaatcttatatgctaagtctaatcacaaatctaatactcatatactaacactcaaatagtgataaatgctaagtc

SEQ ID NO: 10885 - DNA, 2157 bp, Oryza sativa
ttaattgttaaaaactctaattaacatatgtaaatgccacatgcatgatttaaaacttttaaaaattgtaagtatcgcatataactagcatatacatgattaaaacctctaataatcgtgcataattaacatatgccatacatcaattgatttatatggataatcaatacatccaaaatagtttacatcgtgtacacaataattacggcaatacatcggcggggacagttgaccgcacgtactttttcctcactattgttccctccttgtgatcgctgcgtgagtaaggggtgtcttcatttgataggaggatgctagggtcaatcatcaccgtgaaagggggttgcccatccaactgatcgtaatcctcgtcagtcttgtcctcagctccgacgatttttcttttgactaggagacccacatgacgcttaggctcgtcaggccctctgccttctttcctttgctagacatatccttcacgtaaaagacgtgcgttacatcattggcaaggacaaaaggttcgtccgagtatccaactttgtcaaggtcaaccgttgtcatcccactgtcatcaatcattacgcctccaccagtcaacctaaccgattggcaccggaacagagggaccttgagaggaccatagtcaagttcccatatgtcctcgatggcaccgtaatacgtgccagttgttccatcgtgtcccatggcatcgacacgaacagcgctgctttgattcgtgctcttcatgtcttgggctctcgtgtagaatgtgtacccattgatctcatatccctggaatgtcgcgatcgaccaggacggtcccctcgccaggaaggtaagttgttggttgatcgactcgttacccacgagatgttgtagtagccacgcggggaaagtatcaatgtgatgccgtgtaatccatgcatcggacttaccgatgttcctggcgcgaactagagccaagtgctcctcgatgtaaggagctaccaatgaagattgttgcagaaccgtgaaatgggctttacggaataaattgttgtctaccgtcattattgctttccttccgagagttccctttccctgtagtctcccttcatggcgtgattcaggtaccccgattgggcgaaggtcttcgataaattctacgcaaaattcgatgacctcctctgtttcataacccttggcgatgcttgcctctggacgagcacggttacgaacatacttcttcagaacgcccatgtacctctcgaaaggaaacatgttgtgtaggtacacaggcccgagaatactgatctctttgacaaggtgacaaagcaaatgcgtcattatattgaaaaatgaaggtagaaatatcaactcaaaactgacgagacattgcaccacatcattctaaagggcttctaatctatccggatcaatgaccttctacgaaattgcgttcatgaatgcacatagctttgttattgttgcccggacattgtctggaaggataccccttattacaactggtagcagttgtatcatcaacacgtgacagtcatgagactttaggtttgtgaacatcttttccttcgtggagtatccagacggcacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcggacgtccaagaattcccaatagggtaactcccaaaatatagagttctttttccacatcgccgcgtgaccatcttcgctctctataggctggcttccaggcccctttccgaacactactttaagatctttaaccatagcaaacactgttttcccgctgcgatgtttaggcttcgtacggtggtcagccttatgttcgaagtgcttgtctttcttccgtaccgggtggtttactgcaaggaatcgacgatgacccatgtatacaaccttcctacagtgcttaagatacgtactttctgtttcatccatacagtgagtgcaagc

SEQ ID NO: 10886 - DNA, 6046 bp, Oryza sativa
  unsure (1)..(6046): unsure at all n locations
nnnnnnnnnnnnnnnnnnnnnnnnnnnnnnnnnnnnnnnnnnnnnnnnnnnnnnnnnnnnnnnnnaataataatcggcatcattatgtacttcctattcatgcatagccaggggggaggttgtatatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcctgtcctattgacgctcttcaacatgccatcgcatcattctagcattccccttgttcctgaacaaacgccttagccgtggtattatagggaaataccacatcaccttagtaggaattctcttctttgttagctgcccgtcaacttctcctggatcgtctcgtctaatcttgtatcgtagtgctttgcaaacagggcatgcttctaggttctcatactcctcaccgcgatataggatacaatcattcggacatatgtgaatcttctgaacttccagtcctagcgggcagactatcttcttagcctcgtacattgtctcgagcaatttgtttccctctggaagaatgttcttgacgagtttcaataaatcgccaaatgtcttgtcactaaccccattttttgccttccattgcaagaactccagagtggtatccacctttttgtgcccctactcgcaacctgggtacaacgacgttctgtggtcctctaacatcttgtccaatttatgggcccccttttcactttcgcagtcctccttggcgtcctgcaacatctgaccgagatcatccgcaacgtcgttaccatcagcatccctttcctcctcgcctgtttgatttccttcaaatccaacgtactgagcaaagtccggaatattgtcgtcttccacttcatcttcttccatttcaacaccttgctctctgtgggatgtccaacaattatagcttggcatgaaccccgactcaaacaagtggaaatgaatagtcctggatgcagaatacttcttctgattcttagacttattgcatggacaacgaataaaacccctttgcccgttagcttcggccactctcaaaaaatagtgcacgccgtcaatgaactctttggaccgccggtcagcgtacatccattgccgagtgtacatccattgccgatccatctacatgagtcaaaaaaaatcatacacaaataattattcttacaataatgacagtcatacaataattataagataattacaaactctttccacagtcatacaataatgacatatctttattcatacaaaaatcataaaatattacaccaaataattcttatttactatttctaaagttttaaactaattttaatgtgttttacttcttttaattttcattttagtttgttttctattatttaagattaactttcactatattttctttctcaactattttataaaaccttctttagcaaatcaactaaatttctatatattctttcttccccacacaaattttctctctcatcaacttacaactaaattttggagacaaaaaagtgtgcaaaacatagctgcaaatgtaatatgacaaaaaaaaaacactggaggatgaagttgcaaaccttttaggcacctccgatttgtatgtaatcaccaaaataaattcactagaaattttggcgtgacctcccctcttttttgaagaaattttgaaacttgctcgggcagctggaggagaaagaagacatatatataggggtgggactttagtcccggttggtgttaccaaccggggctaaagatccccgagctctttagtcccggttggtaagttacgatctttagtctcggttggtgttactaaccgggactaaagatcccggggggcctgacaggccctgacagcatttgaaccgggactaaagatcaagttttagtcccggttaaaaagggtaacgggcatatttgatctttagacccggcatatttgatcaaccgggactaaagatcatctttagccctggtttttattgtatccgggactattgtggaattcggccgaccgacgaaagatggtttctccaccagtgcttttagataaatatgtggtcatcctgcagatatttacatgttttttaatgtaaatgaatattattgtcatctcatatttactgagcttgaactttcatctcttgttaatttgatatatataacaatgcatggacaaactcatgcagttcacttgaacttttagagaaatgaatggattactgtgcagcccgtcaattatattggtttttgtttatttgtaattttggctcttataaatatcgtatactaaaaaataaattccgtgaatgttaatggacttgcactggctcttattatattcatacataatgatgaaatgcactttacattgatggagtaatagaattacatattctggcacataatgataatttcactggaaaaatatgtaactattgatgtgccagatgtaaccgagtggaataattaacgcagcacaactatacacaaattttataaaaatatcaagaaacatcaactggtatatagaaactttttatgtagaataatgtttcctagctctacaattatcgaacaacagagaaaagtaattatattgagataaactaaaataccaagcctaatatgtcttcagttacctactagcaaacttacataagaactttttgtatcagagaagggtatttttttacccagcctctatatcgccaatcgaatatatgcagccttttaaattggaaacttagccctttaaaaccacttggctacatacccttttgcaagcacataattgattgcttatgattaggaagctacaagaattatatttgaaacagattcccttgtggtggttagcaaacaatttgataggtcaatccatactacattgaatcaagatttgaagttcaaattagttggttaatttccaagagatgaagttttgttgggtacgtcgaacggcgaacacggtacagcacacatgctagccattagcgaaggtgtgtagcgaaggagagtatttcttctcgtgttgctttacaacctgtgtttatatgttcctgcaggctttattttacctttccttgataatgattgtaagcaagattatatgtagtggaataaatctccattaatttttaccaaaaaaaaacaagtgcaaacctcgttctacgatatttttctctttttccttttgagaactctgattctttcttgacttgtcgaaccatacaatgtatataagaccagaaaaaagaaccaatatctacaacctacagtagatcactatcatcgtaccctggcaaagagaaaaaaaaagtcactgtctacacatattatttctttagtttttgaagtaatttcatttgtcaactcaaatttactgaccacttcaaaattccacaccttgtaagttgttatacataataacgactctaggtcgtttatctattttggccctttaattagttatatatcccatattatgctcaaagtttgtccgcaaatgttaatggaataatattgattttgcagtcgtcatgaataaatggacattggatgcaggaatctatcgggatatcgtcattgcgtgcacttcgaggcaaaacccttgtagattccctctatatatagctttaataattctttctatgatgtatggtttttattattaaccttttacgtggtcaattatctaaaagaactgttaagtgttcaatgtacatatactattgtgagtattgtcagttcaattgcagttgacacggaataattacatgataattaccatgcatgcaaattaattgaattataggctaatggaattgttccggccggtgggtattctagcacatggataactcaagcagatgaaatatattgatgtgttatacccactggaataattaacgcggcacaaaatgtaactagcctctctgctatgacaaactactgagtttaagaaaaaaaaaaagaggaagaaaaaagagaaagaccggtctactggaaacttgccttagttaatttgggccgttgtttcacacattcgttttctttccgttttcctagtgaagactgggctgtgactgtgagcgatatacttcgacaggtcggactaagttcacattaggtcctcaatttgtcttccagccatttcatgcttgaaccaaaaaaccagatataacccgtcctccaacttacaaaccggtgtaaacaagatcgcttagcagtattatctccagttttagctaattacgtgtctcctatgacttggtcttcgtcccacgtgatattgacataacatttacacaacaatttgatcccaaaaatagaaaggacactacttaaaaaggaattttccgtgagatcaaaaatggttttcacgtgcgggtgggccaactgcacgcacccaagtgtctacaaaaattgctatttttgcgtatgggtgggccaaccgcatgcacccaagtgtctacaaaaatcgctatttttgcgtacttaactctgacgcgatctctttttctctacctctccatatcttcttcgccgtcgtcctccctctcctcttgatccccctcctcccctccctctctgcgaagccgatgacagctgcgatgaaaacgacggcgggcggcggcgccctcccgtccgctgggagggaaggcggcacgcagcggcgcacgagggggaggcggcagacggcggccacgcagtcgtgctgatgcggcccggcgaagcagtggcgccccggcgaggccatgcgacggcgggggtgcggctcgcgcccatgtggcagctatgctttgctagacggcggaggagctcgtcctggcggcggcgtggctcagccgggcggcggcggcgcgcccgtgcggtggtgaggtggccacgtaatggcgcggtggagcgcggcgcggcgaggccgacggccggcgggggtggacggccatgcagtggctgcacgctcccccctttttttttgttctttttttaatggttttctgttgggttagtcccacattgttaattgatgatgggggagcacgaattaaaaggttgttacagttctcatccatcagactgtcttttggattgtgtaggcccaggacctaaacttgtgcctccggttgggtctgtggaccagacgcctacggttggtggaacaggctgcgcactctaacattttcttcctcttctgttgactatcccgggatggtgtgaagccttcctatcatttttcttctttttttcttcattctattccttgtctctcttgtccgagtactgctgccatggcatgggtgttgctgccatcattcgatgtacgatgttcgatttgtaaatttgtggatgattttgttgatgattatgttcatttgatctgtgatatgtcaatttgatgtggggatttaatttgatttaggaatgtcaggagcaacttgacgtgggatgcaagcagcaaataagaataaaaaaagaaaaaaaagtattgttaacaccaaccgaaattaaagataatagtaccaagtggttggtgctaccatctttaatcccggttagtgttatcaaccgaaactaaagatatttcaaccgagactaaggatacccagctttagtcctgaattggatgtctgggttgcatacccaaaactaaaggggttaccaatcagaactaaagatgggttccccactagtgaaaataggtatggtcagtgaaagcaaaaattcaacagtgacatgttacacaaaagagcacccaaatacactaaaaacacatatatttatgtaaaagcaatctggtataaatagaatggttccatgttatttaattaccttggatttatcctaaatatttggtgtattccagccaccaaaaagtgtgttaccgtacaacaannnnnnnnnnnnnnnnnnnnnnnnnnnnnnnnnnnnnnnnnnnnn

SEQ ID NO: 10887 - DNA, 1153 bp, Oryza sativa
  unsure (1)..(1153): unsure at all n locations
nnnnnnnnnnnnnnnnnnnnnnnnnnnnnnnnnnnnnnnatactcatgtgaaagcaatctggtataaatagaatggttccatgttatttaattaccttggatttatcctaaatatttggtgtattcctgccaccaaaaagtgtgttaccgtacaacaaagtgtgcatggtatgaatatgatgcatattgatgcctaatctaacaataaggaaatgtgaatcctccgtgtcactactacaaaacactagtaggtactagctcatttaaccgtttccacattggataaaaaatatataaaaccagcacatttaagcagctataggtgccgatatggcattaataatataggtgacactttttagaaaaccggtacctatatttatatgatatggcattaataatataggtgacactttttagaaaaccggtacctatatttatattataggtgccgattctttaaaagattgacaactttatgaaactaagctgagctgtcacgggtgagactccttttaaccccaccaaccttatcgtctctcgcactctcccatcgcccccatcccctcctctctcggcctgtcgctgccgcccatccactccagctcacttctgcgtgcatcgtcgccgccgtcccaatcctcacaaccttcaccactgcaccgcccatcatcctctcttcccacttcctccacctttcctgcagctgtggcaactcccatccactctcaccgcatccccctactaactccttaagcttaacatgcaaaaatgtcacatcattattcactaacaagataccacatcatcatccactaacaatcatcacatttaaacatcatgcaaacatgctatatctttatagtttttataatttaagagcttttcaaatacaaacatgttaaattatcatccaacataattcacataatgtttcaatgtgtatcttcatgcaaagatgccacatcatcatccactaattaacaagatgccacatcatcatccactaacaatcatcacatttaaacatcatgcaaacatgctatatctttatagttttttataatttaagagcttttcaaacacagacatgttaaattattatccaacataattcacataatgtttcaatgtatatcttcatactaaattc

SEQ ID NO: 10888 - DNA, 2256 bp, Oryza sativa
cccgtacctatatttatatgatatggcattaataatataggtgacactttttagaaaaccggtacctagtatttatattataggtgccgattctttaaaagattgacaactttatgaaactgagctgagctgtcacgggtgagactccttttaaccccaccaaccttatcgtctctcgcactctcccatcgcccccatcccctcctctctcggcctgttgctgccgcccatccactccagctcacttctgcgtgcatcgtcgccgccgtcccaatcctcacaaccttcaccactagcaccgcccatcatcctctcttcccacttcctccacctttcctgcagctgtggcaactcccatccactctcaccgcatccaatggatcggcggcgatgacctcagtgtggagatggtgacgacgcacgcatgcatggagatcacgctgctctcgccggtgggaggtgattgggggtggggtcaccggggatgacgcataggcgatcgtgataaacgggaagatggcaaatgtgacggtgctggtggtgaatgatgcggcagcgggaaggttgtgagttcttgatcttttttttattttatttaagatgagttttttatcctacttgtgtagtttttgatgttgtgtagttcttcatcttgctggtgttgctttgttactgatgggaaataataattgaatatttctatctgtgatgtgaatggagattattgatgctaaatcaatatagagttcttgatctgtacatattgtgtatggggattaaagcggcttaagaaggtagttggatgcatcggttcattgagccgatgcttctagtctgtctctgttttttttaattgtgggaagtacaaaaggtgttggttctaccaccagcaccaaataaccattggtcattggtactagtagataaagggtgccagttgcaaaacctgatttttttgtcaggtttgcaacccgacaccttttcggtactatgtattagtgtgtgccaatcagtcacaactacacaactatgattcatacttgagtcataagatatttgggcagaacacaataagttaaacaacgatatatttaaccagttctcagtagcaaccgcatgcaaatatatacacacacacatatacacatgcacacgcattattttacacccaaggatatacaagtccatgccaattggaggaaatcaacaaaagcacaaattaactagaaaaaaaaaaactagaacaaaacaatccaatgcacaccgattaagttcttgttttagtttagctctgaatgctaaataaatctgcaagcccctggagggataaagccaccctagcgttgtctcccttgttggcagtcgggtctccgaaaatcaccgatatgatgatgcgcacgacacccccgacaacaatgcggtcttgttccgacgaaatgctcttgagggggccctccttcatcatgagctccttgctcgccagcatgatctggcctccgtgtttcttctcgcggcccgcctgccatctcttcccggcgaggtgcttgacgcaggccacgtgcaggtacacgccctcgccgttgatgttggtgtggtagcaccacagctcacggtccggccctttctccttcttgcacaggctgcacttcctgggtgcccggacatcgaagtcgtggccgtcaagggtgatgggcccctgcaggctcgcgcagcacgggtggaggttcaggttggtgccggagcagtggtagacgaagccgcgcacggagcagtgatagacaaactttacaaacttcaattgtaccaaatttagactccttctaaattcgactccgcatcctatacgcacacaatatctccatcatatgccatatagaatcttcaccaaccacatgcattgatgtttagcctaagcacgccgtatgatatcctgatcattcggacgtcatcttctcccaagttgactcctgattcatcatcggcaacattctctcgaggcattaagatcacctacacatgcatcagccaagaaaccatattctgagcacaagctatctccaacttgactcattgttagtaaacaacagtattacatacgcatagtatccatctagaagtcataaacataaattatccgcggatatccaacaaaacaacccgaaaccaaaactgacacataaattatccgctgatatccaacaaaataacccgaaaccgaaactgacacagagtaagccgatcagaccgcgggctggg

SEQ ID NO: 10889 - DNA, 9346 bp, Oryza sativa
  unsure (1)..(9346): unsure at all n locations
tgcaaattcaatcatctccaaaaccacttcaataatcctcaaatattaaaaccaataatctcatatgtcaattgtccatcacacaataagaatcaaacaaactttgatttaatctcccccttgatgagcacattggccaactcatcaaaaatgttttagtgtttggaaaaataaaaacaaaagtggtaaaaagcatcggagtactcaaaaatccagaagaaaacttttttcgttttcctttacctgaaaaacatgcacttgtatctcttctccccttttgataatgatttcatcaagcatagtaattatgtttattaatattcaagagcttagcattatatatatatatatatatatatatatatatagcacatcatatcatgtgttgcaataaaaagaaaatgaacccatccaatatataacaagcatataccaaagtataatcatgaaccaaagattttacaattaagttcaaatcaccaatcaaaattcatgatttcatacaatttataatgcaacatgtttacaagcacataggttgaaaaataaaccctatacatatatacctattacatttatcactctttatcaaattatttaatcagtactcagtagcaaactgcatgccaatatatatacacacacgaattattttacaccgaaggaaataaaagtccttgccaattccaggaaataaacaaaagtacaaacaaaacaagccaatgcacaccgataggtcttttgttcttttcaaggagagtgatcacacaccagtttagctctgaatgctaaataaatctgccagcccctggagggataaagcgaccctagcgttgtctcccttgttggcagtcgggtctccaaatatcactgagatgatgatgcgcatgacgccaccaacaataatgcggtctttttccgatgaaatgctcttgaggggaccctccatcatgagctcctcgcttgccagcatgatctgccctccatatttcttttcacggcctgcctgccatctccttccggcgaagtgcttgatgcaagctacgtggagatacacaccctcgccattgatgttggagtgatagcaccacagatcgcgttctgggcccttttcctgcatgcaaaggcagcacttccttggtgccccgatgtcgaaggcaagcccgtcgaggatgatcggcccgtgcaggctggcgcagcacgggtggaggtcgaggttggcgccgaagcagtggtagatgaacccgcgcacgggatcgccgcaggcgtcacagaccctgcggcccgagggaggcagaggcttgggacaaaacctgaatatgcggcctttgtacatagggtgctgtagaatggccggcagaggttggagcagaacgtgtgcatgtcaaagttgcaggcgtcgcagcggtatctgggagcgtatcctggctccaagcagccgtcacagcggaacggcatgtcacaagtcgtggtcaccaggcgaagcttgtgctgcgggtggtcgtggtgggtgatcatctctggctctgnnnnnnnnnnnnnnnnnnnnnnnnnnnnnnnnnaaacatgtgtgatgcagttagcactatatgccagtgtatatattcgtaaccaaagcatatatatctcgtagttaattaatccagttaagtatttatcttacgttaatcctagcttgtttatctatttggattatgcggagcaagttgtttgcgtttaaatctaactctatcctaatttcatcactaatatattaatgccattacctcgtgagagataataattgatatttcacccatccgttttcatagccaaaacccattgtcaaagttggataccttctcttctctcccaaaagggatgaaaacttttaaagctaactctaccgtaatgtgatcctcatatattaatgccattacctcatgagacaccctttgagatataacatttcaacaatcagcttgcctatccaaaactctttgttaaagttgcgtaccttctcttttctccaaacaggggtgacttcagttctaccccctccatcaaaaagtcaagacatatttcactttctggttttctaaatgagatggacatatttgtagttttgatgcgctaaattaaattgttgactagaacccaagcagtcatcttaatactcattggttgcatgcatacatatagttccttggttttatcacatggtagatgagttattccccccttggtcttggtgaaaaaaaactgccttagacttttggatggaaggagtactacatatctgcctagcttatttcacatggccactcatcagcaggcttctcatataacttttggctttccaaaaggtcaattaatttatcgatttcaaaaagatgtgctgcacatgatttcaattggaaagcttacaattatctgtacacacgtaattcccaaaatttaggcgtgtatgactagcattaccttttaccccaaacaaagtttgcccaaagtaagggttggaatagataaaaatgacaatgaggtgtattaccttgacctggtgagaacaaaggctccgtcaccgtttgagacctattaagagcaacaattcaacttagatgtacaaataagacagattagtgcaccagttctcaagctgtgtatccgcatatggccaacacatcaattttttttttttactgtgaagcatccctttcttattatgcttaaaattttctagtatagaattttaaataaattttgcgggttcaattttcgttttattttactattcatttaaaatgtccatttcattcactctaacaatttgattgggtcacttaaacccctaaacaatttttagctcatgttacaactgaaactattaactatggttcattatactgcttaatactcttttttccagattcatagtactaagttgtgtctaatacagtactatgtcactatattttgagatggggggtacattttttatcttttttttattttttacaagtcttattttaagctaaaattttttaaagccatagatggcatcattatctaagttccataatattttcaatttttttcatgattgtttgcttgaacatttaaattttgatgtttaagttagttttaggtgcttccaaccttgtaaacaatgatgaaagttctaaagaaaatgctgaggtaagacgtaatgcatctatcagtcctatcaaattcaatgcaaaataccatttatatatataggtcgagagaatctacaaagtaccactgagttcaacacacttcaacaataagccaccgaatttgttgatatccataatatgccatcgcattatccttaacctctatgatttgccatcgtcgcgccgtttgtattgttaattttcttagttatgaccaaaataccctttgaatcatctaaccctagcatggcccagggccccttttttcccagcatcgcatctcccagcgccgcatcaccacccttcccagtgccgccacagcgccacgcctcgccaacgtcgccatccctagcgccgacccgaccttcgggacccagtgccaccatccgtagcacaagtcagcggtggtctagccaccatcgtcacatccgacgggagacggcgcccctgttggagggctgctggtggtgctgccatcgtcatcagcgttgccgtcgcaaacaaggggacacgacgtcgacgcccctgctggagctactgctggtgccgccgccgtcgtcagtgccggcattgcatgcaaggggacatggtggccctggccctgttggagagctactactgtcgtcagtgcaatccctcaaccgctcctcaacagtcacggcaaatcaaagctctaccccctcctgtagccttggagatatttgttcataatcaaaatacttaaaatatgtgctcataattatttataatcatgctgcttaaataaagatatttttcatatgtttagtaccgttgtatgttctctttatagttattataactctcggtaccttgcacggtatggtctcagtgctgctgatcttcactaagggcatacttgtcttttctccaacgcaaactaacaggctgtagatggcgatggtaaatcgtagaggttaaggaaaaggcgatggcatattattgatatcaacaaagtcagtggcatattgttgaagtgtatcgaactcagtggtactgagtagattctcttatcatctatagtgaaatgttttcaatagttttatgatgtaaaatgactgaaaaatagtttacggggttaaatcctccggctaaatagttcgagggagtaaaatgatttttttcttattaattgcaaacttgtacatatatagtttttagtgaagtggtatactcaagagaacgtgatgaggaacatcacctgaccaattcataaagtataggtgttacaagtagaattggattttctctactaagaacaagaagtcaaaatttgagttttgaatctatagtacatacttcatgaaaactcaagaataattatgatattgcatatgtcattatatcactagaaaatacttgtatgtccaatgagttgtgttctaagtgtcattgagtaatagatgagttgttttgagtagcatcctagttgtcaattaggatgtcatcaggttgtcatatagttgtatcgagttgtagatggctttgtagcctttaaatagaggcaatggcctctagtttggaacttacttttgcttaccaccttatcaatagaactagatgttcctattacagaacatggattagatcttctttggagctttggactaagctcttgttgtccgtggattcgggctgccttagggcattatctactacttcctccgtttcaaaatgtaagactttctagcattgaccacattcacatagatattaaatatgtctagattcattaacatctatatgaatgtgggcaatgctagaatgtcttacaatatgaaacggagggagtaccacattaaagtcgttcctacaacattttgtgctatatctacatatcagcacaccgaagaagttcctccgataattgtgctacatcaacgtataatttccatccctaaactcttaaactattcggttagtctagttgccatccctcatctttgaaaccaggtaaactatgtcctcaaactatcaaaaccgaacacctttaatccctcgagctggtttgaggttattttgagtccacatggcaactaaggtgatacaattgatgacaaggacttcgtatgaaaggatcaaattttgatttggatttcgtatgaaatctcaatatccaaccaagtggatttcttggatcgagtcttttgttttgggtggaaatgtatcaatagaagtgaatgatgacatcagacatttcctccaaacaaaaaagggccttcgacaaggtgatcctctttcgccaatgttttttaatattgtagctaatatgctggtcactctaatcaattgagccaaagtagatggacaaatttgtggagtagtccctcatctagtggatgatggcatttccattctacaatacgctgacgataccattcgttttatgaagcatgaccttgagaaggctcgtaacatgaagcttttgctttgtgcttttgagcatctctcaggtctcaagattaacttccataagagtgaattgttctattttggtgatgctcgaaccatggaagaccaatataccaaactctttggttgttcttctggcgaattcccgttatgctactttcctattcattataggaaactaagaaataatgattggaaatgggtagaagaacgctatgagaagagacttggtagctggaaagggaaactactttccacgggaagacgtttaacattgataaactcagtgcttagtagtcttcccctgtatatgatgtttttcttcgcaatatcgagaggtgtactcaagaaactttattgttttcgctctagattctattggcagtgtgatgatcaaaagaaaaagtgtcatttgatgaagtggagtattatgtgccgacccaaagaacaaaggggatttaggaattcatgatttatatatgaaaaacattgcccttcctagcaagtggttatttaagctactcacgatggatggtgtatggcaacaattgattcgtaacaagtacttgggctcaaaacctatgtcacaagtcgagtggaaagctagggactcatacttctaggccagccttatgaaggtcaagcgtgattttctacgttttggcaaattcattatgagagaagcaccactgtgagaacaatacccttgcctatacaataaacaggatactatagcaaatgtgctacaaaactaccctccgaatgtatcttggcgaagggatcttattgagccaaaattagtggcatggaataaccatgttccacgaatggcaaatctagcgcttactcaggaccgagataagttccactagaatttaatccagaatggagagttttcagttaagtcacattatcttgccttggtacattcagatgtgcccaacataaataaagtaatttggaaagtaaaaataccacttaaagtcatgatcttcctaaggtatttacgtcgtgggatagttttgacaagggctaacctggccaagcgcaattggcaaggaagtaagaattgttccttttgtcacacagatgagacaatattacatttgttttatgaatgcagatttgcccgttttgtgtggtgcactatacaagtggctacagggcttttcccgcctcgtggtgtatccaatatgtctggtaattggctacggggaattaggaaagaccttaagtcgcttatcctgttaagggtaaccactatttgttggtcattatggttttgcgggaatgatatgacatctcttctcctttataggttattttttaaactatccacttccttcgtacatgggctatccttcagaagcctgattcacaagatttggttgcagcggcatgtcaacgcttggagtaggtggtcagggagtgttttactcaaggacatggatggcggtttaggctgaagattggtgctccctagattttactactttccttcacttgttacaaactcttttgtgggtgtgtgtgtgttttggctatgtgcatcctagttatgcagaggccgggagttttttttagtatggttctatcagcttgatgtaatcgactgagattaataaaagcttcctttaccaaaaaaaatgatgacatggatgaaacagctaacagttacctctcttctctaactattcctttccctcactcccaaaattccccattgtgagctcaccagcagcgatgggcacacaatccaacatgcatgtgagagtagtactggtgtggcgactcctgcgccctgtcttcttccagcagctgctgaagtggcaccatggctgcctgccaatttgctagtatacaccatcggaatctgtcttcaactgtcccattggtgagactgctgcccacctttcccgctgctatgatcagttcagttcaattttgactcaatattttgtttgctttgcagctacactagatatctattttcatcttattcttcttctgggtctgacattcactttacaagtttgcatcacctttctatgcacgttagcaaaatactggaattctcactgaaagcagtacgtgctggcatacatggccaataaggatgatgaggccaccaagtagatattcagccgattcctgctcagttgtctttcatgttaatcgtggctgctccttcataaaaagaaaaagctctggtgcaggcaccaggatggattgcacgtaggtgtatgctgtggttggccactttgctgacaccagcggagaggctacagacctgcaactgaactcatcattttccaggacctcatgccggctctgacgaatagtggctatgactcatgaacctttttaccaacacccaaatatgaaagggaagggagaaaagatgataagggccctaatgtggggctagctctatgatgtggaggacggctgggcgcgcaaagtcgatgacatgtcacacccaaaaccagccaagggacataacttgtctagtttgcatagttgagggaatagttttacctggtttataaattgagcgacgaaaactagaccaacaagataattgagagacaataactaggctttttcctacacgaaataatagtttcaatctaattatatgctagactcaaacttgtttatacatactaggtattatgatctttctttattctgctttcaaaatgcacatgtcaaattgtcaactgtatgataagagaactgcaaaggccacaatcaacataacagaacaactaagcaaacccacattgagtttgtcttggcgatctttactctaaagccagataaagttatccaaacagacgtcagaataaatattcttgagcagatgggtggtccaagtcagattggagtggtgatccgaggcagtttgttatgtaatctgatggataagttgggtagctgggtaatcgtaggtcgaccaattttagagttatatacaaacactagaaccccatcaaggtacaaaatggctgttacaggcaaaactatggtattgtagtttgagtagaatagtaattcttagcatgtggattcttgttattggagtataactatatggccaaccgatgtaaccctcaggcctcaatatatcatcaaataaattcttaagaggccggagtcaccttacttggctccgagggacatagacataacaaatatcgaatctcatcaacaatggcctgctctcttgcattatcgacttttaagtatttctaaggccctgtttgcttcagcttaagattattgtaatctagattattaaattagattattctaacctagattataataagctaacatagaataagctgcgagttgtttgtttctctgaattattagagacatctaagggtagtgggtctttagccactcaataatctagaaaaagctcctctactcctctagaggagattattggattatactaatctggcttatagattataacaatctagcataataatctacttgtttgtttcagcttactcctaataatccagattataataatcctaagctgaatcaaacagggcctaagtcaattccagggatctatgtgttctgaatttcttgtcagctggtgtcacccaaattacaacaatcccatctaaaaaagaaaaatgtttatgagtcaatagatgaacgcatgtttggctgagttcaaatttttggtgagggtgaaatttttgtttagatta

SEQ ID NO: 10890 - DNA, 2004 bp, Oryza sativa
  unsure (1)..(2004): unsure at all n locations
nnnnnnnnnnnnnnnnnnnnnnnnnnnnnnnnnnnnnnnnnnnnnnnnnnnnnnnnnnngtaataatagtcgtatactaactggacgaagtagaacaaaaatttggatggttttttgtgatcgctagttatgaactgatacctgctgacaactaattggtcggatgtatcttcgcctaaaacctctgttggcgtccactgtgattcacccattaggatctcatacagtttagttagggtttcatgtgattttgatgccaagtcttttaaacacgccatatgcacgttaatgtcctggccttcctgactggagcggtaggaccaaaacttgttgcgataaccctccttgccacacatgcaaatgcaacatctgctgcaagccgacaccctgcgaagctccatgacatagccctttacgtttgcagtgcgaacaggcagcctcgcacagcgtgggtggaggtcgaggccacgctcaaagcagtggtagacgaagccgtgcatgaggtcaccacatgcatcacaggccctaccgcattcagaggccagaggctttcggaggaaccgaaaaacggagcctgggaacagagggtgtttcagggtgtgaggcgctgttgcgcagcacatatcatagtacaccttggagttgcattgctcgcacttgaacctgtggccggcaccaagctccttgcagccatcgcactgggtaggccaggacctgacactcttatccagcctcagattttcatgcatatgatccgtgtgaggggtggggacaatcggaagatctgtgccaaagcccgaagaattagcacaccagatgaccatataaagatctaatacagtatcttttctttataatggctaattgaaggttttttcttaaaatcccatataaacagttaacactaagaggtgaaaggtttctcatattaataggtcacaaaatatctaacaaaagctcccacttagtctgaaaatgaaggtgtcttaatgttcaagtttttcgatgcttgtgacctaaagctcagatttgcatatggtatgttcgcttttctcccattcttgcctttactaaataaatgctactccctttgtttcaggttataagacattttgactttggacaaagtcaaactgtttcaagtttgactaagtttgtagaaaaaaataacaacattttcaacccaagacaaatttattataaaaatatattcaattattgatttaatgaaactaatttggtattataaatattactatatttctgtataaacttagtcaaacttgaactagtttgactttgaccaaagtcaaaccatcttataacctggaacggagggagtaccagaataaaatattattttctccatcattcagaatatattgaacattatgtgtcatccaatgtgctaccaatgaagggcaaccaaaccgtttcacctatactcttaatcctcgagcttgtctaaaatgattagtatttagaatcaggtagaagaataactaggcaatcaaatctgtaagtataggataattctagaactgaatatccataaggccataaccatgatgggcaagcacgatattagaacatcatatcccacagccagaaggtgataaagtataagcttggaaggaattagtttctaagctcatgaatattaaactgacacatgaaatcgacacttttagatgaacttacatcagaaaaaggaattttctgttcattcaaatatcaagccttattttctggtgcttacaacgtgggtttgtatatagcacaggattagctttgctaagagaaattaacgacacagctagaaatgttttttaatgacaatgagactattcaacatttgttttttcattgccatacagcacactgtgtggcgtgaggtacatgcagcttttaatttggatccagccactagtattgtccaatttattcgnnnnnnnnnnnnnnnnnnnnnnnnnnnnnnnnnnnnnnnnnnnnnnnnnnnnnnnn

SEQ ID NO: 10891 - DNA, 6724 bp, Oryza sativa
  unsure (1)..(6724): unsure at all n locations
nnnnnnnnnnnnnnnnnnnnnnnnnnnnnnnnnnnnnnnnnnnnnnnnnnnnnnnnnnnnnnnnttttttttttttagttaactagcctgtcgaatacttcttttatcattttaatgaactttcacacacgcttgtaataatgtggctgtgtacaccttctggttgctgcttccattatctttgcaacagtaccatctctacaatgtcactgatctgatcattgggcctcttttatataataaaatcagtatgatgtgtacaaaagaattacgtagtaggatatgggatatccactgctgttgatcgacctaactaaagacattatactacagcaggtagtaggatgttttgattggtaaaacaaaaatgaaatggatgattgcaggtcaaatttgcatgtccaaatggcatactaaaatagatatgtggttcaaatgattaccctagttaaattctcaaataaaatattttgaatagcgaaaaaatcgaccatgtgcatctcgtccaaattccaatgttaaggcaaggagtgtatcttgcgcaaataaacacagaaaagagggcatgtttattgttacagtagggtatgtaaattcgtaccttttataaccctgttgatgaaccgtatgattacacttgatattcttgtattttgcctgatggcattgttcagtacagaggctatagccattctgttagcttcactagtaccggcaatgcaaatttttgcgctgaccttgacacctgacaagtgcttgaagcccacattttcaaggttgtattgctccactgtgctaccattgaattccatctttaacctttggaggttgggcatagctccttcatcaaatctcagacttgatacagtactacacttgaatttgaagtacttcaaaacatggaatcctgacttgtcaaatatgataggttctgcaggggttgtccggacatacagtgagaaaacagtgagggcattcagcattgagagagtctcaatgtctttcctcaggagttccatgactgctactttcaaaatacagagtttctcaatagttatgatccaactgggaagtctatggaagacgcaaacacgtggaaacaactcaagcctctgcagaaggctacaaggggggggaactttatctaagaaatccaagaaaatggcaatgcttgaattttcgttatcattagaatcttcagagaagcagacaggaacaactgttagagatttgaggctcttaagtatcccaataattgaacccaacagtttcatgttgtgcttaatatggtcagaagtggctatctgaggacatgcgagttgaagatcctgcaaattggtcagttcttcaatactctgtacactccctgcgtcaacaaagtaccctagattgggtggaagtctgaagtgcagcaacggcggaagatgaacaacttctgatctcaaaaaggtcaccattgcaccaatatgcagagtcctgagatacttcagtccttggagctctgatggtaagtctatgcaaacattaccttcaatctgcaaataagtcagtagaaacagttcacgaattctagtgaggtcaagaaattcgccatgtttaccatgaaggaatagaactcgaagaagatgaaactccgaaatggaaggcccgcacttccaaaatccagaaaacacaagtgatcgtagttgtgacaatctaatacatgctggtgcctttgcatcttttgaatatccgaaatggagagagagtcgtcgaactttgtctgctagtcttataccagactgagaatgatcaattgcagtgacaaaattctcttccattgccttgcgtttgataaagttaagaaccatgtcatgcactgtgcaagatacaacctcatcactacagctgatatgttcagtttcaagtattcccctatggacaagctcataaaaatgattccttgcagcttcatccaaacttttcccttccgtcgcacttacaaaatcttcagctacccattgcttaaccagatcgtccggattgattatgtgatcctctttatatatactcagatacagcatgcatgctttcaaatgatgaggaagattgttgaagctattgttcagtagttgtgccattccttcggaagtaggttgtatcctcaaatctggaatcaacgacttctgtacatagatccattcatctggtttgtctggccgactcaataaaagactggctgcagcgatagttgctagtggcaaaccgccacattttcgtgctatctcatatgaaacttcattgagttcttcaggacatttgtctttatcaccaaaaactctactaacaagtaaatctcttgagaaatcgtcattaagcggttccatcttcaaaatatgcttcttgatcacgtgagatgcattatgttgagacttgtaaaaactccatgcctgagccacatcgttaatttctgttgttactactattctactacagcaatcctcttgtaaagcatgtctaacaacattccatgttgatacagtccacacattatcaagtacaatgaggcacctgccaagtagcgcatggtgtttatgttatatgaattcaactagaagatattgacaggttctccctgagtagaaatatgattgtaacatatagagaagaaacgccgttggtgtagaaataaataattgtacttcaaactctcaatttttttcatctatcccattaggctcaattgcaaaggggcatttaactatttgccacttttagaaatgcaaatttctaccgtttcttcgctgaatttcggaaaattttacctttgattacaggaagccaaggcttgaccttgccgccgccaagggcccgacctcgacgtgctcctccagtaaccgccaccgggcgtgctcgttctcgtcgcactttcccagccacagcccgaccccgacgtcgcaggactcgatctcaccgccctccccacgccgccgccgccggggggtccaagctcgcgacgctacccagccgctgccgtccgtcccgccgagacgaagcccgcagccccgcaccaccggccgctgctgcctccgcgtgttgtgaagtgacagggagagagcaacatgattcgcggccgcgggcggggagatgtcggcggggaacacgccggttggggccccccactccccccatgcggccggctcggcttcttcgccaccggacttttccgggcggcggatggctcctcggatgacttcacttggcggaaggcctcgtcgcctcctccccctttggcgttagggatgcctaccgaggcctcctcctcctcaggctctttcccctcttctctcccttcctcctctctctaccaccgaacctagctgctccggccgccggcgacgatgactgcggcggtgtcgtaccagtcggcggggaggggaggggagggacgccttcgcggcgtatggtccgacaccacacggctcgggttggccccggaagattgttcctgtccatcgaaacacgccggtcgacgggtgcataccgctgtcagcccgtgcgggaggcggcggggttgaggcttatttgaggcggaacgactgccaagccggaagggagcatggtgcacagtggaatcggtggtgcgtgaccccccgcaataactacggaaagaaacgaaatttcttccattccgtcgctttgggggaaggtaagccaaatcacgcgcctccctcgcccaagatgcacgcccctctaggcctcactcacgtgtcccctgctcccaatcatttgtccacacacaactccatgcaacaaatcacccatatattttagaaactatctgttaagaaaattcgttttatttttttttcgaaaaaaaaaagtttcacctagtttactcacaatgtttcactatgtatagatctaatgttgcaatgaactgaaacattattttgtaacagatcaccaacatattttcaaaaccctctattatgagaattcgtttcacttttttgttccaccaaaaataatccagtgtacttataatgttttactatgtatagatctaacattgcagtgaactgaaatattctttcgctatttgctgaaacattgtttttatataaggtgaaacaacgcccgatttaaacgattgaacattttcgatctacttagtgaaataattccgatatacttggtgtaacatcgtgcaacatttaaaatataattcaataataagctaaaaaatttcgtcggaatatatccatgtgtggtcttgttttgaagatttaattgcaacaaatttaatagtataatcagatcataatttcgataaataatttaagataaaaaatagtttaaaatggtttttcacacatgcgtggcgctaacatcatgctgacgtcagcccccgatttttggacgcctggatcgggcgcccgattctaagtctcctccgacaaaaaaagagagagaaaaagcacaagcaataagcatgttggtctagaaaaaactaagggacaattgctcatttgaccttgttttaaagccaaactactaatctgatactacattttttagtttgctaatttgaccccgctttttaaaatcgagcatgccgtttgaccctatttacactatgccattagggtttcaaaaaagaaaagaaaaagaatcattttactattcaaagtgaccaaaataccctcatacatttcacttcaagtcttcaaccaatctctcattcacatctcggcggcagcggcacgaggaaggaggaggcgacggcgctggcgccgacgtggggagcgagcaggaggcagcggcggtgcaaggaggaggcgcggtgacggcgacggcgccggcgtgcggagggaggcgatgggcagatcagacggcagcgcaaggaggaggcgcggtgacggcgacggcgccggcgtgcggagggaggcgatgggcagatcagacggcgacggcgacggtgcacggagggagcgacgacaatgaggacacatggagggagtgatggcggcgagatgtggagggagcggcggctgtggctggatgcgccggtgccagcgcttgtttgatttttgtgatcttgtttgaatgttattgttggatgatgttcttagcagggatttgtttgcatgttgatatggatttgaatcgatgctggcatgttgttccggaaccatttgttgtggtgatctaatttgcgttctcaattgtttttttttggctaaaattcaaatctaattcaaattcgcacaagacatatcaattccaagtgaaatttattagaaattgcatcatgtacaccaaagcgtataaaaaaattagggtcaaatgagtaaggatataaaggtatttcgacctcaaattaacactgtcaagttggtttcacgaaatggggtcatgtctgatgtcgatagttaaaaagcagggtcaaaaaagtaggttaaaaaaaagcaaagttaaaaaaataaggtcaaattggttggtagtttgctttcaaaatagggtcaaatatacgattgccccaaaaactaaatactcttgacaatgtatgtttggctatgtacttgtagagaccgagtttttaatacatcttctaaaaaaaatattagtcagataaaattctccacaacattttttttttttggaaacacaagaggaggttatgatctagctgtttgtgttgaaggttatgatctcattacccatcttactaaatgcactttccaatctttaactaatttctgaaaattttctacttgtccacattaaatcttctgcaaatttgatcactgccgttgcaaagaatgttgggttggaaaataccactacaagaagatcagctacaaaataccatcacagggaaatttgagttggaaaatgccggtaccattactgtttcatccaaaactgcaattaatacctttttaggagagagagttttgaaaattccaacactacccttttttttccactcagttgtaatactcaacattccaagtcgcgtttggatgcatttaacaaatctcgcatttaatttatggtggaaatgtttagaaaatcagctaatgcaaaaattaagaaagagtaaattttacaaaattaatgtactttgatcaatatatcacaatactatatatttaagaaagtgtattacaaattaaactacagatttaaaaccatatttttttacaaaactatagattgaaagtatcattagaaaactacaattttataaatgagcatatataacatcagtttaacatcagatttaaatatatatatagtataacatcagttttatcagaaagctacaacttttgtaacatcaacagtgctatagatataaactctaaaatttgtagttatttgataatttcatttctaaatgcatagttttgtgatacaatgctttaaatatgtagttatgtgataaatttcatgttaaatctgtagttttatgatacacattttaaatttatagttttgtgatagtttaaccaaaatatctgtagttttataaaatttagtctttaagaaataagcaataaaaacattttaaggaaatagtacagttcataatttttaaataaatatattatttttttactgcatccctatcaacaataattgatgttcttgaatacatcaagtcaatgtgttttgtgtttaaacttttactatcaatttctattaaaatatttcgatttaattttaaaaattgata

SEQ ID NO: 10892 - DNA, 8304 bp, Oryza sativa
  unsure (1)..(8304): unsure at all n locations
nnnnnnnnnnnnnnnnnnnnnnnnnnnnnnnnnnnnnnnnnnnnnnnnnnnnnnnnnnnnnnnnaattgatgttcttgaatacatcaagtcaatgtgttttgtgtttaaacttttactatcaatttctattaaaatatttcgatttaattttaaaaattgatataggtatatttgtctttgaaaacaaaaaggagtttcaaaatattagaacgtccttgctatatttttataggttttatactagcaatcaatattgatcatttcggtaatcttgttgctttctaaaatgtcacttatttgttaccgaagggagtacgtataaggcaagcagtctgtataaaatattatgaaattgagagccataagtatagcaagcacaggaaacaaagaagaaaaaaaagcagggggcaaattagtcattttcttccctgggtggaaatgatcacggtaatggtatttttcaactcaaattctctttgtgatggactgatggtatatattcatcagcttaggttctatgtatatgtgatagtattttgcaacttgagtttttcctctaattctgttaattaattcttttactccaaattttcccatgataacacgtgggccgggtaaggtagcaagtagatactccagtaattattgtgctagcttgttagtctcaacattgatttttcatacacgtacaggtgctaattaggaagcatatataaggactatagcagtgtttagatcccttcaaacttctaaaaattctgtcacatcaaatatttagacacatgcataaagcattaaatgtagataaaaaaaatcaattgcacagtttgcatgtaaattgcgagacaaatcttttgaccctaattacgccatgatttgataatgtgatgctacagtaaacatttactaatgatggattaattaggcttaacaattaaatttgtttcacagtttaccgacagaatctgtaatttgttttgttattagtatacgtttaatgcacgggactctaattatgggtgttcctctgtaatcaacatagctagcaccccttgctgctatgagtccatggtctcgccgccattctctttctgcgtgcctatgttacattattgacatgattgttacattggtggtcactgcaggagaaacaatctttaatactagttaaaaccccctttcgtaccggctgtagcaaccgagaccagtaaatcgagactatctttagtaccggtagaaagaacgagtacaaaagatgcatactaagtcaaaaaaaaaaagtgtgggatgtgagattcgaactcaagatctatcaactcagtcctcacacacgttaccattccacctactactatacacatctgacttgaatgtagatgctttctttttgaactgatcccagagacatcgttagtaccggttggtattaccaaccgaccggtactaaaaatatctttagtatgagttggtattaccaactggtgctaaaattgcatcgttattaccggttggtaacaccaaccgagactaatgctactatagcattagtctcggttggtgttaccaatcagtactaaagatatatttttaatatagggtggtaacaccaaccggaattaaacatagttttaggaacttcaacttttagaaccggtactaaagcatatttagtaccggttcttgatctagtcaggatatttgtgttttggggtttaggataaaaaatcgtttctctagtagtgggtgcccccatttttatttaaagggttaccgggttatggagtctgatgctaaccccaccctctagctaccatatattacaactttaagtttaactacaacctattaggacaagtatattcggcacctattttaacatgctccacctcactgaatgtaacgccacccacaagtagtagaattatcatgtggattcaccaatccactagacttggggttttcttcttgcagattcctcgtgagatggttgatgagcctatgccagaatcaccgctaccaaaagcaatagctatcccaattactgtttccttctggtctacacctgtaatagtacaccctcacaacttgtaaaggtacgacaacaccttctcttcaattatcacaatcctactatccccgtgaaagggtcaataacctagtggttacaagagtctcagtagcacataaggttctgggtttgactctccatgggagcaaattttccatgatttaacggcttgtgctttcagtggtaggcgacgtacccgtcgacagcgaggcgcctgtggtgacttcgtcaatctcaaggatttgcctgcgcagtcttcgaagatgctcataggggtagagtttacgtgcctccattgtgagtgtctgcgttgtactgtgtaatttttttaaaaaaatcctactgtccctcatggtctccgtggatccgaaaggtacggcatctaaaaatatctcagctataatcatacataagagattcggtttgacatggtattaaatacaagagattctgcgtgacatgggttagatatgtgtgattctgtgggacatggattatgtatcagagattcggtttgccaagcaaccaactatgtactgacccggtctaaggttctccactatttatacccttctggtcgatcgtctttctagcaccattcattcactaaaaaacactttcaacccccacttcaccacttcagaatctcagataccgagcaaaaaagatctagatcaagttagtaccaaaatttagtgttgtatcgatcgatgattgaggcagcagagaccatggagaaagcggtgataactgccttcgtgaacactgtcatgccgccgctgtttaaggtgctgtcaggcagttgtaagatggtcatgaacgtgatcgatgatagcgactcaatgagacgtaaactagttctgctcgcagcttccatggacgacgacctccggcggacgaagaaccccacggccgccgccaaggtgttcggcgaccagctgcgcgagctgacgcacgacatggaggactgcattgagcgcttcctccaccgcgtgtcctgcgccgagggagcgtcgcgggcgcgccggctggggcgcttcctgctcaccatctgcacacgctaccggttcggggacaagatcaaggcgcttaacaggcgcctcgaggagctgaccaatgaacgcctgtgccagttcgtctacgacaagcccccgccgccgccgccactggcgccggcggcggcacaacaacgcgaacatgttcaactcaaccccgtgggcgtcgagggagccaagggggacatcctcgcgatgctggaggaaagtccggaggagctgagggttatcgccatcgtgggttttggcggctccggcaagacgaccctcgctaaggcagtgttccgctcaactgatgatgatagaatccgggtgtttcgttcctgccgtgcatgggttgatcgagccaaggagaaaaatgcgggggagattttcagatcattactccagcaatttggctatcggggtcagggattattggtcgatgacgagcaatatctccaagcccagctcatggactacctcaggggtagaaggtgagagaatttctgtagctgtttcccagttgcacgcattacccatccacacctttacggtcattcagaatgtattggaactttacgtactacattgagtactttattgaggatcgtaaaaccactcattcgctgaaccttgcgcccggccgttggttagagcaagtttaataatatagtcaactactagctctaattcatctatagccaatctaatagctcattcatataatagttacatactacactatcaataactggtcccacctatcataaacacattgcgtcttggagtccgtaatacagctggctacaaatttgtagcccactgctcttctctctcctcgtttatctccttaaaatatatttgcagttggcttatagcctgctattgtacctgctcttacccgaaatttgtcagaaatttgtcagatacttgattgttattgatgacattgggaatgggcaatggaattctataaaatcagctttcgaagaaaatagtagaaacaacggaagcaggataatagttaccacaaccattaagtcggaagcgaatacctgctgtggcaatggcaaaggtttcatataccaaatgcaaaatcttgaagatcaatactgcaagacaatagctcttggggaggcaccttcacctgagttgcagatgggctcggaagaactacttaagaaatgtgatggccatccactttcccttgtttgtgtggccaattatttgggaggtttaaatgagcctactgggcagcgctgtcgcgaattgtgtcgctacctaggttcaaaaatacatgacaatggtaactttgaaagactcaaaggcgtgatcatggataattacacaagtctttcaaaccacgttgtcagggcctgcttgctatatttgagcatatttccaaacgatgttccgctcgagaagaaagtgataatcaggcgttggatagctgaaggattcgcaaggagcgaagatgtggacattgatgaccagactattgcacgttggaattttgagacgtttgtagactgggacatctttcatcctatcattgacacaagcaataatggcgatgtcaagatgtgcaagactcgcagtatcgtgcacgagtatatgttgtacaaggcgtcgagacttgagaggttcatcatgtcctttcctgactggcgaaggaaagttcgtcatctctgtatcgatcataggacacctcacaagcgcagaactacaacagatatggatttgtcatgcgtccggtctttgacgatcttcgggacggcaggtgacaccatttgcgagtttcacaggtacaaggttttgagagtcctggatctcgaagaatgcaatgatgtcaagaacaagcacctgaaaaatatacacaagttatggaatctgtgtgaaaccatgtgtggttatagttcttttgtgatgggaaattgacaagtaccggaagtgcaagaagtgtgtgcgtggactaacattggtcaggttgcgacatctgtgccaagacaacggttgtttggttcatgtgggtgcaggtgatcggagtcgatcttggtcaacggcggatcgggactagactcagggaggagttgaggtccaaagtgatcaaggatgccaggtgacaagattggacacaaggttgcacacagtggacgaacaccgtgtgaggaggtctttgcaacgggcttcagaaggtcaagtgtgcaagcatcggattcgcgaagaaatcagaagggactgtgcaagtgcattgctgctacagtaaatggacttactgtaggtagcatacttgcatgtacacgtaatgtacttgtgcaaggaggagcttgcagaagctgtgcatgtgtgctgtgattggttggcagggaggccaagccaatccagccgttccacgtggcccaaggagatcattgggtcggttggcatcaagtccaatccggcctgtccagctcgggagctcggtcggcccaagcacgttgctgactcaagatggtgaaggccaggccgagcagaccctagacatgacgacggcccagctcggctcggcaaatgcacaggcgtgtgcatgcgcgcgcggaggcgggagatcgtacggcacctggaggcgtggcggccttctgttcgtcaaggaagcggagactcgtgggaccgggtcccccgcggtttttcacatggcgcgcgcgggaacgtggttttcgcgagcgcgcgcagaagcggctcggcgggaggaacggcgacatggcggcttctgacttgtggcgcgcaggtgcgagaggagcgggcgcgggctctctgggacgcgtggcgcggatgcattggcttggaggagcacgacgcggatcggtgtacactgattggcttggagtggaatcacgcggatcgcacgagggcacgcgacgtgaagagctcggatcaacaacgtggcgactatccaggaggtttccttcggatctaaggaacaatggacatccaggattttatcaaggctagggtttcgccccacgggtatttgagacaatgtcttaggggtcttaggctataaatagagggatggatgcaagggtggaggttgctccttttgtaatccttttgagatgctcggtgagagagtttccgtgtgagtttggagtgtgtttgcccgagaggcttttgtattaagattagtttggagtgtgtttgtccgagagattttaagtttgtgttattgttcctctgaaggtgtttgtttgctcctagttgagcggttattttgcatcacctatgaatgaaatgatttgaaggatttcgtttttgccttgtccatttaaattccgcaatttaaattccgcttgaaatttgaactttgcgatgatgagttttgctctctcctcctaacctctcttctagttttcgggaattccttttctcttcctcttctagtttcgggaattccttctctcttctttttctctcttcttttctagatccggcttctctaatagccgcggttctagtaaggattttgagaaatccggcttgatgagtattttcgggggaaagatttgaattgctatattcaccccccctctatagccgttcttggtctttcaattagtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatcaccttacactatgcccgatgatgctgacatcacgcctgcaaatgtggctcaagttgattttaattatcgtgcaagaaatgcaatcattggtggaatttcttctggtgaatttaatcgtgttcaacaccaccagtccgctcatgacatgtggactgctctgtgcaatttccatgagggaaacaatgatattcaattggttcgtcagaatcaatttcataaagaatatcaaagatttgagatgcacccaggagagtccattgattcttatttcaagcgttttgaagaaattgtttcgaagttgagatctgttgaaaaagaattttctgataatgataatgctcgccatcttttgaattgtcttgattatggtgtttgggaaatgaaagttacttccatcacagagagtgcacctttgagtgaccttaccatggacaagctttactcaaagctaaaaacccatgagatggatgtcttccatcggaaaggcctcaaacactcgatggctttggtagctgatccctctggtagtacttcttctaatgacttagcttttgtgtgtggtggcttctctcttgccgctttacactcagtcactgaggagcaattagagaagatccctgaagatgatcttgctctttttactagaaaattctcaagagcttacaaaaatgtgagagatagaaaaggaggaaaaaccaatgaaccatttgtgtgttttgagtgtggagagcctaaccacataagagtgaattgtcccaagttgaagaagaagagtgacaagacaaccaagaagctcgagggacaagggcgaaaggggaagaaggatttgataaagaaggcgatccacaaggtcttggcggctcttgaggaggtgcagcttagcgacatcgactccgacgacgatgatcaagaaaagggggacaaggacttctccgggatgtactgtctcgccaacaacgaggacttcatcaacctgtgtctcatggcacttgaggataaggatgactcatcggagcatcatgaggtatgtcttgatgatatcccttccttggatggttctctttgtgatgattcttgctcagataatgactctgttgatgatgaactaagcaaagaaagaatgacacacttgatgattgaaattagtgacaagtataggtcttctaagtataaaattgagaaactaaaatatgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttatagtgctagtgctgcttgctctacttgctatgannnnnnnnnnnnnnnnnnnnnnnnnnnnnnnnnnnnnnnnnnnnnnnnnnnnng

SEQ ID NO: 10893 - DNA, 703 bp, Oryza sativa
  unsure (1)..(703): unsure at all n locations
ggcgaaagggaagaaaggatttaataaagaaggcgatccacaaggtcttgcgggctcttgagaaggtgcagcttagcgacatcgactccgccgacgatgatcaagaaagggggacaagaacttctccgggatgtactgtctcgccaacaacgaggacttcatcaacctgtgtctcatggcacttgaggataaggatgactcatcggagcatcatgaggtatgtcttgatgatatcccttccttggatggttctctttgtgatgattcttgctcagataatgactctgttgatgatgaactaagcaaagaaagaatgacacacttgatgattgaaattagtgacaagtataggtcttctaagtataaaattgagaaactaaaatatgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttctagtgctagtgctgcttgctctacttgctatgaaatgaaagttgatatgagtttgcttgagatggaattgaaagaactaaaagaaaattttgttcatgataggataagtagttgtgaaaattgtnnnnnnnnnnnnnnnnnnnnnnnnnnnnnnnnnnnnnnnnnnnnn

SEQ ID NO: 10894 - DNA, 697 bp, Oryza sativa
  unsure (1)..(697): unsure at all n locations
nnnnnnnnnnnnnnnnnnnnnnnnnnnnnnnnnnnnnnaaacaactccccctcaaatcaagccataggggtggatcacccctaactcactccgcaagaactcaaaacgagagcgatcaagtggttttgtaaaaatgtctgccaattgtttttcagattcaacaaactctagcacaatggtacctttctcaacattgtctcggagaaagtggtaccgtatctcaatgtgcttggtcctggagtgttgaactggattttttgcaatattgattgcacttatattatcacaaagcaaaggaacaccagagaaagacagaccataatcttttagagttgaaatcatccaaagaacttgactacatgtactagcagcagctacgtactcagcctcagctgttgattgagcaatagaagactgcttacgagaggaccaagagaccaaagaagtgccaagaaaatgacaagtgccagaagtacttttgcgatcaatcttacacccagcaaaattagcatctgaaaaagctcgaactgaaagggcagaagagcaggagtaccaaataccgtacttaagtgtagacttgatgtagcggaagatgcgcttgactgcttggcgatgtgatgttcttggagaagcctgaaaccttgcgcacaggcacacggagaagtggatgtccggccttgacgcagtcaagtagagg

SEQ ID NO: 10895 - DNA, 408 bp, Oryza sativa
agaacgcgaacgagcgaacgaacgtgaacgagaattgaacgtgaaagaacaaacgaacgtgaacgagaacgtgaacgaaacatgaacgggaacgaacgtgaacgtgaaatgcaatataggtaggtgaatgaacgtgaacgaacgaacgtacgtgaacgaacgtaggtgaatgaaacgtgaccttaacgagaacgcgaacgtgaacgatcgtgaacgaaacgtgaacgtcaaatgcaatatatgttacttcgcgtttatcctaatacatctttttgtatcatgcagaaaagacgttgtcgaagtcgtccctcaagccggagtggtagctagccctcgaaggaattcgcacaggcaagtgacgtaattatatatatgattgttatatttgtaatgcaattaagactattg

SEQ ID NO: 10896 - DNA, 377 bp, Oryza sativa
cggtacccggagcgcttctgtactcgtgtattctgatgtcatagctcaccggggagcatagcctcagagccgtacacgaggaagaagggtgtttccttgttagacgttgtcggtgtggtgcgtacgacccatagtactgatgggagttcttcaacccattttttgtcgtgtgacatgagtctgtcgtagacgcgggtttttattccttgtagtactatgccgtttgccctctcaacttgttcgttgctttgagggtgagagaccgaggcgaagcatattttgacccccagcccgatgcagtagtcgtagaaatcggcgcagatgaactgggagccgttgtcggttatgatgcggtgcggtagtccgtatctgcaaaa

SEQ ID NO: 10897 - DNA, 481 bp, Oryza sativa
  unsure (1)..(481): unsure at all n locations
nnnnnnnnnnnnnnnnnnnnnnnnnnnnnnnnnnnnnnnnnnnnnnnnnnnnnnatacagcttacaacgccattatcgggagaactgcacttgcgaagttcatggccgcatctcactacgcgtatcaagtgctcaagatgtcgggactgaagggaacaatcactattcaagggaacgcaaagctggcggtgcagtgcgacaagcggagcctcgacatggtcgagcaaacgcccagcccacccgccacgactgagccacccaagaaagtgagcaagacaaacaagacgccgaaaccggacggcaccatcaagatcgttccactcttcagtgccaaccccgacaagaccgtcaagattggggcgacacttaacgagaaataggaactcgcgctcatcaccttccttcgtgataatgctgacgtgttcgcttggcagccgtccgacatgccgggggtccctagggaggtgattgagcataaact

SEQ ID NO: 10898 - DNA, 579 bp, Oryza sativa
aatgagaatgaaacatcaggctgatttaaagagatcggagcgctccttctctgttggcgattgggtctatatgaagcttcaaccgtttgtgcaacagtcggtcatcactcgcactaatcgcaaactttcttttcgtttttatgggccctttcaggttttggccaaggtgggaactgtggcttaccgtctggcactgccagattccagtttaattcatccggtggttcacgtctcccaactcaagaaggctttggctcccgtagaacgggtacagtctcatttacccgttttgcctgctgatgaagctgcagacatttcgccttgtcaggtgttgaatcacaggcttgttcgcaaaggagctaaactggtgaaacaagttcaggtctgttggtcccgccaagatcccgccgccgtcacctgggagaatcttcaggaactacgtcaacgctttccacaggccgaagcttggggacaagcttcatttcaagggggggagaatgtcatgacgactacttcatctgatccacccaaaggcacggatgatcaaggcgacgaaccaatctcacacaatgggtagag

SEQ ID NO: 10899 - DNA, 648 bp, Oryza sativa
atggtgacctttttgagatcagaagttgttcatcttccgccgttgctgcacttcagactttcacccaatctagggtactttgttgacgcagggagtgtacagagtattgaagaactgaccaatttgcaggatcttcaactcgcatgtcctcagatagccacttctgaccatattaagcacaacatgaaactgttgggttcaattattgggatacttaagagcctcaaatctctaacagttgttcctgtctgcttctctgaagattctaatgataacgaaaattcaagcattgccattttcttggatttcttagataaagttccccccccttgtagccttctgcagaggcttgagttgtttccacgtgtttgcgtcttccatagacttcccagttggatcataactattgagaaactctgtattttgaaagtagcagtcatggaactcctgaggaaagacattgagactctcttaatgctgaatgccctcactgttttctcactgtatgtccggacaacccctgcagaacctatcatatttgacaagtcaggattccatgttttgaagtacttcaaattcaagtgtagtactgtatcaagtctgagatttgatgaaggagctatgcccaacctccaaagttaaagatgg

SEQ ID NO: 10900 - DNA, 819 bp, Oryza sativa
  unsure (1)..(819): unsure at all n locations
ggtactataagattaagctcgggctctggtgcaaagcactacctacttccacatgtctagtgggtaaggcttagtttgtgccacagtctggttataaacaaaagtacacgaatgnagatgcacgaagtcgggggtcgatgcacatctctaggacaaatgaaggctacacgagctgcggcccggtagtcgagatgtcatggcacagggctggtgtcctgctgctaggggctcaatcctgcctgcctgtcccgaaggttccgcccgtaggtggggttgggtcggtactcttgtttatggctaggatgggttggaaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttatgggcaagcctagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacgcccttgattaataacactgtgtaactctaggatcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctcaa

SEQ ID NO: 10901 - DNA, 717 bp, Oryza sativa
atagggcgaattcgagctcggtacccatttttagtcccagttatttcacccgggactaaagatagcgatctttagtctcggattggtagtcccggtttggaaacagggattaaaggggggttacgaaccggaactacaaacgctttctctaccagtgaaggcaatgctattcataatcaacagttcgtcactactttttttgccggtaaaaaaaaaaagctgtgacaatatagcaaacatatatactctaattttttttctcgaagtaactttgttcactggtttttattgagacttgacagcaaataattaaacggatctgatgtacctgcagttccttggcatcgtaattagttctctgcagtttattaccagcaactaatatttccaaattccctatatatatagaaacaaatggaaacttcaaattggttatttgttaatatatatcaggttagaaagggttagagaaacacgatccacgtccagaagaaggttattatacgtaatgggttgcttggcgaagtgaatatctggtagatatatatagtaatccatgtcccacagaatctctgatatttaacgtacccatgtgaaacagattctattgtatataatccatgtcaaacggaatctgctgtatataatttctgcgattcactaaacctataactagctagctagagtgccaagtcattcaagtatctcactaacaga

SEQ ID NO: 10902 - DNA, 799 bp, Oryza sativa
gaaatttctggttcgttacgcccggcgttttttgacttagtttaaattcgctcgtgaccgttgggctccaaatggcgtgctcgactacggcctgtctcgcgggtcctcgcactaggaccgacaacagtctcgacacccgaagtcgcgaatggttacacgagttcattttaagcagaagtcgggggctactgtcagggctacgggttaggcataccctttaccctttaatatacgttacatatcggtatggtatatccacgcgcatacggatacttcttgcgtactctaaggaaatccttcacagaatctatggatgggaagaatcctactcggacaagattgggtcgttaatgtatcgtacagggtctgatatctccgagttctacttggagacctccaggtctgcaatataaaagggaccccccggggaggacctaaggcatcgaatctcagagccaacacaacccacacagcctatgaagccagagcctgcaaggagccaagccatcgagatctagttgaaccaactcgactacgatctcgccggatccgacaagttccattgttccctttgtaacctgtgttttccaccatataatcccacatcaactggattaggactattacctatcaaggggcctgaaccagtataattctcgtcttttgtttgcttgatgtcgtactacgtagatccttgtaccaacgtaccccaataccctctatatccggtctacgggtatcacccgtcgacaacactagtaattcttttaccaatatgggtaccgagctcgaattcgcc

SEQ ID NO: 10903 - DNA, 818 bp, Oryza sativa
gagctcggtaccctcccgactttcctgagctccctcctccataaagagactgaacagctcctgaaccacattgagttgaactgaggctgaacacttatgagtaggggaccatttctctgcacaaatataacacaatccctgggctcggcgataagccttgagagtagtcactttatctgtcgaatttgttggactgcgaacagtatcagtgcttctcttctctttaggacgattcatcaaagagaaacttccactcttccctggtggttgcggcaacggccacggtcccttgcctgccgatcgaaaaccagagttgccttccattctcttgacttccttaacactggaaacttgaggattctccaacacctcttcccgtaacaaagcaacagacagagcagtttcgagggtctttggtctctgtaaaagtacaggattacgaatctctcttcgcagcccttcaatgaatcgatgagtcaaatattttgcactcaccccagggtcataaactaatagttgattcattagctcagcaaatctctcataaaactcccaaaccgttcccgactgcttaatactatccatttgcctaatcaaattttcatgctggtcgcgatcaaatttttccgacacagcagcacaaaaatccccccatataggaaaacgcaaatgagctctagaagatcttaaccaagatgcagccctttccacaaagtagatggttgctacccttacccacaaaccaggaaacgtgttattcacatcgaaataatgctcacacttcatgcgccaggtctggggatctaacccatcgaatt

SEQ ID NO: 10904 - DNA, 848 bp, Oryza sativa
  unsure (1)..(848): unsure at all n locations
nnnnnnnnnnnnnnnnnnnnnnnnnnnnnnnnnnnnnnnnnnnnnnnnnnnnnnnntgccccgtcgttggttaatgaaggccagatcccgttcatcaagatgaaaatagcgcgccagttgcacgtcattaggttctgcagcataacaaccgtaattctgtttttggtcagaggttagaaagtcgacaggcatatcaggctccctacctgacagttattcattaacaattttgcaaccgtccgaaatattataaattatcgcacacataaaaacagtgctgttaatgtgtctattaaatcgattttttgttataacagacactgcttgtccgatatttgatttaggatacatttttatgcgactttttggttacgcacgggtatcaaccagccagcaatctctcgatattcaaattgaattgaagatcaccaattgattcttctgggttattttcatctaaatactcctttgcgacaagcctacactttcttaaaatgtcaccttgtgcagaattccattttttcaaatgttcattcaacaatgtttctgatgatatttgagatgacaatttgtaatgagatgatatatatgatgctatctccattagcatagcgtatcgccataatagtcttgatgctgcccttgctaaattaaatgatcctgtaaatggtttcaacattgatctggaaccaaatatttgagaatcgtctggtgagaaactcaggattaatatttttttgtctttcttccaatgctcatttagctgaataaataaagcacttttacctgtccctcgtctaccaacaacaatggtcctgtcatcagtttcaattagagtcctaaagtca

SEQ ID NO: 10905 - DNA, 737 bp, Oryza sativa
  unsure (1)..(737): unsure at all n locations
cnnnnnnnnnnnnnnnnnnnnnnnnnnnnnnnnnnnnnnnnnnnnnnnnnnnnnnntagagtaagcgtcggactctattctagcctatctcttaaataaaggggtagatatgttgcaaccgcatcgtgacttaccataggcgagagggagtggctgccgacgttcggctgaggctcgttgtaactctaatacattgtaataatgttggatgcctgaatcgatggagcacccataatcagtgccacaaggatataggcttcggttgaactttgttaacaaatatcattcatcggtgtcatcatcaaatttggctcttctatggcgtttctttcatgtttagtttccaattgtgatttgggggccggctttagaacaagttgtatgagagcttatgggaaatccatggtagaggtacgtgggaggtgctccacgctacaacgattacacaggatgtgaagggacgaatgtgcacgcaaggtggagcatggtggtgataaacgaaatttgatcggtggatataacatttcaggcggtggtttgaaccgttcgatggatgttttcaacaaggagatgaccagatgcagtgctcgggttgatggtggcagaagcaaattgcgatccaatagatggattcagacactttgggctggtgactcgaactttctagaaagctactttcaacaaggtgacatgaggccaaacactccggcttgttgaagctgaggtgattgccattc

SEQ ID NO: 10906 - DNA, 10397 bp, Oryza sativa
  unsure (1)..(10397): unsure at all n locations
tattttactaggctaaggaagaaacatattttaggtggggatgcaaagcgtgttataaagtattttcaatggaggcaaaaacatgacatggagttcttttttgagtatgagacggatgaagctggtcgtttgaaacggttattttggtcagaccctcaatcccgtatcgattatgatgcatttggggatgttgtagtttttgatagcacataccgggtgaataggtataacttaccttttatcctattcgtggtgtgaaccaccatggttccactggtatttttggatgtgctatcgtagctgatgagaaggttgcaacttatgaatggattcttaagcagtttctagattgcatgtatcagaagcatcctagaggattgatcacagatggggacaatgccatgcatagagcaatagcagctgtgatgccggattctgagcatcggttgtgcacttggcacattgagcagaacatggcaagacatcttcgtcctgatatgctttcagattttcgagcacttgtccacgcaccatatgatcatgaagagtttgagagaaagtgggtcgagtttaaggtgaagcataaaggttgtgaagacaaccaatggcttgcgaggatgtacaatttgaggaagaaatgggctactgcgtacactaaaggtttgttttttcttgggatgaaaagcaaccaacgtagtgaaagtctgaattctaaacttcataggtatttggatcgtaaaatgagccttgtccttttggtagagtattatgagcattgcttatcacgtatgaggtatagggaggctgatctagattgtaaagcttcacaatcaatccctttcacttctaatgatgctagtcttactgagaaagatgctgcccgtatatttgcacctgcagtttttaagaagttgaagttggttattggctaagtcgatggattgggaggtgataagattgtgtaggaagaggacaacttggttaagtatgttatttccatgaaaggtgattctgagatgctacaaatcttgaattgtacatatatggaatcaacaatgaagagcataaattgcacatgcagaaaaatggatcgtgaatgcctcccatgtgagcatatggttgcaattatgcatcatttgaagctcgatgccattcctgaagcatgcatagtgcgtaggtggacaattaaagcgaaacacatgtttccttctgataggtatggcgaagtatatacatggtcagaccagatggagagatatcgcaggctgcgtagcatgggcacagaagtgtttttcaagtgttcggtgtctaaggaaactactttaatggtgatggagatgctagaaaaattagacttagaaactgatgaatgtgagacaaacaactcagatttgactttatgtgggcatgtgctagcttaaaggtcacgtatagacattgagagtcatgatacggtgcatgatcctatggaaattgtgcctaaaggagctccaacaaaaaagactaccaggattcatggagaagcgtgataggcgttgaggctattgtcgaggacatgggcacactgttcgaacctgtccaattttcctaaggagaaatataatatgattattttgaatatgtcaatttatgtaaactctctctatatattactaatttgatctgagattatattttcagcaaagtagaagaagatgtatgagaagtatgaagtgtttctttgcactggtggaagttgaatctggagtttgaagtgtttctttgcactggtggaagttgaatctgccttgtttgggaagttgtattgtggacagaggattatattgtgtggtctagttttttttaatgaacaattcaatctgtcatggttcttgtaatgaatttgtgtgaaaagcacaagcttttgctggagaacaaagcatgtatatcattgaatggagcttttgtcttaattactgtcagctgtgaacagagcatacattgtttattgtttgtctactagcaccattgtgctgtttttactcgaactcctgtgaaatacatgccattctgtggagtgatcaaaagagagcactcattccagttttccagtaatacttattccagtaatacatgtcatttcagtagcacaacaaggctaagtacaccttaaaaatgtacaaaatgattcagtacacctaagttttacagttttgtagtacacttctttcagtatctcattccagttttgcaacaaccatccttccattactcatcaaccaaaatgaacaatgcacatctgaaaattttggacggcaataaagggcctgatattcgtttattacacagtatctcattccagttttccagttttgcagcaaccatccatccaatacttatcaaccaaaatgaacaatgcacagctaatcaatttagagggcaatcaagggcctgatattcgtttattaccaatgagatgacaaactaaaaagtctgttaccttaacatagcttactgacatgtagaaaatccacaacggccagcctagtacatattattaaataacttcatgagaaggaacacagcttcaacttctgttcctacgaaccaatttctaatgtcatcagtctcttttttctggttggacaacttcttcttgaatgaaaattccatgtctgaaagccggtcagccatttccatacaacataatattatcagtatctaaattttggtctttattctttcacaggtcatagatgcatacattatgttgattaaagacatgcaatgtgaaagtccaagagagaatggtactgcatttctagaaagtacagcacattgccaggcctggaaaacaaatggtgaacaaattggaacccgcaacaagcaatatcaagacaagagagcaaaagttacagcaaaatatttgcaacatgatatggtatattatgtcctcaaatatccttcataataataactgcatgacttacatttcattttctatgtagattttcctaccactcaatagaaactcaactcattggtacgtggctgttctcaatggtgctaaagaaaaaattcaaatactagactcgatgcgcatggacaagagctactacgacaaagataaagacctcaataatacagtatgctacattgtgcctttagattcatcactattccttactaacttgttacattagatatgtaatactctatttgataactcagataaaaggaattgaaaagtttatccagtatgcaaggctagaagatgaagttgaaaacaaatggaagaacaccaagattaccaattggccattctgcccaatgaaagtccctcagcaaagtgacaggtcaaacaaacagttaatttttgtcgcaaattatctataacgaattaccactaacaaaggacatgcttgcaacagctggtcatgtggcttgcacacattgaaattcatacagcattggaatggaaaagaactctcccctgagttcaatgaaatggtaattttaaattgcaatcagtactctttgtaaataaaatgacattacttgatatttttttcataacttgcttttcaggatacaaccaccactttcaaacataaggttgcagccaacctcattaattctactatgaacgaagtgattgaagtgcagcaagatattaaacgcctagtgaccgaggcaaatgaaggcaactagctctaggctaagattcagatagacatcattgtaactacttgcaatgtttctcctgtttagagaacatcacagaatttttatgcatatgctattctcctgtttatccaagttaagggaattcgatggcatttcttatctagcaaaagtcagtaagattttcacaaaatttgaatcttctgtgcgtgattatgtgatgttgcaatttacagaggtaacagaggatgtctctgataagcattaggtatttatttcgcataaaaggtgttcgatgaaatacccatgacagaatttctatctaaagtgtgtgtataggatgtggataaggtggtttcatcttttattttcattgtcagaaatgatatgtcgacctccagattctacatgtcttgtgttatatcttttggatttgaaaaactagattcagagaagaatttattaggctggctaccacctgtgatagcctgataggttagtttctgttccctgaataaaccatagaagtatgctgggaaaacaatttgttaaaacaagcaactcatcagtgtaccactcgttatgctatcaacaatttctttcttctatcctattatcattttgcagtcactcattgataggggaggttattgaacatttgaaaattcacatagaacaagcaacgactgagctcattaaaacatccaataaatcgtacaatacaaatcctataagcaatgaagaagaagagcatatgcagcccagaaaatgaaagtatctaccgctgcaaccaacagaagctaatgatttagattggatgaaaaaaaatcgatgcatacactgtctcgtcgccggctaagaagactacacgaccacctcgccactggagccgcgcaaagcccaaacccgctgccgccacaacaccgggtgcgacgaccacctcgtcaccggggtccgcaccatcgtgcacgccacgacctcgcaaccaaggcttgccacgcaccagtcgtcgtcgtcaccttgtgaacgcggtcgtcaccaggacaccgtcgcgcccgccaccagcagcaccgcagcaccagggcttcgccgcgccaggcaccactgcgcccgccacaacctcgctgccacgaacaacccgctgccgccgccgcctccgcctcccacggagcacttcgccggcggccgcctcctacacatcagccgccgccgtcgcctcgcctcccccgccggcgactcgccttccacggagcacctcgccgccgcctcaaacggatcagccgccgccggcggctacggatcagccgacgccgcctccttccacaaagcaagtaggcgccgacggaagcaactcgccgacgccgccgccatctcccacgaagcaaagtcgcgccgccttccacggatcccgccgcnctccgcggagcaactccaggccgacgaagcaaggtcgcgacgccggctactctcacggatcggatcggatcggatgggaaggggatatttgcctcgcgcccgtttgggagaaagacctattttccttccctggacacttctacgggaaaggacaaattacccctccaccactccaaatattccggtaccacctcatgggcaaatttgtacctggaggtaccacagattttccaccatccgattgagctgattggatggctcagatttcataccggacagtatcgatggtacctgctggatgggagcttctcacatgagtacctccgctccgatgtttgttctgcatcagaggtggttgttgtggagcttctcacatgagtatcgattttttttggctgtctgacatattttataggcattttatatggtaatatgggtgatgaaatgggaaacatttttttgtgagaataaaggaccaagaagatgtacgaagtgttgctttgctgctgggcgttggatctggaacaatgctctgaattaccatgcttgaattctcaaacatgttgctatgttgatgggacaacctgagtttttgatctctgctgtgtgataagttctgttctatgcagtgttcgcctaaacagccgcctagcccgtctagacggtgattaatcgctagtcggcgacaatttgtccagtttataccctaggcagtgaattagtcgttttaccgcctagacggtcctagtcggtcctaggcggcctggacagcttggacaggacggtgcctgggcgcaattggacaatgggacagtgtgtctaggcggcgactaggtgatagaaatcaaaatttgggcacaattaaatttagaaacgccgcgcgggaccagctcggtatagaaggggatttaggttaccttatttgagagcctagagagagagcgcaacccctacctactcccctttttcacgccgccacgagcgacggctccgccaccgtgcccatcgatcttccaccgtgccgctgcgttcttcccgatctcctcctctgctgctccacgttcttccccctcctcctctgctactactgctctccctctcatccttcatccttaccgtcaatggaaggtggcaaacacaccaattgaagcagtcaagcacggaaccactcaagcagcctgcgccaaccctagatcaggccatcaggggatcaggctcccctccaccacctcatctcttctgttcttccagttccagataaatttttcttcctctctcctagctccagctccttagatctgtatgtatgtgatttgttggtgttgatgctgtactgctactcccctagcctgctatgctatatatatatactaatgtatgttcgctattcctatgaatttgtactaaacccaatgctatttgtctaaatgcctatatttactgagtaccgaatgtcaagaatcagtatttttctgtgaaagaaatataaaaaacgcctaattcgcctaatccatctagtcgccgcctaatcagcctagtcgctagtcagtaggtgaccgtccgactagcgtttagcgactaggtgaacactggttctatgtaatctatggaacctagaacctgctggctggcccaagttcccgggggtggaatttgtattgagatatttcaatgaatatatggagtgtggctgaatttgttttcctaaaacactgttgcagtacccagaaacctgttcaatcaacttattctggtgagattgtctcaaggtagcatctagtgaaagaactgctatacctatcacactagaatagaggttcgagagtttttctgttaagaaataagaggctccagttacctgcgaaatttttttattttttagactttttattttttttaattttataaatagacctttcgaaaaaatatgtccgaatctgaaccttttggccactccagcccgcctggcttggccaaataactttggcatgccacgcgcagctggcatggcagtgctgtcctgtcatgctagcctcttgccacgccaccgtggctggcgtggcaaaacaatgctactagcctatcatggttacggataaggtatatctcctatcctacgatttatggaatatatggatacgacataccttcgtttgtacgatatatttccgtatacgatgaggaaattaacaagagattatggaaattatcctcacgagcaagtgaacaacagagtcctactcaaaaagggttaggttatactatatcgtgtggggtccatagtcaccgagttttacttggagactaaggtgattcatgttataaaagacacaccccttaaggggtccagatcatcgaatcatagcaccaacaccaccaccatagcctacaatccggaggacgtgaagcctactcgctagaagatctcgtcgaaaccatctcgacaaggatctcgctggtaatctcggaatcgttggttctctattgtaatccgtggttctttcatatcaatctcatatagattggattatggctattaccttacgaggggtctgaatcagtataatccttgtctccgggtttgcttgatgtcgtattgtgtagatcctcgtaccaacataccctataccctattcttccagtgtgctagtatcccccgtcgacacggagacaagaaatatactggttcagttttcggaaatatatattgtttatactagcttgttcaaacctcttgataggtaaatagccctaatccaatttatatgtatcgttcgatgatgtttcacaccgattataaaattagaagcaagctaactaatctaagcctaagtagtcttcaatgaggactaatccgatgacttgtagtcggcgcctcggcggctagctttaggtttcctcatggctagttggtgttcgatctggcttatggctatggtttataatttgatgctatgtctcaatggaagtctttgtatttatacgggtatgaccgttcaattagaacttgaaaactacaagtgggataggagcatataagacccttatattacacgaatcgattggattctgacatattgaatggcatttacatgttattcgtagaattcccatattatttttttaagccaatagaaatttcatactcgaatatatatatacccttccatataaaactaggtatatggtattttcgctccatataaagctatagacggctgctagctagggtacgggattccgtctaaacgagatactttatattgatgaccttagctccgccaccactttaatcgctcacgagtccaccactaagcgccgccctacgcgctcacgccctagctggcggaggagcacgcccgaggcgctaggagaaggccacagtaccagtagtggcttaggtggcaaagttggtccctgcaggctgtaccagcctggggacccttgtaccaacaccagattgagaagaaaaggcatggagatttggaaaggaatagaagggagaagacgagacaaaacgctggtggtcgacagctcaccacctgcccaagcggcagtgacgcacgttataccttgtacttggtacctatgtgatattggttggtacctataccaagtctaaaacctgtaggtattaaccatgctaccaaaggtaccaggtctgaaacttgtgagtatcaaccatgataccacaggtatcagccttgaaacctgtaggtatcaaccatgataccaaaggtaccatgtctgaaacttgtaggtatcaaccatgataccactaatactaggtctggtacccgtaggtatcaaccatgataccataggtaccagccctgaaacctgtaggtatcaacatgataccattcgtaccatgcctaatacctgtaggtaccagctaagccatggtgatacgccacatgcacgacatacctgcgcacaacgtcgacgagcaacacgatgtctgcaacaccacgtcgattgtcaattgaaactccaaatctagcaccttcatttgtctcctctccatcaccactaacagttgcgtgggaggaggattcacatcgatcggcatcctcctcgatggcatgacatcgaggtggaggccacaggggccggtgcgatcatcacctcatcactgacatggctcaggcggatccaatgacggggaggccctagatatctccagatctggtgctggcagccctctccttggctcgttgatggtgagggggacggaacaggagggtaggtgtagcaggagaaaggagctctagccattttcaagcttctagctaggcaaggaagaagaggagaggaaggagaagagtggcggcggatgcgaggcgtaggtgcaagagaagagcgacaaaggagattggggatcgagtcgggcggaaaaggatgcagacggataaggacgatgaccgttcattatgtatcccgtccccacttcccccatacgggatatcgtcggttagtttttctgaagctagttatgttgtatttctgacaaaaccggatacgattataggtggtataattatctttctgaaattcgtagaaatatatttcttttgcggaggtagctagtaatagagtggacacaatcttgtgctgatttgttttttttttaaaaaattacatgacaaatcgagaaatcataatcatcctgcaaaaggaatagtagtaactaattttgttcgtaattatagaaaacattggttttgttgtcgtgcagcaattcataagtacggaaaagattgttttttagttatgcactaatttgatcaacagtcgcgtgtcaaaaagtatcatgtctagtgattcctctccataagagcgggtacaataatgggcgatataaggtccatgtaagattttttttatgatatggaggagagagtagcagcggacaactaaggccatccccaaccctccatgccatctagtttccatagcattaaatacatcacataagcaaaaatcatactccctctatttctaaatatttgacaccgttgactttttagcatatgtttaaccgttcgtcttattcaaaaacttttgtgaaatatgtgaaattatatatatacatataagtatatttaacaatgaatcaaatgataggagaaaaattaataattacttaaattttttaaataagacagacggtcaaacatatgtaaaaaattcaacggcgtcaaatatttagaaacggagggagtatgtggcaagaaagttaacgagaagagaggtaaaaagatgaagaaaccatctctacacaagaactaagaataaaaataagagaatatgctgat

SEQ ID NO: 10907 - DNA, 476 bp, Oryza sativa
aatactcatggcctcgtcgtccagtacggctgccacaaatccgttccaaggccacccaatctcagagaagcttgggaaggcaaatcatgcgctctggagaaaattgacatttagccattgtcaaaacggggtttcgctggaatgccactcccaaaaatggtttcgttaaaatgccaccctcaaacaggggcaacttgttgcaatgccattccatccatttcttctcagtttaatgttttttgtaatgtttttcttgttgagatgaccaaaatacccttatcctatctcatctctcctctctgtcttcctcctctccgttcggctcggcggcgcatctagagacggagacggcggcagcgtggccggagaccgggaaggcggcagcgcgcttggggatggggaaagcggtggtgcggacggggaccgtggcgacgcggatggggacgggaaggcggcgacatggctggggatgggga

SEQ ID NO: 10908 - DNA, 3025 bp, Oryza sativa
tttactccatatttgtgtatcctaactaaaaaaattcaccctaatttaatatcactcatattttgtttatataatttatttaaatttttaattagggttaattctcatttcatcatactaaaatttaattattgctaatatggttgcgataatattttatttattttccaatcccacctaatctttattttaatttatattttaattatttatttagccaacttgatttttagggtttattcctagttagttattcattattcgcgattaataaattccgagatcaaaatccaatgaaacaggcgaataaaatcatgatgcaatttattacttaaaatgttttgaaactccgtatttttggtgttttgattttgttggtcgaattttcagggtgttacagaacgcatacccgattcccgttccatagggttccgtgttcatcctctgtgaaaccagcggctttaccctgtttcatgttcttgaggagcccatgcatatccggatcattcttctgagcctcgcggatttgatcgagcaaggtaggcttggcttccaacgtagccaagaatccacgaccaactatgcttaggttcagggcttccaactgttgattaagttccggtggaatgccacggacgccaagagtgttgcaatggctttttcgacttagagcgtcggcgactacgttggccttgccaagatgatagtggatccccacatcataatccttgatgagttctaaccatctcctctgccgaagattcagatccgactgagtgaagatgtatttcaaactcttatgatcagtatatatttcacagcgattcccaatgagatagtgccgccagatctttaaagcatgaaccacagcggtcaattccaaatcatgggtagggtagttgccttcatgaggccgtagctggcgtgaggcataggctaccacatgaccttcctgcattaatacgcaccccaatccttggcgcgaagcgtcacagtacaccaggaagtccttgcgagtatccggtaagattaacactggcgaggaaaccagcttttctttgagagtttggaatgctttctcacactgcggactccacacaaatttttcttctttcttcaacaactgtgtcatgggtcgagcgattttggagaagttctcgatgaacctccgatagtacccggccaaacccaaaaagctgcggacttgagtgatcgtcttgggttgcttccaatcggtgacggcggtcaccgtttcggggtccacagcaactcctttagcagatatcacgtgccctaagaacttgacttcggacaaccagaactcacacttgctaagcttggcatacagttgatgttcccgcagctttcccaacaccagacggagatgctgctaatggtcttcctctgattgtgagtacaccaggatgtcgtcgatgaagaccacaacaaacttatccaagtattccatgaacactttgttcattaagttcatgaagaaggcaggagcattggtcagaccgaacgacatcaccgtgaattcatacagcccatatcgcgtggtgaatgcggtcttcgggatatcttcttcacgaatacgcaattggtgatatccggagcgaagatcgattttagaaaagatggtggcacctttgagctggtcgaacagatcatcgatccgaggaagagggtacttgttttcgatagtgacttcattgagagctctgtagtcaacacacatcctcttcgtcttatccttcttctccacaaaaatcacgggagcaccctagggggaagtgctcggccgtatataccccttttccttcagctcttccaattgcttcttgacttcggcaagttcatttgctgccatacggtagggccgtttgtacagaggagttgttcttggagcaagatctatccggaactcgatctcccgcttgggcggcataccgggtagttcttccggaaacacgtcaccgaactcactgacgatggggatttctgacaatcctatctgatgaagttctgaactgccaacagaggttgggggtgcaaagaacacaactggttgttccggccctcggtacagagtgacagtgcgccttgcgcaatccactaccccttggaattgagccaaccaattcatcccaaggatcacatccaagttcttggtgtccagaagaatcaaatccgaggggaaagggattccctggatttctataggaacggccgggctgtaatactttgctgtcatatcccctccaggggtggtgatgagcagagggttcctaagccgttctacccccagttgatttcttcccacgaaaggcacagatataaacgagtgggaagctccagagtcgaacaaaatggtagcaggaatggaatgaatgaggaacgtaccaacgatgacgtccggagttgtcagcacatcctcggcagtcacgtggttcacacgaccccgagcgacgtccttaccaccgttgttggggcggggaggcgcttggccttgctggcaccgcggcttcgggcatttgtccgcaaagtgtccgggctcgaagcagttgcagcacagacgctgctgtccttgagcgtctctgcggccttgaccaggctgcacagctggcgcaggaggacggggtgcacgggtcccttgctgaccctgctgttgctgcggctgtgggacgcgcaccacgaattggggtcggggcgcggagcgaggttgctgctgctgctgctgcgaggaggattgtcacgccctgaaaattttaaaatttataaattgttgtttaaatggaatttctagaaataatttaaagtcttgaagagaagatcttgttttaattaataaattccaatataaaatggggccagataaaatttcattaaatactttgcttaattctataattcctagatttttctgggatttatttgagctaaggaagttattttaataaaatggaattgcatttaagaaataatttaaaatgaaaaagggtttaaaagtctcttttggctttgg

SEQ ID NO: 10909 - DNA, 18881 bp, Oryza sativa
attcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttatccatagaagccctctaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaagcttggtttactttatttacttacctttttactttgattttcaaactttattcaaattaatccaaaaacttgtgctattaattggatagatgtcttaactccctcctttcacctgtctttagatgccgcgttacaagcctgagtacctgtttggtgttgagggttttgtccaggagttgcgtacgatgtcctttgtcattggatttggaactgcccctttttatgcccagattgctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccacagggaagtgaccgtggcagttaccttgagactgaaggaattgagaatgatgttaccacaaagcatttggttgagatgttgtgggctatggatgaaagtcgtgcggagactgtgttagcagcccaagatcgtgaagattggaatcgtggtaagatttgcaagttagaagacaaggtggatcgtttggagaaggaattagccgcattaaagggagaagcaccgccgcagaaggccaggattcgtcttaccgcaaggaagagagctctatttgttcctcgctatcaattggcgccaaaggttcgtgtggtggagaaagaagttgccccagctcaagcggatcctccggtcatcatcataagtagtgatgaagaagaagaatccaagcgcaacaattccaagattgagtgggtagcaacccaagttgataaagacgagccttcaatcgacctccgatgcttggaagaactagagtgacttgttaagccgttgtcttagatcgatgtgttagtttgcttgttttaagtttgcttgtgtgtgtgggtcttgcatgtgatttacatcagtggtgggatgtaagtgcatgcgtttgtttgcttttgagagttaggaagttggtgagtttagtggtgtgagagtctttagtttgtaataataaaactcagttaagatcaataaaagttaaagtaattctctatcttaagtagtttcccccggtttctcttcttgtgccctgcccatgccaaatggtgaacactcacagcaatgggaatggtcccaacaaccccaataacaacaacaatggagagaatcccactcttgctcaagttcttgctcaacagacccagcttatgaacatgatgatgcagcaatttcagaatcagcaaaaccaaggaaataatcatgcacctccccagaacaagttagcagaatttcttcgtgtgaggccgcctgttttctctagtaccactaatcctgttgaagctagtgattggctgcatgccatagagaagaagttggatttgcttcagtgtactgatcaggagaaggtctcatttgcatcacatcagttgcatggccctgcctctgaatggtgggatcatttccgccttaacaggactactgctgaacctatcacttggcttgaattcaccgctgctttccggaagacgcatataccatcaggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctatacgtcaggaggacaagtacaatcacatggagcagaagaaacgtcggattgctcacttcaaggcacaacagggaaataatcagaagccgcgtcttactttaggaccccagtccatgccacagggaggttcttcgtctgttgttcgtccgcagcgtcagttcttcaacaacaatgctggcaacaacatccgtaatcaagctccacgtcctgttgcagctccagcacagcaacaacctgccaagagagagcaaggcagcaagcccgtggtgtgtttcaactgtggagacccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttccttgttaactcagttcctgcaacagtacttttcgattctggtgctacacattcattcttatctatgagttttgcgggaaatcatgggatggaagtagaagatcttagacgtcctttgatggttaataccccaagtgatcaagcactttctttgcaacgtagcccctcggtcagaatagaaattaagggagtaccatttctggccaatcttatcttgttagaatccaaagaccttgatgtcatcctagggatggactggttagccagacataaaggtgtgatagactgtgccaacagaaaagtaactctcaccagcaatgatggtcgagttgtgactgttcatgcattgtcatctgagtctttaaggtcaagactgaaccagataactttggaagagattcctatagttcgggagtattccgatgtgttcccagatgatttacctggtatgccgcctaaaagggatatagagtttagaatagatttggtacctggaacgactccgatccataagagaccttatcgaatggcagccaatgagttggcagaagttaagaggcaagtagatgatttgcttcagaagggatacatcagacctagttcatctccatggggagctccggttatttttgtggaaaagaaagaccatacccagagaatgtgtgtggactatcgtgcattaaacgatgtgactatcaagaataagtatccgctacccagaattgatgatttgtttgatcagcttaaaggtgccactgttttctccaagatagatcttcgatcaggatatcaccagttgagaattaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactctcgaaccaaagaagagcatgaggaacatcttcgccttgcattggagaagctacgagaacatcaactgtatgccaagtttagcaagtgtgaattttggttgtctgaagtgaaattccttggtcacgtcatctcagcaggaggagttgccgtcgatcctagtaatgtggaatccgtaaccaattggaagcaaccaaagacagtttcagagattcgcagtttcttaggcctcgcaggatattatcggaggtttatagagaatttttccaagattgctaagcccatgacacgattgcttcagaaacatgtgaagtacaagtggtcagaagaatgtgagcagagttttcaagagttgaagaatcgcttaatatcagctcctattttgattttgcctgatccaaagaagggtttccaagtgtattgtgatgcatccaaacttgggttaggttgtgttttgatgcaagaagggaaggtggttgcctatgcatctcgtcagttacgtccgcatgagaagaactaccctactcatgatcttgagttagctgcagtagttcatgcattgaagatttggcgtcattatcttttcggtactcgtacagaagtgtacaccgatcacaagagtttaaagtatatctttactcagccagatctgaacatgagacaacggagatggttggaattaattaaggattatgacatgggaattcattatcacccgggaaaggctaatgttgtagcagatgctcttagcaggaaaagttattgcaatgctacagaaggacgacagttgccattggaattatgcaaggaatttgaaagattaaatttgggaattgtcagtagaggtttcgttgcagccttagaagcgaagcccactctaattgatcaagtaagagaagcccaaattaatgatcctgatattcaagagatcaagaagaatatgagaagaggaaaagctatcggtttcttggaggatgagcaaggaactgtatggttaggtgaaagaatctgtgtccccgacaacaaagatttaaaggatgcaattctgaaagaagctcatgatactttatactccattcaccctggtagtactaagatgtaccaggatctcaaggaaagattttggtgggcaagtatgaagcgtgaaatcgcagaatacgtagcagtatgtgatgtttgtcagcgagtcaaggcagaacatcagaaacctgccggtttgttgcagcctttgaagattcctgaatggaaatgggaagaaatcggtatggattttatcactggtttacccagaacgtcatcaggccatgactctatttgggtgatagtcgacagacttaccaaagtggctcatttcattccggtaaagacaacctattctggaagtcgattggcggaattgtatatggcaaggattgtgtgtttgcatggcgtccctaagaagatagtgtctgatcgaggcagtcagtttacttcaaatttttggaagaaacttcaggaagagatgggttctaagctgaactttagcactgcttatcatccgcagacagacggacaaaccgaaagggtgaatcagattttggaagacatgttgagagcttgtgctttagacttcggtggaagttgggataagaatctaccctatgcagaattttcgtacaacaacagttatcaagctagtctacagatggctccttacgaagcgctgtatggtcggaagtgccgcactccgcttttgtgggatcaaacgggagaacgtcaggtttttgggacggatatcctaagggaagcagaagaaaaggtaaagatcattcaagaaagattgcgagtggctcagtctcgacataagagttatgccgacaatcgccgtagagatttgagttttgaagaaggagactatgtgtatcttcgtgtcacgcctcttcgaggagttcatcgttttcacaccaaaggaaaattggcaccgcgttttgtgggaccttataagattgtcagtagaagaggagaggtcgcttatcagttggagttacctcaatctttggcaggagtccataatgtgttccatgtttcgcaattgaaaaagtgtttaagggtacctaccgaagaagctaatcttgatcagatagaagtccaagaggatctgacctatgttgagaaaccaatccgtatcttggaaacaaatgagagaagaaccaggaatcgagttatccgtttttgcaaagtccaatggagtaatcactcggaagaagagtccacttgggaacgagaagatgaattgaagtcagctcatccgcatctgttcgccagttcttccgaatctcgaggacgagattctgtttaaggggggtaggtttgtcacaccctgaaaattttaaaatttataaattgttgtttaaatggaatttctagaaataatttaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaatctcttctctctctcctcggcccagccggcccagtccgccgcgcgcgcgcgccctcgctgtcgctgacaggtgggtcccgcctgtcaggtccttcgtccttctccggccgccgccgccgaaaccctagtttcgcgccgccgccgtttcctttccaaatccggccgttcctttccttctccggccgaattgaaagaggggaaatgatccttgggatctcctctaccttttctcctttggaatctttggctaaatcgttttggaaagagttggattcgagttcgtctcggatttgttcttcccgagctttccttcgccgttgccgtcgccgtgggccttcgccgccgcctccgagcccctttaaaaggacccccggtgtctcctctacccgtcgccaccttcgctttcgcctctcgtcgtcggaagagctctagcgccgtgtgccctagcttcgccgtcgccgccgccgctccagccgtgcgccgccgtcgtttcagccgtcgccgtcgctcgggaagaccaccgtcgtgctcgccaagtcgtcgccgtcctcgttcgccccttcgccgtcgccggagatcaccggagcagcttcgccgtcgtcgacccgaaggttcccgccgcttcctccttgtcgccgtcgccgtccgttggtcttccgccgccgtttaggtcaccggtgagttcgccgtgttgtcctctacatcttggtgccctccgtttgcgtcctagcgccgccgtttgccggtgagtgtgcgccgcccgagccgtccgctccgccgagccgctgccgctgtcggtgacgtcaccgctgacgtcatcggggtcgtccgccgtgagccggtcgtggaccgatcgatctcggccgtccgttttggattggatcgatctcggccgtccgttcgcgtgaaccgtcgcccgtgcgcccggtccaccaaaccctagcccgctgacgcaataattctcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttattacaatttgactagttgagctttatttatattggttcaactagatattagatataattgcttagccctgcttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatctaggaaggtgcgctgcggtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaaggatccccctggatagggattggtgtagcggaccctttggttagccccctgttgattgaggaaattcgccaagtgacgcttgtgcgactccagttccttgtgcttggcttccaagcggatgctcttgtccaccagacgctggaaatccggataatccccggagaccagacgcacagatagctcagggtccattcctgccaagaacttctcctgcttttcctcatcttcccgaacatcctccggggcgtaccgggccaggttgttgaactcatgcaaatactccatcacagagcggttgccttgcttcaactcccggaattcccttttcttaagggccatgactctggcaggcacatgggtcctccggaaagcggcggtgaagcgggcccaggtaataggctgcccctcgggctgcgtagcctggaagtggtcccaccatagagatgcgggcccctgcagctggtgggtggcaaagatgactttctcctcatcgttgcactgcacggtgtctaacttcttccccacggcatgcaaccaatccaaggcatccacggggttattggagctagagaaggtaggcgggcggatgcgaaggaactcggcgagcttagaatgctgcgggggtggtggtggaggtggagcattatgctgtggtggattttggatgtggtggaggaaagcagccatcatgttggcctgctgggcgaggatttgagtgaggatggggttggtgtctggtggtggtggtggtggcgggggagaaggtaaaggtgggccaccttggatgttggggttgctaccttcgggttggttgccatcaccagtagcagcagttctcctggttgtcaccatctgaaataccccaaaacaaaccagccaacagagagaacagactattaaaactaaccacccacgactaccaaaattattgaacttattactgatataaaatgggttcattaaggttcaggatgcttaagccaataaaataaagacaggctccgacacaatcataccacacaccggtacaaccatgccccacacgacttcaacaggaagacaaacgagaaagaacacactcgcaagcctactaactgctcgtctacttctgcgacgggccagggcggaaggtgagcagcagcgcatcctccgtgctaccaatgccggaggtttccccctcctgaggaaccacgggcgcgggctcggcacgaggggtctccacgaagcaggtccacgccagggactaacgaacaagctcaggcctggaggtgctcttgcgggcagtgatcttctggctgcggcagacgcggcggcgcttgggacggcagacctctccctgggcgaccttgagctgacacagctgcgcctccagcgcgtttaggtccttcttcagctgcagattctcctgacgcagctccaggatcttcatgttgttctcgaccatcccacggcgcaccatatgatggaagtcgatacgggccgcgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagtgcggcgttctggcaagcagcggagaaggaatctcctcccgtggtgactgccaacgaagtcctctcgggagagccagtgaggatcactgcagtgacctcccaagcagcatgcgactctgcatcgtcaccctcctgctccgggagctgcttgccttggtagtccactccatgcggataccccaggacaacgcacatgccccgcagctccagaacaaagccggtcaggtccaggccacgacggttgatgctgccggccatctacaagcaaggacaaaaaagagagaaaatattttagagatcagcttttgatgacaaatgaagcagcaagacagagagagactaaaggattttcacaaataagagaggatttttatttcgaaaatattgctaaggcttgggatctaaggctcgtcctagggtcaaggaggctctgataccaacttgtcacgaccggaaataacccaacgggcgttccttacgtgcgtgtattattccttgtcccaggaggcaaggtacaccaaaagttgatacaattcagagtttaacaagcggaagcgtaaatagttaattattacatgggcagcgacggcccaacacactcaaagacaacgaaaaacagcggaagactaaggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcagcataaatgcaaaggagtacaatggagttatagtataggggttaggttttgcaataaacagcatttaaaagactcttagttgctcaaagctaaatttaaaacacgatcctagaactatttaatattattaaacaaggccgtgaacccacacgaacctgccttaacccaaggcctacgatgattcagaccgaactggcaacccgaccctgggtcccagctcgtcccaagccaacccaggccaaccattccacattttagttattaagcaggttttaagaatttgaaacactaacttgggtacattgctaggcttgcccataaccgagggcgcggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtaccgacccaacccacctacggccagaacccccggacaggcaggcagaattgagcccctagcagcaggacaccagccctgtgctatgacatctcgactaccgggccgcagcccgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatgtggccgaggggctactatcaaaaccatgcaccccaagcccagcctaaaaccattttgagagttttgaatagagggggaggtgtgcatccaattccacaataatccaaccattccaatatgtccaggtgatatgaatattcccaaagtctagagttataaaaccacctaatgttgcctaattaatcagcgaagcatctacctaaattcttgctagtggaaccatgaatagagtgcccactagttggggttttgtttattctagggtgaacaaggtaataataacaataacaacaataataaggtcataacaaaggtaaataggcatggctaaataaaacagtgataacgcgggaatttaaataaagcgataatgcaataatttaaatcaaagtaatttcacaaagtgggatccaatatgttcaaagaatgatgtgacttgcctttctcgctttcccaaacgtcggcttcaacctccacgaagagcggatcttccaaagctgcagcgtctacacaaccaacagaaaagaaaagggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttacgaatttcttcatttaaattttaatttaaaaatagatttattgcgtcagccgggagagagggcgcgcggaccgggtccacgggagtgggacccacgcggcagtctcacggtccacggtggaccgggtgcacccggctcacaccggccggccccgtgggccccacgcgtcagccgcacccgagggcgcgggcggctgatggccgggccccatgcggcagccgctaggcgcgcccggaggcggccacatcggcacggccggcgggaggcggcgcgcccgcgcccctatggtcgccggcggcggccataggcacggcggagcggcggccgagagaggggagggaaagggggaaacgaagcggcggtccacggctcaccccgggtcgacggtgacgacggaaacggcgaccggagcggagaaaggcggcggcgcggctcgggtggacggggtcgacggcgctccggcggtcggcgagcgaaacggaggggtggacgaggtcggcgaggatgcggcgaagccgaaggaggcggcgccgaggtgggaggtagtccggggcgacgacggcggcggaccggagctcggcggcgacggcggagagagagagcgacggcgcgagctcgattccggcggggagagagggcggtgagtggcggaaacggtggtggggagctcggggagggtttatatagggttgggagtgagagagggcggccggaggagggggaaatgggcgcgggagacccggccgccattaatggcgccggcgaggttaggggagaggtttccaaacaaatccgagggagagagggagggaaaaatggggggaaagggggaggggatcccggggaataattccccccactttattgcacgcggggccggcgggaggcggcgggattcgcggcggcgtcggcgctaggcgcgggcgaggcggcgggggcggcgggaggaaggggatgacgggtgggccccacccgtcagcgagggaggcgggcgggcccgcccgtcagcagcgcgcgcacggggaggaggccgagtgggccgcggggaggaggagaaagggggagggagatgggccgagccggcccattagaggggagaggtgatttttagggtttttctttttataaaatcattttaactttgtttatttcttaataattattatttgtgctctgaaaattccactaaaatttatttacacattttaggcttttaggaaatatacaaaaatcctccaagccctatttgactttcaactttgcacattttaatttttgaaggcttttaattattctaggcataatttagaggatgtattttagggtcgatttgggacgcgacaaacctacccccttaaacggaatctcgaccccgagattcggaagaactggcgaagagatctggatgggctgccttcagctcgtcttcacgctcccaagtagcttcttcctcggcatggttgctccatcggaccttgcaaaaacggattacccgattcctggtcctgcgctccatggtgtccaggattttcactggtctttccacgtaggtcaagtcttcgcgaacttcaatctgctctgagtcggcctgctcggatggcactcgaagacatttcttgagttgcgacacatgaaacacatcatgcacgttgcccaaggaggcgggcagctccaactggtaagcaacttctccgcgtcgagcaatgatgcggaaaggactcacgaaccgaggggcgagcttccctttcgcttgaaacctgtgtacaccccgcaacggcgttacccggagatacacaaagttatccactgcgaattccaggtcacggcgtcggttgtctgcataactcttctgccgagactgtgccacctttaggttttcccgaatggtcctgaccttcgctttagcttctctcaagatatcggtcccgaacacttggctttccccaacttggtcccacaatagtggtgtcctgcatttgcggccatacaacgcttcgtatggtgccatctgtatgctggcttggtagctgttattgtaggagaactcggcgtaggggagactcttatcccatgtcttcccaaaatctaggacacatgcgcaaagcataacttcgaggatctggttcagacgctcggtctgcccatctgtctgcgggtggtacgcggtgctgaaatttaatcgggttcccaactcttcctggagtttcttccagaaatgagaggtgaactggcttccccgatcagagacaattttcttaggaatgccatggagacttacgatcctagcgaagtagagttcaactagtttgttccctccataggtggtctttacgagaatgaaccgtgctaccttggttagtcgatccacgactacccatatagaatcatatccgccttgggtttttggaagtccggtgataaaatccatcccaatttcatcccatttccattctggcacttgtagaggttggaggagtccggccggtcattggtgctcgactttgacacgctggcacacatcacaaagggccacgaactctgcaatttcccgcttcatactaacccaccaatatttctctttcaagtccaagtacatcttcgtgctgccaggatggatggaatagggactttcgtgagcttcctgaagtatcaactgtttaagttccctgacgtctggaacgtgtggacccccgtttttataacaggaatcaatcgtgtaaacagtaccatttccctggatcaagtagtttggtacccacgaattcatagctggaataccaagtgcacatacacgagtgtctaatacgaattattacatcataggcccgcaggcatagtcttaaatcatcggaccgagcggtccggaatacatccaaaaacagaaatagataaggtagcggaattcaggcagcggcatgccattgccacaggcaacgaccgtactaagacctactgggcaccatcgtcttcgtctccctcctggtagtaggcatagggatcctccgtagcttcatcgcccgcttctgattaattttatatttgcaagggtgagtaccaaccgtactcaacaagccaccacagcaacaatgcatatgaaagggggagagttcaaaggatggctatagttcttttgcgcaaagcaagttttgtaattcttttcacaagcctaagacctagcattgactgatcaaattttagtaccagagtttgtatttaaacaacgacggttctgtccaccatccagtgtgatcccaaggatagtttctcgccattgattcgtcatggttttcggaggacgtccaccttcctgcctctcaggaagtggctccaacggcatagaaatcatcatgcaatatcccatcccacacaggttaagaatttagagtctagccaagtgtaatacatgtcccggtgctcaataaccgcgagcacggctattcgaatagatttggtttacttacactgcagtggatgtacactttacccgcactccacgactgcccaacatatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggacagagaagtctcacacatattaaattatggttcaagttaagttctctctctcacacactcatggcagtcctaccaatggcgacaccgatgtagggcacgcctctcggccctacctcaacggctgtcccatcgtagcgcacctgcctcactcaggggtgaaccatctatgcagggatactgcctccgctcggctatctaatccgctaggtctatactcattcgagaagtacggttgtacgggggtcgtttcatgcttaacttcatggctcggtccttaattgaccggggacggtactagcctttcccagataccacccaaatcctccgtccgccccagtcgaaaacaattgtttaattttattttttctttcacaaatcatgtcatcaacatcatggcaatgtggcgctcatgtctccacatgccgcatctcaattaccttcccaaaggtaattgcccaagcatatagcatttgataattatgagtatgcatgattctagaatagcatttctaagcatttgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcgaggtcccgcgggtcttgtccttcacctggatccgcggctccctcggtctctatagttacgtgcgaaaattgatttgaattcggttagaattcaaataaaaatccaagtaaatccaaatggaagtcgaatgcgaaagtcgattcttttatattaactttactattcgcgaactagggcaaaccccatttcaatttaaactattttgcgagtataaatattttgttgtcatgagtttttaatttaacctacccgagcaacatatcaattaataggttagaaatttctatcgcgagctaaacatcggacgaaatcctagaatattatacgacttaatttagtctatgattaaatataatacacggctaacatcctagtaattaaatccgaatcgctaccgttaatcgattacttatagagattacccagaaataatccataataatttacgagaattcatacatttgtttaattattaattacatctaaattaataccgcgaattgattccttatggagagtaataaaataatctataatctataggaattcatccaattatattttcattaatcctatatttaaaagccagtgttttaggtatttaattagtaagatttcatctaactatattttcattaatcctataattaaattctaatatttgcaaatattttaaatttcccccaaaatttttcctttttcttttccctctctctctctctttatttttttcttctcttttctttcctttcctttttcctctcctctcttttcttttcctcttttcttttcttttcattctctcctctcttttcttttcctcttttcttttcttttctttcttttctttcttttctccccctctctctcttttcttttcttcttcctactcctggctcctttctctcttcccttctcttgtctcggaactctctctctccctacccgtggcggcggtgacgacagcacgcacggaggaagggggggggggg

SEQ ID NO: 10910 - DNA, 2137 bp, Oryza sativa
tttttagggtttttctctttataaaatcattttaactttgtttatttcttaataattattatttgtgctctgaaaattccactaaaatttatttacacattttaggcttttagaaaatatacaaaaatcctccaagcccaatttgacttttaactttgcacattttaatttttgaaggctttcacaagcattttaattattctaggcataatttagaggatgtattttagggtcgatttgggacgcgacaattatgcaattgatgtctgaattgtatggaggggctaggaatgtaccctacactagaaaagacataagcaatttcaagtcaaagttggggagcgagtataggagtataggtgtagagatattcctgaaacaattgctcacttcgaggaaatcaaaaaggatgacccaaatttcttctacaagattcaacttgatagggaagacagggtgcagaacatattttgggttgatggagcagcaagaaatgcctacaatgacttcaaagattgcatctcgtttgactgcacatatatgacaaacatgtataacatgccttgtgcaccattcattgggataaacagacatgggcaatcaatacaggtactccttttttttgcaaaaaagtaattctaaaaaatctgtaataactttggaaattatagtacatcataagttacttgttgcattcattgagttacatcaagtcctgataaaagttacttccagtagaatgtgaagttacatttttttaaaaaaaaaaggtaaaaaagtaactaagtttacaagttacatttttagtgtttgttctatagttcaaaattgtactgatttacttccagcaaacacaaactgtacaaactacgcaaaattgtagtaacttacttgcttcaaaactgtactgacttccttatgtgtattatttttgatattcagctgggttgtggatttctatggaatgaaaagacagaaacctttgtatggttgtttcaagcatttctagaggctatggaaggtgtagagcccacaaacataataactgatcaagacctagctatgaaggcagctatagcgctagttttcccacatgctaagcatcgcaactgctgctggcatataatgcagaatgctcagaagaagattggccatatattagatcatgacaaagcattgtgtgatgcattcaatgactgccttgacaacagctggacagagcaagagtttgatgctaaatgggatgcaatgttgacaacatatcatttacaagatagtgagcacttccgacacctttgggaaatgagacggtgttgggtcccagcatactttatgcactgtttcttccctttcctccagactacagcacggagtgagggatttaacgcagtgctgaagcgctatgtaaatcctcaaaacagcatatacaacttatttttgcagtacaagaagattcaagaaaaaatcactgttgcaacagatcagaatgagtttgaagcagaagaaacaatcccttctatgtgggctaactatcccatggaaacaaaagcattggaggtctacacaaggcctatattcaacagatttcaaaaagagcttattgcttcaacatcatataaattgacctgaacttctgaaaacatgtatctagtagacccgaatggaggtcctgttaggaattatggatcaagggcattcattgtagctgcaaatgtgttggacaggatatacaactgtgaatgctgtaagttcgaaagggatggcattctttgctgtcatgttctgaaggtaacagtctgttattgcagtaagctacttctcactgtgcattaagctacttctcactgcacattaagttacttcttaatgtgcattaaattacttcttatgcattacgcacttttggcaggtaataaaacatatgtttttttccatgcaggtgatgacatttgattttgtgggccaagtgagtgacattccagaacactacatattgcctagatggacgatggttaaagagcctgaattgcctccagttacaagcattggtgaacaaatgcaattgccccctaaatctctgaagctaatcaggtataccaatctgtgcacaaaatttacacagattgcaaaagatgca

SEQ ID NO: 10911 - DNA, 1601 bp, Oryza sativa
attgttgaaacttacttgccagttgcattaagttacttttagcttccatagtagttacttcacagtgatatgtaagttctcaggaagaccatgctgagttctttgcagaaccaagatgctattttaatttgttacccaacctaatttatgtggctataacttatgtgctggttctggaaaaaaaatgcagtgtttcattactttaccttaagtgtaggatcaggctctttgccccataatacttgcatccattgcacacgatttccttgaaacgagagtatcttgtgtgtaagtagtttcttaatgttggggatgtcacttggttcaaatgctggcaactgtttgccatcccacaactccacaaatttcagcatataaaaaccccaatcccggctgtttttgtttgcaaaaacaaaatagggataagtttgactaaagacaataaatgaaaatccctaactaaaaaaaagcatgttacgtacgtgttatcttgctttgggccatcaatgaaaatcagtgggtaattctagatggttttcttcgaaaacctcatgtaaaacctatcccacatggtcttgatggatgcaacaacaagatgagatgctgaaatcagtgtttcgtcatcttctcccctcagcgaatcataaacctcgaatctttcagctttcagattaaggcacaccacgaaatagtgactagccttatcattcccattacccaattcttggagaatgggaaaaaatgcctgcattcaagtaaaaagagggaggggagtggaaagaaggtttttcagtaaatataatcatgatttagtaagtataaaaggataataaaaagtgattcaaaataacatttcctgtcaatataacagaaaaagttacttccacaaacatgctgagttaatttgcaaagacatttaagttacttctacaagcagacaggaaaaagtaactttacatatcattgacagctggaatatatattttcttactaattctttatggtcaagatggttcgctctcgtttgatcgaagtgtttcttgagctcattcctgtccaactgcgaatccaacaaatatccctgcaccatgtggaaaaaaaaacataaggtgttgcaatgatagtaatagtacattaaaaagagattttaatttgtaaattttatatactcactcctattctggcaggaaaaattctcttcgaattgtccttgatatcagtagacagaacaattaatgccaattcacatgtgttattgtccagtgagcccataggtttgacagagttcgcaagatcgctaagataaatataatattctcctgtagcaatgatcttttggctacatttaccaaaagcaaaaagaaaaaaaataaataagcaaattagtataccatgtacaactactgtagcatgttaaattaatttcaatgacatggtaagtaactttcaatgacatgttaagttacattcagtgacatgttaagttactttcagtgacatgttaagttactttctatgacatgtaaagttactgcacaggggtgtgtagaaagtttgtctggaaaaaattgctcggtcgtgtgcagaaccaatatgctcac

SEQ ID NO: 10912 - DNA, 7024 bp, Oryza sativa
tgtatcgtacaatctcatacatacggacagtagcagctagcgtttgtatgttataaacatgtggaagttattatttttttaataatagatctaatctaatggtgtaaaataacgggtccacaaatttaagtgaaaatcaacggtaagattagatagtgccatgcggcgacttaggaatatttgtaggagtgccacgtggcggctttagagcgtttgtaggaagtttaatggacttttagtatataatagataatagatagatagaagatagatagatagaagatagatagatacaccatccattgaatacatagtgtctacatatagtgtctatatgacatgacaagtatggaaactaatagtttattggttggggatggcctaattagtcgcttgactgcacgctcgcccgaggcagcggggcccaccagcgcgtctgcatcgccatccactcggcccgcgtccgccggtatcaccaccagcgcgttcgctccgcttgtgttccccgttgttgccgtcacgctcatctgccgtcgtcgcgctccaccgggccgccgcctcatcgaccatggccagcgtctccgtcgccctcatctgccgtcgtcgcgctccaccgggccgccacctcgtgcaccatggccggcgtctccatcgccctcgtctaccgttgtcgccaccctcgtccgccatggccgtcgtctccatcgcctctgctcgccttggcagtggcccttgcccaccgcgaccgcctcggctgcggacctcgtccacggcggcggtggccgtcgccgttgtggttctcgtccagcccggccgcctgaataagcaacccggtgcttcaattggtggccggggggccggccgtgttcttatcttaacgggttgccgtggtcaccggtgtcaatcttgtcattttggcccacatccacggcgccgggccgctgtcctggtcttcgtccatcccgctgtcctcgcccacatccgttgcgccgcgcaatcttcgtcttcatccatcttgtcgtcctcacacacacccgtcctaccaccatcgtccgcctttgcagcggccgccatccccgtccaccacagtcgtcgtctcctagtacaccagcgccagacgtgcacgcgggccggaccggatgaacccggcggccatgatgtactgatgttcgtccttggacttgagcacgtgaaggataaaacattcccacgcatctcctcctccggcaagaaagagagtagagggatggtgggcctataaaaacaaaaagaatatttgtgttacagtaagtatatgatatatctattgtatcacttagctataatgctttctccagggattcagctcatctgacttcacccctcatgacggcggagagcagtcgaggtcatccaactgtccacgttcgattgaaccgtccgcccagaaatacaggtcagccgcgtcgtgagtctgggccaaggctggcccaacaagcctcgtcccagcgccatcgctcctatcttttttaccgcgaacaaacgcgttttggcggtcgcgctcgcctttttggcgccaaacgaggccatggccccaggcgatcatctgacaacatgctgggacagcgaaccacggattcaaccattgatcaagcacaggtgaagttctggcctcttctcttccttttttttagcaaattatttgattgtcttccacctcctccattagactgttggaattcatcaaagaagcctccagcaaaatctacatatttgagatggaagaaaacaggtctgtaagctatggttgttacttttttcaccatgatcgggtagattttacttgttcgatgaccaccaaatcattttttttgttcctgtagagtgggtgtgctacctagtttgttacctgaagttggcatggaattcaatactgttgatgaggcttggatgttttgggttagctatggtggtcagaaaggtttcgaggttagagaaaggtactcaaacaaaaggaaatcagatggaaaggttgggtcatgcatatatgtttgtgcattttggaaaaaaaaaaccgttggttctcttgaacaagccatatgcccagaattggaacataatttcattgcagtgataagttacaaatggccatttcatcattctgttggacaagtcattctcattgcaaacaatttatagagtttttctgctttctatacaaattacagaacacatgcaaccccatttttcagaacaagtggtctgcttctgctgcccgtgtaaagaacaatctatcattcttataactgaacattcagtatcttcagaatgccattcggtttggtcagacaagcaacaaagcaacactcctagacgcagcatcaaggagctgaagaggaggccgctgtgttcctccactcgctcactgctgagagatggcgatgaggagttcctcctctccctgcctgccgaggcccgacgcaggtaattcagatcaacgagcagctcaggcaccacagcttcggtcttcctctgatcggcgaaatggagccacgcggcgcgcgcactcccctcctccattcgccgcgcgctgcctgtcgcggcgcatggcctgctcgagctccgcgcgcgcacatcgagctcgtggcaccgatgcgccgtggccgtgaccgggcgctgcatcttgcgcgccttccggtccccatcttctcagccgagtaccgcagcctgacggcgagagcgagggcggtgaggaggacgagcacgacggtgagagcgagggcggcgaggaggacaagaatgacggcgatggcggtggccagacgaggagtacgagcacggctgggggacgaggcttgttgggccggccttggcccagactcacgatgcggctgacctgtatttgatgcgcttcctgggcagacggttcgatcgaacatggacagctggatgacctctactgctctttgccatcgtgagggttgaagtcagataagctgaatccaactccagatgatgtgcccatctattgcagccgatagttggctatgttattgacctcattctaagctcgtaaaatctaaacggagaggcctctccatttagcgctatcgtgcgacgcgcgtggcagccgtggtgacgtggcgtccatcacggcgcgcgccgcgcgtcccgaccggccgaccgagcgagctcacgcgtcgccttttccgaccgaacgagcgaagggtactgttcaaattttttgggtggcgctcgacgagagagagagagagagaggcggagagtgagagaggcggaggtggcgtgaatctctggcgaaatccgtggcggaggcggcgtgaatctccgacgaaatccgtggcggaggcggcgtgaatctccggcgaaatctgtggcggaggcggcgtgaatctccggcgaaatccgtggcgaaggggggggtgcggggagttgctgttgtttcctcccatcgcgccggcgtcggcagagtcggcggagccgacggtttcctctcatcgcgccggcagttgcggtgggaagcgtaggctgcggcggaggtagttttctctcctccaaatccggcggccatttttttcggtaagttgtggcggtttcattgcggtttttttgagccaaagaggtggagtgatggggctgtttttccctgcgttttttgtgccggggaggtggagaggtttgggcagtttttcactgcgcaaattgcttctcaaacctcccggtttgttctcccctattccctcatttcccctctctctctccctcattcatcaggtgctagttcatcctctcggcgagcgcaaggttgcggtggaattcgccccctcaagcgtcggcttgtggatctcgggttccatttgaaggtatttaaatttctctctctctggcttatgttgatttttccggttgcaagttgattactagtgattactatcatccaaaatgaatttctaaaattattactaacattattagttgcaagttgattattagttgatcgatggttagttgcaagttgattactaacatccaaaatgaatttccaaaattattactaacattgttagttgcaagttgattattagttgatcgatggttagttgcaagttgattactaacatccaaaatgaatttccaaaatgattactaacattgttagttgcaagttgattattagttgatcgatggttagttgcaagttgattactaacatccaaaatgtatttccaggaatgggaaaaagaaaaaccattgtacagaaaggcatgttaggcaaaccagagccaagtgaaaaaacaagggggggttcgcaacgtgctaagaaaagaagtattggagatgatcatgcagatgacatagaggaacctcctccaaaaaggagcagatcaaaggtattaagcatccacctttttttatgcattttttgccctcaagcagtgtttcgctttttccaatgcactatattttcttatgatgcattaagttacttctcactgtgaattaagttacttctcactatgcattaagttacttattttaaaattcctatgagatttccaacaccagtactcatggctatgtaactagggaatgcaaattcaagtttatttttggaagtaacttgcatgtttctaggaagtaactttttgagttttataacgagtaactttctgttcaaattgctctgagaggcaactagatggaatgtatcatgctgtgtaactagggaatgtaaattcaagtttatctggaagtaagttgcatgttcctaggaagtaacttactgttttgttagaagtaacttcctgtcaaaattactttgagattttctgttaacaagtaagaagttacttctcgatgtgcctgaagttacttctctctttgcattaagttacttctctatgtgcattaagttacttctcaccgtgcctaaaatatttttgatgctgctgcttgagggcaagttattttctagaactaacttaatggcaagttacttcttggttcagttacccttttttcaactgttttatatatgttttttaaaaaataaacaaatgctgatgtttttttatttttctttttgttgttttatacatttgcagcaagaaagtagcagggcttcacctatgaaacttataaagttgtatccccatatgagtggcgaacaaaagcgactaatagagggggctggcttccatggcctcgtagatctcaagtgctcgaagctcagacctgatttgtgcagctggttgatggagcatttcaatccagcaaccaatcagcttgtattccctggacgtggagccatagatgtgaacgaggagtcagtgaagtctgtacttggtatcccaatgggcgacaaggatgtctcatatgagatggaatctgaagctacagaatttgtgctgaatttgcttggaatcaatgatggtatctcaccatcactgacttctcttgggattcaattggagaagttgaagttagcagatgacaagtacctgcgcatgtggatcatctacgccatttcttctgttttagcaccaacgacggcaacaacagtcagcccaagatgctatccttctgttgttgatgctggaaatgtcaagaatcttaattggtgcaagtttatcatatctattttgcaaaaagctgctaaagctgggaagaataccaactcagcatgtctcctgtatatgatggtaaaacccccccaaaaaaaaaattttggggggttttttcaatgctcgcctttttttatttgatcactgtcccaatgtaacttttatgttttttagaagtaagttaagctgtccaggaagtaactaacatgttcctaggaagtaacttctttctgttaaattgttataaataattttctgtcaagtaaattctctctgtgcattaagttacttctcactgtgcattaagctacttcttattgtgcattaagccacttctcactgtgcattaagttacttcttcatatatgccctgccacatctttttttccaatttgtttttaaatttaaattacatctggaagttaacatattttgtaggttttaaatcaaacaagttatgtactttttttaattaatctaaatgctctaatttcttttgtagattctttatttggactcgctttcgtttaaaaatctcaatgttccagtggagggttatcgagctactgtttggacgaatgaaatgataaatcaagcaatattagctgacacatcagcagacggctcctttggagctttaccagtgagttttttttatagttggcatacttgcatcatttttagttttttgtttgttcgtaacttacggattttataattgaaaatatagcttaggagcagttttcagcatgaagggaccaatttgtttgggaacaatgtagatttttcaacccttcataaattcaaatgtgcccaatactatgcagcagcaggtttatattttttccccacttctctgtttaactttttgtacccttggtaaatgtaacatcaacaaactgcaaaagtaactttgtgaaatctgcatatgtaacttctctgttttttctttttatacaggaaaaggacagaattgtgatcgctgtgcaaaatttgtgtgaagggttttcaggtttggtcacgaaatttgtgagacagatttccggccttgattttgtggatcctaggggtagccaaccaaggaaaatgcgaatgaaccggaagaaacttgcacaatggacaaaaagagttcagcaagatgaagatctaggtttggttttttcactatgtttctattaattattgtacagaataattaatttagccatgctctaccactctgcacaatttgaatctcattagtatcattgttctaccacactgttttttttacaatgatttcaactgaatttttagtttttttacatttgtccaaacaacttcctacaatacactaagttactttttgttcttttttggtagatgtaacttcaagtgatgatgaagattttgttgctgat

SEQ ID NO: 10913 - DNA, 719 bp, Oryza sativa
agtgggtgtataaattaaaaggaaagctgatggtaccctagataggtataaggcaaggttagtagcaaaaggatttaaacagaggtatggtattgattatgaagatacctttagccctgttgttaaagctgccactatcagaataatattgtctttagcagtgtctaaaggttggagtcttagacagctagatgttcaaaatgcctttctgcatgggtacctagaagaagtttatatgctacagccaccaggttttgaggatcctactaagccacatcatgtgtgtaaacttgataaagctctgtatgagttaaaacaggcacctagagcctggttctctagactaagtaaaaagttgatggaccttggttttaaaggatcaaaagctgatacgtctctgttctttctgaataaaggtgatataactatgtttgttctggtatatgttgatgatatcattgtagccggctcttcagagagggccactgcagctttacttcaggatctaaaaggggaatttgcactcaaagatcttggtgagctgcattattttctcggaatagaggtaagcaaggttcagaatggcattgtactgaatcaagacaagtatgccaatgatttattgaagaaagtgggcatgataaattgtaaacctgcttatacacctctttcagtaagtgagaaactctctcttcatgaaggctcattgttagggcctg

SEQ ID NO: 10914 - DNA, 9615 bp, Oryza sativa
aagggggaggccagaggcagcgtggttcttgtcacaacccggtttccatatatagcacaaatggtgaagacaactaatctgatagaactgcaaggtctagaacacaatgagttcttcgcattctttgaagcatgtatatttgctgattgcaaacctgagatttatgttgacgacttaattgatattgcaaaagaaatttctatgaaattgaagggtttcccactagcagcgaaaacagttggccggctattgaaaaagaacctttcccaggaatgttggatagaagttcttgaaaggaatgagtagaaaaatatgcaaaatggcgatgggatgatgcctgcactaaaaattagctatgattaccttcctttctatctaaaaaagtgtttttcatactgttccctttaccctgagaactaccagtttaataatttagaaattacttttttctgggaagcaataggcatcataaattctagtgatcataataaagctgaggatataggattaagttatctggacgaactagtaggtaatggctttttagtgaaggttagtgatgataagaggcaatattatatcatgcacgatttattacatgagttagcacaaaatgtttcctcacatgagtgtgtcagtatacggtcatatagctttaggtcaaataatgtcccacaatctgttcgccatatatccatcaccttacaagataaatatgacaatgattttgagggtgaaatggaaaaattcaagagaaaaatagatataggaaatatacggactttgatgtattttggagaatacaataaagatatgactatatttttcaaaaatatattcaaagaaacaaagtgcattcgtgttctatatatgtttgcaaactcccttgaatcattcccatacaacttctcaaaattactccaccttcgctacttaaaacttgaattaccatatgactcggaattttctttaccaagtgcaatgtgcagattttatcacttaaaattcttggacctagggtatagtaagtgtattttgccacaagacatttcttgcctagtcaatttgcgccatttaatttctaaaatggagctatgttccaatattcctgggattggaaagatgaagtatttacagtggctggaagagtaccatgttaagaaagaggacattggatttgaactgagtgagttggggaatttgacagagcttggaggagagctaaagatatttaaccttgaaaatgtggcaacaagagaagaagcaaatgatgctaaattgatatcgaaaaggaatctgaaagcattgacactagtttggagtgcaaagcaactctccataggatctggcgttcttgatggtctgcaaccacatcctaatcttagagcacttgacatacgaaaccatggtggttccactggacctacttggttgtgtggtgatgtttgtgtcaaaggcttgaaatctctccatctaaaaggcttatcttggggaactttcccacctttcgggcaactaatgcatctggaggaacttactttgatcaatattgctggcatacgtaagtttggacctgattttggtggtgttacccaaaagagttttttacacttgaagaaaattaaatttgttggcatgccagaacttgtggagtgggttgggggagctcattggcatttgttttcaaagcttgcaagcatcagatgtgaagattgtcccaatttctcggtgctactgttgccattctctaagtgctctgtcatttgcacacaagacataaacacagtatggttcccaaacctgtgttctcttgagattcgaaattgctccaagttgtcattgccacccatgcctcacaataccatgctaacacgtgttactgtgaaagaagataatcaagcaaagctgcattttgaagaagagacactgagaatagatggttatgggggtgctttggctttccataacctggacaaagtaaaagatatgacaattgaaaacatgttccacatttcattgactgatctccaaaagctgaattcattaacaagccttgatgtcacaggatgcaaaagcatgttatccagtgaagtagacaatggttttatcttttgttcagttcagcaactcaatctcagagattgtcatcttaccgaaaaatcattgggtaagttattaaattgtttcccagctcttacccatttcttcttgagcatgtttcctgaatctgaagaggaagaggaagtagtactgcgattcctatcgcccagctcattgcacgttgcctcaatctcaaatcacaggaatctggttcttccagtggaggatgtggatggaggctgtctccaacatctctcctcactcgaaacactcgagatcgatggatgtggcaacatgttttctcagtggtccatggtagaggcaggagctcagaccaggaagcccttccctacttccctcaaggaactcagtattgtgggagagtcaagcatgcaatcgatggctccactctcaaacctcacatccctcaccagtttaacactaaagcactgtgttaacttaaccgtggatgggttcaatcctttcatcacatacagccaatactcttataaatagagaatttttacggcaataataatcatcgctgctccatagcaacggatatgttctcagaggtggcaaggaccaaagttatgcctgcaggtggctccttccaacagctggtacgacttgatgtggacagtatctcagcagtgtttgttgaaaccatttgtagcctcctcgctgcgaccctcatcgagttgagattcacgtctgacttgattacagaaagcttcacagaaaagcaggagcaggtacttcagctccttgcctccctccaatacctagaattctatgggtgttctcgcctaaagtccctccctaaagggttgcatcgcttttcttctctctatggactagacatctctcgatgtcctcaaaaagaatgttgccaaaggagggcttccccgcttcactgcaagatctaagtatggaggcatgcagcatcaatctaatggatcaagtcaaaaaattagaagcatcaaacccacatttaaaagtacatgatacatcagtgacttatatcgtgaggttagttcatcgaaaaccaacttattaccctcaatttttgtgattttttctgcactaggcagtaggtactagctagcaaccactgtggctttcagcccctatagtccatagagttcctttatctgttatctaaccaatgttacattagttgtacaattatggtagtttactacttcctctgctattacacttttttttcttgaaacagaaaggtgagagcaagatgtctcaggggcagaggcacattgacccagtatggtccactgggcacaatgtaaatttgcttctcccctgttgtcagagccatgtggatacatgatttgcattaccagtgggatctcaactcctaagccgaactgtcagcaagcccaagataaactctttatcttgatcagatcctttaaaccgaaggtactttcaatttcttccaagtatttcactttatcttcggtgtaatcacaattttctgtcctgaggacttgattgattgccccccccccccctcccaactgcccaagtggcaccgcacacccacccaaagtatataatagtgtcaatatagttggtatatgtcagggaatacaaggcagcgaattgaaagattaaatgtactccctcattttcatattataagtcgttttgactttttcttagtcaaacttcttttagtttgatcaaatttatagaaaaacatagtatcattttcaacacaaaacaaacatatcatcaacatatattcaaagtaagatttagcgaccccgcaaaaaaaagtaagatttagcgaaaccgatttgatgttttagacattgcttttttttaataagttttatcaaatttaaaaagtttaactatgaaaaaagtcaaaataatttatcatataaaagggatgtctactttttcttagatggttaatgaaataaccctcgtggttagatattgtgttttgatgctgatggtgctcattttatatgtgttttatttttcgggaatacatttttatgtgtgtttcgtactcctactttcaataatgcacttgcgatagcgatacaattatcttgttttgttgagcattaatgtaacatttacaaatgaatggttccttttgtactagattcaccctggcgagcctttttcagccatgtagtacggcaaatgtctgacgacataatataactcctcaaaataacgttaaattaatttgggacttgcttttgcatttgcttcctcaaatcaaattgtttccgtgagttcaacctggagattctgcagaacagttattacagtccaatgcattgttttttccaggtggtttccaagacaaattggtgttccatcggacgagtaatgcagccgccatctgtcgttatatcttgacagagccgagaaggaaaatcctccagagattaggcaccatttgcatggtcagttgattctccattagtccattaccctacccttgctgctcctatagaagctcagaagcgcttgttttgcgatgaaccacttacactgtatctgttcatcattgcaggcttgcagcaaccggatggcgagcaaggttacagagacggcgccgggggccctctccaatgggctgtggcttgcctgggccgaatgcgctcaaacaaatcagcccatgtgtgtgtttggggtggcccaggggccagccagactcttgggcttcttctctctctactccaccacgcattgcaagcagagaggcgcgaggtctcttcttcctccacgcatgacgccttcggatgagtagcgaactaacgatcgcatcctgcacgcatctcacaagggacgccgcgtcgacgccgatgccatccgccgtcacgatccgcagaagcatgcatctgctcaggcgcctcgcgctccctttggcgcgggatgatacgcttttagatcattggatggcagcgggtttgttcgatcgagggataggtttttgcttctctcgaggctcgagctatctccctctgcaacccttctcgctttgttcgacggataagttttagctgtgattggtggtgttggcgtgggtcgttcagtggtgggttcatgtctaggcttagcgctctctgatcttgcttagcggtggttggtgcagcgttaattttcttttattgttatatctatctatctatctatctatctatctatctatctattatatactaaaagtctattaaatttcctataaacgctcctaaaacgccacatagcacccctaaaaacactcctaagtcgccacgtggcgctctaataaattttagaatccgatggacccgttagttctaaccattaaatctattataaaaatacaattaaatttatctaaaaactcttattgtacgtgcacatataggtattccaaaaaaaacaaaaagtacgtccatattttgatacgtacgtacgacgttgggcccacatcattcttttttttctatctcacttattatggaaaaccaaactgtctatatttactatgcaaaatatatgttatttagagtttctaattaggcgcatttcatggaaacatccatgaaaaatataaataaaataaaaaatagattatatgatagctaaattaggctttcatttctaaaataaaaacaactctaattgtgactaacaattctaaaaaattttccactccctaggtaaaatataataatatgtcaaaatgatattactaaattatcatgaacgtattttcaggtattatatgttttctctattctataatatttgaaaaattaaagatcttatatattcttttgacaccatgtcgatgtcttctatctccaacttaattagactttgatctagctcaatagctgagcttatcttggacacacgaaacgacacatgtcattagtgcaagattaattaaatattaaatattatgaagccaaaaatagatttagcttttatatagaatatatttctaataatacacacgtttcacttaaatatatacaatgtagtccatgattatcaatttatttataaggaatataatggtttagatggacttagatattgttatcaaaaggtattaatttcttttataaaaattcctagaacaatcgaggaaacgtgctcataataaataagagagtagccaatccgataagtactttacaacttattgcatacatattaaaacccttaatatgtagtatataatatactttataaatacaaaatagtctaatacaatcgtatattcccactaatcataagtatataagttctgtattagtgggaatattgcttacgaggcattcgtgcacagtgcacctaataattagctgatatccaataagcacatgtgtcatcaagcactgaagataggactatactaagtgggcaacttcaacaaatgataggtaagaagagtatgccactaaaccacaacaaacaatagttgacagtgagtaggttgccagtgtgagtaataacatttctacactcctacaagcactcttaagatgccacgtgacaactctaataaattagaaaaaaaataagaaaaattataagaaaacaaaatatttggccattgatatacacgtagctccattattttcaaccattacattagatctattccaactaaaaaccatttaatcccttcgtatgtacgtatgtacacaagatatgtaaaaaagaataaaaaagaagagttcatatacgatctgctctatctgatagtttttttttctttaatttgaggcactaaagtttttttctcaaattgtgcatatatgatatatgtaatgacactcatggcaatcttctcgaagaagtcgtgtcgctgtggcaccgcttcatgccatcccaccaaattttttgaaagtattttttttactaaccatgtaaaaggcaatcgtaagcgctcatataaatgtgtgcaccccatcctatgaatacacatactactattcacaaaaagaaaatatacatccttagaataaaaaaatgtcacatggaaacatattatatccttatgtaattatgccattctcatataaaaagtgttaccaaaattagcacaaataattttgacaatggattattccttcgtatattacccatgaacatgcgcaggtgacttagatgtatagtaaaagaaaaaaacaaaactcatattaactcgtatgtttgtgaaagatggtgatagacgagtttacgtataaccaggataaagtgaatttgtttgaatataatagacattgtcatttagtatataaaattttatggtttatttcatggtgtaagtatttctttcttttatgattataatgtaatttatagttattacagttgaatatggtgagatacgattttttatattcttttttataaacaacaaataaattacccatgcatcggcacgggtttccttgctagttatatactaaaagtccattaaacttcctacaaacgctctcaatccgccacgtgtcactcctacaaacactcctagaccgccacatggcactatataatctcaccgtcgattttcacttaaattggtggatccgatattttagaccattggattagatctattattatttaagaaagtaatcccttcctctactgtgggccagaaaaagaaaaaaaaattatgaaaaaaaacgtccgtacttacgtgtggcttcgtataaccgtgggccggaaaaagaaaaaaacataagaaagtagtacgctcttcctgtctcttcctctcctattcttttatatctccatctctttcttatcctaattattttatattatcaaattaaaaacaagttaagttgaccataatttaaatgtacatagctaatttatattctattaaaacattgctctatttataactaaattgacaattttacatccaatgttttgctatatataagcaatatgttattgtggtatagactgtgcattttgcaagtttgcatgccatctaaataaattaaatacttattaacaacatataatatatctatatatctatctatctattattatatactaaaagtcgattaaacttcctataaacactcttaagttgccacatgagactcttataaacactcctaagccaccacgtggcactccaataaattagaaaaaatatataacttgaactggtgggccaattggatttatctcataaaaaaatcattcctcaactactaccgtacgttctcatctccttcccctcaatcctttctcctcatccctttcttttttttctctatggtagttaagatttttgttttattacttaataattaatttcttcacttctatctcacgagaatggccgtggattcttgattgcatgtcccatgcctaaatatataaatgattaatgatctgatgcatgcttttataaataataaatctatttttaaccaacaatttagaaaaaagataatagttacatagcaaaataatcataattttaaaaagttactccctctatttcatattataagccattttaacttttttcttaattaaatttctttagatttgaccaaatatataaaaatatttaacaacatctatcacacaaaattgttttgttagatataacgttccatatatatccataatatatttttttttgaaaattttactatattttctataaacttgttcaaacttaaaaattcactgaaaaaagtcaaaatgacttataatatgaaacggaggttagtttgtttgaacggttgtttcataattagacagctaaataatttaaaatcaatattaccaatatttcactataaaaaataaaatatgttatttgaatttccacctattctttacctgacaacccaaataacatcctatttttaatttatttgaattgttgatttatgttactcatattttactatgaaaaatttaaaatacgtaatttgaacatagaccaacaagcaaacaacactgaaacattaaaaaattgacaatatatattatgtcatcttaatcattctacataataaaaattagaaaaatacaaagtcaccatgtatgaccttttagagacatgttaaattaccaagtgtcacatttaaaaaattagtaaaatcttatatattaaaagaaaaaaataaaacatctagctaacggttttcacctagatcgataacctattaacattattttcaactatataatctacttttagaaaaatatatcttaataagtggcatgtcacatcttttaaaaaaaaacctggcaaatcttaggaaaattacatctaataattggctttcacttaatcacttagaaaaattacaaaaaaaatcccctccacacgcgcccatcactacacacccgctccttcccctctgtggctcaagctctacacttttcattcctcttacgttcctatttaactaaaatataaataatctataattataagtttcacgtctaatttctaatctaactattgctctg

SEQ ID NO: 10915 - DNA, 30292 bp, Oryza sativa
  unsure (1)..(30292): unsure at all n locations
aatgcaacctacgatatatgccggcgcgaatgcgcgggctaccttcctagttatatactaaaagtccattaaactttctacaaacgctctaaagccgccacgtggcactcctacaaacactcctaagtcgccacatggcactatctaatcttaccgttgattttcacttaaattggtggacccgttattttacaccattagattagatctattattaaaaaaataataacttccacatgtttataacatacaaacgctactgatgttctttccgtaacatacaaacgtacatgattgaaaataaaatgatcaagctttcttaaccttcgctggaagaaaaaaaaccatacacttggacataaaaaagacagaaccaacatacatccataaaaatcaaccgtttttaaaatatgattttctacaatataaagataaaatatattacttcacatgtataaatatatttagttaaattaagatctataataaatatccaatcaatgttctttaaaccatcttctaaatctatctattatatactaaaattacattaaactttgtacaaactcttttactctgctacgtggctctcaaataaattagagaaatcctagaaatctattatatacttaaaagtctattaaacgtactgcaaatgcttccacattgtcacgtggcgctttaataaaattacagaaatcctagaaattcagaataaaaaaagaaaagcatccaaccttcagttttcacttaaattagtggacccattattttaaacaatggattagagctcttaaaaatacgatgatgctaatctctatcctggaaaaaacataatgcgcttacgtcatacgatcatctccctcccggaaaaaaaacaaaacttaaatacctacatcatatactataaaaaaaataaagccaaaaaagaacaagaaaacatgcataggtacatagtaaaatcggaaatatatactaatcaggaaaaatcatcagtgtcggcactgatttgttgtcaacagcctttaatctacgattttattaaaaataatactacacatatatgcacaattaaacttaatataaacttattatagtgataaatatatcatgacaaatgacggtaacatgtaatagttaatgcgataataatgtttcaaataatttcacatcatattttacagtgtcaaatatcacttgacaaaaatatacaacatcaattttaatctacatgtgtaaaaattaaaaaaacaaaacctatcattgttttttaagtacatctgtttaggtttatttaattttaggagagattgagattctcaaagtatttcgaagttttcaaaaattttcttatttgaggtgtgagaagcacaaataatagatagatgagaaaaattaaattaaattttagccagtgataataaaaatatataatttagctttggtttttaagtagacctttttaggtttattttgggtgagattgagattctaaaagtatctgaaagtttttcaaaccttttttattgctatttgaggagtgagaagcatacaagatggatagatgtgaaaaaataaataaataagattttagacagttattttactacaatacaacccgtaattcatcacgagaattatgtatgttctttgccaaatagtattggaaaaaatgaataatccaataaaatatgcataaaactacttatgttatatttttttaattgatagaaattctaatatagcgggtataattgatggacgaatgacatataccactgaaactcagcagtaagtgcactctagtgaattagatagtgtaaataagtttgtgaaaataagtacattattacaattagtaaatgagtctcatttagttataaacaatatatggttaaaaaaaatctagcgctaaagtatgaatctttatcaaaatataaataatgatatggtgttttgtagattttcatggtggtacatctctttagctatagctctttttttctaagtagtgccgaatgattaaccccactcatttgaaaaacataatactgtttgtattgcattaaaatttgagaagcacttattactaacttcatatacacattgtctattctctaccaaaaatcgactcgaaactttaaaaaaaattgtttcaatcacctctctttctgtccctctttgtcctttaatgcaaggtgcagtacttgctatgctatcgtaaatattgcatgggcatgcacattgttgagttaaggtactgtccatgaaaggtcaccatagacaatgtaactaaagtgatagacttatcaatataatcatttgtgagtgtaacaatagtaaactaagtgttaaaatagtactctacgatggttttttaggggcatggctacatcgacgtggaacctatatgtttcaaggcattacatatgaaagccttggttggcagatacatttgacttcatccgttagagaggtattcatgtttatttttaaagatgttatcgtattattctgtagatatgttatatttatactatttatacatagatgtgaaaataagtgatgaatttttataatgtaacaataatgtatcatttattttagtggtactaatatagtttcatttattaaaggtgcacctaactcttaaaacaatgatagtaagtaatgatgataaacaaccagtttatatatgactaggacaaaggaatttttatttaaattcgagggacattcttatcacattagtagtatattaaaatctatcgtctattttatggtaaatatatttatttttttactgtaggataatctaaattcccttacactatatatagtgatataatccattttagcatttttttaataaaaaataagatgcccatgcatctgtgagaaattccttaccgatttatattctggaaatgttctccaatttatattacgtcgttatagtgtttgaacacaacctatgatacatgcccgcgcgaatgcgcaggttacctttctagttaatatgaaacatcgtactaactttgtagttttgtttattttaaaagatgtccaaacatgagtagggatggaggcatggagctactattgagagggggtgtctgattaagaaattttttaagctatattagttaatctattttgactatatatgtatctttctcaatgtaaatttaagaacctgtatcaatttaaatttggataaaaaaagagtaagggaagcatgtgacacccccttttcattttgctataactctgccctgaacatgaaagaaacggtgcggaaagagagataatttgcgtcctagagtatccgaaagctttagacactagattagtatgcatgcataggttcgtacctacagttcctaatctcttatcaatgttgacaacctttattggtgatcgctatgtaattcatatcatcatatgtggtggactacttcctcagtcccattttaagtgtagccaactcacatgccattaaggacccttgatgctgtactcttaatgtaacaatgattatcatgctaggctagtgtaccaataattgcagagcaatgcaaatcatttacacttaccacttgtgcaattgccatcgtatgagcaggattgcaagagacgactgacttgcagcctttcttgactactttactttgtttgcattttattagtttatttaaaaggcctgatcaccggatttagtgggtttaagtaattgggtttgggcgaaaaaaactcatctgtatcgagcgagcagccatcaccgatggggtcatctttgttggacctaaataaaaacttgttactgataaggttttacctagtgcgccaggcatcctataatccatcacgatgactcattcctgaanggctccaactcttactcataaaaggtgactttgtcatccgactgagtcttgctctccattcttggtccaacatgtgttgttgtccttcatgaatcctcgacatattagatgagggtgtatatctactcttccgacaaacatcttctcatttttttcaatctacacatgaacaagtcatagatcgtattatgtacacgtcaaaaatatcaatgacatagatggccccgttgactgttacaatggtactgacaaaccatgccttactagtctagactctagagcccacatgttgttatagatctaatttccgaccaaagatgataccaaaatatgaagcaactaaaccctacaatgacatagatggcccgttgagaatttgcttttcaatggagtagccatgtcattgtccagcaaaatcaagacaattatagagaaggtagtaggtgcgcgtgttgtctctgtctccaactttgccccaaatagacattggcaatagtattagtagtaagctttacttgactccaaatgacatgacttattttgttcttcccatagttggatgatatacggaaattcaatagcgacagtggctcgaagtagatcagcttcattcatacaaaggggtaaacgatgggcaactcaatctcccatctatatcacgtactagtacacatcctggcagaataactgctaggtttttcgatcataattttgatcatcgtggtttaatggtttaaatcttttttctgttcttttattaatgtgagaatttctagtcttcatagtataaatatggtggcttctttttaagatattttaataatataatgatccctataataaatagatagattggtagaaccaccgatttttttacatctaaacacatgcagtccaataattacatatgtgagcacgcattgtttggaatctatctattatatactaaaagtccatgaaactttctaaaaacactctcaaatcgccatgtggcttccttaaaacgctcctaaatcgccacgtgacattataataaatagagaaaattcgaaccattgattttcacttaaaataggtggacccattattttgagccattagatttaagctaatccgtatcctctcatctccgaacgccgcgtacctcctccccgcacgcaagacgtagatagctaggtacgcatctactcctctccatctccccttttttctccaaggttgttaagctacaaagcataatttgttacaataagttaagaattttggggggggagaaaaaaaggggcccccccctctcttgggggggcccccaaaagggggaagccttcgctgtgcaccatgcatgctacctaaattataggagtgatcacagtgatacacttgaactacacattcagtttattatacacttgaactactgttttttaatcaaatcaacggtttaagactcatattagttagctatattttggtggtaaagaattattacatgttggtctttttcaatttatcacatgcacgtatcattttcatgagtcctccccaaaattgaaggaaaccctaagaatttccttcaatatcaagtctaattttttattcaaatcggtggatcaattatgatacaataaggcaatagtaactaattaactacatacgtactctctcctcctcctctcctttctcattcaattcttcattcttctaatttttaactaattagcaacttaatataaaaacaaaaaataattagaaagctaaatgattataattcttaagttatatatggtttttatgttcaacaatataaaagtaaaatatattacttcacaaatataaatatatttagtaaaattaagatctatatatgataaatatccaatcaatgttctttaaaacatcttctaaataattcaagatctatattacccaatttcactgtaataatacgtcatttgtagacacctatgcgtgtcaaccaaataaaaaaaatcaaacaaactatatcaccttaaatcatcgtacattctcaatagagcacttacatgtcacgtgttatgtcttaaattaaaaacaaaatcttagaaattatagaaaaacacatttgaccaccggttatgaattaaatatgtatatccattattttaaaccattagatctattttttttaaaaaaatcttaagccgctaggtgttacattttaataattaaaaaatattattcgaaattttaggaacaaaacaataaatcatcgggttttatttaaatcatttataaaaactaggaaataaaccccgcccccaccccccaaactttaccccctcctcacatatgcacaaacacaacactacccgtcccctcatccccgggtcgcactttcccctataccctccttgatatttttataaccaataaaaagagaaataatcaataatattaaagcatacatatcttttgagccacacatctgattctaatataaattgctctatttataattaaaccaacaatttaaagatccataacgcctatattttaaacttaatttttcactaaaattagaacaattatacatgttcctattttttaagtgcttagatattattgactttcatgacattatgagttcctctgcacattattgtatatatataagccacacaatgtttgcggtttatagttggttgagaagttacatttgtaattactaaaatgttcagactcatattgactaggtattttcttttttttaaaaaaagaaagatactatagatcacacatatattagggaagggagatctacgatatatctttagaaatttatatataaatatataacaaattgcgtcaataaaatatattcattaaaaaataaaatatattcattttcaataatagttatttaggatttgctaaaaaaaagaaagaccctaaacattttattaaacaagacaaaacatcacatgtttccaaacaaattaaatctaactcctttctagataacgaagagatcatagataattgtttatatgaatgtattaaatattatgtatttaaaagctaacaaatagattggaaaaattatctaagcaacactgatgagataagttatggataaacagtacttatgaaatgacaagtgtcatctggctgatattctgccatcttatatatttttttcaaacataatttatagtgcatgcccgcgcgatgcgcgggctaccttcctagttctaattctaacaaaccttcgcacaagtacttgaccactgtcaatatcgggtcgaccaagaggacctaacgaagtagtatatgggggttttgcggtcttgtttctagcactaacatgcgagcagcccaatagtattaatcctcttctttttcttcaactaatagcaatagttttggtctcatagctcacattgtattgtagagcatatgtaaataatgtaagaaatacatatgctacaatgagttgtgaaatgaaaacaacacaattaaaccatgcatgctcccgtaatgatgcatttaaccaattggtgatgtgggttattgcgctaacgttcttaattcagcggcccattagtctgttggtcaagtggttcaatggaagcaccgtgcttcatgtgagcatcttgcctatgcatctaaatgtggttgttgcgtgcttatttttgtaattactggattgcatgtgcttacatctaaaaaattcgggtgataccaccacttaactatactaatgctccaagtggatacttctatttttcgagtagttgtgtcaatcaacaaattccttttattttacgctgacgaactaatatcattagaccacattcacaaatcaaggggctcctcatcttcgtcaccaccaggctcagggctatttaaaacaaatcgatgcatcttcttccatataaactaaataatccttttaaaagagaaaaaaacagaacaatccatgtccttatcaaacacaaaaattggtggtggcaatggacagtattgaacaacaagattttggacagaatcaacacatagccatgtgacgaatgccatattgatgcttgggacgtcatgaggcagacatcaaacatgagtagtttgtttcatcaagcaatcaagcctggtacaaatagaatcatcagggactcagagccaatctgaagtctgaaacttatacgtccagcaccaaacactcaataaacaagggttgtttatttgcatgcgtcccagatcccgcatcaagcaataaaggtgtatgatctgacaattctctattcagagctctgaccgttgctaacaggaatttcacttcccaatccatgctcataagcaccctatccaacttctcaaaagtttgattttgtagagcattcgcccacgtaaatttacgtccagtgagctccagctctctcaagtctaagctatctatgacagcgttaaacaagaaaggccacttatcactatacttgtcattgtttttctcgctagggtttcgaattatattgaaatcccctccaattagaatcggcaaagactcttttctacaagatctgacgagttcagtaaggaaagcctccttatactcctcttgcgcagccctgtaaactgctacaaggatccattggaaggcattttccttattccgcacatgaaactttacatagaagtctccttcatcaatactagaaacgtcaaaaaattccaaatttactcccaaaagaatacccccagatctcccttttggtctagtccaatgccacaaaaagtctttacctccacaaatgttcttaaggcatgcatttaaaaaatcacttttgcatgtctccaagagagcaataaagtctagcttttgctccttggttatgtccgaaagaaatctgaatttagccaagtcactaagacctccaaaagatccctaattttgatcgtcgcggtttaatagtttaaatcttttcttttccttgattaatgtgagaatttctagtctctgtagcaaatatggtggcttctttttaagatattttaataatataataatccctataataaatagatagattgataccaccacttaactatactaatgctccacgtggatacttctatttttgagtagttgtgtcaatcaacaaatcccttttattttacgctgacgaactaatatcattagaccacattcacaaatcaaggggctcctcatcttcgtcgctaccagactcaggactatttaaaacaaatcgatgcatcttcttccatataaactaaataatctttttaaaagaaataaaaaactgaacaatccatgtccttaccaaccacaaaagattggtggtggcaatggacagtattgaacaagaagattttggacagaatcaacatatagccatgtgacgaatgccatgacgtcatgaggcagacatcaaacatgagtagtttgtttcatcaagcaatcaagcctggttactggtacaaatagaatcatcagggactcagagccaatctgaagtctgaaacttatacgtccagcaccaaacactcaaacccaattaaccccagctgcagctggcaccatctttctcgatctgcaggcggaggagatccatccatggatgtggccgtcggtgcggcgagctggctcctcggaaaggtggtgacacagctgtccgatggcatggtggcggcgtacgtgtccagtacagagcttggcctcaacatggagcaaatcaagaccgatcttgcatacactcaaggactgcttgacgcggccgaagagagagatgtcagaaacaaccatggcctacgggtgctcctagaaatcctgaccaagcaggctgacgaggctgaggatgttttggacgagctccagtacttcatcatccaggaccagatcgacggcacccatgaggccactcccatggtagacgatggccttcgtggtcaagtgctcatccatggccgccatgctcttcatcataccaccggtaactggctttcatgtttttgttgttcctctgcacgagatgacgccgatgatccacatgatatacccaagtcccatagtgatgttcctgaccatgttagcaagttgacattcaatcgagtagacatgtccaataaaatcaagttggttatagagggcatacatgcctcatgtacacctgtatccaatttgctcaaaattatccatcctgcagtaggaagggcattaccaccgaagcgacctcctaccagctcaacaattacacaggataaattgtatgggcgggaaaacatctttaatcagactcttgatgccatgactaactttactattcatagtagaacactatcagttattcctatagttggtcctggtggaattgggaagacaactttcgcccaatacctatacaatgacaaaacaatagaggcacatttctctataaaggtctgggtttgcgtgtctactcattttgatgtggttaaactcactcaggagatcttgaagtgcatatatcatgctgaaaatgagggaagccgcagagtggatgaattatccaacttggatcagctccaaataaccattgcacaaagactgaaatccaaaagatttttacttgtcttggatgatatgtggaaatgcggtagtgaagctgagtggggaagcctattagctccattcagcaaaggggatgccaaaggtagcatggttcttgtcacaactcgatttccatccatagcacagatggtaaaaacaactaagccaatagaactgcaaggtcttggggatagtgaattcttcacattttttgaagaatgtatatttggtcatgataagcccgagtattatgaagacaacataattgatattgcaagaaaaatttctaagaaattgaagggtttcccgctagcagccaaaagtgttggtcgattattgaagtatcgcatttcacaggaacgttggatagaaattcttgaaagaaatgagtggcaacatcagacaaataatgatgacataatgccagcactacaaattagctatgactaccttcccttttatctaaaaaggtgtttttcttattgtgccctttaccctgaggactaccattttaataatatagagattagtcatttttgggaagcattaggcatcatagattctggaagtcataaaaatagagctgaggatattggattaaagtatttggacgaactagaaggtaatggttttcttgtgaagaaagttgatgataggaccgggaggcaatattatgtaatgcacgacttattacatgagctagcacaaaatatttcatcacaagagtgcatcaatataagttcatacagtttcaggtctgataacattccatggtccattcgtcatgtatccatcaccttacaagataactatgaggatagttttgagagagaaatggaaaatttgaagagaaaaatagacataggaaatttacggacattgatgctttttggagaaggcaatgcaagcatgcttatccttttcaaagatttattaaaagaaacaaaacgtctccgtgttctattcatgcatgcaaactcgctccaatctttcccgcacaacttttccaaactgatccaccttcggtatctaaagttggaaataccttatgacgtagaactgtctctaccaaatgcagtaagtagattttatcacttgaaatttttggacctagggtacagtaaatgtattttgccaaaagacatcaatcatctagtcaatttatgcctcttaaatgctagaaaagaactctgttccaatattcctgggattggcaagatgaagtatttacaaaggttggaagagtaccatgttaaaaaacgggacattgggtttgaactaagtgagctaggggatttgacagatcttgaaggtgaactgaaaatatttaatcttgagaaagtggcaacaagggaagaagctaataaagcaaaattgatgtccaaacggaatatgaaaaagttggagctagcttggggtatggtgcaacggaccacaagatctgatgttcttgaaggtcttcaaccaccttctaatcttaaagcacttgtcataaagaacccaggtggttccattggtcctagttggttgtgtggtaatatttgtgtaaactacttgaaatctctgcatatagaaggtgtatcttggggcattctcgcaccttttggtcaactgatgcagctagaggaactaactttgaacaatattccaagcacgcgtcggtttgaacctaattttggtggtgttacacaacaaagtttctcacacttgaagaaagttgaatttgttgatatgccagaacttgtggagtgggttgggggagctcattgccatttgttttcaaagattacaagcatcaggtgtgaaaattgtcccaatctctctatgctgcttgtgccatcctctaggttctctgtctcctatgcacaagacataaacaccagatggttccccaacctgtgttctcttgagattgaaaattgccccaagttgtcactgccccctatacctcacacttccatgttgacatgtgttattgtctcagagcgtaagacagatttgttgcgtcttcaagaaaacaagctgatctcacatggatacagaggtgctttggtctttgataacctggacaaagtagaagatatgagtatcgaagaaatgccacacgtttcattgactgatctccaaaagctcagctccctaacaagacttgccgtcaaaggatgtgaaagcatgttatttagtgaagttgaagagggtgttatcttcccttcagttcagcagctcgaaatcagtgattgtcgtcttaccagaaattcattgacaaagctactaaaccgtttcccagctcttactgagttccacttgatcttctcttcatttgaggttggagaggaagcagtattgcaactcccatcctccaacttattgagctatgtcagaatctggtgctgcaagaacctggttcttcctgtggcggatggagggggtctccatgatctatcctcactccaagaagtcgaaattaggggatgtggcaagatgttcgatcggtgttccatggtagaggccggagctcggagcaacaagttcttccctgcttccctcagggaactcaatatcagcgacgagttgagcattcagtccatggctctgctcacaaatctcacgtccctcactcatctaacactgataaactgtgataacctgacagtgcatggtttcgatcctctcatcacgtgcagcctcaaggaattggtggtctacaagaaagccgatgacgagattcatctctactctttagcagatgatttgttcttagaggtggcaacaaggatgacgaaagtaatacctgcgggaggttcctacttccaacagctggaaaaacttgaggtggacagcatctcggcagtgcttgttagccccatttgcagtctcctcgctgccaacctccgcgagttgcgattcaggtatgatttgtggatggaaagcttcacagaagaacaggaagaggcacttcagctcctcacctccctccaatgcctgaaattccggaagtgccttcgtctgcagtccctccccgaagggttgcattgcctttattctctctataaactaaatatcgctggatgtccggaaatcatgtcgctgcccaaggacggcttcccggtctcattggaacgtctaagaatacgagactgcagcatcgatttaatggttcaagtcaaggaattagaagcatcaaacccagatttacatatacggctccactagcaaacttaccacccaaggtaaaacaaggtgctctcccaactcctacatcttttttccccatttcgtctctaacctttcgaactaactaaaactcgttttttattgtttgttgttaatgatgtagctatccagcaccattgcctcatctggaacctttcagagttcttccatcatcgtatagctgacaatgtaaatgcgaattacacgacaacacatgaagataaagagctctggatggcagagcagccactttggctttcagacataatggatgtcctttgtctattatccaatcaatgttatattgatcattacaattttggtaacttacgttctctgtcattacacttctttccatctcaaactgcatggtgaattttggcaggttgcagctgcgtgatatcgaaatccacctgcacttgtatgatctgtacagatccaatagcgacattttgccaatcagccgtgctggttttttttagaaaatagattaaaccggcctctacatccaaaatagatacacagccaggccgtgctggttagtaaatatgcttatgtcgttttgctatttttttctttttggactgaaactagtatagtattgtagaatgtcccgctcttggtcttactttctgcttattactagtagagtgctcgtgcgttgctacgggaattttgttgatcacgggaaaacaaaatctggcaatccaaaagaaactacaagtcatagttgttctaagattaatttaaaagcaagatatatgttataattacagaagcgtagtataacctttttggcgcataaaacaatctcatggcgtttattaaattataaaaagcaacataaatagaagacagctaatctccaggtacgctttcttgatgaccctcgcacggacaatccaccattttcagtgtatgtgatccatttgtacctcgtggaaccgaacaattctgatgtgaccatggctaccacggatgcaaccattgctcacatcatggatgaacaagaagatatcgagatcaagtactccaagtgctggaatccgattcggccacctactacactgctgatttcaaccggccaccgaatctgcatacgacctccgttttcggcccgggagtacttgatggaaagctctcggagccctctttctaacggatccagcctcttctctgaattctatctcgtgtggccagaatcacaggaacaaggtgttgcatcacctataatgggcctatgggcttgtaacttcatttgggaccccggcccaggtggggcccatgtggggtgcgccccaagctggtggagcacgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgtttgctcggtgagtttttatcttcctataaccagaaaatagccatacaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgttttgtaccacagtcgtcgctgccaccatgtctctgttgttgtcaggacctacgaaaacggaatcggctcgctgccacggttctatttttgtagttttcagaagtttctgtcggttagttttggagttcttgagttgcatctagagtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccacctccttgccgagtcccactcgcccctttggccgagtccgaccccctccctcaattccacggttccgagttgtgtcaaacaccttggcgaatttttgtttggtgtcggtttcgagatctgtttggaaaaacggaaccggcataaattcagcattccattttttgtataattttaattttgggtttagacttttatatttgagtccctgtaaattttatatttatgtttgagtccctgtaatcttacattaaggtccttgagtcagtttttgttaaaaaaaatcaagaaaaaagtgaaaaaaaaggcagaaaggtgcaaaaaaaaagagaaaaaaaaagccgcaccaaaaaaaaacagaaaagaaaaggaaaaaaaaagaaagaagaaagaagaaagaaagaaaagagaaaatcctattatgtttgagctaaacttcatatatcagagttgtgcatgagttgttcctagtgctatcttgtggtattgtttgtgtctaggctcgcgtctctagtacgttctagcctaggaccagcacggtacttgactttgaacaattattcaactttgcattatctgatttgagcatttgctattcctttgctacatatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatatgcaagataattggggatagctgtgctcaacatcgacatcttcgtcgagacacgaggagggatcaacatgaccattataaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatatttcagagatatttatgttcccatgtattatgctgacattttgttcaacaaactgcaatgtttaaaacaagataccagagctgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggacatgaagaagcaacatgctatgtttttgtcttctattactaaccatttgcaggaagtgcataatcatgaaaaggaggagagagacatgaaagagccgccagtcccattgatcacactcaaagtcgaggcacctccattatctgaagagggcatcaaaggtaaacttaatggtgctgaaattaataaaggtgagtgtgttgttaatgaattgaatttgtccacttttcatgctatagcagagcaaccattagtggaaccaactgctgagattcctttgtcacaaattgatttgtttgctgttccttgtgataaagaagagttatgcgataatgcttcacttatatccatgccacaacttgtgaatgaacatgctattcctactgttaattcatactgcactgattttaagcatgttgttcacattgctaataaaatagaggagcgtgaattgagatcttctttaaatactttgggttatgttcagtttgatgatttttgtgagctcgataatttcaaggagaaattatttgctaagtctgatttgccatatccaaccaatgttatatttcacatctttggtgaatataatgatcttggaatatattttgtgcatagagtttacatctgctcggatttagaacctcctgtacatgtggataaaatatgcaagctagagaaaaatgttattgctaaccaaattgtctcgagtttgcctagttttgattggaagaaacaggttgttgtaaatggactacgcaaagagcaccatatggaaaaaccgaggacggttttccgtgaagaaggggaggatgatgtgaccatggctaccacggatgcaaccattgctcacatcatggatgaacaagaagatatcgagatcaagtactccaagtgctggaatccgattcggccacctactacactgctgatttcaaacggccaccgaatctgcatacgacctccgttttcggcccgggagtacttgatggaaagctctcggagccctctttctaacggatccagcctcttctctgaattctatctcgtgtggccagaatcacaggaacaaggtgttgcatcacctataatgggcctatgggcttgtaacttcatttgggaacccggcccaggtggggcccatgtggggtgcgccccaagctggtggagcacgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatatggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaaattctgcatggggaagacaatatacacaacatgatagctttacacaatccatcaatacaagaaacaatagaatgaaggaagagtgacctccatggttgcacggctacgcattctccatattgtgtgctaatcagccgttcggaagagacgtccgtaagaacgggtggatagttcggaaagaacgtggaaatggtggcaaagaatgtggaaatggtggctagggctggcaacaagagcttcggttgctgctggcgcaacttatatgatgattgtaactaatcacgattagcgtgatcttgccatgccgtcaaaagcgaaaaaagaacaaaaaattcgttgcctggttgtttctggcgttggaccgtaacagtcagatgttatgtttctggcattggaccgtaacagtcagatgttatatgggccgattaggcccatagcttgtttccttggctatttctggcgttggaccgtaacagtcagatattatatttctggggaataagttcatctgaggtcccttgactttacaccaaatccgattttcgtccctcgatcggaaaaccagacacaacgggtccctcaactatcacaaccgatgcagatcaggtccctcggcggttttaagggcggttttggctaatgtggcgcatacgtggctaatttgactcagtcttcgttcgacatggcattgacgcggcgcttacgtggcaattcgaccctgaaaaataataaaacccgtgggacccacatgtcagtctcacatagaaaataataaaaaaatcgtgggccccacatgtcagtcaaactcacccttcctcttcttcctcctctctccccatctccctctcttcatctctctcccctctctgctcctcttccggcgagagcggcgagctggagggggcagcgagaccggcgcccaccggcgagagcagcgagctggaggaggaagccggggcgataaaaggggatcaacgacggcggtgggcggaacagatcgacccggggcagcggcagctccccccggagcagcgccggcaatcgagatccggcagtggcggccgggagaagggcggtggccgatggggagaaggggcgacgtgcagcgatggccgccggaggaggaggagatgcagacatgcggggaggcatggcggtggcagccagaggaggaggacgttcggcgtgcgctgctcccctcggtagcggcggcggcacgggggtcctgggagtcgccgaggtcgacgtcgacgtcgtccgctttcacggccatggcgttcctgtccgcatccggcgtgcaccacagaagcggcggcatggggagtggcgcctcaactgctgcaacgggggcgtcaatggggggaagggaagcgaaagctcctcgctccggtgggctgccgctgacgagctcggtggtggtgaaacgcgacggatcgagcgccatcttggcggctgggggccctcctctgacctctgctctagaccgctggcttcgtcctcttcacccgtcgccggctgtcgtcctcctcgctccggggggcggtcgctgacgagctcggtggtggaggcgggttccgccgaagggcggtcgccgctccctctcccgctggccaccgccggctgcgcacctctccctccgtccgtcgccatcaagcccccgcccacggcgctcggccatcgccggcctccctgcgtcctccctccctgcccgcctcgccggtctttgcgcgttgctccctcctctcctgctgccgggcgcctgccgccgcgcgccgttgtcttccgtggcggctggagagagcagagatagggagatgaagagagggagatggggagagaggaggaagaagaggggtgagttggattgacatgtgggacccacgtgggtcccatgatttttttattattttctatgtgagactgacatgtgggtcccacaggttgaattgccacgtaagcgtcacgtcaatgccacgtcggacgaagaccgagtcaaattagccacgtaggcgccacgtcagccaaaaccgctctcaaaaccgccgagggacctaatctgcactggttttaatagttaagggatccgttgtgtctggttttccgatcgagggacgaaaatcggattcggtgtaaagttaagggacctcagatgaacttattcctatttctggcgttggaccgtaatagtcagatgttatatgggccgattaggcccatagcttgtttcctttatcaattaattccaagagtgcaaataagcaagcaaaatattccatcaaaatattccttggcgggtgttgcagatctgctgcttggagttaacctttctagtttctaatcaagctagatgtgccacatctgatacagagagagcttcttggcagtgtgaagctctggaggtgctttaaaaattcttttttgaaattcatcagggacaatcacgtttcttgcacaatatcaattattcttagactaatagctcttgaaactctactgtttctgttgcatcagttatctggtagcattttctaccagctgaacacacgattctacgtacattttaattccaattttcatgacaagagaataattccttttgatgtaacctacccgatctcctctctgaaagcatattatctgtttaaattgtaatcccgaacgatcacaattaacaaatcacatctcatttttttcaaccggcaaacattgcccctatcaataaattgcatgatccacactttttatcagtaaaatcaagtacagaaatcacaaatgccagcaacacttctacaggaagacaagagcatgttcaaccagtgccattggcaatgaaaaggaagcttcttgcattgctccttccagtttacattcacatcaaggaaccaaatagctggtagatcagagtagtaaaacaccagtactggctcatgggttatctgcatgatggagtataaagtaagtatagtgcactactagtatacaatagcaattaatatttagcagaaaaagagtgtgcatataggtaaagaaggtatttttattgaattgtttaacaaattggtcaggaagacgtgtgaagaacagatcaaaagcattgtttcttccagggaattgattaagtcagatatgctgtagtaggagactttccctgctcgtgcttgtggacaaccatttgtaatgttcctaaggtaatcaaatcagctatacaaaatataattttcaactccaactaattatgaaactttgccatttaaatttgcagacaaacaaaaacaagttacatgttacgtatactgtatacagctatggccaacttatatgtttagattaattatttttttggcaaattttgctacaagatatcacgactttgtggttttagctgtagggcaccgcacgaagtcacttttggggaaagacactctcaaaatgtggttatttgctaggggacacttcattcattaaattaatatttttgtgctgactaagcgagaaggggcctacttttttacatggcatgaccaaattgccctcatctctttctcttcctctctcttcctcctttaacagcgaggccgctactgaggcattgcaacggtgtgtggggacgggcgtgggcggcggtgcatgggcgatgggcgcggcgttgcagcggcgcgtggggatgggcgtgggcggcggcgcgtgggcgatgggcggcagcgtgcgggtacacgcggaagacatcggcgcgtggggatgggcgtgggcggcggcgcgcggggacaggcggcgccgacgagggagtcgcgtgatgcggcggcggcgggcggcgctgaggagggcgttggacagtgccgggggcggacgcagcttggggggcaggatggcgacgggcgtgggcggcggcgcgcggggacgggcggcgccgacgagggcgccacgtgatgcgccggcggcggacggcgccgaggagggcgttggacagcaccaggggcggacgcaacttggggcagcgggatggcgacgggagatggcagaggctgctcggggtcgtgggttagcgccgtccggcggtgatgacggcgagcaggatggggaagacgctccggtcgaaggcggcggaggtgtcaccgccgcgcctcttccgctttttcatcacaaccctgcaagtttgattcgtggcggagctccggcgaggccgccgccgtgggcgctgttggtgcgtgccgcctccccctgcgccaagttggccgcccatcccagcgccgagctcgttgctcgtggccgtgggtggggtgaggacgtcatcgccggtgaaggtagaggaggcaaggagggaggtttggggtgggggaagaatatgacaagtgggcccgagggcatttttgaccttttacactgtttatctctcctattgaaccagaaattaatattttattggctgcggtgtcccctggcaaataaccacattttgagagtgtctttccccaaaagtgactttgtgcagtgtcctacagctaaaaccacgaagtcgcgatgtcctgtagcaaaatttgcctatttttttttgtccatgtgaatctaatagtggcctggtatagatggatggtcgacagcaggggagagcagcaaagctgctacacttggccactgcaccctcttttgctcttccttgctgaccaccctaggagatggattacaggcgaggcaagggctccagatcaatatcatccagaaaaaaagtagtatcacaatacccgtaatggtgcatatagtccgtgccaaaatcccaccgaaagtaatgtttactgctgtccaagaaaaaaacacacgaaatgttagacttggaatataaaaattacagaaagaatggaatttaagcaagcatattatggatggttaatagtcacataatataccttttctaatctgtgaggacctctctatacacaatattttttgtgtatgctgctgtctgtttagacaatttctttcctttcttctcattgtccttcacgccagtacgcttagactttttcttttgtttcttgtcttctaccggcatcgatagtatttttatgtttgttctagaggttgctctagacaacgtgacgtatagttgaccatgagagaagacagactctggtaaatagacgcctgcatttggaattgtttgtccctgcgccttattgatggtcaatgcaaagctcaatctaaccagaaattgcttcctcttgaagcgaaaggggaacatctcatcatccgaaggacattgaggtatccgaggaaggaaaactctcttaccagcatgctgccctaccacaatctctacgtcaatagcatttcttccgaactcacgaaccaccagccttgtcccattgcaaagtccgttggctgggtcaatgttcctcaatagcatgatggggcagttaatcttcagcttaagcacatgcggaggtagcccatttagagttagagagttcaagaattcaggcgggtaatagttataagggtcatcctctggtcgatcaaagctatgatatgtcaccacctctcctctaaaccgcccaatcattttcatgttaattcgatccacgaactcattccgggtggacattatggtcctacatgtgatgtagtttgggttcgtaagattatcgtttaggttggggaacacagtatcgatgagcctttcgaggtccgtttcattctctttgcacgacatgcaaatatccgtttcacctcctcggtgccattcccaactcgaaggaggtagtccgcaaaccacacgtcgctctgcaccctcatattgcgaacaagcttcaattgaaccatacaatcccaaagataggacctgcgcagagtggcatctgttatctgagacctagcgcccttcctaatgaccgggagcacctgcctgaagtcccctccaaacacaatcgtcttccctccaaacggagaacacggacaacccattatatctctcatgctcatatcgagggcctcaaccgcttgcctctttgacatggaggcttcatcccatattataagcgacgccatctagaatttggagctcactgcaacacggcgcagttggtgctccaacattccttcggatggccctctccagtcattcgaagtccaaagtccaacacggcccagtccgccacttcccctttctcacccctcgccgccgtccccggctcatgcctcgccgccgcttcatcacttgntgccctctgctcaagcctcgccaccgcccccggctgctcaccacctgccgccgccgccgccgtcccgttactcgccgcattctccacctcctccggtgcacaagtatccatcgccaccgcctcacggcaaagctgccgcacccccaccgcatggccacaggaagttcccaccgccgtctcctcattcagtgaatttggcaatggcgcccttgccatcttatttcagtgccgatccgccatataactaagcagagctgatcatcagcagctctgattgatcggcgacgcacggaatggagcatcgccacattgctatcttttggtatctttgatatgcaaggccatgataaacaccttagctaattaagtaaactcgaggtgaaactgttaggcaaataatcaaaagcccaggagcaactctctgagtgcgttcgtgctttttgtaacattttatctcttccaaaatttaacgagaaagttactgagtaaagtatgtggttgctttgaaatcatggagttgatgtaatgttgttgcttcgttgttttgttgcatgcatgttgccatgttctgtgctggtggatgtgaattgtgacacatgaatcacgctttatttatgctcataagtcatcactattacttgtatgtcatttactgtgtattttcactggtgtatgttgtaatatacttgtatgcaacagtttattggaaaaaacagcggcaggcaaacattgagataagttcaaacatcttaaaatgggtatgcatctgatgacagtaaatttctatatctacaagtaaattaattaggtcataattacatccttagaaatcttcatatatatgaagggctacagaaccatattggaccaaattgtgtagaataccttgctattaacagactcaccagtttaggtttgttaagtggcaaagaaaacatggtaaaacaaagttatcatcttgcaatactgcaacttggaaatagccaggaaaaggaatagcagatacaactcacctagtgtcagattgcagcaacactgcaacagaaaactgcataaggttcaccaggccaaatctgcaacagaaatttgctcggctcattaatctgaacagatatacaattcaagaaaattactttttagcaagattaaccctgctattgtgcatcacagccaggggcaagactggcacctaaatacatctgttcacaactgagcatgcaagctccaacctgtttggttctataatgactataagtggtactttcagattcagcatatgcagagacttttaacagtaggctagtatcggtctgaaatccatttcctattgatccccaacgagcagaaaagagcaggctggtactttcagattcagcatatgcagagacttaaaacagtaggctagtatcggtctgaaattcatttcctattgatccccagtgagcagaaaagagcaggcaagtataggtcataaaaaataaagtgcatcggtgttctcccgaccattttagttttgcagcaaaagaaccagcgaccgcggctggggagatctgttcgggggagttgacaatgagatggtggccagcggccctgagtcccggcggcagaggtggagtacagacggacggcgaggcggcactgaaggaatagtgatcgctggtgacgacgacgcacgctacgacggcggctgctcggcggcagaggtgtagtatggacggacggcgaggcgacacagagggaatggtgatcgctggtgtctggtgacgacgacgcacgctacgacggcggctgcgagcggagaagggtagtcggcgatgaggggctcgaccccgccgcaactcctcccgagcggcacgaagggcgncggcgtgagagggctggcggagcagcggcagcaggcgtgagaggggcggcggagcggcagcggcaggcatgatagggccggcggtgtgggcgtggcggcaggggcgggccgtttttagggcacgggtgcgggcgtgagaggaggcgctggtggggtcgtgagagggggaggcgcggggtgcggtgtcagtacgtctagattggttcaccatccctcctgcgtattttttaagtagtataaatattcgtagaaatatccataatttcttgaagtgtcacatggcggcttaagaatgctccacggatatgaaatcatgtgactaaaaaaccatgtaattttttttacaaggttattaatgtttatgcggtggcttagtctactaattttaaattatgtagcaaattcttacagtataataatatcaattttaacttcgcccggccctccggcgttagcactagccgttggatgctgctggccaacggccaccgctgttgacgatcgttatcgaccagtttcgaccgtcaatattacccaatgtatgaagactagctatgcttgcaatgcataaattccaaataaaatatctacttccactatatactatgctagtaacatgtatgcaggagaagcacatataaatggaggagaatcgacagaaaatagatgaacgatcaatcagacgttgtcgagaagtagacttgtggatagataggctgataatacagaattaatatgagtaaacaagcccataattcacaccattgggctaaggaataaacgaggagtacacctgccaagttctgggccaaatggaccagaccagggttcggccgaaccaaaagcagcccagatggcccagaaattccacaggccagtagttatcgacatccaatggcggttatgaccgtttctacctgaagcaaccgtcatggacacttgtcacaaggagggagaaagatgctctttggatgcttcatcatgccacatgtcaagaggagagcaaagatgctcctaggatgcttggagcatctccacactcccaaggcacctctccacctataaatacccctcctctcattcattccctcacacactcaagcaaggatcaaagctctctacaaagtagtattagtgctagtggagtagtgttagaatagtttccaagtccgcggaggcttcggggagtttggtaaaggttctatagcttttcctttcttctctgtaagacttccatttatcaatattatattcttctttatacaagttcagtactttattccaatcatagagtatgagtaccagtcttagtttatcaataagtagtataatatgtgtagttaaaccttctgggatttgcattgattctggtatagtgtctgattaccgggtcataagtctgctctggctaggccgagagctatggtccggggactcaggtgctctacaccgattgcaaggctatagagtaataagtagtaatttaagcatggagcttaggttaccgcttatcattatttgggggtatattctctgggtgatttgtaggccgctgatggtgacagctcagtatgggcgtctcccccgcagtttatattcctacatacaatttcctggggttggatacacctccgtatcctacttcggttggagggttatgacaggttatcgtaagaaactcggcaacccggggtaactttgcgatgcatcgggagggcatagctatgcttaggcttagctatgctgcattgttaaaggggttatactacatagtgtatactagttataatatactaagatgttgtatactagaagtacaggaatggaacatatctaaactactgccacttagctataattaggagatgtaggagttagataaatccttagttgtgtgtcactctacccttaagcttaacttacccctgcatagaccttgatgtatataagtaatatataactattagcatagtactctcttatcatatcttcccttgggattaaacaaatacagtaccttagaatactcccgagtgaaatgctacaatggtatatccgtgcgcttgaggatcacatctgtaaccataggaaggcgaagaccgagtggaggtcggcgcggacgctggcggtgcgccaggagctctgccgggacgctatgtggaggcggtcgacttcgaccctgatgacgacgacctcatggacgaggacgtcgccgaaaacatgccggcgcccgcccatcgcctctgctacaccatcgcgggtggcggcgacgacgggggtgtagaggtcggccttcatcgagtcgacgacgttctcgcggagcttcatcagccagagggcctcgtcgatgatcgatcccgttcccggcaccgacgacgacgacggcgttggtgcccctcatcatctcctcgtcggtcacccgctccgccgccgggcagagcatgcaaaggccgccgcggcggacgcacacgatgttgccgcgcatgatgcggagaggcggcgccggccggcagcagcggcgtcggcgccccttctctgtctcctctctcaccgtgttctctgagttgataaggggaaattttgtctcaacacctagtagaggagagaaaatcttttcgaaaatgaataaaatagcgaaaatggcaaagtggcggtagacgcacgcttcatattggcagtttatcgaatcacgtcttcgggatggcattctagcgaaaccgcgttttgaacatggcgaaatgtccattttctcgtggggaactgagaaagtgggaatacggtcgggacgccactctcgtcggcgcggggagacgaaagcgagaaagacgttggtgccgggtcaatatcccatcggcgagacgggagaggacgacggcgttgattggcggaggcgggaggcctaccgcgtacgggagggtggaggatcgatcgcctgcgagaggggatgaggcggggattccgggcgtggaggaagctaggatgtctcgcctagaaattcatgaaccagaatttctaagctgaatgtgcattaaacccctgtccaggaccagacagggtacacaatcgacaattgttgacatacagatccacgtcttacaaaaatataaaagattacaaatgcagcggaaaaaataaaacgagctagacttggaagcttgcatgcctgcaggtcg

SEQ ID NO: 10916 - DNA, 608 bp, Oryza sativa
agagtgaatggtccaacagttatgttatattgtccatttgcaagttaaatgtttttttaaaaaaaagagatatagcgggttgattctgaagtattatcgtactattcaagagtagagaaagtagtaatcgtatccaaaatacatacaaagaaccatcatacataattttagcattcagagaaatagagatgcacgcgcaacgcgcgggctatcttcctagttgtcctaatttctcttcgttgctgcggccatcctcggagtgctctgtctctcatatacaagacataaaccccacatggtttcccaacttgtgtgatcttgacattcggagttgccccaagttgtccctgccccccatgcctcatacttccacgctgacacgtgttagtgtgagaaaaggtgatgaaacactcttgtattttcgggaagaagagctgacagcataccattatgatggtgctttggcactccacaacctgggtaaagtaaaagctatggaaattgtagatatgctgcattttccattggctgacctccaaaatctaaactgcctaacacgacattctttcgaggattgcgataacattgacaatactgttgttctccat

SEQ ID NO: 10917 - DNA, 11343 bp, Oryza sativa
  unsure (1)..(11343): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaacattcactccctctcactaaactgtggcatgttctctagccgcttgtgatactcgcaatcctaaaccacgagagaaaacattgcccctatagcagaagggtagatcgatggaggcagccatcggcgcagcgagctggctcgtcgacaaggtggtgacacagctgtccgacgagctggtggcggcttacatagccagcaccgagctcggcctcaacatggagcagatcaagagggacctcatgtttatgcaagggctgctccatcatgcccgggagaggagggacaagagcaaccctggcctgcaagggcttctagaggaactcagaaagaaggctgatgaggctgaggacgtgctggacgagctccagtacttcatcatccaggaccagatcgacggcacccatgaggccacccccgtggtagacgatggcatccgtggccaagtcctccatggccgccatgctcttcgtcacaccatcggtaactgcctttcatgcttttcttcttcttcttcttcttctgtaccagaggatgccaattatccacatcacacagccaagtcccgtagtgatgaatctgactatgttggcaagttgacattcaatcgagtagacatgtccaaaaaaatcaagtcggtaatcgagggcatatatgacttatgtagccatgtatccaatttgctcaaaattacccaacctgaagaaagaagggttctatcactgaagcgacctcccaccagctcaacaattacacagaataaattatatgggcgggaagacatctttaaccagactcttgatgacatgtgcaccatacgtagtgaaacactatcagttcttcccatagttggccctggtggaatcggaaagacaacctttgcccaacacctgtacaatcacaaaagaacagaggcacacttctctggcaacaagacctgggtttgtgtatctactaattttgatgtggttaggctcacccaagaaatcttgatgtgcatatgtcaaaatagaaatgaggaaagtagcggagcacatgaaacatccaacttggatcagctccaaaaatccattgcagaaaaattggattctaaaagatttttacttgtcttggatgatatgtggagatgcagcagtgagggtgaatgggaaagcctactagctccattgaaaacaggagaagccaaaggaagtatggttattgtcaccactcgttttccatctatagcacaaatggtaaaaacaaccaagccaatagaactgcaaggtctagaggatgatgaattcttcacattctttgaagaatgtatatttggtcaggaaaaacctgcgtgttatgaagatgaattgattgatattgcaagaaaaatttccaagaaatttaagggtttcccactagcagccaaaaccgttggtcgattattgaagaataacctttcccaggaaagttggatggaagttcatgaaagaaatgagtggaaaaatcagcaagatggtgatggcataatgccagcactacaaataagctatgactacctacctttccatctgaaaaagtgtttttcttattgttccctttaccctgaggactaccggtttggtaatttagagattacttatttttgggaagcattaggcatcatagcttatggagatcaaaataataaagctgaccatgtaggattaaagtatttgaacgaactagtaggtaatggttttctcatgaaggaaggtgatgatagtaggccatattatgtaatgcacgacttattacatgatctagcacgaaatatttcgtcacaagagtgcattgacataagttcatataactttaggtctgatagcatcccacaatctattcgacatgtatctatcaccttacaatatgatgagtatgaccaaagttttgagagagaattagaaaaattcaagacaaaaatagacatagtaaatttgcggactttgatgctttttggaaaaggcaatgcaaacatgacctttttcaaagatttgttaaaagaaacaagaagtcttcgtgttctatttatgcatgcaaactcgcccgaatctttcccacatgactttttcaaactaatccaccttcggtatctaaagttgaaaataccttatggcgtagaactatctctaccaaatgcaataagtagatttcatcacttaaattttttggatctagggaatagtatatgtattttgccaaaagacatgaatcgtctattcaatttacacctctttcttgctagaaaagaactttgttccaatattcctgggattggtaaaatgaagtatttacagaggttggaagagtaccatgttaagaaagaagacattgggtttgatctgagtgagctaggggatttgacagagcttggaggtgaactgacaatatttaatcttgagaatgtggcaagaacggaagaaggtaatcaagccaaattgcagttgaaaagaaatttgagaagattgacgctaatttggggtgcggtgcaacagacgacaggatctgatgttcttgatggcctgcaaccacattataatcttagagcacttggcataataaaccatggtggtcccactggtcctggttggttgtgttccgatatctatctatctattatatactaaaagtccattaaactttctataaacgctctcaagccgccacgtggctttctacaaacgctcctaggtcaccacgtggcattctataatctcaccgtcgattttcttttaaatcggtggacccactaattttaactattagatcttcattgaaaaaataaatctggtgtccccactattttttaaaaaaattgccgtgtttgccatcgggcaaggaacgtaagttcttttttttttcccggcggcatacgatacgtactccacgttccacgttagtattatttttttccttttttttattttgcaaacagttctggtgtccccactatttttaaaaaaaattgccgtgtttgccatcgggcaaggaacgtaagttcttttttttcccggcggcatacgatacgtactccacgttccacgttagtattatttttttccttttttttattttgcaaacagtactttttctttacaccttctgaaaacagtactactactacgcacatcgtacatacactaggggagtttaggagaaagtgttaatagatatgtaaaatcacatcttatcgatttaagtaaaaatccatagttaaatattttttctttttcttataatttttaataattcttttaatttagagatatgacatgtggtaacctaccagcttttatatgagtgtcacgtggtagcttaatagcgtttctaaaaagtttaatggacttatatatagtaaaagttaatttaacttcctataaatactctcaagccgccacatggccttctacaaacgttcctaaatcaccacgtggcattttttaatcacaccgtcaattttacgaaggtaaaaaaaaaaaaacgcagtacgtactccttccaccctccgaatctcccatcctctcctattttctagctaacttatcatattttctcattaacactcaatatatcaaaaaataattcggacatctaattgatcgcgactctcaaattataattttatactcaggtttttttcaattgttatgttatttataattaaatataaaattcaaaatccatatcactcatattttgttatctaaaaattagatcatgctgccgttctaactacaaatgtcagggcctaatggtacgcccataaacacttctaagtcgatctcgccttgtaacactataataaattaaaataaatctataagtatgacaaatgaaaataaaacatctaaccattgctctccacttaaatcgatggatccactatcttatatggttagatctatctttaaaaaaaaatcccaaaactccctcacattcctccattcctctgattcctctctccctaccattccttctctgttctttttatctccatagtaactaaaaccaacattatctttaggataaaaaaactccaaaaatggactccacctaacaagtctagctagctttccctctataatgtgcttttcttatctttctcctcaagctagcacttacagaaacaatataaactagactttaaaacactcataaaattttaaatcgtatattcatttatgatatttctacactattttaatttttaattaaataaataatttaatatctgtattgacttacattgtggaccacatctatccacctttaagcctccaataaataaaatagaacactaaaatttctcattaaaaattaaaatatctcaccttatgtttttaataaatggtcaacccattatttataccatgctagacatctaatctccttcttccaactccttatgtttcagattataagtcattttaaattttgtcaatgtcaaattacttgaattagtttataaaaaacatagtaatattttctacacaaacaatcatattataaacatattcaattttcttcacaaaaaaatcatattataaaacatattcaattttgaattcaataaaaataatttgggttgttgtaaatattgatatatttttcctcaacagtggaaatagttaatttctcttaacatgcatatatgggctatttacttatatttgaacttaattagatgcacttttatgaataaatgatctttttagggataaataaacgttcctaagatgatcataatatctaaattatacatatgatatctgatgtcactaatagattagagaaaaagcttataattatatcattttttcgtgtcataacgtgtaccccgtctaggatctatttgtcatacacagcacattgaaaatatttaagggatacctttatcccatgccaagttgtatggccattccaaattgcagagatcaaaacatttaagagacgctcgatggaatggaaatctataaaaaaataacatgataaaaataattgaagactgaactttttttttctaaatttaacatttttttaaaaaaattgaaacccattctaaatagcaatgttttaatattttaggagtactgaaataatgaaaataactaaatatttaaataaaatataatagaaaatttgacccttttcagcattatgttggaaacaaaatctaatataactaaactacaacttgggagcgataaaagtctcattttctaatatattttctggttgagaaaaacatttactgctaaactgtagtttcatactgcaatactatatacatacaattaaatcaatatttcaacaaattcagctaatttaattagatgtagtcgtattaggcatatttttaatagaaaatatcttcaattaatatatcctaaaattcataaagacatatatattataaaaagaaaaattggtactcagagtttagaaagtacaaaattatgttatgctaaatattttaaaaaaagaaacgcattatgtacaaatgatatatagtttcatgtatattttttttataaaacctaaactgcattgttttaagtaattttagtttacaatttatacggtggcgatggttactagcattaagagaaacaccacacaaattattgaaaaattaaagatgtttacgatagactaatcataaatatttctaatcaaatttttaacacacttaaatatgatgcccgcgcatttgcgcgggctaccttcctagttcgtataaatggcctgaaatgtctacatttagagggcatatcttggagaacactcccacctttggggcaactaatgcatttggaggaacttactttgatcaatattgctgggatgcgtcaatttggacctgattttggtggtgttacgaagaagagtttcttacacttgaagaaaattgaacttgttggtttaccggaacttgtggagtgggttgggggagatcattgccatatgttttcaaagcttttaagcatcagatgtgaagattgtcctaatctcaccgtgctcctgctgccatcgtttgagtgctctatctctgacacaaaagacataaacaccatatggtttcccaacttgtgttctcttaagattcgaaattgccccaggttgtcactgcctcccctgcctcacacttccatgctaacctgtgttactgtgaaagaagatgatacagatttgatgtattttgatggaaaaagtctgaggttaaatcgctacggtagtgctttggccttccataacctgaacaaagtagaagatatggaaattgtagacatgccgctcgtttcatggactggtctccaaaagctgaactcccccagaagcatgcaatcgatgggtctgctctcaaacctctcatctctcactcatctagaactagtaaattgtgataacttaagagtcgatggttttgatcctctcaccacatgcaacctcaaggaaatggcagtttacaatagtaaaaaccatcacccctccatagcagcggatttgttctcagtggtggcaatgatggaagtaatacctgcaggttccttccagcagctggaacaactctcggtggacagcatctcagcagtgcttgttgcccccatttgcaacctcctggctagcaccctctgtaagatggaattcccgtatgacatgtggatggaaagcttcaccgaaacgcaggaggaggcgcttcagctcctcacctccctccaatgcctaggattctatgtgtgtccccgtctgcagtccctcccagaagggttacatcgcctttcttcacttcgtgaactaattatccataaatgtcctgaaatcagagcgcttcccaaggaagggttccccgcatcactgagatatgtatttgcatacgagggcatcagtgttgatctaaaggatcaactcaagaaactaaaagcatcaacgccaggtttacgtggtaaagcatgtcctctcctaattcctgtatttgtcccttattaaatctgtaaattttcatatttaactaatttttgcctgttttgctattaatgatttacctcatgtggagtagtggtttcatcgctaaccaacttagtaaattaatgcgagctacacaagattacatgaaggccagcaatctagaggtcagttcatggaaaaccaaggcagtccttcattttgtggtttctttctaagttcaggcagctgcttttagtttagtccatatggttgagctgttttctttatctgctatctgaatcaatgctatattagttagcttacattctatatatccttacatatttttttcatctcaaacagcatcacaacagtttgcacgcatgcagctgcgtaataaatctgaaacccgcccgccctgctatggtctgatgtcatcagatccaacagcatcaattaagccatggtggtcagtagcatcacttctgctcatatcgtttgtttttttttcttttctgtagtttctcctgaaactagtactccatccattctaaaatggcaaaatatatcaatatcaacgtagtactacgaatgtagacagccttcatcgtattaggtggtgtctaatctattattaggacactatattttgaaacggaggggatagcttttgtaatttctctcgatgtcctgaaatcagatcgctgctcaaggagcattcctctcttcattgagatatccaagggcaagaccgcaagaggatgcagcatcgtctacaggatcaactcaagaaaatagctaggagaattagacccacatttggtaaaagtgccagggtgatccaaagtgaaatttaggtaataaaaagtgacctaaagtgcaattcactcaataactttacaacgcactgcagaagctgatatgttctctgttatctttggtagcggtggaggcagcctaggaaaatctggctatactgagatgtttgtcatttaaaaagagaagtctatcttcaattaaaataacaccaaaatgcctttatgcattcatcaacgagccagggaagcatttcaaggtactagattcaacaattcctgtaggacaaatggtcattccactgttcatgggtattgagagtatagatagccatgtgggccgcccggcacagcccggcccaggcccggccgtgcctaggccgaggcttgtcaggccggcacggcccgaccgactcaccgggccagcccacgtgccgcactcacggcctaggcacggcccaacacgcctcgggctgtgccgggctggcccgaaggcacgatgggccatcgtacgtttcctcagaataagtctaactttcctccctcctattgggctgtgacatatatatagctaaaaaagtctattttacctccctcttatttgggctgtggtatataaatagctaaaacaaactcaacgcacccattggtgcgcggactaatgtatggcccgtcaccatcgtgagcttctctatatctcaatattttttttcatatttatttgaaattgcctgcgttagttcgtttgggttgggaacccatcttctccacatagaaaacataacggtccattagcacgtgattaattaagtattagcaaaaaaaaactttcaaaaatggatcaatatgattttttaagtaactttcgtatagaaactttttgcaaaaaacgcaccgtttagtagattgaaaagcgtgcacgcggaacacgagggagagaggttgggaacacagagtaaagaagtgcgttttttgcaaaaactttctatacaaaagttgctttaaaaatcaaattaatccattttaaaaaaattttctgctaatacttaattaatcacgcgctaatggaccgctccgtttcctgtgtggaggagatggttcccaactcgaaggagcgaacagagggttgggaaccactcccctttgcacgcaaaacggagtgatggattaacgcatgattaattaagtattagctataaaaaacttgaaaaatggattaatatgatttttgaaagcaacttttctatagaaacttttttccaaaaacacgcgccgtttagtagtttgaaaagcgtgcgcgcgaaaaacgagggtgatgcgttgggacataggggaaagaactaagacagggggtgtttagataattagatctaagggtgtaaagttttggcgtgtcacatcgggtattatacagggtgtcgcatggggtgtttgggcactaataaaaactaattacaaaatccgccagtaaaccgcgagacgaatttattaagcctaattaatccgtcattatcaaatgtttactgtagcaccacattgttaaatcatggagaaattaggcttaaaagattcgtctcacaaatttatcgcaatatgtgcaattagttatctttttagcctatatttaatacttcatgcagatatttaaatgttcgagttcgacttgacagggtgtaaaattttggggtgggatctaaacagggccttagttttatgccagtaaaatttgtaacaaaaaattcacacatttgaaatgatcccttcaatacttccctcatcacttacaattttaataatttttttaaagttatgctgaatacctaaaatagatattattgtatattggcttacaaatttatatctaaaggaaaaaatgtagcaagtgaagaaattcaaccacctttttcagtcctttgtcagttcaaaattaccttcagaacccaaccaggacgtacctatgtatttgactccaacctgtctgataactaaaaaaaaaatgtcctagactccatgatgtaaaatttgctaggttaaattagaccagattttattttaagaattgcatgtaacattttctttttttaaattattcttaccttaatttttcctatctaatatttaatctgcattaattttgcttgtaaaattttcttgatggctaacattagttttttgttcttttgcctgtcattctcctcttacatgcagcgcaggacttgcccgtccagtagggcacccaagacccagcacgcgcgcccaacgtcattcgtccggtcgtcgcacgtcctttgcagccgctaattttcctccctcctattgggctgtgacatatatatatatctaaaagtctattttacctccctcttcttgggctgtggtatataaatagctaaaataagtctatttaaggtccctattctttggacaattacatttatatgtctattttagtccctatactttatgtgccgggcctagcctgccggcccatcgtgccgggccggccggtcgggccagcgtgccggtggggaggcccagacacggcccggcagtcgggccatgccgtgccgtgcttgggccgggccaaaaagccgtgccatgggccgggccttcgggcctcgggccttatggccatctataattgagagcgattttttttttctgtggaaatctaccaatccagaagcttatccacaaatcatcaatttaacatgcatcatatatggttcggcaccattcagattcgccagtggaaactgattctatgtacgcctactaacttcaaaatcttcttattttcataggcaacctgtccagctgttttcgataacagaggtacatggcgatgtggttatgtttgtagctttcttgggagttctgaacaaaccatttgtaacacattagcaggtgattacatggcttgttttcccacagaaattacagttttgttgttaaggggcaatacccgaattcttggaggatcattgtttccatttcatttcgttcaaaagaaatttgtttccatttcatcatctggtagactggtatgttcatagtgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcaca

SEQ ID NO: 10918 - DNA, 27015 bp, Oryza sativa
  unsure (1)..(27015): unsure at all n locations
catctccatcctcctcgacgacctcctcctcgagtgcctcgccggcgtcccttatgcctccctcccgcaactccccaccacttcaccacgcttgtcgcctccgtcggcgcgcacggcgagctccgctcctctctcctcgccctttccgtcacgcccacggcgagccgacgaatgttggcgtggtggtggtgatgaggacgaggagccggcggccaccgactcgcagctacgccccgtcgccgccgctacgctccaccgccggcgactggatggggatcccctttcttctttcccctgcaaagtcaacaaaatgactaggggcaaatatgccagagaatgatggaaaacatttggaaatcagttaaaatggttgaaatggcattatagtaagttggcttcatttgacaatggtattataacgaagccatattcggaagtggcattccagcgaaaccccatcctgaagatggctaaatgtcaattttctctgcgctctggaaggtgcaagtaagcgccgcagtcagaggagcgcggcttcaggggcatctcaccggcgcaaccaagcggccgccggcagagatcgctgtcacaaaagatggcgccaccaagaaggagccgaacccagcccatgaagactgggaagccaccgaccagcaagttctggggtaccttctctcgtcgctgacaagagaggtgctgatgcaggtcgctacaggcgacaccgcggctgaagtgtggagcgccatcgagcagatgtactccgcccacacacgagcaagagcgattaacactcggtttgctctcaccaatacaaagaaaggtaacatgtcaactcctgagtattttgcaaaaatgaaatccttaggagatgagatggctactgccggaggtcgcccgatcgatgaagaggagctgattcagtatatcatcaccggccttggcgagggctacagcgaggtggtgtcggctgtctgcgctcgggttgaaccaatctctgtgagtgatctgtactctcaagtgttgaactttgaagctcgccaagccatctaccgcggcgcacaggaggtcaccgtcaatgttgccaaccgtggaggcttcagccacggggggcgtggcaacagcaatggtggccaaggaggttcgcgcggcggcggcgacggcggcggccatggtcgcggcaacggagaaggtggccgtggtcgaggccgcacaccaggaggcgttgataaaagaccaatctgccaagtgtgtttcaaacgggggcacacggcagcagattgttggtataggtacgacgaggattacgttcctgacgccaagcatgttgcagctgcagcggttaactcctatggagttgacacaaattggtacatcgacactggtgctacagatcatgtcacgggagagctggacaagctcactatgaaggaaaaatacaacggtggtgaacaaatccacacagcaagtggtgcaggtatggatattagtcatattggtcatgctattgttcataatcccaatagtcgtaatatccaccttagaaatgttttatatgtgcctcaagctaagaaaaatcttgtttcagtacatcgcttagttaatgataactctgcctttcttgaattacatcgtgattatttctttcttaaggatcaaatcaccaggaaaactctccttaagggaagatcatggcgcaggctatatcctctaccacactcctccttgaagcaagcctacagtgccatcaaactatctttggaccggtggcatcatcgtcttggtcatccttccattaccacggttaaacaagtagtcaataagtttagcctcccctgttcagatttgtctagtgagtcagtttgtaatgcttgtcaacaagcaaagagtcatcaattaccttttcctatttcttccagtgtttccaaacaccccttagaacttgtcttttctgatgtttggggacctgctccagagtctgttgggagaaaaaaatattatgttagttttattgatgattttagtaaatttacttggatttatctcatacagcataagtctcaagtgtttgacaagtttcaggagtttcaagtcatggtagaacgtcaatttgatagaaaaattctagccatgcaaactgactggggaggcgaatatcaatcccttaactcttttttttctaagattggcattgttcatcatgtttcctgtcctcatactcaccaacagaatgggtcggctgagagaaaacatcgtcatatagttgagatcggtttatctctcctatctcatgcatccatgccattaaagttttgggatgaagcctttcaggcggcaacttatcttattaaccgtgtgcctagcagagttatccataatattagtccccttgaaaaactgttcaaacaaaaacccgattactcctccttgagaatttttggttgtgcctgttggcctaatcttcgcccctacaataaccacaaattacaatttcgctctaagcgttgtgtttttcttgggtttagcactatgcataaagggttcaagtgtcttgaggtctctacaggacgcatctatatttctcgcgatgttgtctttgatgagaatatttgtcccttcactgaacttcatgccaatgctggtgcccgtcttcgttctgagattgatattctcactcctgaactgctaggacccatacggtctgttgggaatgaacaatgcatgcatccagtgactaatccattatctgctgatgtttctgctgctttatctaatcgtgctaatgagccacatagagatggtgcagtacatcccgctgatgcagaagatccgccggcgacgcctcctctggatgccagttctggtccagaaccagaccgtgtcgtccaccactcccctgcggccacgtcatcaggccgtcatccgggtcccacacctggttctgtgccacggggggcagcatcatcgctagcagaggagacagcagaagactcagtgtcgcaggcggtgcaggagcaggagtcgcaggtggtgcaggagcaggagcagtcctcaccagcgcaggaacatgcacaggctgtcacagatgagactaatacattacagcatgcagatgtgactgacacaggttcagaggcaccggcaggaccgcgcaccaggttgcaaagtggagttcacaaagaaaaggtatatactgatggtactattaaatataagcattcttggtttactgcttcaggtgaacctacaaatgatttagaagccttaaaggataaaaattggaaactagcaatggattcagcgtatgatgctttagttaagaataaaacttggcatcttgttcctcctcagagagggagaaatattattggctgtaagtgggtgtataaaattaaaaggaaagctgatggtaccctagataggtataaggcaaggttagtagcaaaaggatttaaacagaggtatggtattgattatgaagatacctttagccctgttgttaaagctgccactatcagaataatattgtctttagcagtgtctaaaggttggagtcttagacagctagatgttcaaaatgcctttctgcatgggtacctagaagaagtttatatgctacagccaccaggttttgaggatcctactaagccacatcatgtgtgtaaacttgataaagctctgtatgagttaaaacaggcacctagagcctggttctctagactaagtaaaaagttgatggaccttggttttaaaggatcaaaagctgatacgtctctgttctttctgaataaaggtgatataactatgtttgttctggtatatgttgatgatatcattgtagccggctcttcagaaagggccactgcagctttacttcaggatctaaaaggggaatttgcactcaaagatcttggtgagccgcccccccaaaaatttttttttaaaaaattttttttttttttttttttccccccttcccggnaaataagaggtaagcaaggttcagaatggcattgtactgaatcaagacaagtatgccaatgatttattgaagaaagtgggcatgatagattgtaaacctgctaatacacctctttcagtaagtgagaaactctctcttcatgaaggctcattgttagggcctgaagatgcaagtcactatcgcagtgttgttggtgctttgcaatatttgactcttactagacctgacatagctttctctgttaataaagtttgccaattcttgcatgctcccacaactgtacattggattgctgtgaaaaggattcttaggtacttaaagcaatgcactcggttaggacttgaaattcataagtcaggatctactttagttagtggcttctctgatgcagactgggcaggctgtttagatgacagaagatcaacaggaggatttgcaatatttctgggttcaaatctggtctcctggaatgctagaaaacaagccactgtgtctagatctagcacagagtcagaatacaaagctattgccaatgccactgcagaaataatgtgggtgcagactttacttgcagagttagagattaaaagtccaaaagctgctaaaatatggtgtgataatcttggagctaagtatttgtcagctaatccagtgtttcatgccagaacgaaacacatagaagttgactatcactttgtcagagaacgggtaagtcagaaacttctagaaattgattttgtttccactaatgatcaagttgcagatggattcactaaacctctgtcagtaagactcctggagaatttcaaaagcaatctgaacctggttaggtccggattgagagagggtgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacacatagatctaagctaagcagttttaggtgagagcactatctattgtttatggtattggtaacatatgtacatgatcattaataagagaactagtaagagaactaggaaggtagcccgcgcatatgcgcgggcacttatttaatgttgcttaattttttattggtataaatgtttatatgtagattatattttcaaaatagatcttcactctatttaaaacatgttttagttattatctagttatgacatattacataaaaccatacagccttgaatttatgataatgacatgaatttataagaacaacatgtgtcacgataataaaacaataatagaataatggagttgtttcatatctatttgtactatatgtgatttttttacctaaataaagtgtttttttaattaccaccacggtaaaatctccaaaggaccatattgttggttatattttgataaatatctataattttgcgtctcgtgtttttcaacgcctattcttcataatcattcataatcacagaagacaccttgaccaattaatttggagaatgaatctattttcccaaacttatttataataactaattgattaaagtatacttctttgtcacatcaatagagtgcatgacatacattcatcgaattatgcctgatatgctggaattcctcaactataagaaaatatagagtgaacttcactgtgggctagtaatttttacccaagtttcattttggactaggggtggacaaatcttttcactttggaccaggtgattttacaaaaatttcaaactggactggccttcttctccatctctcttatggtttttttcttcatcgagatactgccatggattaaccggagcaagcacataactaggatttcttctctcggatccgttcctgagctcgaactcacgaaattaagtcactgggcagcttgttgctgcaactgtttcctgtgagatcacaatcatgtgattttttttcagctcacatgattttggtgggagaaaaagagcaaaaaaagaaaatcaaggtgctggttttttctttattgagatgctgccatggatcaacccaagcaatcacatgactagcattccttctctccgatccgttcctgagctcgaactcacaaaatcaagccatagggctgcttgctgctgcagctgtagcctgtaaactcacaatcaagtgattttttttttcagcccacatgattttggcgggagaaaaagagccaaaaagaaaatcaaggtgctaagtgatcaggatacattactggcgtgtttagttgtttgtgagctaaagaaatcaaggagtgagtggcagcacagtaggtcagaggcaaggaacaacaagaatggtccaatgtgcaatataaggtagcaaatcccggtccaaagtgaaaacatcaaacatagcctagtccaaagtgaaactttggcaataataagtggcctaaagtgcaattcactcgaaaatatatcgtgagtagtttattgcgtatgttacttgattgttcatttgttatcaaaactatttgacaaagagaaagacatacatatgggacaataaatctcatgatggactaaatggttgttttatagcaagatcactggcttgaaatatttttcataattattttttagatttatgtaatatttatgttgcccaattatcatatagttctgaaaattcaaaaaaaatgaaaatattaatctcaagaagtattctattaaatcatatctacttaaaaatacacaactaaattgtgttgttttcaattattttacatatgtagctttaaattagcattatatagtcatcaagtgttatttgacacctggaatatgatgtaaaattatttaaaataggaaaagcctagagccaagtcattatatagtttctcttgtagagaaactcatcacagctttagagccatccactccctggcagcttagagccaatcctaagcaaacactgaccttggcaggcagctccatcttggctggccggctgagatcaatcatcgatggaggtggccgttggtgcggcgagctggctcgtcggcaaggtggtgacgcagctgtccgatagcttggtggaggcctacgtggccagcaccgagcttggcctcaacatggagcagatcaagagcgatctcatgttcacgcaagggctgctccacgaggctcagatgaggagggacgtgagcaaccctggcctgcctgggcttttggagattctcagcaagaaggctgacgaggctgaggacacgctggatgagctccagtacttcatcatccaggaccaaattcatggcacccatgaggccaccccggtggtagacagcagcatacgtggccaggcactccatggccaccatgttcttcaccgtaccgttggtaactgcctttcatgcttttcttcttcttctacacgagatggtgccggtgaccatgttggcaagttgacattcaatcgagtagatatgtcaaagaaaatcaaatcaataatagaaggcatagatgccgcatgtaaccatgtatccaatttgctcaaaattatccatcctacagtaggaagggttctatcactgaagcgacctcccagcagctcaacaattacacagaatgaattatatgggcgggaagacatctttaaccagactcttgatgacatgtgcaccattcgtagtgaaacactatcagttcttcccatagttggccctggtggaatcggaaagactacctttgcccaacacctatacaaccacaaaaaaacagtggcgcacttctctaaaaacaaggcctgggtttgtgtgtctactaattttgatgtggttaggctcacccaggaaatcttgaggtggcatatgtcaaaatggaaatgagggaagtagtgaagcacataaaacatccaacttggatcagctccaaaaatccattgaagaaagactggatcctaaaagatttttacttgtcttggatgatatgtggaaatgcaacagtgaggctgaatgggaagtctactagctccattcaaaacaggagaagccaaaggaagtgtggttatcgtcacaactcgctttccatctatagcacaaatgataaaaacaaccaagccaatagaactgcaaggtctagaggatgatgaattcttgacattctttgaagaatgtatatttggtcaatacggcggtcggccttagagattggacaaaaggcatctgctcagaggctaaattgcaattccatatggcactcaatgtcatccaaagactcgacgtggcacaagagcacagagaactctcccccccccggaaacgcgactgagggcggctctcaagcggaaagtcctaggactcgcttctatagaaagggcaaggaaaaagcaagcctccagggtaactcacatccgtgaaggagatgcgaacacgaagttcttccacctcaaggttaatgcgcgaaggagaaggaatacaatccaaagattgaaaaaggacagtggttgggcggtgacgcacggtgaaaaggaatcgacgattcatgatcacttcgcaagcttcatggggaggccagggccgaggccaaacgagctaaactgggagacgttggacatcacaccgattgatctagccacgctgggggaacccttcactgaggaggaagtgcatagggcaattaaggaaatgccagccgacaaagcaccgggaccagacggcttcactggggccttcttcaaagtttgctgggaaatcatcaaggatgacattctgctagtcttcagctccatctataacctgagatgtgcgcacctgaatttgctcaactcagcaaacatcgtcctaatcccaaaaaaggatggggctgaaagcgtttcggactataggccaattagtctaattcatagcatcgccaagatcttcgctaagatgctagcgctgtggttaaggccccacatgcatgagttgatctcggtcaatcaaagcgctttcataaaggggagaagtattcatgacaactacctcttcgtaagaaacatgaccagaagataccaccgcctaagacgggcaatgttgctcttcaagttggatataacaaaagccttcgactctgtgcgatgggattacctcctagccttgctgcagcgcaagggcttctcgacaagatggatagactggctaggggctttactgtcgtcttcgacatcccaagtcctccttaatggctcgccagggcaacggatcaaacatggaagaggactacggcaaggggaccccctctcgccgcttctcttcatcttggcgattgatcctctacagcgtatcctttccaaggcaacagagctgggtgcaatttcaaaattacgaggaagaacaactcggctgcagatctcaatgtatgcggatgatgctgtgatcttcattaatcccacccggaacgatgttgcgactttcgcgaacatcctacatcgttttggcacagccacaggactcgtcaccaaccttcagaaatcccaggttgcggctataagatgcggcaatatagacctggaagaggtcctccaaggcgttccggcgaagcgggcaaatttcccactaaaatacttgggcctcccgcttgttctgggaaggctgcgaaaaacggacttgcaaccggtctttgacaaaatatcagggagagttgcaagttggagggggaaaaacatggcagtagccgggagaaccacgcttgtaaagtctgtgctttcagcgcagccaatttatctcctcactgccttgaaggtgacgaaggaatccctggagcagcttgacaagcagagacatcgcttcctttgggctggtacgggggatatcaccggggggaaatgcaaggtcaactgggcaaagacatgcttgccgaccagccaggggggccttggtgtcctaagcttggacaagttcacaagagctctgagattgcgatggttgtggaacgaatggagagatccaagcaagccttgggtgggtttggaaacgccttgtgatggtgtggatagggacctcttcgccgcctcaacaaagataactgtgggcgatgggaatacaacgcgcttctgggactccgcatggattaacggccaaagaccaaaagacctaatgccgttggtctatgagatctccaaaaataggaagaaatccctacggcaagggaaagaagacgactcctaggtgcatgacctgaccctcgatgcgggttcatctatcacaatcaaccttctcgatcagctagtccgcctgtgggaggcggtacggaatgtgcacttagacagcgaggagccggatcagattgtttggaaattcacaagcagcggccactatacagcttcctcggctaatcatgcccaatgtttgggggcgccaaacacaaacttcaactccctaatctggaaagtttgggcgccagggaaatgtaaatttcatgcctggctcatcattcaaaatagagtctggacgtcggaccgactcgcgacaaggggttggcggaataacggacattgccccctatgtcgttgtgacaccgagacagccttgcacctcgtcgccatgtgtagatacacgaagagaatctggcgcctcgttgctacatgggtgggatatcagcagttggaaccggcccaatgggaggaagcctggtcagtccatcagtggtgggagagcctagctaacacacccggcattccaaagaagggccttcggtcccttatcctgctagtagtttgggaaatttggaaggagcgaaatcggcgaatctttgatcacaaagagatggcaacaggtgttctcctagcaaaaatcaaagaggaggccagcttgtgggctttagctggggctaaaagattgcgcgagctcatcccgcactctgtatagtgtatagtctaaagatctttttgttttatccctaggggttgtattttctccttctatattcaatgaaaaagcactgctgtgctgttttttccgttcaaaaaaaatatatatatttggtcaagacaagcctgcatgttatgaagatgacttcattgatattgcaagaaaaatttccaagaaattgaagggttttccactagcagccaaaagcgttggtcgattattgaagaataacctttctcaggaaagttggatggaagttcttgaaagaaatgagtggaaaaatcggcaaggtgacgatgacataatgccagcactacatagtagctatgattatcttccattttatctaaaaaaaatgtttttcttgttgttccctttaccctaaggaccactggtttaataaattagagattactcattttttggaagcattaggcatcctatgttatggatgtcaaaataacaaagatgctgatataggattaaagtatttggatgaactggtaggtaatggttttctcatgaaggaaggtgatgatagtaggccatattatgtaatgcatgacttattacatgatctagcacaaaatatttcgtcacaagagtgcatcaacataagttcatatagttttaggtctaatagcatcccgcaatctattagacatgtatccatcaccttacaagataagtatgaggaaagttttgagagagaaatagaaaaattcaagaaaaaaatagacataggaaatttacagacattgatgctttttggagaaagcaatgcaagcatggcctttttcaaagacttattaaaacaaacaaaatgtcttcgtgttctgtttatgcatgcagactcactcgaatcattcccacacaacttctcgaaactgatccaccttcgatatctaaagttgaaaataccttataacgtaaaattgtctctaccaaacgcagtaagtagattttatcacttgaaacttttggacctagggaatagaaattgtattttgccaaaagacattaatcatctagtcaatttatgcctctttcttgcttcgaaagaactttgttccaacattcctgggattggcaagatgaagtatttgcggaggttggaagagtaccatgttaagaaagagggtattgggtttgagctgagtgagctaggggatttgacagagcttggaggtgaactgaaaatatttaatcttgagaacgtgacaacaagggaagaagctaatgaagccaagttgatgatcaaaacaaatctgaaaacattgaagctagtttggagtgtggtgcaacggacaacacgatctgatgttcttgacggtctccaaccacctcctaatcttaaaacacttgtcataataaaccatggtggttcggttggtcctagttggttgtgcagttatatttgtgtaaaatacttgaaatcattccatctagagggtgtctgttggggcaatctcccactttttggtcaactggtgcagctagaggaacttactttgaagagtatttcaggcatacatcagttcggacctgattttggtggtgtaacacaaaaaagtatctcgcacttgaagaaagttgaacttattaatatgccagaccttgtggagtgggttgggggagctcattgccatttgttttcgaagattacaagcatcaagtgtgaaaatctatctatcttctatctatctatctatctattatctattatatactaaaagtccattaaacttactataaacgctcccaagccgccacttggcgctctaataaattagagaaatctaagaaattctaagaaaaaagcaaaacatctgatcctcgattttcacttaatacagcgggcccattattttacaccattagatccatattaaacaaaataaaccccatctcccaaaaatcctctcccgctcccctcatgggcctccactcctcacataaacagtacgtacatgtactaacgttcctccctcgcatcctctcttttctccattccattcatcttctatttttttagataataaatttattatataaaaataattagataactaaataattatatttatttgcaacatattatatttatctatattagccatgtgttttgatatatgagaaatacatcatttgacaaaaactcctacaaatagcaaaaattaataacatatactatcatgtgatcgcaaataatttcatgtcctctttgcttgctcaccttggcctccttaatttctagctagcaaataataaatatccattaaattaaacatcgtgtatcataatatatctatctattatatactaaaagtccactaaacttcctacaaacgctctcaagccgtcatgtggcactcctacatacactcctaagccgccacatgtcatatctctaaagattctacaaattttgaatacaaagaaaatatccgaccgtcaattttcacttaaatcagtgacccattattgccaaaaaaaaggctgaacgctattcatcgggaaaaaagccaaaaagaacgaacatatatgtacgctcacctcaagtaatgaaaaaacacagaaaaatagcataccatccctcgcctgatcttataaaaacattagactattacaattaaatttaagagatgtaaaacaactaaaactgatatttaaaaatcatcgacggttacgaaattatgatatgttactataaatttaccattagatttataacaaaactacaagaaaaactaattccatttatttatttcatcataaaaattataacaaaactaataatatcgattatatcatcatatataacttcataaacatggataacaaaaattatatctatgattattcgaagtaaatatttcattcattatgaaactgtgataagttacaataacattagagtcatgataaaattatcagattgtcatataaactactttcatgtattcatatttttaagtttattgtgaatatactaatttcatgtattcatatttttaatttttattgtgaatatattgcaagaaagaccagatacaaagctcttactatggtacaacctacacagtttatacgtggataacttaaaggtatcaagcatatgtcccgttaatcttgaatgtgtccgacccacttacaaattcttatccaccaaacatcgagctacaattgctaacaaggtatttgtgcatcatatcatatcaaatatctaatatatgatgaacatgtgtaccattagacgcatatagagataaaggacattttataagggacatttgctcatttaacccttttctaaagcttaactaccaatttgatccttttttaaaacaaggtttgctcatttgaccatgtttttcaacatcgaagttgtcgtctgaccctactttcactacatcctgagtttttcatttagaagaaaagaaaaacatgtatttacaagcccaaatgactaaaatgacactgaatacatcaaccttatcctcaagcactcatttgctcattccttatccccccgtctctctctctctctctctctctctcttcaaagcgcgaagggcaggaggagcggtggcggcagcacgacagcagctgcggagtgcccccggctgcttcgcggagggtaggatcggtggcagagaggcaacattgactcgccgacgaggagggccgctggcagtggtcgaagagacggtgacaactcggcagaggggaggcagcagctccatgaagggtaggaggggtggcgtcggctcagtgacgaggaggactgccgacgatggcgaatgggaagcggtggctgtggaggggtggcagcaaccacagatatggtaggaggagcggaggcagagggatggtgtcggctcagtgatgaggaggataggcggtgacggtgaaggggcggcggcacggtgacgaggaggaccattggcgcccacgcacatctccgccattagcttgctaataaggtcaaataagtaagggtagaagtggtatttggggcttttgttaactccgattaatgctcttaagagaagaaggtcagagtgtagcttcggttttgaaaagaagggtcaaatgagcaaagtgaccaaaacatggtcaaatcggtagttagatatgcaaatagggtcaaatgtgcaattgctccattttatattatagattatatcattttgtatcattttataaacatacaaagccaaagacacgggtgatttacttaatctatctaaaaaaacatgtctacggtaataagaatcatagatactgaaaagacagaaaaactcaagagcatataccctaataatacctaatagtaaataaaaattatcaatggctaatccctaggacatataaaattataaagtattattttactagtttattaaatgccctaaagaaccctcctacaacgtctattaaagcctttaacaaataagaggaaactttaaatttcttctgtaatagataaagcatctaaaccttattcctcattaatttaatgctcccattaattttggccattgggccatttcaatgggtatatgtatacacacattatttaataaaaaaacattcatccaagcatgttttctaacaaaaaattatttgagatgtcaggtgaggttgtaatgacctgttgcatggtttagagggttgttgtcaggatgactagcattgagttttactaggttgccagccatccaatgcatcacaaaaagagcccatataggagatatttgtgttttgttgatcgagccaccatcaagagaagccaacatgggaaccccagtacaaatattttttatgactaaatcttctcttaactcaagtatctatgtaatattatttaagtcgtgttggcttgaagcatgcataatttgataacatggtatatctagaaggctacatgttagaacattcaattaacccatcttggaaataataatacttagcaagaaatcaaacaggtaacaaatttctatctttaattttgatatttaattttaatcattggaaagggggagatagagtgaatggtcacccccaaaggttttttcaaacagttatgttaatattgtccaatttgcaagctaaatgtttttttaaaaaaaagagatatagcgggttgattctgaagtattatcgtactattcaagagtagaggaagtagtaatcgtatccaaaatacatacaaagaaccatcatacataattttagcattcagagaaatagagatgcacgcgcaacgcgcgggctatcttcctagttggcctaatttctcttcggtgctgcggccatcctcggagtgctctgtctctcatatacaagacataaacaccacatggtttcccaacttgtgtgatcttgacattcggagttgccccaagttgtccctgccccccatgcctcatacttctacgctgacacgtgttagtgtgagaaaaggtgatgaaacactcttgtattttcgggaagaagagctgacagcataccattatgatggtgctttggcactccacaacctgggtaaagtaaaagctatggaaattgtagatatgctgcattttccattggctgacctccaaaatctaaactgcctaacacgacattctttcgaggattgcgataacattgacaatactgttgttctccattcagttcagtcgctctatctcgatgattgtcatcttactggaaaatcattgacaatggtattaagcatttttccggctcttacctacttcaatttgagaatgtttggtgaaaatcatgacatagaggaaatagtgctgcaggccccaataacctgctcattgtgccatatgtcgatatcctccagcaagaacctagttctgccagttgaggacggaggaggtctgcaggaactctcctcactccagtcactcaggatttcagattgtggcagaatgttctctcgatggtgcatggtcgatgcaggagctcgtaccagcaagcccctcccttcttccctcagggagctcagtatttgtagagagtcaagcatgcagtcgatggctctgctctcaaacctcacatctctcacacatcttacactattggaatgtgaagacttaacagtagatggatttgatcctctcattacactcaacctcaaggaattggtggttttaaataattgttatgagaacaattattcttgttccatagcagcagatttgctctcagaaatgacaaggaccaaagtattatctgcaggttccttacaactggaagcacttaaggtggacaatatctcaggagtgcttgttccctccatttgcagcctccttgccgccaacctccacaagttaattttcaaatctgacttgcagatggaaagcttcgatgaagaacaagagcatgcgcttcagctcctcacctccctcaagcaactatattttgccgactgcccaagtctgctttccctccccgatgggttgcatcacatttcttctctccagaaattgcacatatataattgtcctaaaattggattcctacccaaggagggcttcccctcttcattgagagatctagtgttatcagagtgtagcgtcgatctacaagatcaattgaagaaattggagacatcaaacccagatttatttgtacaccacatgaggtaaaaaggaaagaaaaagaagtgttctctcaactactacttatttcagcatccatctgtaaccttcaatactaaactaaaactgctctgctttgtttcctactttgctgtgaaggatgggccgaatcagtctggagatatagcggactatctgcatccgcatgcgagtaacacaatagcacatgcgggccaaaggatcgatcggttcttccctctgcaacaatctggaaggttcttgaaaaaccaactttttttaattttatgtggtcgggaatttatgatctcctttttttagtgcatgcaagcgaccactctgttattcgcccatgtagttcattgcttccttcacctaaccaatgttatattaactgtcagacagttttggtaaccttggctagagactcagcatggtgataatgcatgcagcaggctgatagctatgcggtaaatttgagacgcgccttgccctggtctgacctctacaacatcagttacacctaggtggtcagtaacctctcctcaactcatctcgtctctctctctctctcttgatctctccaaaatagggaagttagaggatatgtcctttaaaactactccctcagtcccgaaataagttaatataatatggcatgtaatattttcaagtaaagtatgctaaaaaaaacaagtatgctaaaaatgactctaaagtatgtatagggtaaaagtattctaggcaatttttaaaatgcctctaaaaggtgtctacacttttgaactcccgaatttagagacaataaaaaatttttatcccgttttttccttttttttttctacaaaagtgtctcaacataaggtttttgttgtagtgtgagcttggcattgagtgtgtattctttctgtggaaacctatcaatccaaaagcttgtccagaactcatcagtttgacatggtacagtaaagttcagacctgcctgccagttcatgtaatcatttgctctttagcttattagccttagcgaaaatttgaatttcagaacttaattttagggttgattttattaattgttttccatcatagtttgttttctggcattgtgtcacgcccacgcctaccatctttcattggcagcttacaacggacaaatgaagaacaatagaacatcattgcttaaaataaagacagatgatgatcaaaagatcaccacagttgacatgagttctgtggagcatcgattccatttcatcatctggtatgttcatctatgtaagcagttttagatgacagcatcaggcccaaatacgaattatacccttacatactcttttgtccttgctctaagtagaaatttaacaaatagtatattatgattgaaacaaatgagtttatatgttttacagcccatctaaacttttcattgagactggtcccaccaactccaaacaacatagaccacacagctctactagactactaataaactggcaatggattctggtgttggtaacagaggcatatatggtctttcttctttttttttaattgaagaggtgcatatggtcatcgataggagaatcattttgagcttattagtttgttaagtcccatttaatcattcattatggaatgctaaaccgattgcacataatactgatataactggaatgacataatatttcttgactactagataataccccgcgcgttgctgcggacataataaataactttcaaacatgcaatatgtgcataacatttgagaagaaaaaagaaaaaactacttattaccatataattgatggagtatatacagtggtaattataactaaatattacatgatggagtatctccccaggtagcagtggttggccaatgcaactaacagaattacaactcaaatatatggctgttgaccggatagagcaagtattaataaacaaaattgaaggccactaaacattactggaaaatgaaaaatatacaccaataaaattacccaaaattatgtactatgtgtttatgaacatagcatgtatgaaaaataacagtagaaaagcaagtaaggtgtcatactgttgtcctcgttaacttgatagcctttattcagcatgacatttttcctagtaccgcttccctcgctgacccattgatctcagttttggaaattctgtagttaatcttgcaaatgaatgccaattgattcatgaataaggtgctagaatatcataaataattgtggtaagaaatgtttatttaactggaagtagcaattattatgcatatcttatcgtataaatatgcgatgaacattaggagcgcatttgtagttgcatagctgatcaggaatgtagtcaaggcatgtagcaaacctaggtgatgagtgatgactactttacaattacaaaactgataataaccataactgaaacatcaatattttatatgtttaaacatctacaaatatagtccaattatcactgatagcaaggaaatcataactaaggtgtcaaactattatataataatggtagaaaattttcatgcttgagtaagatatgggaagttgggaaaaggattattacctcgtatatataattaagtactcatccttgattaactctttggagtgattttagctttcagaaaactccaaaaatatttatatcaccaagctaattcaagagtgacaaaagatacttaaaaacatatctagagtatacatgatcagaaaataaaatgaactttgagacggaagacaacctaatctatttaagagcaaacctgtgtgtctgtgtgtggagaatctgacatcattcttgatgaggaccttatcaaaagtgaaaagcacatcaacgacatagatgtaccgagatatatatagcttcaccagttaaagaccataattaaaataccaaaagaagaaagctccatccgcttagcagcccatatgattgttacttagctcgatgagttcttagatctgatcgggtgacgacaaatcaaccaatagatgcatatttgccacgtcttcaaccacttaagaatgagaagtggtctataattcaggataaataaagaatatgaatcaactaaatcagtagccaagaacctgaaacctggaaaaagaggatacagcaacaataaaattctctgttgggtatcagatttattgaacataaggaaaggggaaatcggtaggtaacctgtgttagatcattgaagtaattggagaggatcgaccaggtgagggctgcatatgaatccagcaagcagagttgcaagaacggtagtaaaacgccagcagcctggtagagtgtggtagatcgacgaataagcgagatgataaattggatatagatgcagaactgataaagggataagaggagaagaaaacgcattaagccattaatggatttacttgataacagccgtgaagtgttttcctcggtggttgtcgacggttttcattaatcatggcaacctaaaggggcgaacaacctttagacatggaagaggaagggggaagcagcgcacgagccgccatgggggcgacggaaggggaaagcgccacaccctcattttgcttccgtgtggcacgggaggcggatgacatgccagcgccggtacgggcgagcacgatgcgggagatggagaggatcacggcgagattgatacgaagggggcggcggagcgagatgcaggagagggaatcgatgcgagcgtgcaaggggagaggagaggagcgatgcgggagagaggggtttatgcgcgtggggccggtgaagcagcgagatgtgggaaaggagaggagcgatgcgaccgcttgattgagatcgaacggtggggagaaaatggggtgacgtgaagcaccaggaagcagagaattctagtagtgggaatgatttgtataggtatataggattcctgctaggggaaggtaataaacctgtgattccaaccacacaataatcttaattatctagactacagacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatcgagctgacctttttttttttgcatgcccctgttgctgcatggtttatatatatatatatatatataaaccatgcatatatatgtttcaatacatatatatgcatacatatatatatgtatatatatatatatatatatatatataatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgctgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctaaaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgtgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagtgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgatcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaacctttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgcctgagaggaggcttccactgcatctgttagtcgtcgcgcagcctcttgtatctgatagccgaagaccagtgagccatcagctgggttgagcgttccaccgtgagcatagtcccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaattgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctagttcccctccacatccctttccacgtgcccctgctggttcccctccgcatccctctccacgttcccttcctcgttcaagtactggtttggatcctcgttccccccttcttcattccagtactgggctgcttccctccgcgattgtatggcacaatatctgttcctcatcgcggtcagccatctgttgatacaagaaaacatctgctaagtcatgagacatttatgttttaacaatctaagccatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagacaataattacataccaagtctaattacaaataaagtaatattatattaaaactcaaataatattacatgctaagactaaaatagtaatgtatgctaagtgtttcgtgcgtatatgctcaccctacattacactactgtagtcaatgtctttatgccaaccaactgcttagggaatcatgatatacttagtctaatttgcaataaaataatcttatattaaaacctcaaataatattagaacactacacattcttatatgataagtctaattaccaggtctaataattctaattaattgcattacaaatataacaatcatttatattattaggtcacttgcgtgctccaattccttctagggctagctcttccactcaggcttgccggacgactccgacaacacgtcttttctgcaagataaaaacaatgtattaggataaatgcgaagtaccatatatatatatatatatacacatgtatatatatatatatatatattgcatttcacgttaacgttcgtccttgttagttcgctcgttcacgttccctagctcgttcacgttcgttcgatcgttctcgctctcgttcgttcgatcgttctcgttctcgttcgtaaacggcggtgtgccggcatcgggacgacggttggcccgtcggcgtggcgacggcgaaaacggcgtggcgttgtgggtccgtgtcgacgacggcgtggcgtgtcgtcggtggcgtggcgtgg

SEQ ID NO: 10919 - DNA, 8914 bp, Oryza sativa
taaatatcttttcccgctatttcgaaattctttttaaacccggttagggttaagaccgggactaaagattataccactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatactaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgacgctcttcagcgtgccatcgcaacattctagcattccccttgttcctgaacaaacgccttagccgtggtattatagggaaataccacatcaccttagcaggaattctcttctttgttagctgtcacatcctgattttcgtttcaggatttataaattatttaataaattaataatagaatttatattaaatgttcattaatttacatgtgaagttaaatgtgggaaataaaatttcctaaatataaagcatggatggatttaattttttattaaattctccatgattaagtcaactctctggaatattctcggatttttcggagctcaattcctaatttttaatcttacaaagagcatttcagtaattacccacatattaaattaatcattaaatggtctaattataattttgttaagtactttgagtgtccaagtattttcaagatttttcttggaattatttgagcataggaagtatttttcacaattcaaagatcatttcagtgattaatttaattggaaaagtatttaaaatccccttctccttttcgggccgaaataggaaaagttcagcttctatcctcggcccattctcccttcctttcggctggccttatccctcctccaaagtctgctttgtgtccctttttcaatcgggccaagaagtagaagcccagcaaaaagtctagtttgcctccctgctacagtgtcatcttcaatctccagccggctggagacagagcccgagccagccgcacagtacctgtatagccgcggttttccccttcaaatctgacctttccccttgtgtttttctaaaattagttgaggggaaatattcctcttatcctcctctatctttacctccaaaaatcggagcaaatcgttgagtatcttatccgaatcaaactcgttttcgagtttatctcccaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgcacgtgctccaccccgccgtcgtcgccgcccgagctccatccgcgtcgcgccggtcgcctccgtcgtcgccgccggtcgccgtcaccgccgtaaggtgcgccgaggtgtggagaagcccggccgctctctccccgctgtcgccggtcaccggagccccgtcgccgccgtcgacagaagccgtgccgccgctagacctcgtcgccggccgtcgtcgttcgtcgtttggttcgagggtgagtaccgttgggttcgtctcgtcgtcctctacgtgttcatgtcctccaaagtcgcagccgaccatccaatctccggcgaggtcgccatcttggtccggccattgatgaggtcatcatgacgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgccggaagtattcgagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccagtttgcattgattaccctattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagttactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataaaggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttatacttggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaaacctcagttgaagataaaggatccagaaggagaagacgtttggcttataccccagttgagctgcctgtgggagtggagctgaagccatcgctagaccgttaattccgctgctgttttcttttcttttgtaagtatgtaacgttattattatgatggatttgtatattaaattgtcagtttgtgtacctcggctgattcctggacgaggattttatgcacaaataagttcggaaattactagtgaatttccgggcgtgacattagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatagacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccggggctaaagttaagatctttagtctcggttggtgctaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgagagtacaaactgcatatgcagataatactgatgtacgatggattgatggctcagtactagcctacgaaggaacttatgatctagcagatgtttttcgtcctaactcaatgcaaatgttatatctggagtttaccatgcattagcctcgtacttttttttttctttccaggtgacttccaggacaaaattggtgttccatccaacgacagcgtgtaacgcaacctgcactatctgtctccatatcttgaaagaggcaaagagctgcttcttcgttccgggcattccccctgctgttcctactgaagatcacaaaagagatagccggcggtggcgatggtggtggcggaaattgagagccgcggcctgaatgcggggccggcggtggcagacaagcggaggcggcggaaaatgctcgtcaacctggtccgctgggagacgagcagtttccgcgcgtggggttcggctggcgggcgacggcgctctgctctgggtggtggcacactggagagatgaaacatctagagggaaaatggaaagagggggagaaatttgttttgttgccaaaagaaaacaaatttcttcgagtacatattatatatacagtatatcaaatggctctgatttcttcttgtcttggaaattacagcctaacttattagcttagaaggacgcgactataccgagaccggtatcacgatagggctatcgcgcgacgcgcgcatctggcgattccgcaccgcgcgcgcgccccatgccaaaaacggtaaccacctttttcccgggcccccgcgcgtgccatcgctaaaaaaggaaagcacgcgcttgcgcgcgcaagcgccgtgcgatgcacgcctcgctagctggcgtgggccccacctaaaacagcgcgatgcgcctctctccctcactccaacccatccggagacatcaatccacacacagccgccacggtggtaaaaatcagaaaaaaatcgccatcttggaagaggagaaggaggagaagcaaatccaagaaaaaatatccaagtaaagtacacatgaagttcaaattctgtcttctgtgagatccatccacaaaaaaaaactaacctagaaacttttagatcttctctgtattcttcgacaaacaaattgatatgaatctgtgctgtaattttgtgagtaattttgtgagtaatgagctgtagtcttgttttctgtcttccttcttgatttctgtcttcctttataccccaaattcacattctagtgctactcttgatttctgtcttcctttataccccaaattcactttctagtgctgctgagaaaaaaagttgtagagaaggcatgagtactggtgtttcaaaaaactcagagcaatttctaggaacatgcaacttacttccagataaacttgaattcacaatccctagtttacagtttagacagcatgaaaacatcccatctagttacctctcagtgcaatatgaacagaaaagttactttacttcccaaaataaatttgaatttgcattccctagttacataggcatgagtgctggtgttggaaatctcatagcaattttaacagaagtctcagtgcatttttaacagaaaagttacttctaacacttcaatgagttacttccaagaaacattaagttacttctcaccgtgcattaagttacttctcactgtgcattaggttctcatagcaattttaacagtctcagtgcagttttaacagaaagttacttgtaacaattcaattagttacttcctagaaacatggaagttacttccctataaacttgaatttacatttcctagttacacattttgtaccttgtgtctatatacagcatgatgcatcacctagttgcgtctcaatttcatcttgtactgcatcaaaacaaattgtgaaaaaaaaattcattaatatagccactggtcttaatttgagaaaattgcttcctagaaagcatctaaaaaagacatgctgcaaaaactaaaagttacttcttcccccctcccccccaaattactgaattacctcaatgaatgctctgtataaactaactttgttactaatagcctgaaacacatgcagcaaaaatggactttgacctcaacagtatcccggaattagtttctggtgaaaatgaacctccagtacaccatttactagttgatgatgaagacagaaatgaaacatacttccctataaatctgactgacactagcatggagattcctgctataaatttggacgacacttttgactttgaaactatgtatactactggtgatgctggaagtttacaagcacacaatgtagccaatgatgagatgcaagtatttgaagccaatgatgagatgcaaatatttgaaggcgatgatgagatgcaagtatttgaagaaatgtcagatcgtgcagacacaatgcatactagtgttgcaactggcgcaacaactgctactgccaacacaatttcaagtgaagacactggaacagatgattcagaagcacagtcagcgccatcacaggatattccgtgcagcacacaagtgccgtacctcaccttgactttcaactcagaggaggaagcaagggctcactacaacaggtacgcaaagcgcgttggattttcaatcaaaatcaacacttcaaggaagtcagccaaagatggagaacgtgacaaagtaatgtttgtttgcaacaaatgtggtccagaagaaaaaacgggtgaagcgtgccccccaaagaaaatgaaaagaagtagaacaagacaggctgcctgcaaagcaaggatgacagtgaagaggaaaggagctaggtgggaagtaattcagtttgttgaagaacacacacatcctctggttagaaagttttcactcaagaaattcctaaggtcacatagagcaataccgaaagaggaaaaagatttcatcacaatgctgcacggagttaatctctcagctggtacaattattgtcacgaccggaaataacccaacgggcgttccttacgtgcgtgtattattccttgtccaaggaggcaaggtacaccaaaagttgatacaattcagagtttaacaagcggaagcgtaaatagttaattattacatgggcagcgatggcccaacacactcaaagacaatgaaaaacagcggaagactaaggcgacgaccacaggcgcttgacggcaggcacgagctagacaccaaagccttcatcatccaggggcttctcttctgggtttgggaaaaattgagcaagactgagtacaaccaccgtactcaacaagacacacccacaagtgcagcataaatgcaaaggagt

SEQ ID NO: 10920 - DNA, 736 bp, Oryza sativa
  unsure (1)..(736): unsure at all n locations
nnnnnnnnnnnnnnnnnnnnnnnnnnnnnnnnnnnnnnnnnnnnnnnnnnnnnnnnnnnttgaacaaagtggcgtaggactgcaatatccctcagattcagaccagcatctcaatctaggaaatgacaacacatgaaagaaaattcatcttgaaccagagtgctaaatcagctagtatttcatatgcacgccccttcagaaaacatcaagttgatgactctcaaatttattaatgggtaggctggtagcaacctcagcctgcatctggcttcagttggtgggcacgccaaatgtgccaattcacagtacatcgcaatcaagcaaatcgctgcctcaagcatagcgcaggagcaggttcagtaaacccgggcgcttacctcatttctcccaacttcctccttccaatgatcggcgccccattcgccaacccgcgatgctccagagcacatcatcacgtcgaggtcagtgtactcacgaatcacctcgaattgctacagcacaaatgcagagcaaccagctcccgatcagaacacatcgtccacactccatttgttcacatgttgatgaaaaaaaaaaagaaaaagcaacctgatggacgaggtgcacggtgggcgcgaggaacaccacgatcccgcgcggggccttcccggcgcgcacccggcgtgcgtgctcgcgcgcgagcatgacggcgaccatggtctttcccgaccccgtgtcgagcaccgcgatggtgttc

SEQ ID NO: 10921 - DNA, 728 bp, Oryza sativa
  unsure (1)..(728): unsure at all n locations
tcaccgagaagtcgttggtggtggtggtaatggtgtagaacggcaccggctgcnacggccggcggttcgagaggcagaaggtggcctgcgcaaccacgggctcggcggtggtggcggactcgtcgccgttgtcgagcgagaggtgaaagnagatgaagtcggtgttgctgggagaccggcctctcggcgcggcgcgnatgcgccaggcgcggccggccgccgacgcggaacgggcgggagaagatgggatgggctggcagctggctcgcctgcacgttcagggtgccggagtacccgtcgatcctgagcaagtggcagcctctcgcggcggaggccccggccgccgcgatcggcgggagcgtcgccgtcggcggcatggtcggtcggtcggcgcgagccacaacttgcggctctggtcgggtttccttccgttttgtagttgttttgctcgttagttttacggtttcaggagcgtttggtctcagaagaaagaaaatcctttgctagctccgaacttgccagcaacaatgaactttgtagctgtgagtggaaagaatgggaatacttgcccggaaaagggccctggtacacaaaggcctggtttagttggggagaaattttagatttggttgtcacattaaataggggaatatannnnnnnnnnnnnnnnnnnnnnnnnnnnnnnnnnnnnnnnnnnnnnnnnnnnnnnnnnnnnnnnnnnnnnnnnn

SEQ ID NO: 10922 - DNA, 765 bp, Oryza sativa
  unsure (1)..(765): unsure at all n locations
atttgaaaatatttttttctacaaacttggtcaaactaaaagctaggatggacagaaaaaaaccgaaccaaaaagatcgaaaccgagaccgaaaaattcagtcatcaattcggtcctaggtagtgaaagaccgaattttgtctaaatgcaacctacaatccactagttcaataggattaaactctaattttcacatccctacttcttctaggtatgcaacctaataagaatctttactcataagtgcttacgatttttttgggtgatttttgtattgaaaatttccattatttctttgcatatatgaaaatgttgttgaatttcggtcaggaccgagaccgaatttgtcggtcctgatatttttacgttgaaattcggtcttcacttttcaaataccgaaagaccgaagaccaaaattttcggtcagaccgaatgcgcacctatactaaaagcagtttgactttgaccaaagtcaaaacatcttataacttgaaacggagggagtagtattttgcccaaggatgaattttgccccccatatttgaattaaaaaatatatatagtgtcaacttttgcagaacattttatcttcatatccattaagtgtactatttagactaccaagtgctttctctaagacgtatctttaatctctccaaacactgaagcacaataaaacatatatagagagnnnnnnnnnnnnnnnnnnnnnnnnnnnnnnnnnnnnnnnnnnnnnnnnnnnnnnnnnnnnnnnnnnnnnnnnnn

SEQ ID NO: 10923 - DNA, 712 bp, Oryza sativa
  unsure (1)..(712): unsure at all n locations
tagatttagtgtacatacagcaagccattgctagaatgctagaaatgactcaaaatggttacatataataattttaaatgaataggaacctctcaggttaatgctgagcagttgagctaaattaacttgaatccattgtacctattctgattaactggtctgttttctctctaatacctggtccagaattattaactcgaatggcaacaggtacataataggtatttcataattgcatgcatataatatagcgatccaaaagaaacataagtaaaanctttgcgatactaaccaatcctgcgccagcatgatctctaatataagttgcatccatgtagcgctcctcttctattgcactctgcatgccaaaaagattagaaaagagtttcaattatcttgtaattatcaaatatgttcccactattttggccatggaaaataatttggattcattgctctacctacaaaagcaatttatttacatccttctgttatcagtagaagttagacatcttttgctgaataatacagtgggtacaaatatgttagcttggggaaatttggggtgcaagactacgttgttcttccataaattggttatttcagctagtaccaaacttgttagttattatttattattttccatcaaatcaannnnnnnnnnnnnnnnnnnnnnnnnnnnnnnnnnnnnnnnnnnnnnnnnnnnnnnnnn

SEQ ID NO: 10924 - DNA, 377 bp, Oryza sativa
ttccttttccgcatctcgcgctccctctcctttaacttggcctgggttattacatagtatatgtgaagctacaaagctacattcagtaaacaaagcatcagagtacatcagttaaattgactgacttgttcatccagtttggccttggcagcttgctctgcttccttttcagcggattttagttctgctatgtactcattaaaagcaacctctctttcttcgtgcttcatggctttgtaccttgcatcgctccggaaattttctttcacctgcatgatgtaatacactagtacttaactcatgagttgtgtacagtgagcaactttaaaatgttactgtgtactctctccgtttcacaatgtaagtcattctagcat

SEQ ID NO: 10925 - DNA, 60172 bp, Oryza sativa
aaatgctagaatgacttacactgtgaaacagagggagtagtactgtagtcctaatacactaaaagataccatccaagtaaaagttggagttatggtttaaaagataccataagaacagatacgcatgaccacatgcaagttagatgatcaattatcatgacagatcagaccttcatgcttcattgaagtccattcagaacatatcaggatgttaaagacttgtataaaagaaaggttacactagaccaccagtacaatactccctccattccaaattgatctacatatttcataggtacaccaagaccaagaaaaactaataactctctcatactatatttactctagcaacaaactcaatgcatgcaccatccccactatttcctagccaataggaaatcaagatattgcatgtgggttataaatacttgtatgcatggatgcatgcatcaatgtccatttactccaatgcacaaataacgaatagacttaatgaatgaacacaaatatgtagatcatttaggaataacctcaaaaaaactatatgtagatcaatttggaatggagggagtagttgttaaaaggccaactccctaaatcgttggtcggcattcaaaggaactcggttaatccctaaggcatgcaaataataatatgaagtatcacaactagaaaaaataatttaaacacaataagagattgaacacattcctgctatcatgattagaacataacaggactgaaaactgacaaggacaacaccctggaagtatcatgcagccactgtattttataatctgtagatgtatacaacaaggtcgttgcagggtaaattgaatgccatttttttcatgaataagatctgcctctttcatcttttggcacaacatgtttacttgtatggtgataagagtacaaggactttactttggtccaacggctagtagaggttatgtctttactttctcgaagcattgatttgaactcagctatcacagcattgcgcactgattgaactttctcttcaatcgatttcaccctgtggaaaattggaaatgcgtcaagtatagtacatgaactaatatgatttaaaaattgatattcaaaaatgttaatagaagggtgtgcatacttctcgttgaaaagagcatccctttcttttcggtccaaggcttcaaaccttggatcagtgccccattttcttttgaattccttgtaatccttattggagttgatgtcctgcattttatgtattaagatggtatgaccctaaaaaaaaagcaagtatacaggacagaaaactggatccatttggcaattatcgcacatcaaagtaagttcatgtgaaaaactcaaacaacttttcagaaagtatcaataacgaacctcggatgcttcttctagtaactgtttatacgcctccactgcagctctctgagcagctcttttctctttccgctcctcgtcagcacgtgtccgaacatactgctcaaatgtagaccgtctcctcgagtgacttggaatagcctgtgacggacaatctagtataaacatcatattactaaactaaggaaaaagtctacttaacacctagggcatgtttggaaaaagggttaggaaaatgttatcccaccctccaaaggacaggatataatctctaccatcaattcatctcacctcagtttatcccaacccttcattcatttctatttcccaatcccaccctccaccctaaagcataaaactacatattatgcatttgtgcctcctgaacaatgcaaaatgctgaactgtttaaataactgctagtgtggttttgaaggtagtttggccacatgacctgtgtggcatggagtggttttgaccatagtcgctgaggcaccgcttagatgttaaggaaaattcagggatcaaggcatccctccaccttgtgggcacaaccaggggagagagagagagagcagaggagaaggcaacatagacagtagtgcatccatcctaatgtggatttgttctaccatcctccccaccgcctcaccgccagtgaccttgctgtcttagcatcgcccaatccagcccatcatcctcatcctattgccaagtttagtgttccattgcttagcaccgatttactcctctcccttcccttctgctctgcctttgatatagtgccatgacaccattgctgctcgttgttgtggcagctaggttagaagacacaggggagccaggctaggaggctgcgggagtgggaaaggataacatgtggactggtttggtgctttacatgggctgttaggtttgagccttagtgtgtaatgtgttgtttatagcccatattttttatcttttcttcttttcagctgtgtataaggtatggccttgtcttacgtgttgccttgccttcaccttaccacttaggctgtaaggcggtgactttgcctcaccttatcaccttagcagccatggttttgacaaataagagatgatatctgccttcctcgcaaactcagcaactaaaaatatttcaattagttctcatgccactctcggaacccccatgaatgttttgcatggcaaaataatcttaactgtataacacatggaccttgattaaaaaaaaaattagccttaagtgatggctatgtgtcagccatgtcactcgccaggtggcaaaactaccttcaaaaccacggcatcttaggggttatttagatcattttgagtttagggagtaaaatgcttcgttttatactgaagggggccaagtagaccctgtcctataatttataggattagcagtttagcactgccactgtataaaggtacgacacagcagtaggccaataaaagtaaagtatatttactaaacactataaaaaatgaagtgttactgtgtaagcatttagttcttctaagtaggacacatcaaatacatagtccagtttttttttcctaatcggctggaattttgaagtctcataaatcaaatgaatgtgcgttatgttttttcccaaatttcctgaacaaaagttaacaggcatctatgtacaacttactaagatcaagataatacatcctatacgagtaacaaaggtaaataatcaaccaccagaaactgcacatgacatcatgcattacaggtgaaaaatgtttccgacacccaaggtaaccatagcataattttacaacaggtcaacagcataagtgatagtatgccaagtcataggcaacgctaagaaaaaaaattaacaagtctacaaaactgtacaaaatgccaagaaaaacaaaccttaaaacgtggatcaaacactatttttgggagttccttttcccactttgaaaatggcaatacacctctttcctttaacatctcctgtgaaattaaaaaactcatttaggtcatgcaatccattcgtcaaaaaatcagctagttctattcatgatttcatatagaactgaggcacagctatcctaattatccaactacacaaaatagaaaaccaaaagctgtctaagaaaattataaagcaaaccgtaaattgcagaccactacaaaacagtaatgaccaaacagaactaatgtaaagtgataacatggaaaatttcaatgacaaacaaaaggctcagtcagaagtgaaaataccaccttaaactgacgagtacactcctcttcacttgggccatgttcctcatcatctgaatttgaagaggaatctgacatattaccatcaccactgttatcttttgatttctcgccgctaattgagacttgatgtcccataggtgcagcatcagttgttttagacccattcagctcggatgcactagatggagtagcaagaggtgaaggcacactggaagcgccagcatcctgcaatttcttctttattaaatccaaagcagaagacgatgcaggggcaactgtttgtcgaagtggcaacgaatcacggccacctgtctgtacagcaggagtatcaatatcaatacttatttcctctttattccctatcgtgccagcatcttgcagcgaagttgaacttcctttcaatggaccagactcggcattcttgatgagctcagccacctctggtggaagctgccagctgctaacctgttcagttttagaaatgagttatatacttatatataagttcttgtgaagtcgtggcattgaaatacctacatagacattcaatattgagattatgtcataatataggccttacctttagcttattatcatagtaatatttctttccatcacttgtcgttactatgctccagtcagtgccagccagtttgtccctgtcgaagtgaggtgtttaatttttcatgtggcacgaaatttatgagcaagaacagaataacagatcaagacatttatatgggtaaagagggaaagagcaaaagccaaaaataatagcagcattcataaatattgcaacttctactttttgaaaaacatcacagacctgtttgagaaagctcaattctagattttttttttctttagctaattaaggaaacatgcaaatttattcatcaacttggtgccatatgagaacattaatgaatgaactactagaaggctttgagcaacaaaatatcattcatatatgctcgaaatgaaaaaatgatctcacatagtatcattctgcataattagacttattttgaacacaatgagaacatatgtggtcaagtaacttagaaagcggctaacctacaggaaattcccgaccattccgcctatcgttttgttttgtacagactatgaaaaggaaactaccagtataccattttcatccataattctggaaaaatacggtatagttctgacaacccatcagaataaaatataccttagcctaaacccttgtgcatcatcatggcatattttaaattacttacacccttctttgaatgttcaacaacaattgcaagtgatgcgaatttataatgtaaacatactgtgatttgcttgccaatagttatattccaatagttccaatgttgttttgatttccatctctatgttttcaattccgttttcaagaaaaatatggttctggaaacgatttttccaaccattctcgtccctagttgcatgagcatgatgacatttgtggcctataaagtatttgttaaacaagcaccatagatatacaactaatcagccgctacacttatcaaggcctagttcggtagagcaactagttgtggcaacttcctcgttttctgttagtcccaaactgctaaacggtgtgttttgtgcaaaaaaattcaatatagaagtttttcacaaaaatcaaataaatccatttttcaaatttacaatggttaacacttaattaataatgtgcattagatctgccccgttttcttagcagtcatcagctccagccaaactgttgggacaaactaagcctaaataatgagtaccaagcatgttaggtagtcttgcagtcaacaccattttcagtttcagaaataccaaattaaagcaagatttatagtagtttcaaaaatgcaagataatgttagatctttttctttttttaaaaaaaagtaaagctttagggatttcttgtcttactatccatgtcaaacatgaattttgctaactttttggctattgtgcaggttaccagaaatcatgtaacaatgtcaccaaaatcggttgtcccaaataagttgtagcactcctaattgtgtggaaaacagaaaccaatttcaaaaggtgacttaaccagttacaaccctcacaagagaatatataatttctgttataaaatctgttaaagatagcaaagaatataggaagttctcacactaacgtaccaagaaactggaactggctgggctgcgaccttctcaggctgcaggaaaacgaatgaaataaattagttaaattgtgatgctaaattgctatgccgtagactagaattaagtcatattacttgatacagctattcctctgtgcaactacctcccctttataaccaggtggtttttgataagttgattctccagtcaaggcattgtaataatatacaacaccagcctctgtcttgtgtgcagaccatgaatctgaatcctgaatggcagtagttcttttgtcctcgagctgatcgctgttttggcttccctgttctgcagcatacaaaagatcacaagaattaactggaccactaatactgatcatcaaattaagtaaaactgtcccagttgatgaaagttaagctaacgcacgagtgggctgctcagatccaggatttgctgatgatagctccttggaatccctgtcagttgttgagacaccgggtggttgtatgcttggcaagtatgcagtcacagaagaactcccaaccatcggcctaccaagaggccctagaagaccagatgggtatgattggaaggggggttgctgaaaaccagtaggctgtgggggatatccccatagaggctgaggttgaaccccatgtgctgaaggataggaggggtacaactgttgctgaccaggctgttgaaaagcagttggagactgcgatgtttggggaaaaggagaagcagatggagtcataggtctcccaaggaggcttggtggagcagacaagattgtggaaggttgtccaggtacagaagcaccaatggccccaaaaacctccgggcgagttggaagtgatggatttgttggcatctgaacagtgattgaaggacttccagcagtacttgttgatggtgggcctgtcgacaactgcatggtctggggactagcctctgggacacttcgagtatcagacctggaagtgctaacatctgagctcccctgtaataattcaaaattattagtaaattgatcattataacccacgcatataaaagaaagttggtcgaagcatatacactgtttgaaggtaactgagatgcctggggctgtgcctgttgtgggcttgcaacaaaagtattgatggatggtctgggtggacctggaaatggcaagcgaatagatccaggaggatttggtggcatagctcctgctcctggaaatgctgaacttgggcgagctaaattcataggagctggaggttgcaaggatgatggtggaacaaaccgtgaaacttggacagcatggtttgtgccctggaagaaaagaaagcatcaacagtcagtcagtgagtcagagaagaggattcagatcattaagtaaaatggacaaataaaaatgttcaatattaatgctagcaataaagacatgaggaattacggtgtcaagttgaaactgctgaccagtaggcaagccagcattagcatgcgagactacattatatgaaaaagacggcctgttcccaaaatattgccctgggacaggaggctgaagagctgcagcagccactgaaggagccatcatggcctggaaggaaaagagaagacgaaagtttcacatggggggattccactctgacaagtaaagccatcatatggtacattaatccaacttaactttgttgagttgtttgctatgattgaataaaacaggaacaacaatagtcctctatttatatgtgttttgttattttatatgaattgtactccctccgtttcataatgtaagactttctagcattgtccacattcatgtagatgttaatgaatctagacacatatatgtttggatttattaatatctatatgaatgtggacaatgctagaatgacttacattatgaaatggaggaagtaccagattatgctgagacattaaagagccatgtaacttctgctgcataaacagctttcaggtgaccaattatgatgaactgattactaacagttttgtgaccaattttggttatatatcgatatgaaaggttcaacagttttgtgtgcaagaacttatcagcttaataacatttcacatgagaagagaaagactaatctcacaacattttgtatcagagcaaaacgtaagcaggcatgtttatcatcagatcaagataaaagcagagtaaaatgagaacaaaaattataaacacaactcgtactgctgctgcgtatatctaaacaagaaatttcttcagataaagtatgagctagccatcggctactgaagctaaacaggagttaacaaaatctgatatgaatcttcaccgccactaggaactataaatgctgcaatgtgttgatcagcaaattaaacggcagctgatatcaacttttgaagcccacaagagttcatagggaatctataaagcagaaattctcattttctgcagttgtatacaaataatagcactaattaacgcaacagtaagtcaccgctcataatctgagctgaacaccacaaattggtcccaacaacgctatataacattgcttctcattcccaaggaaaaaaataaaacgacatttcgtgcagttaaggtgaaaacaaaaaggtatggagtataatataattgcgatgtgaagcatagagggtgcacgataccctaccggaggggaagctagctgctgctgggccgcaccactgcccacctgcggccggggtgacggcctcggaagaacgttgtacgagaacgccggcgccggggggctcgcgtaagcgggcgacccggcgaactgcggccgcgggggccctggagttgcaggagacgccggattcgccggcatagacggcgccgcaggaccggagccggaggtaggagcgggagcggccggggcgtctccctccaccgcactatccaccaccgccggtgtcgttgccgccgcgacgacgccggaatcgaacggtccttccgattccgacgccggggcagcggacggcacttccgccgcctccgggttggtcgcgtcggaggcggccgtcgccggcgtcgccatgggagaggaggagtcggggggcaaggcctagggtttttgcggcctaggcgagcggagccggatgttgcgagaggggagcagtaaccggagcgagcggccgaattgagaattgggggatgcacgagcgttgacacgtgggccgtgggctggatctgggccgtgggctgtaatgggcgtcaactcgtagtttggccttggttttactcatgaaaaatttatgattaatcatatcttactatataaagttgatgtctaccaatctttaaaagctcaacatgtaagtgtgccacatcattacccactgataattattatctagagtattttaaatcacatgcaagcatgtcacatcatcatccactagcaattactccctccgcctcataatataagggattttagaggtatgtgagactatattatgggatggagggagtattatatatttcctccgtttcataatgtaagtcattctatcattttcatatttatattgatgttaataaatctagacatgtatctatttagattcataacatcaatataaatgtgggaaatgatataataacttacattgtgaaacagagggagtagagtattttaaatatcacgcaaatatgatataccatttatatatttttagaactcaatagacaattaatgtcaaatcattatctccacgtcattttcacattatttaagcatgtacatataccatttctataatatacaacatgcatccattcatatatcccgcgcataactcaaggtataaactagttaattattagggcatgtacaaagatgcttattaacggattctctccgttgccatgcagagtaattttggttgccatgcagagtaattttggtaacatagagaagagaaaggggaggaaagagaaacatgattgctacgcacgataatagctcagagtcaactattagcatttattaaagaaatttttgttgtatcaggtggataaaaggaaagaagagtaataaaaaaatatttatgtgcattaatgcgaaggttaagagattttgttgtctcaactattgcaggaaaatagtctctaagtgagtatgtattaactaagagctcatatcagagtatacctttgtacatgcccagttccacaaagaaacgattgtgtacagcaacagtcttaaaacaattgtatacagtaacagtgaaaaaatactgcatactgtggattcagtagtagaaatatcaaaactgtatgcaatgttgtcttttctaatccacaaagaaagcagtacagttcagtagtagaaatatcaaaactgttagtgtaatgctgtcttgtctgatccaaaaaaaaaaagagtgcagtacaacgtcatattgcagtgtcagcatgtatgtgcatggaacacttgcaattcgggaaccctcaaaactctagtctattctctaaaaatagaagaggaatgccctaattaattctctggccagaccaaatgctcgataggctcttcactcacttgccaagctccttcagatagttcatcaaatagttgactgtattcccagttcgagaacccaaggaaaaaccacaggttctcagcagattgctcccctgatttgattcgtctggtgacctgggctgtggcggctacgtttccataatacacaccgggtataacctgcaagtacccatcgaaggctactctggaaaggctcacaaggtaatagccctgcaccacaacaggtccgccgtagaaaagcggggcgtgcttgatcggctccatggagccgtccagattcttgaaggtgtcccagcttaagcgcttgttgatgatcaagccatgaaagccctcacgagagtcagcggatacgatgagcacctgggagttgtcaaatggaacggcagacccgagcttcgaagttgcagtgagcacggaacctgtgaggacacgtgcctcgttcctctctgaatgacttggtgaatgggaaccaacatcgttgctgattttgtcgctgttatcaaactgaattgcctgtggtgcatcaccttgcacgaccgttttcttcttccacagaaatcctgcgagccaaaaagagcgcaggcattagaatattccttcatcacagtgatagtggacagtgaaaacactttcttattaatctttggtgcaacatttgggaatgcccaggtcagctgcgaacggttggtttatatatgaaatgtgaacaatataaaggaattgagaaattagaataacaatgtcagaaaatatcaaagccattagtcacatggtggttcaatcaagcagaccactgttcacgtcgcattccctggggttttcagcacttctaacaaggtagtctaccatcaagcagctacccagccaagacactaatatacatcgtatgctagccaacaaaaagacagtggagtggacacttttgagagtggcaacaacagcgcatcctgtagtaacaaacactactatagtaagacaacatatatcatcgtactaggttcatttattttttaaaatttatgagttatgagatttttgcactaacctttatattccaacaggtggggtgaattgctagcatgagactccaagaattcaaataaattagaaactgaaattcctctttcatatgatattgcacttttgttctctgccggaaaaaacaacaatgtgggataacgctcctcctgtgaacacatgaaggttacattagtattgtcaatataagcacttcaatacaaaaatggtaaggtgaagcaaggcccttcagtaccaaaaaaatagaatagattcataagtatatttaattagatggaccatctatttatttttaattcaagcttcagtactgctgaacagaactatggtcattataacatctccaacagtctaatgacaaggtcattcttaagactcaaatgatgagactttaatagtttaatcagtccaaataaaccaaaacatacttcttgaatgactgttgccgataccggtacatttattacgaacaatgaaatgagactatttcggggtaaacaacagcaataagtatggagaacttctatctttttttttattagtcaggagacagagcaaacttcaataaatggcaaatatttgattaccttgccaactgatttcagtaaatgatggcattcatttgatgtgcagtctattagataaatagctggaaaacccttcatggtagattcttcttctttctctgcaaccaaaaagatgattcatcagtgccacaggtaattcacgtttgaagtgccgtaccatataaacggtgagctccaacaggctatagggttatcttactatggtgtgacacatgtatgattatatataggaaatgcattgcatagtgctgcctaaaagtttgctagcatatgttgcattacattctggtatgatataatttgattgacgggatgatcctaaaattcgaactaaacaaagctaaatagcaggaaattttaaatatttctgagactaagtttaatctaagttctcagcatgatattggtgaatatgttattaccttcaatctgcaagtcttgagcctgtaaaaattgagaatttgaactcaaaaagttcttgaatgatcgatatacctcacggacaacaagctctgttcgctggcaaaatccgcaccaagagttgctgaaaagcaccaatacatccttcttccaagcagatgaaatattttcagtgtttgaaaacggcagttcactttttgaaacacaaccttcaaatccaaagaccaacatacaaaaattacttgttgtcaactgggggatggaatctgcctcgtggaaatcacggttaataaaaggtggtctcagaagctccttcgaacttatgacagataaggctgaacgataatatggagatagacttcgattcataaaatggtcgagaaaatttgctaaagaagggtaggtaaattcaatctcatctggaaagacataatgcttttgctgaattgggtcaattattacaagggatggcattctcgatccaccagttaaagtttgcagaagcctataaccaccatcagagaagaagagtgaacccgcaaaatgttcatcaggtatacttggagtttcctgctctgtataatatgtgttatcgcccacaaggctactggaagagcttaatgctgcatgcacaggatatttgctatcactttcttctgatccttcatctagaataaataggttatcctcataaatggcatcctcaattcttcgagattcttgacccaggactgaaaacacagcatcttgctgatttgctgatcctgacttctgttggttaaaattcacatttgtcccatcgggttccaaaatgtctaaagcttctctaactgtttcctcatctttgtgtttgtgtaatatatgaccaacttcattgctggaatgcacatcagtggagacctcttcctgaagatcagcacttgtatctgaagcctcagttttatgttcttgttcctccatttttgtatcactacagtcaagatcttctttattgatcttacagaaatttttaggagcattgctactgtgcacatcaacagaaatatcttcctgcagatcaaggcttacatctgaggcctttgttttgtgttcttcctccacttctgtatcactggattcaagatgtttttcattgttatcacagtaatttgcaggacctttctcaagtttaatgggtgcttgtctatcattgatatattcagcttctgttgccctgttttcatgaacagaatcttcagtgtaatcatcattaccaccgtctgaactggcacatgacccttcatttctttcaagttgactatctcgaattgacagagattccaccacttggacttcagaatcatcagacagcttctttatggcaacatcttttgcaacaaaacttatctttgttttctttgacctatgtgctggtcttgttttgtgtatcagttttgttagaatatcatataatggattatcggtactaccttggctatcacttctgtacgaaatactttctccatcattgaccaccattactgacattttctccccaatttccattaatttggaggcccaatcattcagcctagttcgttcagtatgggcagatctacctgtgctaactagggaaggaacagctttagagctcattctggatttaccactagttagaccaccagtactgaaatgagatggataatttttctgcacatattcccttagtagtttgagggatagtttgctttcatctctgacttttgaagaatctgacaatctatcaataaatagaatagccgatgatctacttgcaggaaaggtagcgataccacttgcatcaatatccatctacacatatagcatgcaactcgaaaggtcactggataggtcattacagaaagaaagaagaaactcatagaatgcatccaggacatgtcatttctatataatacaacattatgtcatcaagataattgcatacttctaatatatgaacagaagtattctctttatgtgcagcccaagaaaatttttcaagaagagcaacacatttgcaaagagagaaacatggttcaaaggatttgaattggtaagcttggaatagaatataaatgcaagcagctatgagctatcttcttagtccattttcaaccaatatcgaatagagttgtaagaaaagtaataaggatatgcacattgttatatctgtcactcagttacatgacagttgtcagttgacaactttttatggaaagaagttatgaaattgtttttcacctacctcgttaatgttaagattatgataagattgcagtaggcttcttaggtcatcaccttcttttgcaacaattgaacaattggtgcaccccagataatgaacactgaggaaccatgtctccgaattgccttcattgataaactctgatgaaggtaatgatgatctttcagttataaggccaaatctaactttctctggaggaagaaaataatctcttgatagagcagtaagctttgcatagaaactttcaaactgttgaagcttttccgctgtacacaactttctattttcatcagttgtaatcccattttgatctgacatgcttccgtttgctaaggtaaatccacctttccaaggagagccagcaagctgaaccccacctccaaaaatcagttcttcatcctctataacctgttttcatctcaaataagtatattttcagggatgtttctcctggtatttgctgaatcttcgtagttcagatagatatttcatatttcttctcaaagaaattagcagtgtaattaatcagagataaatgtgatcctctttgctacacttacaagctctagtggcccatccgattctcctgttagtgccttcccagaaatgtcaactgtatgataagtgatacaaatgagcatagcatgcacatgctggaatggagtggaaccattatcatttattcaaaagttaaatgataaaggtcatggagcaagtcatgcttgaaatggattgagagttaaagattaaagtagatcaatttgaacgaattcataaaaggagaaaacaaaccaaatactccttggagccccacatgaggatacttttaccatcttataccatatttgcaccccctgactcctggcttttgtggtcttataagttgcatgtgcatttggtatattaaattatttagtaataattaacttaagtcagaatagaataaccaaactaggccatttatttcttttagaaagggaaaaaatcgtgcccactcatgttcagggaaagaactacttgacctactgcggctatcaaacacaatcttaacaaagcccctaaaaaatatagcagcgagagaatacgtaatagttaaatgaatcataaagagtggatcagaattgacgaaccattttctgtgtgatttttggatgaagtgccctcggttctgttgctcccaccatgagccaatttggaaaaccacccacagaattcagatagaactacagctttgtcagttgattcaacaaaagcctccacatcttccttcgtatgcaaaaccacaaatggggcctctgcatgcttgagtgacataatatagtggactgaagacaatatctcacgtgcacgaagcttcccttcatatttgaatggcaacgagcgttggtagtatatgaactttattccttctgtggcaccaagtacatccgttagcaacttctcagaatttctgtacacagccatcaacttgagatgcccgagctcctgctcatcggcagcaaccaaaagttctatctcggccatcagtgatcttgactcgccataccctacagattatcataaacaaaaacagtagaagtaaggactttgcgcgcaaaaagatcccatacaagcctttttcctttgctggatactatgaactcgctgtaatacaaatgttcgcccgggtctttgggggtaaaatgttgcattttcatagaattaaattcgcaattatgagagcgtttagcttaaattcgcatttatgagagcatttaacttattaaactacgcagagctgactcaaaactcaaaagggaataaagcatatattaacagaagtgtaggatcttacaacggttgagcatttcagactacaaaattgtcgcggtttccgtaatcaatcaactcagcagaagtacagaacaaaatgtgttcctagtcccttatcgtttatataattcgacacatggagattcacatttccgctaagagagaaaaactcagctctccaaattaaccgcatagtgcgaccacgcgactcatcggagaaccagagctctcgactaggaacggatagggggtgctcacatggcatggtgacgacgagcaggatgtgggggtgaagccggatctgggaggagaagttggccctggtcaggacctgccattccgcgcgcccggaggcggcggcaccggagctcgccgccgccgctgtcgcagatgcccccagctgcgacgccgcgaggagggagaggaggagcggcaacgccgcgccgaggagggggaggcgcatggcgggcggccgtccgtcctcgcgcgcggcgggggagttgtgtagtagcgcgagcgccacccccgccgtaggagcccacgactttcgtctcgtgtcgtgggtcgcgggctcgcgaagaggggctcgacccgaccgctggagttcgcggggcgatactctgctgtgtgcccctgccgtcgaaggtccccccccgagttacgaaatcatcccaaaacgagatataaggccaaaacttcaactttttcatcacatcaaaacttttctacatacataaactttaaacttttccgtcacattgttccaatttcaaccaaatttttaattttaacgtgaactaaatacaaccaattaaaactggtcacaatagatccttaagtagttttgaccccggttttatcctacgtagtggctgagttagcgtgggacccacgtgggtcccacatgtcaaagtgaaagtgtcgtttttgtgagtttgttagattggcggcgatgctgcggaggatggtgttcgatccggacggcgccgccagcggggaggtggggagggttcgaggcggcggtggcgcgacgctgttcgccgtgccaaggttgtgtttgttgggctggctgcgaagcgcggggtggcggatggcggggaaccggcgttgaggagcccaacgtcgctgttggaccccaaggcactcctgctccggtcgccgcggtcgccgaagacgtggtatgacgtttctacccctcatatgccatgaattctacttgtacttgtgaggggtagaaacgtcatatcgcatgcgtggctgggtcaatagcgatcgaggtggacggaaaaacgatcggaaattgacagaagtgttaaaaataggaacggggtgaactttgagtgctattaaagtgaaccggtatcttttggtgctataaaatcgaaaacgtaaacttttgatgctatataaccaattttcctaaatatttatgagtggggggacacttcttacaattagttttttttcttcatgtgccattccaatctccaaccgaagaaatccaagaataagcccatgcttaaatcgaaagtcttaagaggcaatcgatcgctctaagagatcggtccccctccccacgttgatcacccccttctccatgtggtttcctttttggcacagtattactttcctattttagtaaatttatacaccttaaatttacgcatctaaagtttagagacccatagtttacaagtcaaaagtttatatatccgattcaaaattgaatttgaattcaaatattttttatatatagtatttctatacatctaaagtttataagtcaaaagtttacatacccgattcaaatttgaatttgaattcatatattttttatatatagtatttctatacatctaaagtttatacacctaaagtttatagacccaaagtttataagtcaaaagtttacatacctgattcaaatttgaatttgaattcaaatatgagtttatagacccaaagtttataagtcaaaagtttacatacccgtttcaaattttaatttaaattcaaatattttttatatatagtatttctatacataaatttttctaactttattttttattatttttttaaaaaaatttatggtgtagtaggaatagaagaaggagaggaggaaaaggggaaagagagcgtaagggggatggggatcgatcgcctattagccacaccctgctaaaatgcaccaataagtgtgtaggttagttttttttaacagtatgttagtatttgaactatgataaaaatagagttatgcaaattaaattttggttgtttggattgaagctaattttatcaaatgagaatgttggcaactttaatagaaccacttagatgattgatttactaccactttttatccccattggttatctattaaccgattggttaagttgaatcataccacgtttggaagtgttaacacttgcggttttggccctaccaaagttttatagggtggaaaattgatatggattttttactttttatcttcttagaaaacttattctaaaactagacaaaaaaaacttattatagaaatgatctttttcatggcgccaatatcattgacgcgtggtccaacatgacggcgtcatcccctagccccgatgaaagctaagtcaactaatttgaaggggaggacatatttgcattttttgaaaaaggtcatatttgtaataaaaaatatttacaaataagtcctcggcgacaatgtcattggcacacaaatagatcctcagcgcaaggatattaacgtcgttcctcttcatgttagtgacttagctttcacccaggggcgagggaaataacgccaacgccattggtgttgtcacgttgcactgctcaacgttgatgcccatttattaagcatttgtcaagttgattcgtaccatccatgaaaggtcgtgtgtttcgcgaacgatgaaaggttgtgttgtttagcaagaatcatcttgcttatgttgcttgtgaatgtccattgcgattgaaatacgacgaaagatgagttggttggttttacttcatttgtttcacactgtgcgctgaatatatgtggaacagagtgagtaaacatggatacatcacgatgataaaattgataatgataacatcaaagagatggataaaggttgtctcatgattgttcaatctcgaagagagctttaagccatgtgatcgacattcgtcaggtcaagtgatggagtgctcgagaggattcagggaagcaaaagctttcatccacgtgttcgagggttcttcatgtgtcagttgatgtgtaagtcaacaaacagtacatcacaccacattgcatagagcgagaaggtcccacatatcatctcactccataacatttcttacacgtgggccctacttgcacacgtaccccctccttgcagacagtcagacaccacaagccatcgtccggtgtgctgcacccacgccgttggcgccgaaccttttctcgtggccccccgcgtttccgacgacccaagcaaggtattccaaaaaagagagaaaaaaaaaacaacaaaaatcgcacgccgcagaaacccccacagccacgaacgcacgggcccaaagccccaaagcacaggtgtccggtggtggggcccacctgtcatggtctcccccgtcacagatcccctcctgctctccccgcccgcgacttcgcgactcttatcatctcttcccctcttttcgttccaatccacaggaggagaggcgaggagaggagagcgaaggagcagaggcgaagcacgagtccaatccaaacccgaaaaattcgcgtggcggccaagccatcgacgcgagcgaaacgcacgagcgcgtcgcctccgcctccgccgcgcctcgccatggcggcggccgtctccacggcgccgcgcgcgccgctccccgccggagccgtgtcgtcctcctgctgctggtagtcgtcctcctccgcgtcgatgtcgcgaaggtgggatccgagcccgaaccctagcagcgacagcggcagcaggttgttcctcgcggcgcggcgcggggagcggctgcgcgtgcgccggcttgcgggcgccgcgcccgcaccggcaccacgccgccgcgtttcgtccgtggtgcggttcgacggcggtgaaagcggcgtgcggagccccgacgacgcggacgccggcagcggcgatcggcggaggggctgggacgcgctgttccacgacgcgttccagggcgccgtgcggcggtggagcgagtacgtcggcagccactggcccttggcgcctgccgggaaggatgctgggctcgggaagagggttgagagtcgtcgcgaagagcaggttaggggcgaggtggaggaggaagaggggaagtggagctgggagaggtggaagcagcacttcgcgctaatcgaagagagcgagcgcctcgtcgatgagctgcaggtatatctctcgcacggagattaattcaatcaattcatgtcatttacaaatcacgtgctcttaaccataagtttcaaatttgttgattccagcagaaaatttacgtttttatgtaacatcgagctccagacgtgtacttgtagaaatgcatctgtttaattcctggaccaatatccggctccgtcggttggcttattctaggaataagccaaacggcatatttacaaatggaaaataatttgtgaataaaacttttatatacgtactcttagcgacctaaaagcaaagtctgaaaaataaacttcgatgaaaaaaacctcaaaatcaacttcaaatttaaagttgaaaattcaaattttggccgataagcataagcataagcataagcaaaaagatggggctgagcatgtgtgactgtggactggtcgtggattttgttcatctggaaactaccgtgaattaaacttagttataggagggtgtgctggtggacttcacgatggtatcgatatttctatttgctgtccatgttatctacaagtaacctgaggaaccttagcatagtgtaaacaatatgtccctagaggcttgcattatggaagctaaagccttcttttgttaaggctatatggtttgatgtgctcagaaaatgtgctttgtactgtgagttagactttgtatgtaggcaaagtagacaagttcccgttctccttatgctgaacatagccttacaagtttcctctggagctactattaagttgcataattcaacattgaccattactgaagctaatccattccaatatcaggaagagagccagttacaaacttatctcctcagttcagtggtgcttatacattttaaatgtctgacaatttagttttaaattgtcaaacatgacagtttggtgatatctagaattgtttgaaaccaagtactccctccgtcccaaaatatagcgacttaggactggatgggacatatcctagtacaacgaatctggacattgctatattttgggatggagggagtctgttagatgcataatatctggatataacggtataacctcctcaaacatagcagatggaacttagttgtgtatgaggcagattcaccatatcaattgtgtgcttttgttcatacatgtttttctccccaatgtttttgtgttacaccatcacatatttcctgattgttgtatattgcatttcagctacaactacggactgctgtttatagagaggacttcaggagtgctcacaaactgaagttggctattgcggctacatcaaaaaacgatactgtgggcagagcaatttctgacttaaatgtaaggagtatctcttttttaattgcataaacagcaaatggcacttttgatctttgctaaaatggtgcacagttgatcctatacaagcttataagaggactaatggctagcactattgttgatttgatggaaaataataaataataactaacaagtttggtactagctgaaataaccaatttatggaagaacaacgtagtcttgcaccccaaatttccccaagctaacatatttgtacccactgtattattcagcaaaagatgtctaacttctactgataacagaaggatgtaaataaattgcttttgtaggtagagcaatgaatccaaattattttccatggccaaaatagtgggaacatatttgataattacaagataattgaaactcttttctaatctttttggcatgcagagtgcaatagaagaggagcgctacatggatgcaacttatattagagatcatgctggcgcaggattggttagtatcgcaaagtttttacttatgtttcttttgtatcgctatattatatgcatgcaattatgaaatacctattatgtacctgttgccattcgagttaataattctggaccaggtattagagagaaaacagaccagtaaatcagaataggtacaatggattcaagttaatttagctcaactgctcaagcattagcctgagaggttcctattcatttaaaattattatatgtaaccatttcgagtcatttctagcattctagcaatggcttgctgtatgtacactaaatctactagcaaaatgcccaagctttgctacaggacagaagaaaaaaatcataatatgtcatagctaaatatttttttattcaaatatcttagtatcacttgtttgaaccaaatgttggactattccactatattagaaaatatcagggggaaatttgtaaaaactgcaaaaacaatggcagattcactgccaccatcactagaggcttttaaaaagagtatagatgtttccctgttattacagcataagaataacaatttgattcctctcgtgttttaagcaagcaagcatgataattaaattatatttcaagcaaaatttgaccattttagttacttatcctgacggtggcattaaggctcatactatacatataataataattttaaatgaatggtttagaggttgtgcaagtccacactgtattttctactttgatgtcttgtggcctatgttgtttgtctggtgaatgccacagttagaacttgtttgagaccgagcatggcacctatgctcgatcaggagaatctatcctcaggctcctcaagacctgaaccacttctgtttttagaatgcgtggtgtgatgaggaaggaataataataaacataaaatataagtgtgctgttatgaaggttcagctgtatgcatgtagtatttaagtgttctgtaagtgttctatttttttgcccttatgttctgtagtgcatgcttatccatttctatgttttctttttcttctttccatctgcacaaaagaatgccatcaactgatcctttaaagcacctgcagttgggatggtggtctgggatttctggaaatttgtctgatccatatggtcttataattcgtataagtgctgaacatggtcgatatgtggcgaaaagttacgataccaggtaatagttgtcattttttatcattattatctgcattcttaattacatgtccgatacgaggataactgcctcatgggcaatttagttttttcacctgttctattacagaggcattttcagtcaagatttttgtgcatccgtgttcacgttgtgttcatgaaacagttgggattcttgtttcattccattatgattatcccattgttgatgggaagaaaatccaatagggtatgaagggttagctaatagctactaacgaatgcttgcattgatcaagctgatgccatcatggaaatggttgcatattagcattgataaaatatttgctctacttgctagttgagcctttaattttctcttgttcaggcagctgaattcagatggccctggtttccccatatttgaaatttactttgctgaggccaatggagggtacaatctgcaggtgcgctaaattaaattccaatgaaaaaaatatgcctggaatcataggaatagttctttttgttaccaattgaataagttgaacacgcatttattgttttttcatgcactccctgtaaactcacaatgacatcctttatttctttaatgtggaaattacattataaatatggtaaaggctgagtcttctctctaaaaaaatggtaatggcatctggaagtgtcatattgacctgcatttttctacattttgaataaggaattcactcacctttaggaaatatagtaatagatgaatgcacatcatcaaaggaaaaaaaagagaaaagattgcatgtccacctaggctatcccaaatttgcttttttaaagaaacatcagggcactcccctattccatttttcattacagtggaacaatgatattttaatatttcacatggaaaattatgatttccttttatagttacaaccattgtggttacaaatcctgtatttgcatttttttatatatttgagccaacagttccttttataccaacattattgagctttagtttttttcctcttgatcacaaattagcagattatggcacaaatccttttctttttgtgaagtaccaaaatacagtgtacattgaagttgaacatcacaaatattataacctacaaatgggtttgacatgcatggttatatgacttctctatttggtgtaattttgatagaaataactgacatctttttttaatctaataacctgtgcaaagttatcagaactgctaagcaaactacttgcatattgttgttcttctcatcttttgacaaaatggtattcttgtttacaggcagtgcatctgaaaccagatgacagtgattctcagcagttgtcaaatacgttgagagagaaactaggcatggatagtataaacatatctagcagttcatttggagctaaacatgaggatcacaatgaaggtgtaaacatggatgatcaaaatagtgatgatagtgatatttctgctggtccagctggtttcaaaaacttgccaagcgattcaactccagttcccagggttaaaatactaaaagtggtgcccatggaaaatgttaatcaggactatataatcaaaatttttgatcagatgtcggatgaagatgatgaaaatgataatcctgaggatgaaattgaatcatcagaggacattggtgatggagataacgttgaagaagcagaagcagcttctgcagaagataatgttgatgaatctggcgatgaaagtgatattgaagccttaatatcaattgattttatcacagaggacgacaaggattttatgtctccatcatccacaaaagcctttgaacgaatgccagctagattagaaagaagagaccgtttttcattttcgttctatactgaacaatatagtaaaaggcaagatgtggaaaaagttcaggggatttccaaagaaaaagttggactccgaactgctcagcaggatgatgatgatctccaatttgaccgtgtaaagttagtaggcagcaacagaaaattatcggtaagtattatgctgccgtactgttttatgtttgcttttgatatcctgcatttgtcttaatttgaataaaagattgattgattgtcgatttatggcctatgaactctctgattttgttcctgaattgccagttttttttttgtgaattactgtttgttaaattcacaaaacctttttgtctctgccaattattcttcttcagggtgtttatagtatctttttttcagctgactgttaaatgtcaaattatctaatcttcacattttttttctgcttttatttgcttatcaatgcaagcatatcccctgttcaacaagatttgaataaattttgtagactaaggaaaggcatattgtctaattcagcttgaagtaaataaattttgtagactaaagaaaagcatggatttttcaaattgactgagtttgtctttttcatggtgccattttaatttatcttatgcaggtactacaacttggcatcaagcaacacaataataaggttcagcaaaaattgtacggagttactcacttcagccgtattcagatacctgtctcctcagatcctcttactggtacgttgaaaatgatatttttcacttaggattttagtggtataattgttctcatttagccacaaacttttccttattgctggtattagctgattaggcatctctccttggcaggtttatacatgacggcatcaggttttgactcagaaattcttagcttacaacgaaaatttggtcaatggcgagaggatgattcatctgaagagcacagggacctacagttctatgagtatgttgaggctgtaaagttgaccggtgacaaccttgtgccagcgggtcaggtattatgccttcaactcttgtagccatacaaaactaacaagtactgtaagtaatatgtattcccttgtttttgttcttcccacttgttgaagaaataaaatacatattgacttttcacaaaatagttttctgctaagaagtgcaatcattatactatttcttgacaatcttgtgaattcccttatggcatttttcactctcaagcacttgcacatatcctaaagcaccaacaaggggtaagtaggtcctatccatccttgtttggtgctgtgcaacatgctatttgcagaaccatggaagcacatctccttttgtgtttgttgtgtcttgaggtggctatttcaagtttacaaatcgtgactagttggtgcagcctaaatattgatatcctgtttttctggtgagcactacaatttaggtttatcttatacagtctccatgtcaggttgtcttccgtgcaaaggttggcaaacattatcagcttccacataagggaatcatccctagagaacttggagtggtacttttttctctctcgtagttttagttattttttcttttcaatagtgaacttgactgctatattgtatataggttgctaggtacaaaggggaaaggagaattgcagatccaggtttccaaaaccctcgttgggttgatggcgagcttttgatactagatggaaaggttgaaaactattcatataatgcacatttccttgtatattcacgagatacttttttttaacaggttttgtttgtgaatttgcagttcatcagagatggtcctgtgatagctttcttttactggacatcaaactttcatctttttgaattctttaggcggttgaagcttcctgattagtttcagagaatcagttgaaggtaaatgaattttgtctttgtgtggcccagctgttattgtgctgaagtaatcttcatatgttctattctcgcaccatattgcacttgctatgtttaattatgcatgcagaattggtgccaaaactagttacaaatagtatgacactagtaacaaatagaagaacactactcttttttgggatgctattgaagcattttttactcctgatgtggccaccatgattctgttagcctacatatagtgagaacaaagtgtgtgctctatgctaggtttggatgagcagtgagcatgaatagaccgacccatgaaagttgcgagttgagaagcatgtcccgcgttgtattttctgcatgtctttcctgacttttgaaattagccagttactatagtcgttgccgggaatctgattaggttcgatcttgagacgctctggcaaactgatgttgatataccaaagaatattggaattaagcatttaggatgggtgcactgcatgtcatactacatgtagaggggagagggcccagcaggcacatgttagttggacggtttgaaccataactttctgtcccattttacttattatagttagctgtatgttcgtatgagcaccgaggacttgctctgtttccttgactggttagtatgatcatgcatggagtattttaatgccattcaaatacgtgaatacatgattcttctgcggtgaacataactaacttatctcgtttattgttgagcagctagcaactgctattattccaaccctactttacgcctgcttcatcatgtttttttgtgtgatgtctgcaattttgttcgtaagatactaaaatgctttgcaatcagtctgatctttagcaagaactaaaaagtggatttgttgcttttttatagcaggccattccacaatcttgcatgtcgatgtacataacagaatgtacataatcgtcttcgttaaaaaatacagttgggaagaattgcgcaacatcacattccttttctttggagagaatccagtggaatgaggacttgagcggcggcatctccaatctcactggaagatgccacttttaaggaaagaactcgcacaaaggaagatatgaagagtgaactcgttgttccatttcctttcagctcaccaacccggtttggagttggaggccaggtccaagatagtttagtaagaaagaaaagtaggttgaaagctccaaaatgaaaagctagaattattccagggtttcaactgttgctttttcgagccatatcacacaggaacaattgtacgtgaaatataagtaggaacagttttggccagtgtgatcaaataattcaaccggtggtaataacgggcacttcgtgttttgtaaatccaaccagtagcaggggggataactgctgtgtgtatatatataactcagcatgaattttgttgaactttggccttgtttagtttccaaaaaaaaaacttttcaccaatcacatcaaatgtttggacacatacatggagtattaaatgtggagaaaaaaaaattacagtttgcgtgtaaattgtgagacggattttttaagtctaattgcatcatgatttgacaatgtggtgttacagtaaacatttagtaatgacggattaattatacttaataaatttgtctcgcagttttctgttgaaatctgtaatttattttgttattagactatatttaatcaaatgcgtgtccgtatattcaaatatttaatgtgacaaccaaatctaaaatttctccccaactaaaccaggcctttgtgtaccagggcccttttccgggcaagtattcccattctttccactcacagctacaaagttcattgttgctggcaagttcggagctagcaaaggattttctttcttctgagaccaaacgctcctgaaaccgtaaaactaacgagcaaaacaactacaaaacggaaggaaacccgaccagagccgcaagttgtggctcgcgccgaccgaccgaccatgccgccgacggcgacgctcccgccgatcgcggcggccggggcctccgccgcgagaggctgccacttgctcaggatcgacgggtactccggcaccctgaacgtgcaggcgagccagctgccagcccatcccatctcctcccgcccgttccgcgtcggcggccggccgcgcctggcgcatccgcgccgcgccgagaggccggtctcccagcaacaccgacttcatctccttccacctctcgctcgacaacggcgacgagtccgccaccaccgccgagccggtggtggcgcaggccaccttctgcctcctcgaccgccggccgtcggcagccggtgccgtcctacaccatcaccaccaccaccaacgacttctcggtgaacaggtgacgggggtacgactacgagagggggaagctggagagctcggagtcagagctcatcaacgacgactgcctccttcggatgccatgtcagcgttacggaggcacaggtggagaactgctttttagtcccggtttgtaaccccctgtagtctcggtttttaaacttggactaaagatcgctatatttaggtcctctttgtttaggcttataagccaacttataagccaaaaagtctaagcctaaacaaacaagcagccttttcgtttggttttttaaagccataagccgctcttacactattaagtcaaaagataggttggagaggcttttttggcttatatgagatatatgtatgactccaccactaaacttaggacattaaattcactagcttataaatcatataaaccaataagctgacttaaaagtctaagccaataagcctaaacctaaacaaagaagaccttagtcccgggtgaaaaaatcgggactaaagatcgatctttagccccgccaactaagagtaaaaagagggatatttaagtcctggttggtgttatcaaccggaactaaagagagggtagctttcttttttattttctcccgaatcgagtggtatgcatatcgtcaaatcaaaccccaaatccacgtcacaactccacagcacgattcacatattcatcacaaattcattcacaatatccattcacatattcattcacaacatcacaaatatgttcacaatattgattcgcgggttcattgacaacatcgagtcacatactcatttataacatcacagattcattaacatcgatccatagattcattcacagagcaaaacatctaaaccacaaataaaaaaaaatcaaaaaaacaaaaaaaatcgactcaccaagcggcctcccatcccgccgccggccggccacccatcccgccgcttcccctccggccggatctgggggaggggagggcgaggccgccggcgaccggcctccgtcccaccggcccacgcccatttaatgggagctgccagcccatctcctcccgcccgttccgcgtcggcggcctgccgcgcctggcgcatctgctacgcgccgagaggcccggtctcccagcaacaccgacttcatctccttccacctctcgctcgacgacggcgacgagtccgccaccaccgccgagccggtggtggtgcaggccacaccttctgcctcaaccgccgccggcagccgaagcccgaagccgtcctacaccatcaccacccccaacgacttctcggtgaacaagtcatggggggacgagaggttcatcgagagggagaagatggagagctcggagtcggagctcatcaacgatgactgcctagtgcctcaccttcggatgccacgtcagcgtcatggaggaggaagctgggtggccgtattccatggaggagctcctggaaccaagaaccatggccgtattccatggaggagctcctggaaccaagaaccatggccgtattcctgcccaaccaagaaccgcatcatacggataaggtcataagggacacatatcctctaccgtacagataaggggataaatagtggtggagctaacgacaccatagtgttcatgcaactaataatgttttttgtgatttaactagttttgttaggtgtcaacggttatcggtagtggagacgacatcgacaaagcctgagctgtcactaacctacccaggagctaaattcgcaattgagggaacgcatattctgtaccatatgcacattgccataacaactaacgtatagactcatttattctgaagcatatatgttactggctcgtatgacacctactgtactaccgtacaatagagaactaatgaaatagatagctaatgagattgttatgttgctgtatagtatcattttttttttctaaaaaggttcacataagaacaaaatatgaaccgtcgactacatgtatcgagcaaacatgagaagcaattcatgcttctatttaattaggactagagaaaaataaaaagacatagaacaattctagcgtttcaaagataggcatacttaattattttcttccaacggagaaacatactggttccattgaatcggtggtattcaattttagaagaaattgaatgctaagcaatgataatattactaattttcaaataaaatattactactaccttgtactcctcatttcagctggatttgcgtagattcttgacaaatcgaaataaataaaatctattgccaaacatctatctattatagtattaagacagctcgaaaaggagacaccacgttcgctgtagaggttagaaatttccacattaatcggagaaaaagaaaaaatacgaccgttatattgtggtccctttagattttagcggctgagatataataagagtccatagaaaaaattaagaaattatagtctgtttacgtaaggtgaattagagacggacatattggttataatggcagaccgagtcagatacgaatcgacgtgtgtatggatttaacaacaacatgataattctaattgcaaagtgacacaacttgactgtggaaatcaaatcagaataacaccattgaatatgattagatgtgtatgattctatcaccccgtttcttaattaaaatttaaaataaaaataaaataaaacaagaaattagaaaaacatattattaaatcagctttgaaaggtggcatacgttcgccgtggaggttagaaattcccacattaatcggagaaaaaaatgagagtccaagtaggaatataattttaaaataactaaaattcggaattaaaaataagaaattttagaagaagagtccatataagaaccaatacaagattaattaaaatttgaaataaaaaaataaagtaaattccaaaattgttagaaaaataaaaaatatagttcgaataggaatacaattttgaaatagagtccatataaaaacctaatacgagattaattaaaatttagaatgaaaaataaaataaaatccaaaattggataaactaaaaaaagagagttcaagtaggaatacaatttcgaaacgactgaaattgaaaataaaaaataaattaaaagaacacaatacgatatattagttaaaattcgaaataaaaaataaaataaaatctgaaattagaaaaagaaaaaaaagatttcaactagaaatataatttataaataattttataaataactaaattggtgataaaaaataaaaactattgaaagaaaagaccatctcaaacacatgaggagattaattaagtaaaaggcctataaaggagtagagtggcggcggttgatggaacatctaaaaactattaataaaacaccagatagaatcctaatgacgattaaaaggaaggatgacgggcaggtcgtgaagcaaccggtcaaggcggttggtaggacttctagaaattaaaaaaaataaaccctaataataatcaatttgatttttaaaatcttaatgacaacaaaaaggagagacagcgggcgggtcgtacaagagtataatgctagcgccgccgattgttggtgggacttttaggaagtaaaaaataaattccaaagatgtgtatgttcgatttttagaatcccaataataataaagagtagggggtggacgggtcgtagaggagtatagtgacaacatttgacgggatttctaaaaactatcaaaaacgaaatccaacgagacaataaattataaaaactataaggttcaattttaaaaggttcgcacttctaaaaagtaaaaaacaaataaactccaatgataatcatgtttgattttaaaatctcaatgacaataaagaaggaaggcagtgggcaagccgtagaggagtatgctaacaaaaccactgacgttttgtcggaacttctagaaagtaaaaaatgaaccctaacaataattatgttcgattttgaaaatatcaatgacaataaagagaagaggcaatggagatgccatagaggagtataatgacagtgtttgttgggacttctagaaattataaaaacgaaacccatgaggacaataaactctaaaaagtataagatctaatttttaaaggtttccaaagagaatgaataaaaaccatgtagatcgagccagcaaataaagaaggatatgacataagtaaatgatagcaattgatgtgatttttaaaaattataaaattagaaacaaggggatgataaggtttggtctttaaagtctcaaaacaacgagataactatttaataaattaataaattttaagtaaaatcatattaaaaataccaacagctagtttgaagaagagggagagagatggaggtggacgcgagcgagagtctcccttgcgccacgtttctcgcgtccgttcttctccgagccgcgtcaaacaaaaccaaacaccaccgtgcgagctctctctctctctcccctcccccctcctcctctttctctctcctccccttctcctctctctctccttccgctgattccgtcaccgcctctctcccgccgcccacgcgggcaccggaacccgccgccggggacggcgaatccggggcggccccgccccgaatcggcgccgcccgctcccagatctcccaccccttccccgggggcgcctccgcatgtcatgagccgcccccatttgcccaaagacgaccacgccttcgccaatgggttcttgttcgacggcgtggcccgccgccccggcgagatcgaggaggcggccgccttcgccgccgccgccgacgtggccatcaccatagccgccgagcagtccgggtccccctcgtcgtccacggcgccgccgatgtcgtcgtgcgggcagtacatgctccaccgggtgggcaagctcgacaccctcgccgggatcgctatcaagtacggcgtcgaggtaatgcgacgggagtacactgaattttttttagggcctttttttttcactgctccatattggaatactccattagagaagatataaaataacagtccttaacttctagctgttttaggtagtagtatgccgtttagctctatattgattgggaaatgattttggaatggtttgcgcattgtttttgtggtggtgttgtaggtagcggacatcaagaggctgaatggcctatcaactgacctccagatgtttgcgcacaagacgctgcggattccgctccccgggaggcatcctccgtcgacttaccagcagaacggttcatatgagggtgatgacaggtagttaaaaatcatgacatcactttgctcccatcgccagcaaaatgctggacttagcattgtccgttgtggagttgtcctcacttatcagcattggcgcgtcacagcacagtgctatatcttttatagatttacatggagtttggtagttatgaatttgtctgtagccaatttctctctatgatgtgcagagggcagttaattaattaggtggttatatgacttgggattttggctttgggctccaaatacatggctaatagtatgttctctgtttgttcttttgcgattgttcaccttccgctattatttcctgtataacatccattgagtgaccatagttatagctcagaacataagataagctagggcaggaatgaatgaagagcattaaaatgtagagaatatggtaaagagaacacatttcagccaaacctgcaactaggtcctaatcatcttgtgctcagggggagagccttatttaggccacactgggccatatggccctcccaagtcgataaaataacatttgtaccatactataggctaattacctgctatggttgctcttggataagcagacatttctctagctcttatatgcattatcagttataacaatatgatattatttcagggaatgtactcctccacgtcgccttcatgatgatatattggattcagttttgagaacaccaaagcacaaggcttcaccagccatgagccttctgcaggggtactatggtctcacaccacctccaaagaaggatacgacacatgaaggcacagaaatggcagtatatagaaaaggaaaatctgttttcttggatgatgacccatggtttggagagccgccagattccgacccattcccttttcaacataggaaaactagaagtcttgcaataggttcttctcttctgaatggcgagactgaggagaatggcgacagcgaaaagttgataaggcgacgccagaaagctgatggtgagttgttacctagggaagaaaatggtagtagtgctgtcctagcaagggctgggaaaggcctggcgttgaggcctaagtcgggcagtcgacaagatttgaacaagagccagcagaatctcattgcattggcggagccttctttcggtgatgggttgcatgctgtaaggaaatcgtcgagcactccggagttccaagagccagagagcaacagcagcagcaccagttcctccatatggtcgacaagcaagtggaccttaaaaccagacgctttcactctccctcttcccctccctctttttgacaacattccaaagccaatcgctgcttggagaaacaaggcggctcgagattagtagcttatagtctcttggttttgcacaactcctgttctaaagcaaggccctgtaagcaccccccggaggagcttcggttgacaacagctcttctgagagttggaagcagagcagaggaccttgtggaccttggttacttcttcctgggtggctggagcacaactcaggaagatcaaacacagagatggttcagagattagcttctgttttatggttcccttgttatattggagatgttgcaacgagtagcagcatcagtttcttcagttaagttatagatgacacagagccttggatactgagggtattcttttgtacacaaatgcagataaatgtagggatcgaaaggcggctatatatgttgtatgtgtgagaacttcgctgatatagaaaagtatcgtcattatttaccttccaaatgagatttgtttttgttctttacttttttggccttggtggctcaattataatctcttttcccactgtgttgcttgccagttgccattgcaattacatgtactccacctacaatctgtgttcttttcagagaacaacctgacagttatttttgtcagttcatcgtagtgaaatgcaaacaatctctaaaaaatttcaaacaagtttttcttctctagaaaagacaaaaaaaaaagaatataaatgctatagagagattcattcatcaaatgggcatgaatgcatgatattgcatgcgaaaagtttcagtataccaggccagccaaagcagggagaagaagatctgcaacggccctctgacatgacgggcccacatgtcggcctctcgcctcacatctctgcaacggccgccgctgccctccaccgcgccaaccaactctcctccgcctcctctcaccgccgcctcacgcacttcgccttctcccactcacctccgccacgccgccgatttatacccacctcgtcatgcgcctccccaccaccgaaccctcccaacgccgccgccgccgccatggccgacgacgaggctgccgtcctcccgcccccgcctccgctgccgccgccttgccgcccccacaggcagctccgcccgagggggtctcgaccgactgctgataccacccctcgcactagccagttggtcagtgcagcttagctgatgttggctgctctcctcgttggcgccgcctgcgtgcgtgcgtgcgtgcaggtaccaggtggaggtgttcgaggcggcgctgcgggggaacaccatcgcggtgctcgacacggggtccgggaagaccatggtcgccgtcatgctcgcgcgcgagcacgcacgccgggtgcgcgccggggaggcgccgcggcggatcgtggtgttcctcgcgcccaccgtgcacctcgtccatcaggttgctttttctttttttttttcatcaacatgtgaacaaatggagtgtggacgatgtgttctgatcgggagctggttgctctgcatttgtgctgtagcaattcgaggtgattcgtgagtacactgacctcgacgtgatgatgtgctctggagcatcgcgggttggcgaatggggcgccgatcattggaaggaggaagttgggagaaatgaggtaagcgcccgggtttactgaacctgctcctgcgctatgcttgaggcagcgatttgcttgattgcgatgtactgtgaattggcacatttggcgtgcccaccaactgaagccagatgcaggctgaggttgctaccagcctacccattaataaatttgagagtcatcaacttgatgttttctgaaggggcgtgcatatgaaatactagctgatttagcactctggttcaagatgaattttctttcatgtgttgtcatttcctagattgagatgctggtctgaatctgagggatattgcagtcctacgccactttgttcaaagtagctgaagttctgtaactttggggttcaatttcttagatccttgctatgttagtacctatcggacttaattacagctactgaattgggcttacgcatgccattgctaacttggatcggaaatacgtgtttacgctgacatttgagcgatgcatgccttttgtgtttcagatcgttgttatgacgccacagatactgttggatgctctgcggcatgcttttctgacaatgagtgcagtgagcttgctaatatttgatgaatgtcatcgtgcttgtggaagccatccatatgcacgaataatgaaggtaatagaaatttggggatctgtcttttgctttgacaacattggtagataagctttggcttgcagtttttgttattacagaaagttgcttaggataacagtatttgttttaataatctgacatggcaaatttgcttttgttttatgtctctcttgagttccaaaggaattttattttgggtctcagtggaggccagatgtatttggaatgacagcctcccccgttgctactaaaggcaagaattctacacacgacaatcatgtgcttttttgtaacgaaaatagtcacgtgcttttaaccctgtgtatatttcattgatcaatagtttcagaaaatgtgttttagctttgttattaaaataagcatgtcgtgtgactgttattatcttcctttttgaagaatgccccaactgccatgtactgtcaaaaactcatgtgatgtatttgagtgcttttgccttcttcataacaagacaatacatttctggaagtatgattctttctcttgcttcataattctacatggaatacctctctgcctgccaactgtagattgcatcctatttcaaattttgatgattgggcatcacagtttgcgtgtttgacttagttgtccactaaaaggcgagttccttagagggtcgcttaccctggttgggtaaggttaggtcgtgtgagccttttgttttgtaagtagttttttcgtaggtgtttttggggagaaaggcattctagtctcttccccgtttttattccttcttaatgaaatgatacacatactcatgtatatttttttaaagaaaaggttgtcccaatttaatctattcaatgcttctactcatattactggagagcacattcaatcagttcattaaattgaaacagtttcctgttgtagaataatttcattgaaattatgaatttctaatattgttcggatttgctggctcataatctattacaaccctccattttttcaggtgcttccacactacacaattgtgaagcacacatttctcaactagaactaaccttggatgccaaggttatctcaagctgacaagctttggatttattgaattttaagaaaacaactttccagtaacaaatagcctgtcatatgttacatgctattgcagatatacatcgtagaagatcgaaatgagcttgagagcttttcccctcctacaacaattgtgaacaaatactatgatgcttacatggttgattttgataatctgaaatcaaagcttcagatattttctgatgaggtgatttaactgaaatacatttgagcttattattaaaatacatatataatttggagtaccaaaacctacagctccctgtaactttctttttgcatgtatatttgtttaaattttgtactgttgggcagtttgattctttgttggttggtcttcaagaatcgccatctaataaatttaaagacaccgataatatcctagagacttcaagaaagagcttgtccagataccatgggaaaatattgtacagcctaaacgatcttggtccaattatcacctctgaggtattgcattatccaatcagtattatataatcagttctatgtaaagaaaacttttctgaagagtcacataactttgacatttcatatcggccttgtttgtttactagttatacctacataaattccagtcttattgaaatgatttttaacctttttgcaaatatataaaatattgcgcatgccgaactgataaatcaaaagaatatttggtgaattcttttcataggaaccattcactttaactagtaaagattggcacaagttcaagtacctaagaacataagctgctttgcatgaccttgcctgtgacagctatagtatctttgccattatttttccgtaacatcacgtgtgctgcaactgtttgtcttctgttatgaaagagtgctttgttcttttctggaagtggaaacggtgtattggtactaaaaaacctgttatccataaggacttcaagtatagtgtaaaatgcttatactaacttaaattgttttcttaacaggtagtcaaaatacatattgaaagcgttaagccattatgtgattctgaagactgcattttttctaaagctagcttgtgcttacatatgtcttattttaaagaagctttaagtctaatagaggaaattcttccacaaggtatagtgcaccctttagttgttatcttgaattaactgcataagcaaaaatgatgcagtgagtatctttcttttatctgtatggattaggtaatgacacaatttgcaaatccaactaggattgcattatgttctttctgtttagcttatgccctccagtaaaagattccctgaatcttattagtttagttgtctgttttttgtacgttattctcagaataagaagagaaacacatgcttctacacaccctcctaatttgcatgctctatagaagtgaactatgaagttgatgtagttcgctgggtgctgctagctaatttgtggagttggctgctagctgagagggctatcacctttgacgttaatctttgccccttatgataagatctggtcagcgggcttctgccggtttggcaaaaaagaagtgagctttgaagcagtttccagtaggtagttagaagcactcaaccaaaaagacagaggagattgactctaacctctatagccacttagattgcagttggtagtctctgtgccacagctattgtttctctgtatgtgttcctttttctactttcgtgcattgatagttgccttctctaattctgctgatgcaattgcatgacaggatatggtgaactaatgaaatcagaatctggttctgaggaattaactaaaaggggatacatttcttcaaaagtgaatacgctaatcaacatcttcaaatcgtttgggtaataccctagtattctactcaagatgtttagtttcacctacttttggtcttttgttggccaaaaataatacagccatgtgttttctctacaggtcatcaaatgaagtgctttgcctaattttcgtagacagaattataacagctaaagccgtcgaaaggtttatgagaggaattgttaacttctcttgtttttcaatttcttacttgactggagggagtacatcaaaagatgctctgagtccagcagttcagagatttactttggatttgttccgagctggaaaggtatgagatgctattgtaaatttgattcaaacagtctttcaaatgttacattaacttcacatcaatttctaggtgaacttgctttttacaacagatgtgactgaagagggcgtcgatgtacctaactgttcttgtgtgatacgcttcgacctacccagaactgtttgtagctatgtccaatctcgtggtcgtgctagaaggaacaactcggaatttattcttatgattgagaggtgaatcatcacacttgaaattaagttaccctgtgacagagatagtcaattttttctaacctaaattcattttccacattttatgtgtataagttagatccaagctacgcaattatgtatttgtgaacagtctgagctcctaggcccaaaattgcttaatcctacctatctcagtagaaaaaaagtatgcccgtgtttaataattggcataaatttttatgccatttttttcgcttgttgatctttcatatatggattttcaggggaaacttgcagcagcaagaacacatatttcgtatgatacagactggttactatgttaaaaactgtgcactctatagacaccccaatgctttatcctatgacttgtctatccaagggatgtacacctaccaagttcagtcaactggagcaactataaccgcagattgctgtgtcaacctaattcgtaaatactgtgagaagcttcctaaagataggtacacttaacactctagtatttataactctcgttgttttatgagttgcttgtgcttcagtgagtatctcttcttcctttcctgctgattaacattgcaacttatgcatgaatcattgatggtatccttaagatttattgatatactgcttgacaccagatgcatggatagctggttagattcaaatcacacatagacaaaaaaacatccctgctacttccctaggcatgatttgctgtcctagttccatttcattaaagtggtacttcatggtaacatccttctgcaggtatttcatgccaaagccttcctttgaggtgaccattgaagatggattattcaaatgcacattgacgctacctcgaaatgcagcatttcaaagtatagttggccctttaagcagttcaagtaatttatccaagcagcttgtatccctagaggcctgcaagaaattgcatcaactgggagaacttaatgatcatcttgtacctttgactgaagaacctatggatacagatttcactacagcagatgaaaaatgcatatctggaccaggtatgagtgtaatgttgcagttttgcttatattatatttcttggatacacccatcacttcatatatttttctacgctgtagcactggtatattttataaactatacaatagtacaatactatggttcttcagaacagatctgggttgccatacaacactgaaaattgtaaaactagaactacctcggctgtctctttacgtttcctttgcaatgtagctatttatagagatactctacacatatggtgttttatttttggacatgtttgttggagcaaatacctcctgatgcttgaactctgttgatcttgcaattacgtagttactctcccttcattttgttactttatcatttgtttgagaggttcccgcatactgtagtatggcaattgaaagttttaaacagcaaccctaatcttcccatatattgaaattttccaacagatatgagtgtttctcctattgtacatgatcactaattttccattctctttcctatttttgcaggaacaactaaaaggaaggagcttcatggtactacatgtgttcttgctttatcaggaacttggattcatgacagtgaaaatattacactgaatacttacagaattgattttctttgtgaccaagagggtgaaaactatgctgggtttgttctcttaatggaaccagaacttgatgatgatgtggcaccctcaaaaatggatctgttcctgatccctaataaaatggtctacaccactgtaactcctcgcggaaaagttcaactaaacaaaaagcaggtagttcaagaattagtggcttattgacattctcgttgctaaaattccatatagtttttatatctgtgactcatctttcttgtttcttcagttaggtaaagggaaattgttccaagaattctttttcaatggaatctttggtagattatttcatggttctcgaaaaagtggagcacaaagggattttattttcaaaaagggtcatgaaatacagtggaacacggaaagcatgtacttgcttttacctttgagggattcttcatatatccaggatgacctaagcatacactgggaagcaattgaatcttgtgctggtgcagttgagcagttgtggagttcgtatcaaggagatgaaaatgtcattcctgtaaattgtattccacaaaaaagaagagggggccaagaagaaattattcatctggccaataagtctcttcattgttccagcatcaaagattcagtcgtgctatcactgcatacaggaaggatatacactgttcttgatttgatcttagacacaactgcagaggactcgtttgatgagatgtgtaaggggaaagcctcaccttttacttcatttgtggactattaccatcaaaagtacttcctcttttttatatatatatttatttctagtactgctctgctcttgtatgtgtcctgatgaactttctttcttcacttcattgtaggtatggtattattattcaacatccagaacaaccactattgctgttaaagcaaagccacaatgcacacaatcttctcttttcaaaattgaagtatctaggtactggatacacaccctactctagtaacctttacctctgttaatggaaagttttagctgagtgtgggctcactgcacctgatatccatgccttgcaaatttcattgggataagagcacaaattgtgtcttttatctttagttttggttaaatactagacctcaacttttcatttattgacatacactagtgattgttactccaacatgctgttctatgctcaccctcttttggccaggaactacatggccagcagttggaataacttaagtgaaaaaatctatccgaaaaaaggcttgaatgctaacattatattcttgatgttgacttaatttaacatgtttggccacctgtattattttggatagatgaatcagttcaatgagatagcaaagaaactgtttgagaaaaaaaaagatggcaaagaaacaaatttaatactacttttttgtgttttcttaatacaaccatatggtactactaaaaaattatcaaataaattatagtacatgacacaaaacatggaatcctctcctttatttttccatttccttttgtgtgcgcttcaggttatgctggtatcccaacaggaactttgtaataaactatatttgctttctacatgagcagggtaatttccttaataaatcgatgtagtgtcattgtgtcaaaaccagcaataggagtccttaattactttattttctgcacacaatttgattaatgcatactaattattgatagtggaactattgcattcatccattcatgcagttgagccacatttcttttccagcatataccttttcttttgcatcatcaatccacctcatagagcagtagagtccttcttttgttaccctttgtccgaaagtacactaaatttgtaggcctcttactatttcgagaactgcaaatcaatatgactgtccacccttattattactgtatcccaagcaacaggactgaatcaatggctctagtggttttttttttagataatgggcagcgcccggcctctgcatcataaggtgaatgcacacggccaatatagcgtggctggcacaaaagggcttagcatcttatggccttgacacctgtaccatcgtaacagtggtcgtttgctgttgatttttttgtagatttcagtgtgttagttcccttttgggggtgtgtgtttttggtggtctcttggtgttgtagtccattgggacctttttcttttccttctcaatataatgatgagcagttctcctgtgcattcaagagaaaaaaatgcaagatacagctgcgagcctgcgccacactcagcatatcttcacttctagtataatgatatgcaagatagcaggtacagtactttgggtcttatttgacatgaaattccatatgacctatggcagatggctccactggcaaacctctgctcatggaaaaagaacaaattcatgctcgggttccacctgaactacttatccatctcgatgtaacaactgatattctgaagtcattttatttactcccttctgtaatacatcggcttcagtcacttatgctagccagccagcttcgcagagaaattggttacaatcaacacataccagtcactttggtttgttctctttcaacatttttatttgctaaggatgactatgcatttatcaataatttggtatatttttcatgttagattttggaagctataacaactttaagatgctgtgagacattttctctggagcgtttagagctgttaggagactccgtgctaaagtatgtggtaggatgtgaccttttcctaaggtatcctatgaaacatgaaggtcagctctctgatatgagatccaaggctgtctgcaatgctacacttcataaacatggaatatggcggtcgttgcaggtagatgatttacacccctaaatgcatttacatggtttcaacttcctgaagtttgcaatatttctgttgttgtacaaataaattttttaagttacttaatttggtatgggcaattcacctacttgagcatgagagactacggattgtatatgcacattgtgtagcaagtatttgcttctatttttagctttgatttttgcataaatgcactggtggtcatatgtttgccatgattgctcctttcacattgttcctttcataactttctttgaatgcctatgctttacttactgttctatcaatctttagtttcatagtcacatcataggcttgggcaatatatatattcaagaatattttctaattcttgtgcttttttttgtgagctttgcttatgtttacagatttttttttatcatactttcagggttatgtacgtgataatgcttttgacccacggcgttgggttgctcctggacagatatcgttgcgcccttttccttgtaactgtggaatcgagactgcatttgttccttctcatagaaggtatatccgagatgacccatctttttttgtgggaaaaccatgtgacagaggtcataggtggatgtgctcaaaaacaatatctgattgtgttgaagcactggttggagcatattatgttggtggtggcattgctgctgcactttgggttatgaggtggtttggaatcgatatcaaatgtgatatgaagctattgcaggaagtgaagttcaatgcatctcatttatgctccttatcaaaaataaatgacattgaggaactggaagcaaaactgaagtacaacttctcagtcaagggccttcttttggaagccataactcatccatctctgcaggaattaggtgttgattactgttaccaggttagtgcaacagagtaattatgttttgtgttagaatcaaaagttttgtgcccccctcttttttttttcttatctgctttctattcagcgtcttgaatttcttggtgattctgtgctggatctacttcttacacgtcatctctatgctactcatactgatgttgatcctggagaattaacggatttacgctccgctttggttagtaatgagaattttgcacaagcagttgtaagaaacaacattcacagtcatctacaacatggatccggaatacttttggagcaaattactgaatatgtcaggtcaaatttggagtgtcaagggaaagagagtgaattccttcaacatactacatgtaaagtacctaaggttagatgcagtattctttgttcatagtcttgatagcctagtttcaagttatgtgttttctctctctctttaatgtctaattctcaatacttagctttgcggagtgtatcaccagacaatattatgattacatgttatcaacctaattttgttctgtgttttacaggttcttggtgacattatggaaagcatcgctggtgcagtatttatagacaccgattttaatgttgacatggtttgggagattttcgagccattgctttctccactgattacacctgataagcttgcattgccaccttaccgtgagttgctggagctatgcagtcacattggttgcttcttaaattcaaaatgcaccagtaaaggagaagaagtaattatagagatgtcactgcaactacgagatgagctgctggtagcacaagggcatgacagaaacaaaaagagggcaaaggcaaaagcagcatctcgtattttggcagatcttaaggtaagaatttgtaagaagaaacaaaaagtgtacacacatatggggttggctagtgcctcgtagtgtaattgattggccggttgaatggcagcccaagtacaccttgagccttgaggtgttcatattgctagtttgaaaatagatgcttatttatcctacaaactgatgttcgattttgaagcagcaacagggtctttcaattaaacaatgtttgtccaaggctaaacagctggatatcgtgacttcagatcttcagtttgacttgacaagtgtaagattctagacagcactccaccaaacgccttatcaaagtattgaacttattctgaataatatatttgatgttgtgtagtcaggaacacaactcagttattctgatttgaatgactatcatatcctagaaggtctttcctcagtaaagaaagaaggtttgcgcattatttattgtcttttggttcaattgttgcttgctggcttgcacctgtcaaacaggaagtactaaaatttaggtaaattctactgaaaccatatgccattcgaaatgttttcagttgtgcttccactcaaaatggagaaaggtggacctcgaagtgcgcttttcaagctatgcaagattttgcagtggccaatgccagaattcgaatttgtggaacaaaggttcaggtatgtacaggaataccaagaaattctttcaagaaatgcaaaacttgaataaactcaaacgatcttcatgatgtcttgattgatgcacgtggttgctgcaacaggactcctattgttatggatggggcgacaacaacaaacttcaatagctttgtttcgacaatcaccttgcacatacctgacgcaacaaccattacatttcaaggtgagcgacgtactgacaaaaagagtgctcaggattcagcatccttgatgatgcttcacaagcttcaagaactcaagatctgtatatgcaagacttagcaaagcatcattgagacatgggccaatatgccagttaacgattgcgactagctaatgcgagctacttccctcccaaagtgagatgcgacgaaaatatttctgaaaagctcgatgctccagactgtcactgatcctatgttattttggggaagaagatccctatggtatactaccttgcattacctggatacattgttgtcgagtttccaatattccacgatgtatcgccccaagattcagggacatacctggctacttttctcttatccaacttcaaggtttccgaggtgctctctctatatatgttttattgtgcttcagtgtttggagagattaaagatacgtcttagagaaagcacttggtagtctaaatagtacacttaatggatatgaagataaaatgttctgcaaaagttgacactatatatattttttaattcaaatatggggggcaaaattcatccttgggcaaaatactactccctccgtttcaagttataagatgttttgactttggtcaaagtcaaactgcttttagtataggtgcgcattcggtctgaccgaaaattttggtcttcggtctttcggtatttgaaaagtgaagaccgaatttcaacgtaaaaatatcaggaccgacaaattcggtctcggtcctgaccgaaattcaacaacattttcatatatgcaaagaaataatggaaattttcaatacaaaaatcacccaaaaaaatcgtaagcacttatgagtaaagattcttattaggttgcatacctagaagaagtagggatgtgaaaattagagtttaatcctattgaactagtggattgtaggttgcatttagacaaaattcggtctttcactacctaggaccgaattgatgactgaatttttcggtctcggtttcgatctttttggttcggtttttttctgtccatcctagcttttagtttgaccaagtttgtagaaaaaaatattttcaaatcaagacaaacttattatgaaaatatattgaattatttatttaatgaaactaatttagtagtataaatattactatatttgtctataaacttagtcaaacttaaaacagtttgacttcgattgtcttataacttgaaacgaagggagtctggatttttcacattttggtccttttgaaaaacttattttgcaaatagacccctgaaaaaacttatcccagaaatggtcctttttggggcgccagagtggctggcgccatcgtccaacggcgccaacctctttggcgccgtccccctgccgacgtggcggggcgatgctgaggtgactagggggagcgcgccagagtggctggcgccccccccccccgaaattttttatttttcttttatttttttgatattttttttcacgcttagggaacataagaaccaaccatagaaaaaataaactcaaatggacgtaatatgtgacctgtagaattttttctctcctctcctctctctccgaactagtgcagagagatatgtgcaacttttttatttttattttatttttttgatatttttttcacacttaggaactcacaagaaccaaccatataaaaaataaactcaaacagacgaaatatgtggcctgtggaatttttcaaagctctaccgaaaaacttctcttctcgaaaacacaatcttgcaagtggaatttggaggttgtaatatcgctgaacccggcaaagcggggagaatcgggtgtaactttttctgtagatatccgtggatatattatttgcctgattccgagtccgtatgagaaagttacgcctatttcaataaatggcatattttgtctgtttcggtagagttttggaaaattctacgagtcacatattttgtccgtttgagtttattttttatatggttggttcctatgttctcctaagtgtgaaaaaatatcaaaaaaatgaaataaaaataaaaaattgcatctctctatactgtttaacttatggctatcatttcatgtggttatattttgaattagattaagtaatttcatatagtctaatttactaaaggatctctcctatgtttaacatgctgatcaaagggttttactaaaggagttatggtctaattttactgaaggtgcaaagtagactaattaagcggtatgttagctattttcagacttagctaagtggtagttcgagtttaaattttttttgtggttggctgtatcgtgatcctaagtgtgaaaaaacatccgaaaaaataaaaaaaatgacaccgttgcaactccatacagagaaacatgaatggaggtgaggggtggggaggggggcgacgccagccatgctggcgccctcctccctggggcggtgccagccactctggcgcgctccccctagccacctcagcatcgccctgccacgtcggcagggggacggcgccagagaggctggcgccgtccagttgcacgacgacgctagccactctgacgtcccaaaaaggatcatttctgggataagtttttttaggggtctgtatgcgaaataagtttttcaaaagaaccaaaatgtgaaaaagccagcgaagggagtagtcctgtacggtaggcttcaggctttagtagtctagtttggttttgtttgttcctcgccggagttcaccgtagtttcataaatgaaaatttttgccagagttatatgctgaaaatgacaggttttgaagccaccgtcatcttagcatattttccccccgattttattgatcacgatacacgcgtgtgtatgtaagtacatagccaacatacggagatatgcgagtctgggacaaactcacaaacctgtgaatctcataacatttctatcgtgagcgtactcgcatctacaagtacaactgccagtacatttgaactagtgtgatatgaataaatagcgtgatgaatgcactaatgactcttaccgctacgtcaaaggtgtttttccagtagaaattaaccctaaaagatctctgtactcctatcacaaatgcaagcaattcaaaccataattaaccaaaaccgaactcaatcatttttcttctcttctttccctagtatacccaatttctcttgtcacatatagcaatttaaccaagaaagaaaaaaaaacaaaacaaagaagccatacaaaaagggacaaaaaaaaagaaaaatcatttacaacatcaacggccggtgatgatgattatttacaaaaaccgggaggagagcctcttgccgcctctgtccagcaaaccttccatcaccaccttcttcttgtgctcctccgtgcacacctccaccaccgccggcctctcctccgccgccggctcgccgaacctcccactcccgccgctgcctttgcccttggcagcggcggcggcggcggcctgcgcccggacgaaccgcgcggcgtacaggcacgagcagaggaaggccaccgcggtgacgcggccgaagaacacgatcactcccagcgtggtcgccatcgtccacagcccgcccccgccgccgcagccgccgcccggctcgcgccggaacgagccgtgccttctcgacggagctctcttcacgccggccagctcgccgggcgccggcctcgggcacggttgccaggcaggcggcgccgtctctttggccggtgctgcagcgtcgccgccgccgccgccgccgccgccgccggtgaccgtctgctgcggcagcgacttgcttccgcttttcctctgcttcttgccgccgtcggcggcgaagctgcccacctgcggatcacggcgacgagccatcgatgacgacaaggattgcacgcgaattattcgacgaaatgtaatgcactaggagaaagttagccacaggagttgagctacctgctggctgctgctgcctgagataagctcagctagtgaatcagcgggtgtgatgcgctgatggtgtcacaataatttaaaaatctgcttttgaaaaacgagaatttaaaatttgtttttgaatggtgaaaaggcttcaattccagccagatttccaacgagatacaatattaaatttggcccatcatggtaggggtgtaggaccgccaaactccagaactcatcatggatttgctactacttgacctgcatcgatcattgttctttttcaccttattcgctagtatactattgaaactgattatttgcttcccacgttgaaaaaatatatttttaaaaaataatgtagtaaaaatattttacattaagctatctattaagtttatttattaaaatatttaaattatcattatattttagtagataatccatagcaataaaccactcaataatctaaataaaattgaacttaatatgaaaatattttctctactaatattcagtgtttcagtgaatgacaaagatcttaacagcaagagacagcatggcatgaacgacaatgatacaaacggttaaacagaagctgacattgacacaatcacaaggtacactattgctgcatgaatgccatgtgtaaacagaaaagttaaaatccccgagttttttttttcaaaataatctcgtaagactatgaaaaacaattcaacttttattcctttttttcaacacacgtgacgtgaccagctatatattatagtcaaatttgagttattttttctccgaatgtcacagcccaaaacctcgcaacaacaacagcgactagtttccttcggcttcttccacgcgccggctgcgtttggtgggtcaagcacgcaggctgtggccgtggtgggccccactgcatccccatcgtcgttagtctcccgccagtttaactaactaactattacccggttactactactactaaccacgcaattacccactaatgaactgcgacattaacgtgtcgacgaagctatgcaggtaagaaaaattcacgctaatgatcagaaaattttacgctaatgatcgatcaccacatacacaagctgctcgagatcgtggccatggcgaatggtttttttggagaaaaccatggcgaatgtaatgttttggtttgacgacgtgggtgtgcgcgtaccttggggagtagtaagctgccggctgccgccgccgagacggacgcggcggcggcgagcgctttcttggccggcgacggcggcgacgccgccgacgacgatgacgaggagaggaggagtagcatccgcttcttcatccccttcgcttccttcgtcgccgtcgccgtcgtcttcttcttcttattgccgctgttcttccgccatggccaggagaagaaccacgatagcctgatgagccttaacctgaacctgaaccttcgccggcgccgccgcggcttcgtcctggagccccacacgccgcagaacggtggcaggcacgagcagcagccgcctgcgccgccctcctcctgcccgccgccgccgccgccgccgtactcgttgtctccccgacgtcgcccaccatgacgatcctcgtcagcgcgcatcgcggcgtcccgaccgcgccgcgccgcgcaccacgcggtgtggtgatcgcgatcaccgccgccgccgcccggcgcgccgcggcggcatcatccgacgccgcggcagcatgccaccaaactaactgtgtaacgtacactcgcgatcccggcgatcctccggccggcggcagatcgatcgatcgatcgaggaaggaatggatttctctgggaggcgctcgcgcgcggcgtcgcttgatttgggcgtcgcgcgtcacgaccggcgactcgtggaggcgaccgtctcggcacgtcgaggagcagaggtatacaagctagtactagcagttttcaatacgataatttaaggcgagaaagcgaaggttttttctgggtttttggaggaggagaagactaaacaaatttaaatcttccttttttttaaaggctaaacaaattagaatcgcgggagactctgaccaactttgaagccaccgcgtgctactggcgccagtgaggagggggatatgcgatatgcgcgctagcttgcaacaaacttgttaagaattgcgaaacaaatttcttttggattattaagaagaatcttggcatggatccaatggtccaaaatctgtatgatttcatctacaaatttcattcgaatgctatatagcaatcccgttatttatttattaatgtaatgaattaattgtttgagaaataaactttacaaatagtttagaactgattttttttaaaaaagtatttctataagcgtgaaaaatatagacaaaatgctgaaaatgggcctgaagttattcttctggagatcttatcaaggacaaaattacttggaagttggaatgcatacattatattttgtaggatttttgcagtaataagtttgtctttcgtacaaatatttttgatgtcctacgtttataaggccttgacaaaaaaattgtttatttaggaccaggataggattttttttttcaaaaaagagagaaaatatatcagacatcgatcgtgtcatacaagattcttctttgtcaacattctgattaaaaacttgggaggacatccgtctgcaaatgcttgccatgttgaaaacaggggctgaccggcttacacatgagctagctttcgtagtactataacgtacctatggacatatggaatacaataaacaccaccaatggatcaatatattacggaatatcacaagtttatctattcttgaataacacttttacttgtcggaatttcgtatgtatttaaaatacaactggcattaacaattcaaggatattcctcgtattacattgtttatattattgaaatgacaatattgcactcaaggaatatatgatgattctttttagaaatatgtataaggcttatgtgttttgtattaagattggaaagtttatacatcacttgaactcagaaacaacaacaaaaaaaaaagagaacaaagataacaaagcggaaaagaggaagggatgaaggtggctttggtaaggctgtattcggaactctaagttttcaacactctccttttattttctgcgcgcatgcttttcaaactattaaatggtgcgtttttttaaaaaaaagtttctatacgtaagttgcttaaaaaaatcatattgatccatttttttaaaaaaataactaatacttaattaatcatgtgctaatggaccgctccgttttccgtgcgcactgttagagttgggaactcaagcatccggacacagccaagtctatattctcgcgtcatccaattcaagtgacttttagccacggtggttgcgctatatcggcgctctggctgagtgatagagtatagtctcttccaccgcgtcgcgagctgtctctccaaatgttacattctttccaaatgtcccaagttgctaggatgatcaccgtgtcaaacccttcatgtgcgccttatcgatgtttttacgatgcataacatccatttgtgatgtgccaaccatgtttccatagccgagaaaaggaacacaggcatagcaaagcctacctgataccaaaataccctcaaaagttcacagaaattataaccaagattcaatattttggtttgaaatttcagattttccagcctcctcgatcagaaataactttaactgcatagggcagttggcagggacacaactgtcaatcttccccgcccacgctccaaaccaggtaatttcctgttatccattctagtgttatttttttaaaaaatactttgggcgaaattttgtcttttctaaaaaaattaccaagaaatttcaatttcaaattttccttatgaaatttcagatctccctgggcgccccaacccaagttttttttaaagtaaatttaacaaaactactatactttgactaaattatcgcaaaactacatatttagggtcatatattagcaacaaatttattccaaaactacatgtttaagattaagtatcccaaaactacatatttactaataaaattatcataaaattacatattttggggtttaaattctttcactaatgtttgagttgtaaatctccaagttttatgattaaactgatgttaaacatgtagttttatgataattttattactaaacctatagttttgcgatattttactttaagtatgtggttttgtaataaaattagtgttaaatctatagttttatgatacatcatgttaaatctgtaattttatgataatttgaacaaagtacttgtagttttgtgaaatttactcccttattttaccctaacttaaagagtaaaagtcaagagttacaagttataatgatgcgactttgggtcaatatcaacagttcaattcgtgataattagagcactacagtagaaaacaatatttggtatcctgtaccaattaaatatgtggtatcctataccaattaggatttagttacgtgtgacatataagagctgtgttcgtatgtttaatctgcttgtcggctggacagaactgcacggttttgaagggcggacatattgggttttggagggcgagcatatggtctccttcaaaaaaagattatggaagaagaaaatccgaagctatagctggtcaactcaccttaggccgtgtttagttcgatgccaaaattttttgacgtatacggacacacatttaaagtattaaacatacactaataacaaaacaaattacatatttggactgtaaattgtggacgaattttttgagcctaattattctgtcattagcaaatatgagctattatagcacttatggctaatcatggcgtaattagactcaaaagattcatcaagcaatttatatgcaaactatgtaattggtttttttcttccatatttaaagctgtatgtatttaaacatttgatgtgacggaaaagttggaagtttggagaaaaaaaagttggaatctaaacacaaccttaatttgctctacagtgttagaaacttctaccctcatggaccttcatatgaaagacttctcttcccttggggacaaagcaattccatctccaatacttatcctgcagcttccccttgactcaatggatgatctcatactattccttttctcttcttcattttttaacatctcagcacacgattggctctgcatttgactgtaatatacttccttaacagagaattaatcatgatttggtactaatcctcccatgtgtacagaccatatatatataatctgataattaatcatcatgtgcatccatgctcgctcgtggttttactttgtcagttggccgaagccgaagaagcagcccatccaatccagataattaattaacagcgacacaacgagaagaactatcagtgtacggcacagcgagctatctagcgctgacgaaacagtgaactgattagtagtaattaggtgcagtttaaatacgcccatgcatgtgatgtggttgttcatccgctgcttgtcttcatcttcgtgattctgatagtgatgatagcttaatgcttattttaatttggaaatatatatatgtggcactactgctcagtgagagtgaacgattttgatgttatgtacagctgggtcgacgcaagcaaaatgtgcatgaattaggttttttttttaaaaaaaaatgcgaggaattaggcaggcattttgacagaagaatttgaactgttcgtgatatcaattaagtggttggtgaaaaggacttgggttaaattaacctgtgatgatttgatggtaactaccatacaatcgcatagaaatttcgttgtttggactgcacggtaaagaagaacaaacgcagttgaaaaaaataataatcaaagatgagctcactaattcacttgtttttttctctctccgttttgttcatatttctgaacattttgattctcatttgtaaatataatcacaaccagtaacgaagaatgaaataattagctgctaataacgtgtagttcgtagctatctgcgatcacgctggagaagccccttgagcacaaccagcttcttgtaatccttcgagttcacgtcgccgacgacctcctcgcctccgccgtcagccgccggcggcggcttcgcccggcgccgattgagctggagcccgtacaccgcggcgagccacgcgcacacgcagacgacggcccagagccggccgccgagcagccccgccattgacaccgccgccaccacgcacacccccatcgccggcccgaactcgccgtggccgcagctgctcgcgcgttcgcgcgagctcgccacgacgacgacgtcgccttttgattcggccgtctcggcgtcggcgatggcgccggcgccggcgccggcgccgcgcgtcgtggccggagcgacgacgtcgtggcgtcgtaaagacggtgacggtggcggcgacagctcggccggtagcggcagtgacggcacggtgggctcgtgctgctgccgctgcccgccatggacgtcgttgctgctgttgctgtttctcctgacattacgctgtgacaccatttttaacgtgtcaaatcaaatgcgaatttctcagacgatgaaattacaaaaaaaatctctcacaatgacgcaattaatccacgcgattaatgtacgtgttgaactgaaaatcgtgtacaataaag

SEQ ID NO: 10926 - DNA, 7449 bp, Oryza sativa
  unsure (1)..(7449): unsure at all n locations
tccttcatgcgcgcgccgccgcggcgaagctcagttcagctcagctagctcgccggagatgaagacgacgacgatcgatcgatcaggcagctagctgctgccgaatctccgagctgagccactatccatcgatcgatattaataaggcggatttggaccaagaaaatgattaactaatgccccgattaaattaatccattggttggagcagcttctccgacatggtgcatcccgttaattaactgtcggattagttgaggaattgaacgggattatctgcatcggattaacgacgacgactagcaacaaacgaacggcacacgccaattaattaattcgtcatggcttatgataaaattgcttttacctagtaaaatttgtaaatggggtcgatttttttgatgggaaaaaaacgaggtcaatttgcttgacaaaatttgctcttgattaactttttctgcaagctatgttcgttggatggattcaccgcgtccttgtagctatcattggcatttgtatctttttctttttgaaaatgatggtatttgtatcggaagttaccttcattatctggaaaatatgatcgatcgtcgcatcaagaattgaggatgctgaggcgcgccaacggccgcacctcctatatatagtttgactgtttgtgttgtatacttgcgtaaaattagagtaaaaaatcaggggcatctcagtggatgacttaaaataacaaaaactatgtgaagtaaattaaattaacatgcaaatgtagagaagatgcaaacttggatagtttttatttgaagtaatcactatattattttttttaaaaaataatcatgtgtacatacaaagtacctttgaaaaatagaagtaactatttccagtactaaaagtatgggaatattttttcacggtattagaagtaactctaaaagtatttgtgtagcattttgttttagggttaattagatccatgccattgcaattttgccatattaaaaaaatgcttcgcgatatcagctgggtgccactgaaacttagtctattactattgggtatgtggtattcataaccatgacaatagcccctgacttcaactcaaatgaattcatgtttgtcatccgcgttttcctgtcaaagttgtcatgctcacttggtcgttctcgataataattgagaagacatggagtactcagcatcattgaaacaagatcaacagttcataagtgaatttgaattgtgtctaaacaactaccataaacgagcctgagaaaattttggcggcaacgcatatgaacgagttaatgttctcaaccgaagaccttcgaacaacagtcacaatgctcgcttaaccattctcggacgatcgagaagatacagagtgtgcgactaaatttcttgtctcgccgtaatcgagaatttgggttgaagtcaagaatttttatctcggcgggtacaccatcgctacattccgtaatcttcgtcgaactccaccaaccattctcgagtaatcgagtaattgtataatctgcgacaaaaccctgaaatatgacttttctgaaatcaatactcagaacagattgttagatacaaatggtctccaagcgagcactcaagggtaacacaatataatatgaatttaaaaattgaaaataaattgaatttacatgtgacaataaaagagtattctctctaaatctgccctcagcaattggagtatggtacccttcctagctcccagctatctttatggaaaagtcgtttttccacaaaggcaacttaaatcttataacaaaccaagctgaagttgacgaaatcctagcccccaatcgtgaagttggtaaagccaatttccgattacacggcttagttaatacgcattcagaacagcgtaaagggacgaaaggatcgacttcaagacatggcgatattagaaaagaggatcaatagataaatattgcatatacaaacacttatagaggttgtcggagaatccatctcttgaacccatctcgtttaaactttgaagcaccaaatttcctctacctggcatgccactgtcgactactattgggtatatggtatccataaccatgatacataagtcagtacaatcttcttcctctatcctcccctcttctctctatcctatcttcatcttgttttcaaatgtgactgacaacgaggagggcgttggcaagggaggaggatgagcgaaggaggctgatgatggcggattgccgctgatgggaggtcgacggctcccgagctctaccaccgcggatgggagaaagtcgaagacgatggcgacgacgatagtagctcccgagcccacccgccgaggatgagaggatgtcgacgagcgacggcggtggctctcgagccattccgccatggatgggaggaggtcaaagatggcggcgacgacgacggtgaggtcgacaacggcggtggctcccgagcccacccggatggttggaggtcaacgagcgacggcggtggctctcgagctctcccgccttggatgggaggaggtcgaagatggcagtgacgatgacggtggggttgacaacggcggtggctcccgagccctcccgttgtggattggaggaggttgacgacggcggcagcaacggcggtggctctcgagccctcccaccgtggaggtggtagacgacggtggcagtgatggtggtggaggatgatgtcggcgaggtggtcaacgacggcgccggagagagagagactagagaaaggtagggaaaagagaagagagggaagaatggtgaacaagatggaactgacagctagatcctatgtgcagttgaggctaacggagattttttacagatttcgtaacagagtggcatggtttcaatttcctcaaattcaagtggcgcgtagccgatatcgtgaatagtagtgacattatctagatcgacatatttgcaatggcatggatctaattaaccatttgttttatagctggtctctctggcatgatttggcacagatattagtgacggtggatagttttgtaaaattctgaatgcaacctgcatatatgttctaaatgtttacttattccacatgaattagatatgcaaccacaaaaacttacctatgttttcttttggttgctgtggttggtgacggtttttatattttggatgcacaagatgtagccagcttggcgtagatgggcacaaaccacacgcagccgtaataaagtgtagttctggaattgagacggtaactgctgcgtccactatgacgtgttctgttcggaggcctcgattccaattcgaaggtttcggaatctgaaatggcggcggcggcggtgcgggcggcggaggagcttgcggagagggagatggcggggcgcgacgcctcccacgacgccgcccacgccctccgcgtccgcgacctcgcgctctccctcgccgccgagctcggcctctcctcctcccccgaccgcctcctcatcgtaacccgccgcttcctcctcctcgctttatccgttttctctcttttagattttgttgtgatagactttgtggttgattgattgctgcaggtggagatagccgcgctcctgcatgacatcggtaagttgatgatgtttttgatttcattggttttgtgtgggggagagaagatgccatgttttttttttttttgctaattcggttcttgcaggtgattacaagtacaccaagtgaggatacttcccccgttgctcgttgatttgtaattcagtaagcacgatgatcgcgaggaatgctgcggcggcggctgcggcggtgttttttcttttttgtttacttgctttcccttccgcccccaactcgaacacgttgggggctccggcagcagattggggctggatctgtgctggacggcggcggccgctcgttggcaacggcgagcggctcgggctgcacgcttcctcgtcgacggcgggctgcggccccgttcgcagtggggcgatggccttgttctgctgctgccattgccggcccttgctctcggccccctcccagttcttcctccccttgctcgtaggccctctttgtttaggcttaggcttattggctgacttttaagtcagcttattggtttatatgatttttaagtcggtggatttaatgtcctaagtttagtggtggagtcatacatctatctcacataagctaaaaaaaacttctccaacctagcttttggcttgagtgacttatggcttcaaaaaagccaattgaaaaagctgcttatttgtttaggcttaaacttttcggcttataagttggcttataagcctaaacaaagagggcctctatagctcgtgcctgaggtgcttggacgccatagggttgatgcggcggtggcaatgccaggcattcatggggacggtagtgtgtgggtgggaggaaacagatcccctgactttgtgaaatctgcagttgtgccactgacatgtgggccccactttttcgcgatggctcacatgtcagttccacaactgtaaaatgcaaaccgcacaaagtcaggggagtctctcgttcgcgtgcgggatggggtgttggtctcttaagagttgagaatgagatggtgtagtgttgatttcatgcggctgcgttgatgttccgtgtcgaggagtatggcaagacttccttcgtcatggtgttgtttttattttcttgtaacccgtttggatttttactctgcttgttgaaatataattggcagcttttctgcctgtttagttttttgaaaaaatgtttgttgggtgagtggatagggacaatgctgaggatatgagcatcgtggagaggtttcttgaagaggtggaactggagcagggccagagggaggaaattgtggcgatcattaaggggatgggtgagttcttcatgtttatgaatctgtggatgaaactatttggcaaacagcagctggcttgagcttacttaattgttcatcgaacttcaaagccatataaatcttatagtttataaaatccgttttttttcctgtagtacaatcccattatgataatgttgtatcatatgaaggccataagtagttcttagtgtatccctagttatgcaatgcatacgttataacatctcaaatcttatgtgcaggattcaaaaatgaagtttcaaagaagtctgttgttgagcctactcttgagtttgcaattgtacaagatgcagatcgtcttgatgcaattggtgcaattggcaagtactgcataaccgaagtttctttatcagctctactcaaacaaagtttccttcaacaattaggatgcagtaaatgttgcactggttatgcaaaatcttttccatgcaccatcttgttttttccccttcttcctttggactctgatggcataaatttatcaagtgtttgccactttgcctcatcatttagtttttcaatattgactagcgcacatatatcattatttcttcctctactgatagaagtacgccacaatctttttcttggttttaataggactgtcacatatgttttattgtcctgagtcttatgctcttacttatctcagcagttgtttccaaatatcatgagtttataagttactgtacctcttaacttgcttcatatgcgttcatatgctaattgcactttacccccttgtcatatgaagctgaattgaaattactgataccacacaaaggcaggatatagggaggaaatttttaggtagcaatgatcccctgaaattgtagacgagcaagaaatagggagagataaaaataagaaaacatcatgtactgttagtttgcaagattgtactgtctaccctgtcctgtccaggtccaagtgtcttccaacgtatgctgatatgggtaatgggctaatgggaatcctactatgtctgtttcaattgagaaatgcatatgctttgactgccttttttggtctcatgtagtatgaataaatgctctgtgttcgaatctttccctaaaacacctgcaggtattgcaagatgttttacgtatggtgggagcaagaaaaacacattgcatgatcctaagatactgccgcgtgataatttgtcaaaggagaaatacatgtccaaggatgaaaaacagacatcaattaatcatttccatgagaagctatttaagttgaaggacatgatgaagacagaggtaggtgatgagttatgtagacatgtgttcttaccgctgtcctagttgaagcctatggagaaagcattaaatatttggacctattgaactcagtactaagagtagtagatctatgttgggtcttatcttcatcaatttacacgtgttaagtacatgaaagaaaattctgcttactgatgctcatggtatatcttctgatttagcatgcatctgtacattggcgaagtgtatgaaaagtggattctgtgtactagtcatcaatactccctggagattcctattataccttctgatgggctaataatcactcattgtctttactttattcaaattattgagcatgcatcttaataccatgtactccaatttacctagtacaaacattccttgtagaatcccattatctcttcctttggcgttgacaccatttcactttgtgcataggccgggaaaaagagagcagagaaaaggcacaagttcatggaggactttgtggctgaattctatgaagagtggagtggcagagcttgaagttgaccaaccaggttatgggctgttggtctgtggcatagcttgaagttggccaaccaacaacaactcatattgctagtcgtctacttggtgacattagcatgttttgttgctgatatgttaagccatgcaaaaaaacgagggataaagcacacttgagtggccaaaccactgaataatgctcctcaacaggtactttgcctgaactctgatttttttctggagcacctgtgattgatgtacatttgatcggcagcaaaaccatcacatcttgcagttattgtgttgaaacagccttgctaaaaattattagtaatatcatcttaaagtattcctcacacgcatatacattaaattctataggcaccacacttggctacagtacatattgctatttggacaaaaaggaaacagatcaaatactagtacataacagcaaacttcaaatgaagaaacaaatgcagaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10927 - DNA, 476 bp, Oryza sativa
  unsure (1)..(476): unsure at all n locations
nnnnnnnnnnnnnnnnnnnnnnnnnnnnnnnnnnnttaaaaaatttatttgtacaacaacagaaatattgcaaacttcaggaagttgaaaccatgtaaatgcatttaggggtgtaaatcatctacctgcaacgaccgccatattccatgtttatgaagtgtagcattgcagacagccttggatctcatatcagagagctgaccttcatgtttcataggataccttaggaaaaggtcacatcctaccacatactttagcacggagtctcctaacagctctaaacgctccagagaaaatgtctcacagcatcttaaagttgttatagcttccaaaatctaacatgaaaaatataccaaattattgataaatgcatagtcatccttagcaaataaaaatgttgaaagnnnnnnnnnnnnnnnnnnnnnnnnnnnnnnnnnnnnnnnnnnnnnnnnnnnnnnnnnnnnnnnnnnnnnnnn

SEQ ID NO: 10928 - DNA, 326 bp, Oryza sativa
atatggagatagacttcgattcataaaatggtcgagaaaatttgctaaagaagggtaggtaaattcaatctcatctggaaagacataatgcttttgctgaattgggtcaattattacaagggatggcattctcgatccaccagttaaagtttgcagaagcctataaccaccatcagagaagaagagtgaacccgcaaaatgttcatcaggtatacttggagtttcctgctctgtataatatgtgttatcgcccacaaggctactggaagagcttaatgctgcatgcacaggatatttgctatcactttcttctgatccttcatcta

SEQ ID NO: 10929 - DNA, 694 bp, Oryza sativa
tggtcgagaaaatttgctaaagaagggtaggtaaattcaatctcatctggaaagacataatgcttttgctgaattgggtcaattattacaagggatggcattctcgatccaccagttaaagtttgcagaagcctataaccaccatcagagaagaagagtgaacccgcaaaatgttcatcaggtatacttggagtttcctgctctgtataatatgtgttatcgcccacaaggctactggaagagcttaatgctgcatgcacaggatatttgctatcactttcttctgatccttcatctagaataaataggttatcctcataaatggcatcctcaattcttcgagattcttgacccaggactgaaaacacagcatcttgctgatttgctgatcctgacttctgttggttaaaattcacatttgtcccatcgggttccaaaatgtctaaagcttctctaactgtttcctcatctttgtgtttgtgtaatatatgaccaacttcattgctggaatgcacatcagtggagacttcttcctgaagatcagcacttgttttgaagcctcagtttatgttcttgttctcccatttttgtatcactacagtcaagatcttctttattgatctacaagaaatttttaggagcattgctactgtgcacatcaacaaaaatatctttctgcagatcaagggcttac

SEQ ID NO: 10930 - DNA, 688 bp, Oryza sativa
  unsure (1)..(688): unsure at all n locations
nnnnnnnnnnnnnnnnnnnnnnnnnnnnnnnnnnnnnnnnnnnnnnnnnnnnnnnnntatgcaattatcttgatgacataatgttgtattatatagaaatgacatgtcctggatgcattctatgagtttcttctttctttctgtaatgacctatccagtgacctttcgagttgcatgctatatgtgtagatggatattgatgcaagtggtatcgctacctttcctgcaagtagatcatcggctattctatttattgatagattgtcagattcttcaaaagtcagagatgaaagcaaactatccctcaaactactaagggaatatgtgcagaaaaattatccatctcatttcagtactggtggtctaactagtggtaaatccagaatgagctctaaagctgttccttccctagttagcacaggtagatctgcccatactgaacgaactaggctgaatgattgggcctccaaattaatggaaattggggagaaaatgtcagtaatggtggtcaatgatggagaaagtatttcgtacagaagtgatagccaaggtagtaccgataatccattatatgatattctaacaaaactgatacacaaaacaagaccagcacataggtcaaagaaaacaaagataagttttgttgcaaaagatgttgccataaagaagctgtctgatgattctgaag

SEQ ID NO: 10931 - DNA, 545 bp, Oryza sativa
caatggcatgcgttagcctaattcagtagctgtaattaagtccgataggtactaacatagcaaggatctaagaaattgaaccccaaagttacagaacttcagctactttgaacaaagtggcgtaggactgcaatatccctcagattcagaccagcatctcaatctaggaaatgacaacacatgaaagaaaattcatcttgaaccagagtgctaaatcagctagtatttcatatgcacgccccttcagaaaacatcaagttgatgactctcaaatttattaatgggtaggctggtagcaacctcagcctgcatctggcttcagttggtgggcacgccaaatgtgccaattcacagtacatcgcaatcaagcaaatcgctgcctcaagcatagcgcaggagcaggttcagtaaacccgggcgcttacctcatttctcccaacttcctccttccaatgatcggcgccccattcgccaacccgcgatgctccagagcacatcatcacgtcgaggtcagtgtactcacgaatcacctcgaattgctacag

SEQ ID NO: 10932 - DNA, 446 bp, Oryza sativa
  unsure (1)..(446): unsure at all n locations
nnnnnnnnnnnnnnnnnnnnnnnnnnnnnnnnnnnnnnnnnnnnnnnnnnnnnnnnnnncgaactaaacaaagctaaatagcaggaaattttaaatatttctgagactaagtttaatctaagttctcagcatgatattggtgaatatgttattaccttcaatctgcaagtcttgagcctgtaaaaattgagaatttgaactcaaaaagttcttgaatgatcgatatacctcacggacaacaagctctgttcgctggcaaaatccgcaccaagagttgctgaaaagcaccaatacatccttcttccaagcagatgaaatattttcagtgtttgaaaacggcagttcactttttgaaacacaaccttcaaatccaaagaccaacatacaaaaattacttgttgtcaannnnnnnnnnnnnnnnnnnnnnnnnnnnnnnnnnnnnnnnn

SEQ ID NO: 10933 - DNA, 575 bp, Oryza sativa
  unsure (1)..(575): unsure at all n locations
nnnnnnnnnnnnnnnnnnnnnnnnnnnnnnnnnnnnnnnnnnnnnnnnnnnnnnnnnnnnnnnnttgtcaaatggaacggcagacccgagcttcgaagttgcagtgagcacggaacctgtgaggacacgtgcctcgttcctctctgaatgacttggtgaatgggaaccaacatcgttgctgattttgtcgctgttatcaaactgaattgcctgtggtgcatcaccttgcacgaccgttttcttcttccacagaaatcctgcgagccaaaaagagcgcaggcattagaatattccttcatcacagtgatagtggacagtgaaaacactttcttattaatctttggtgcaacatttgggaatgcccaggtcagctgcgaacggttggtttatatatgaaatgtgaacaatataaaggaattgagaaattagaataacaatgtcagaaaatatcaaagccattagtcacatggtggttcaatcaagcagaccactgttcacgtcgcattccctggggttttcagcacttctaacaaggnnnnnnnnnnnnnnnnnnnnnnnnnnnnnnnnnnnnnnnn

SEQ ID NO: 10934 - DNA, 606 bp, Oryza sativa
  unsure (1)..(606): unsure at all n locations
nnnnnnnnnnnnnnnnnnnnnnnnnnnnnnnnnnnnnnncctcccatgtgtacagaccatttatatataatctgataattaatcataatgggcatacatgctcgatggtgggtttactctcgcaggtggccgtagccgcagaagcagcccatccaatccagattagtaattaacagcgacgcagcgagaacaactatctgtgtacgggacaaggagctatctagcgctgacgaaacaatgaactgactagtagtaatgacgtgcagattaaatacgcccatgcatgtgaggtggttgttcataacgctgcttgccttcatgtatcatgattctgatagtgatgatagcttaatgcttattttaatttggaaatatatatatgtggcactacagctcagtgagagtgaacgatttagatgttatgtacagctagggggacacaagcaaaatgtgcatgaattagggtgtttttttaaaaaaaaatgcgaagaattaagcgtgcattttgacagaagaatctgaactgctcgtgatatcaattaagtgggtggtgaaaaggacttgggttaaattaacctgtgaggatgtcgtggaaactaccataca

SEQ ID NO: 10935 - DNA, 615 bp, Oryza sativa
aaatgatgccctgtgtgtttatctgtttagcctctttatcataactggacaaacctgccagggtggctcactgagagaaacagcgaaccatgtgatataacggctttgaattgtgattgtgcccatgactcctctactgttcttacctggtatgcattcctgtgtccaaggctaaagctgacgtgtaatgggtttccttatccccaacttgtagcctgctttgtactttgtcccccatgccctgatgctaaccgatcagcccccatgcatgtatccacgtataattgttcgtatccatcttggtgcgtgtgtgttgctagtacacaagctgcatttttgcacatcctcagtgcgttgttgagctagctatgttggataatgattcgattcttgcaccgcttgttgggaagtgaccatttgtatagaatcactggcttttggtagccttgcttcaattctttgtagtttggaaattgtacataaaggtgccccttcaacttcaagtgcttgtgcaaaaaaagccagtagaagagagatggattcctccttctctgacgtggatatatgcttttaatattcgcgggcaaattcaccttggggatgaaataaaaacta

SEQ ID NO: 10936 - DNA, 713 bp, Oryza sativa
  unsure (1)..(713): unsure at all n locations
acnnnnnnnnnnnnnnnnnnnnnnnnnnnnnnnnnnnnnnnnnnnnnnnnnnnnnnnnntctaggcgcctcgtcaggctgctgaaattgagcattttgtggggagggccgagatggtggtcgtgggccgtaattgggagcccatgaagagaaacccggcctgccacgggctgcctcgatcaatgccgccgcaggaatttgggcctccatttggcctaccagtaaatggaccgctgctgcccgtgggctgtacgagggagcccaagcgaagaaacgcggcccacctcacaaatttgggttcgttttggcccaccaagaaatccgtattgggcctagagtggagtaggagagcaatttcacgcgccgagaaatggtggctgtcggactattttgggcctccaaatggcctgcttagaaagtgggtcgtcgtgggccgtttttagcgtgacaggccgagttggagcccaactgttcagccatcctcggccatcgggaagtccgtcgatccatggcaaccgctcgccggaaagtccgtcgtctccggcaccggcaagtgtacgccactccgtcatcattttgcttgctacacgtccaagacaggaactgcttggcatgtgagcaccaccaaggctcctgcagtgtccgggtctgcgagtgcatcatctcacttctgactaaattaggctgtgtttaagttaccggtgtaaaggtttg

SEQ ID NO: 10937 - DNA, 673 bp, Oryza sativa
aattatgcttgaattttatagtgatatagtaacaattaataaatttgagttaagtgcacttacggggcctacaggagattagggggggagagaagaaaatatgttttttttttaattttattatttttatatgaatgacatgtaggctccattaacacgtatgcgtcaacatggcatgtcatatcagtgcacgtagcaggttagactgttagaactcgtttgaatctggatacacctatgataaatttaggaacctatataacatatccatttaagtttagacagaccactggtgtacttcactctaacaggttttgaccaactcgccagtcgtttctcgcttcgtttatgctgcccctttgttcaacaatcacacactaaaatgttcaggtgttccatcgtgtcaggtatgagaattattatgaaatttatggaggtgaagtggaatcaaggacatccaactacgctgatttggtacctttttagctggagtagttgtttttcataataatttgcatatagctcatgtgaaatcgatcaattgaattagcaacgagaattttggaggttataaccaaactaattagtgccaaatttaatgcatcaggcaaacaagtattatgatcttgtcaccagtttctacgaatacggttggggagaatcattccatttt

SEQ ID NO: 10938 - DNA, 746 bp, Oryza sativa
  unsure (1)..(746): unsure at all n locations
gcctcaagctcgcaaaggtgctcgagctcgccaacttcatgaaggctgttggaagggtgcctaccaagcgatccttcttctagcttcctgcagccagcctctgcaaactttgaatcttgatcgatctgctgctgctctgtttctttcagtgccttttgtgtgctggattaatctagctgccgttcttcgtgtgatgtttgcttagctgtgcgcatccgagaacctaattgtaaaaaagattttaaaacaagttgtatatttgctgttgctgctgttgccctctgctgcttgtgatcacagagtggcccttgtttttcccctggcttgtattatccatacggcataaatggtttgtttgctcaaatcttgcaaacattcagttcgacactagtactagcacttcatttttcttcagctctccatggatcaatctagctcaatttctcaaagcaatggtaccaaatcaattcgattactgtgagtactacgtgtggacattggatgtcaatctcaatcatcacgatgactgatggacgttggacggcaacctcgagagagagacggagaaagggagcactcgccctgagctacacgtcagtaggtttcgcccttttcctcatgataacgccattgaattttttttaaagatgaattcgatacagggaatgaggaggaggcatnnnnnnnnnnnnnnnnnnnnnnnnnnnnnnnnnnnnnnnnnnnnnnnnnnnnnnnnnnnnnnnnnn

SEQ ID NO: 10939 - DNA, 24262 bp, Oryza sativa
  unsure (1)..(24262): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcacacgaaagagtgcgagagcttagaagaacacacgcagaagcccctacctggcgcgccagatgacggagcgtggggctcctcaccgggagaccgcgcaggcccccctttgccggttcggccgggggccctgggtgagattctaagctcctagtctgtgtgtggaaggttcgcgagaatggaaacacacaagacacgggcgatgtatacaggttcgggccgctgagaagcgtaataccctactcctgtgtttttgtggatctatgtatgaagaagctacaaaagagctggagaaccagagagctcttactctctccctctctgatcgttctggatccgaaaatcaatcctcccccttctaagtgggcaaggtcctccttttatacctcaaggggataccacatgcaccatctctctcttttttgtggggacttatcctctcttttcataaacagacggagacttgtatggttgccgtccgaatgaccttctgatgggacagcccatacctacctccacttccgccggaagcaggcgcgacgtgggaacatggctgtctgctgacgacatgatcagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccccccccccccgagggggttaggccacgtgggtgatcgtgtctgcctcaagtctctaagtcatgatactcccggtcccatgtcaccgacaagttgcaatctatacaattagttatttttgagactatatttaatacttcatacaggtgttcaaatatttgatgggataatgtgtaaagttttgggtgggatttaaacagggcctaaagtgctcactagtcactccagctttgaggtttctggacgaaaaatatcttcatttctgatctgatcagccttgattgatgatgaagaaaatgggggatttcaggagatggttggagagtaggagattgtgtgtggatgacttgtgggcccggagaggagtaggttcacgtgtaggtgatcatctaggatactggtagactagttgttggtgtctcttgaaggatccagattccagaggtgaatgttccagcattccagggtgtgatctgttccagatttttgagaattctaggtctcttgtctgtgtttgttgatttgcttctgtgtttttgctttatgtattttgtcacctatggcactaattattgatttattgtgtgttaaaaagtagtgggagtgttatctgaatttctggagtgtgaagcatgggggattttacatgaaacaagatgaacggacaacttaaacagattaacagactagcatatttagaagtcaaattactagtacatagtagaagaaatctgtattgatcaccagtaagactaatatcattcttttcccggagggatattactcaatcatgcatctttcaactatcaactcaatttctcaaggctcttatattatagcacctgaagaactcagcaatcaatcatctttcagttcaacaagtcaaaagctccgtttgcaatgcacgaatatcactcaaattggtaagagttctcgtagaaatggaagaaaaatataacttgtattactgacgtatagtgtacttctaagatcttaaacatcatgttcggagtgttacagttcattgatcctctaatttcagctaattaactttagttacaaaccgatcctttaatttgtttcctggaaagctggaatcgaattccatccatgcataacagtccgtcgcacctttaatttcaagaatatctttagacaaatactttgaagaatatgatactttatgtctgtatttcctcatatatcaaaattaattgcctttttgtttgttagcttatctcgaagtgcttatcttatgcttccaggagtgagaattggcagcttctagaatgctgcaatcatacatttgctcgtgaaaagaattcaacttttcttcacctattgagggtctgtttagatccttgacaaaatttttcaccatctcacattgaatgtttggacatatgcatggagtatttaatataggaaaaaaataattatgtagattgcgtgtaaattgcgagacgaatattttaagcctaattgttacatgatctgacaatgtgatactatagtaaacatttgctaatgataattaggctttataaatttatgtcgcagtttacaagcggaatctgtaatttattttgttattagtctatatttaatattttaaatgtacccgtatatctgagatgacacatcaaaactttttacccctggtctaaacacagtctgagttgtatgcaagtgccaagagcttaaaccggcctatcgattttacagttgaagatacgctagcacatccaactcataactggtatacaaaagcaaattcgatctattcatctagacaagagttatgtcagacaccactgaagtgcatggttatgctatgtcagacaaacgatgaaacaagacaagctaaatggacacatgcaaataggttagtggacgttaccagtagcactccatgattggcttcaaggtttgagctttgctaagttaaatcattgtccatctctgattctctgtcagctcaacaccatgaatccatgattgagggcaatgttgcagataagtaatgttgctgtttactgcaactgaagaaatactactgctattgagctgtggttaaaaaaaaatccttccaaaacaaagccatttataccccctccgttttaaaatgtttgataccgttgactttttagtacgtgtttgaccattcgtcttattcaaaaaatttaagtaattatttgttcttttcatatcatttgattcattgttaaatatattgtcatgtacacatatagttttacatatttcacattcttttttaaataagacgaacggtcaaacatgtactaaaaagtcaatggtataaaacattttgaaacggaacgagtattatttttgcatgtgagcatagcaaagttagcaacacgtggaaactggaaagtgaggttggattaaccaagcgtgaccgggccaggcacgagttgggcccgtgttcaagaatccaacggtgtgccggatccacgtcaggctgggcacaggatgggcctgaatcggttccatcccagcaaaagtagttgtgatgaaacacacagctgatcagctgaacactttgggttttttttttatataagggtgttttttacccgatctcgttcttacgaagatttaaactcaggtcaggactagcttatcaaaaatgacctaatctaaaattcactcatataaagatttgaattcagaactagtagtactactcaggacatctacagatcttgctcgtgtcgtgcacgccatggttgattgcttcatagctgcgtgattattcagggccaacttataattaagatgccgttaattgatagaaatactgaatttacttataatgtcaataacggtaatgcagtgtattattcgtccggtgttaattttcgcagttgaacatattagcattaccatctctatgttaaggagtgtagtagagtatcattgcacatgttctagtaggatgattagtgaagaaaaagacgagcaaactgtacatgctctctgctcgtgctgcttcgagaaatctaccaacctaattaagctcgtctaaattactactctagtgtacttaacttgaaagcttgttgcgctgtgatttacctttttggcatgatatatccctaccccgacattaatggaacaacgtagacgtgtctagattcgggccacattcagttgtctcctagctagtccagggccaaatcccgggtcctgttgctaacaaggggtctacctgttgtttgatctttggattagagctgaattgaaccagcccattttaaatcaaatagattaatatgaaactagtttataatgtttttatgccaacgctagcttatggtttcatttcggccccgatgctcccgcgggcatggggggagatggatgaggaagacgggagaggagagaaataattagtttaaatcatatccctccatcgtaataccgaaaatcttaatcccaacctaagttagatctcatagcagtatggagagctatttttgctgatgtggcatattagtcaaaaatatttttagaaaacttgtgaagcccacatgtcactagccacaccacagcacaccttcttcctctgttccaatctcctttcttctgtggaataagttcatcggaggtccctcaacttaacagcgatatttttttagtcccttaaccacaaaaccagaaatcttcacccctaaactataaaaaaaaccgtttaatttgggtcccaaaaataaataaaaaagtaggtggggcccacatgtcagtttcgttgccgcacgccgccgcggcctcccctgctccaaccgcgcgctgacgcctctaccgctcccgccgtcgcggcggcggccgccactcctgccacgcgccgccacgaccaccgctgctcccgccgcacgccgccgctgctcccgccgcgggccgactcctcccccgctcctaccgtcacccatgttccccgtcgtcgcctaggccactgcttctcccaccgcacgttgccacggccgccgttcccctccccccctggagccgccgctcccaccacgcgccgccacgaccgccgatgctcctaccgcatgccgatgccatcgccgccgctcccacttttgcccattctccctgctgttacagaggcaaaaaaggtaagagtacagtgagaaatttgtgtcggcgagatcctccaacgcggcgcttattgccgggttgctcaagatgttctccgtttcctgcagcagcgacagtatactcactctcatcactcgtcttctgatctggaggcagtcctccttgtttctctggaccgtctccaccgcatgcttgatcttcagagccatctccgtgatatgcttcatgctactcactggatccgccatcttaattctcaaacacaacataatcaatcgtttagacaagtagttatatatatgcttgaaattgtgaggcagtagctacgttggattagaactccgacgaggagctctccgtctccggaggcggcggctagtgaagcttattgaagtattcttctccgtcaccgactacctcgtcggccgctcgcccgccgcactgctccggccgcgcccggagtcggtgctcgctcgccgctgcagccgcgcttgaccgctgacgccgccgctccgcctactccggccgcgcgccgcctgcgcccagagccgttgctcgcccaccgccgcggccgcgctcgcccgctaacgccgcgcgctgacgccgatgctccgcctgctccggccgcgcgccgcccgcctgctccacccgctcccgcctccgaatggggagaggcggcgccggccgccgctcctgccgttgcggcctcatgggcgatcgggccgggcgcctctctccccttctctggcgccggccgcctcctctccccctctcccgcttcttcccagcgcgccgcagctcccgctccgccgtcggccgccatttgctcgcctgcgcgtgcgaactgagaagttgagaagagcagagaaaaagaaaagaaaaaagagatgtggggcccacatcattttctctcagtgagatatgggccctcacatatttattttattatttttgctgactaggatgccacgtcatcaaaaccagccatctatactgtcttgggacccaaattagacggttttgtatagtttaggggtgaagatttctggttttgtggttaagggaacttagaaaatctcgctgttaagttgagggacctctggtgaacttattccttcttctgttcctcagttcccaacctcctccatgccgggccgcaccctaggactcctctcggagtctccacttccgactggcccaaatcaagcccatcttcacttgactcatgtcagccgaaatgatgagaaagaggagccaattttcttgggactacgggcagatttggattcgagccaaattttatccagcaaagttttgatatactccctccatctagtttgatagtcatatttcatcttggcacatggaccaaggataagtaattctacttatcatctatttaaacatgctactagtcattcctcgtaaacaaacgattcattaatatttacatttctcgatgtccatgtagccaatcttgtgtggaagaatggagtcacgcattaaatccgagaaattcattaagatgataggttattggattgaaatatgcctatcaaaaataaatttttcagatttggaaatatgactatcaaaagtagatggagggagtatttacttaaacagcatagtaccatcttgatgtttggattggtgtctgattttttccccattaataccattagtggtgttaaattttgctcacattagttctaaatagttgtaccagtagttgatataccctattaaatttgatactccctccattttaaaatataataacttctagcatttaaattttatcttaaaatataaaaacgtctccatctacattcttttatcaactaatcatagacttccatcattcaaattccatacatatttccttttcttaatcaatcacaatattccctcatttaatccaatcatttgtttcttaatatcaatgtacagccctaaaacttcttacattttgaaatggagttagtagacctgttttggtatatactggtaaggtatcaaaccaaacaaaattttctaagacattttgttgttttggtatatattggtatcaaaccaaacaagttcaatgcaagctactaccgtaacaggtcacaacttccagagttcagattcagatacacagaatttcagattcagatacactggatgacaacaggatgaacgagttgagaatttcacgccgcttgtattatggtacgtacaaaactacaaacaattgtaccaataattctggtctagtaaactgtaagcacaccatctgcttccccatcccgccctcttttgggtacatacatatctgccgcctgactgacaaatataatcgctgctggtaagcacaaaaccacaaatgctatctatacaaagccactaagttactgtgtgaaaaaataatgtaacagccagcacacagcaaagaaaaaacgtaagcgtagtttttttctctgtccagtctattgcgtgtcgtcactgatggatccgtccttttgaagcttcagactgaggttactgaacctttgtcttgagtactgcctagatgccttcctccagtcagtgccggccttcatcatgacggcaaactcgtcgtagcttattttcccatcctgagaaaagaataaatgaaaagaaaacattgcattgttgttaggatgaccatatcgacaagttcaatcacacggaatttgaacaggtcatactttgctaatgttactttcaactaacaattgcactagaatcatctccagtaagcctaccccagttgtttgtttgttatgtcatttgttttatgtcgtctaattagactatccttgtccatccggttacaacttattatatgatagtataggtcaatgataacattcaccaaccctttaattaaataaaccctgccttgcagccaaaggtagaaacatttgaaccctggctaccaggtaatcaagtatgtggcactattcagcttctagcaaatgatattcatagatttcactagctgtgggcttataacttttatataattgaagtcattgcatagataccaagaacaatgtcatgcaatataatggcctgctaaggaaagattaagctgaccttgtctgtatctacatcacggatgatgctattaataatgtcttcatcattgccatctatttcatcaaccaaggcctctctaagctcttcaatttctatgtaaccactcttattttggtcaaaatatgagaaagccttctggatatgttcatcattgcctattttcctcacatggatagacacagcaacaaattcttgatagtccaggatcccatttttgtcaatatcagcctgcaaagcaatgagcgaacatcaatatgtatcgccaagaaccagaaccagtcctttttattctagtttagaccatttttaatgataactcacagcatccatcaatatcttaagatctgaatcaggcatctgattcccaagtttacgtatgccagccttgaaatcctcaaaggtcagctggccattcttgctcacatccattttatcaaacatgtcctttatgtcagctgcttcctctgcagacaaatgctcagcaatgacctgcaattaagcacaaataagctaactacaagaaaaggagaaaaatccttatgcacatctcgtgtttagaatttaggaagcaaattatatgtgatctctatgtagaagtttttattcaataagaataataatctattttggtgctaacatattataaatgctaccttaagggctttcttctttaacttgttcatcgcagcaaattgctgcagtctagctcggacagcatcaccaagaggaatgtcaggcatctttttagaatcatgtaaccatggatgttctgtacatgcaacgaaaatcagagaaaaacaatgagaaaaaaatgtctgagccatgaaaaatgttaatcatggtgccattaaaaaacattctggataaaaacacagtaaaaaaaagggtacagctagccatttttcggagaacttttctgagattagccctgcatgatggtccctgaataataaatagccctgggctaattttatatcttcttataataatgtgagttcattactcatcaatcacatcatagataatatatagtacagacatatccttcatatattccactaaagtaggagtgagatagcattatgtatgctgctacgcgttaggacaggtgattggcgatgcttaccaagtacttgttctgcagtaagccttgtcatgggatttgggtccaacatccgcttaacaagatctttagctggctcagataccctgggccatggttctcttttgaaatctaccacagagcgtataattgcctgcgctactccctgctcggtttctgcatggcaccacaataatatgataagaatggtgttctataacttccccgcaacacatgcagtctagtcaagagaaagaacacacctgcccaaaatggtggtacaccgcaaagaagtatgtaaagtatcactcctgcactccagacatcaacttcagggccatagtgtcgctttaaaacctctggagccatgtaatatggactgcctacaatttcagtgaaccgctcacctgcatattgaatccatcattagaaatcaacaagcattcagttttgctgaaaagaatgctgcatgtgcctatgaagtaagctccatttgcagtgaattgaagcaaagtacaatggggcaatcccatttgctcttcttctacttgttttgtccaagtacaatagattcagttccatttattctaaagttatgtacttgagcatcagtctgcagagcataccaggcctgaagaacacagatagcccaaaatcaattgccttcagaggagaactatccttcttgttagcatataggaagttttctggtttaaggtcgcggtgcatgacaccatgcctgtggcacatctgttcagtagagaggacaacaatacatgtcagatgtcacaaaagcaagtccaatatagcaagaacttaatatgaaaagcacatgatgaagaactgctagcatacattctagaatcagcgtgattatacgtttacaaatagaactgctgccaaaatataccatactcgcagtacaaaatgcgcttcactagtacatggactcctttgtcaatacattatcactctggctaaacaatgatgggtgactctaacaagcaccaaggtttaacagactgttgaaccctagcaaattcaacaattaaattttgctcagaatcttaccagatacccagttggatgctaccatgatttctaattcctcactacataaaagaccagatcatggccaattcatgaacataacagctagtagtagcaattatcctatttgaggcataaccaccaatttctctcatctgaaccaaatttatttacgaacataacaacagatgctagaaattaattaagcaaataacaaggtaaaaaaaaatagaacaggactctgtccagtccacagtccacacggagacacgcgttcacctgaaccacctcgacgatggtgcgcgtgacggcggcggcggcgcgctcggtgtagtggccccgcgcgacgatcctgtcgaagagctcgccgccctcgcagagctccatgacgaggtgcacgttgtcctcgtcctcgtaggcggcgcggaggctgacgatgttcggatgcgacggcatgtggcgcatgatctccacctcgcgccgcacgtcctccacgtccaccggcgtccgcagcttccgcttcgatatcgacttgcacgcgtacctgtcccccgtctccgcctccgtgcacaggtacgtgatcccgaactcgccgcgccccagctcgccgccgagctcgtaccgcgcgccgaggtcccgccccgtcgggtcccgcagcaccatcagcccgggcctccccgccgccgcccccgccgacgacggcgcgcggttgtacgcgacggtgaaggggttcgccttcttctgcttccccctcctcctcctcttcccgccctcctccgccgtcgccggcgtgccgcagcagttgcccatggcggcgtgcggcggcggcgaatcgagcttggattcaattcaacaaaggaggcgaggcgattcgattcgattcgagagagagaagagaggaaaataaatggatttgggaaaaaaaattctgtgtgcttcgccgtgtgagttgggtcgcagagtccacgaattctggatgcgttctagaagaggggggcaaataacctagtaaaacctttgcaaaccaaaaggatatatagttttttctatcttgagaaaaaagttttagtaaaaaattttggggaaattttgtgggaatacaagagattttagcggagtttagtaaacgcgattaggataatccggtacagatagatggaggagtagttggtgtttgtttgcttcttctagagatgagtgagtcagtgagagcagatgccgttggacagttattgtctaaggagtatggtgtccggtcttttttcacataatactataatttcagattatataattttcacaaatatcaatttctactttttaaggagtacatgccaagttgccaatttgattttagtgtttgggtattagcggaacagcttattaacgattaaataattagttatattttcttagtgatacaaaagcaaatacttaaaaataaacatgagaaaaaacctaaaattaactctaagtttaaatttaattttaaagtttagcttatgttggtaatgtaaaggctaaacggtggggctgaacagggttttagaagtaaagaattaaaggttttctttccccgaaaaagataaaggggttttaaaattcggttcttgattgagtttagatttcttggaatataaaagatatatgcaggacaatgtgaagaggactttgacgtttgaaacctcgcacggacgacttgtggagctcaaatgcgacggcgacaagcggcaaagaaaaaaaaaacacaccagcttggaaagttggtttggtaagcaggacaatgacaccccagtaaattacaaatggagagaaaaaaattacagtttaggccgagtttagttccaaattttttcttcaaactttcaactttttcattacatcaaaactttcctacacataaacttctaatcttttcatcacatcgttccaatttcaaccaaacttccaattttaacgtcaactaaacacaccctaagcgtcctgtattgagaatttggaattcagtagagaattgattggtacagtactggaacctagtcatcgattattctaatccctggccattgattgactagctcgtggcgttgcttgacaggatcagcaacctggggaagaagaggatgatagaaactgaagcttcggttcagacttgacctgtcaggatcaactaactagaaggaaattgcatgttcagttcagacttcagggtttactctttcaatgagaagacttgagaactgaagagtttattactgtattttctttttttttcgtttctgtggggtttaagccttcatagttcagaccagtccagaacttcaaatttcatcaggttcagtagcaaatccgcagagaaaaaaagaggagagaatgtattcatcttatgtttgtacgagtagtagtatagatcaaggatgagtttattcataatattttttgtgttttggaatctaccataaatcgtaagcacgtgcatggaatccatggaatgtttcttttttattttctatcagcagcactggaacctcttttcttttcttttttgttggcgctattgctattctatttttctgacaggaaactgaaaccaattgcgtatccctcttccagaagagaggtgcaggctcaggcctatcaacacatgctgctttcaatcctctacaccacaaccacaagacgtcaagattgaagaacgaaggcgatcaaatagttcagggtttactcttacaatgagaagacttgaaaactctaagagttcactgtggggtttaaggctttaagccttcagaattcagaccaaaacttcaattttcagattcagtagcaagtcctcatcaagaaaaaagaaagaatttatccagctttaaaatgtttatagggtaaaattagtatctactagtaggatttggatcagctgcagtagtagtactgactgcaacttatgcagtcatagcagctaccgtttgatctgaatcagatggcactgattaggtagagcactgtagcaaaagtactgtagaataaaatattactatgattatgtagtttgataactgtagcggcaaaactggaccgttgatcatcaaaatgaacggctgaagatacgtgcagtcctaagttgcagtcgtagttaccactgcagcaggttatccagtaggatgattctcgatgcaagagattgcactatttaggtacttcactagcaggaactattcttttgcaaagagcttattgaactccaaacatgatctcaatccctactagtagtagtgtacttcctactctcccaaaaaaactcaatttaggattgggataggacataatacgatgaatctggacatgcttctgactagattcgttatattagactatggttgcgattctctcggttgggaactcattcccttagcacaaaaaaggtccattagcgcgtgattaattaagtattagctttttttctaaaaatagatcaatataatttttaagcaactttcgtataaaaacttttttaaaaaacgtaccatttagcaatttgaaaagcgtgcacgcagaaaaagagggaagtgagttgggaaccatgagtaccgaactcagcctatgtatcatcctaatcctaggttaggtttttttagacgaagagagtactactcaaggatcaatttattcatctaattctgtgtttttgggttctaccataaatcaaaagcacgtgcataaaatccatggaatgtttctttttcttttctatcaccactgaaatttccacttttcttttctttgtcttggcgctattgctacttcctccatttcacaatgtaagttattctagtatttcccacattcatattgatgttaatgaatctaatgtgagaaatgctagaatgacttacattgtgaaacggagagagtattatattttatgactggaaactgaaaccaattgcgtatccctcttccagaagaaaagagtaggcgcaggtataaagcatgcgactttcagttattctagaccacaaagacgtcaagattgaagaacaaattaaggcgatcaaataatatatgttctttttcaagctgctgaagatgcatgtacccaatgggttcatggaattgtttgccttcttggctcttgccctgttctttccatcttgcggattatgttgtaagcttctaaacgtttgcaaaaccctttctatgtgtatataagattcttagaacactttctaaaaacaactaataaaatttgtaacaatgaactcgttcttttgcaccgtccgatattatcacaacaacaacaacaacaacaacaacaacaacaacaacaacaacaacaataataataattcataaatatgttctgatattcagttgaaaagaaggggacttcgttttcctttaattaattagtatttgcttgacaacaactaaagaagtaaagagggtcaagaacaattaaatgtggccggccggcgagcgggcatgagcatgtagacgatctcaaccttacgaggcggatctagaggtggtattgggaccacccaaaaaagcattagcccaatacagatatacatatgtgaaaagattttttttggaaaaaataactcccttattagtatattaagatgtaaatttgaacaatttatacttatatttagaatatttaaaaaaacatataagttggatcacccattttgaaaattctagatatgccacttacgttttttttttcgaacggtcaggccgttgccgatgttttatattaagaagaagatatcctattttaaagagaaaacgagatcaaacctcacagtgctcagttaattagggacaactgagcgaaaaccacaactacaacatcacaccaacaactaacctatcctaagctaccacgacggagcccgacacaaggcatcggccaagcttgccatttgagacaacacaacagcctacatatgttatcgttatcaagcttgccacccaagtgacacagcagcttcgacgccacttacgtcctaaaccttgtggagaataagataaccatgcagattgagcagaaagcgagcaaaaacgaaatcaaaggggttaatttccgaccccttctgcatctgacaacggctcggctgctctctgtcttcgccttcagaaaaacgatgtttgcctcgcaagcattgcatgtttttttacgcttcgtcggcagaaaaatgttgacatttcagggaatcaaggactgcatttttcttcttaaggtcctgaagctcaactgttgatcgatcgagtagttcaccgtgtgtgcatcaaagcatgcacgacaaaggagaagagacagagagaggtgtgtgggtgtggctgagcgagagacatgcaccgaaatttaactctccgaacccctctctgaagtttactttttcttttttgtatgctgggttctactgccataaaggaataaataaatcataagaatgttatataaaattcatacaaatgttccttttatcctttctactagcacttaaaagtctgaaactattgtttttccttttgttggcggtgtcattgttatgttttctgtcggcaaactgaaaactgattcatatattcctctttcagaagaaaagcagtaaagcacaggcgcaggcattaccaacatgctgcattttaagcttctagatcacaggagcgtgagaaagaaagaggtcgaaggggatcggagttcaaaactccgaccccctttggatatgaccagagctctgctctccggcttcggcttcagaaatgaatgtttgcacgcatgcatggtaatcctaattatgcttgattggaaagaaaatgttgagatctccgagaatgaacaaggaaaaaggactgaacttttgtttctaaggtggttatcgatcaaattatccccccaaaagaagaggtgccgatcggaaagagaagtacctagcagctaaaactggaacttccattttatatttttcttggaggtgtcaccgttctatcttttgacggcaaaactgaaaccggcataccagcatgctgcatttcaatcttctaaaccgaaaaatggtggtgctgcatgtaccaaatggctcataaactgtttgcacttcgttagcagaaacatgttgagatttcagagaatgaacatggaaaatgaaaaggactgttctgaacaatcaatcgattagttcagcatgtgtgcccatgttaggttcgttgtgaatgcatgagaatgagaagagagatgtgtggatgtggctgagagagaaacatgcactgaagtagtgaaggaaaaaaacaggtgaagggggtcggaattttaatctcctaatccctccttttatttttttttaaaaaaaattgggttctaccataaatcataagacacatcgcataaaattcataagaatctttttttccctcttttctactacgagcaagtttaatagtacagcccactactagctccaattcatctatagccgatctaatagccaattcatacaatagttgcttactatactattaatatatggtcccacctgttatacacacattgcgtcttagagtccgtgttgcagcccgctgctcttctctctcatcttttatctcattaaaatatatttatagttggctaatagtctgctattgtaccagctctactagcactgaaaccagtttttctttcttttctttttttttgttgttggcggtgtcaccattatattctctgacggcaaactgaaaccggcgtgcaggttgcatattcttctcccaggagaaaattgaagggcgcaggaatacaaacatgttagctgcattttcaatcttctagaccacaggatggtgaaactatacaaattaagatgctgatgcatgcatgcatccattggttcatgaactgttcactctagaagaagacgatatactagctcagagccacaggagtctcaggtgaggtcagatctctgacctctgaagagaacaaaccaagaaatttccactgctgatgcgcctccttggctttggctttgtcttgtcctgaattcctgatgatgacctatatatatggtggttgctatcgattctcattcgctgttctagatgaaatatctgaaccagtttatctccaagatgtgcaaaatgatcagataaattgctatctgggccgcgcattgatgatccaaccgtgaaatgttcgagcggcccatgaaggcccaagtttgcgatccaaacttgcatcagctctgctcagtggatgttatgtatgtaggagtaactctgtaacagttaaacagtggctaagaaaatctcaaatctgagatctcatctgagtgatatttagctcatgagttattacaagcatgtctagtacttattcatgcacggattagatcagatcagattacaccatgcgcaaaagccaaatcactcttctcccgcgtcaacaccatgcatgttcgatcatgcaccgatcgcgacgaactcacgccatgtagcggcgtcgtcgtcgccgccgctgccacttaggatatcctgcaatggatcgaaccgagatgaacaaacaattcagtaaatgcaaactaatgcgccatgagaccaatctaatcaacttttttttaattattacttgctgcagtcggtggcggcgccgacggggatggcgagtccgagcttgcagagcgccgggaggcgccgcgcgcggtcggggagcacgccgaacgacggcccggactgctccaggcacctgcacagcgcgcgccgcgcctccgccgtgcccgccatcccgcgcagcgccctcgcgccgccgcagcaccgatcgcccggccggccgcgccgccagcaggaacggcccgcacggagccagcgcgctcaccgcgtaggcgcacgacaccgccgccgcgcccccggcgcccgccgccaccaccacgacagccacaaacaccgcgatccccaccgccgccacgccgcggctgcgacgagcgctcgccatcgtgcgctcgcggtgacggccgatcgattgaacaaacgcgttgcgtgtgagtgtgtgtgtgagtgctgagctcgaggttggcaatggcggccatttttgtaggtgggggaggtcaaggaggttggtgatgcgcctgaatgctttcccgcgactttaccatgctcgtcgccatttccggcaagctgaacaactctgcaggcgcgtattgaatcgaccggatggcgagcggctaaacgccatgcgtcgcctgcgaggtccatgtgattgtgcattcagttcacttgatctttatgttgcattcaatccgtatatccaaaagggaatatcaaaccataatgccccttgccacaattttttgtcatctgcattttttttccaacaactatactagtccgcatgccctttttgaatgatctccaactattttaaacattataaattcctgcccatagtttgtgaatctatagttgtacaacctagagaataatttgagagtcaaaagctcaaaaacacaactttatcatatgagaaaatccagaaaataccaccgataaacatccaaattcaagaaatgccatcgatgaacatatattcctaaaaatgtcattgtacaatcgtctttgttccataaatatcatcgtcattagattttcattaacagcactccgttcagtgctataaaaagatcattttaaccctacgaattgttgaaagctgattaaaacttttgttcttttccattgggttgcacaggccatccctgggccaggccaggttctgacattgcccacaagcagcccattagctgtctcggcccagatcttccaacgcctgaactgcatggacagttgggtacacaggtcagcgctccgaagaagaaaatactttccttcacgttggcgcccaaaggtcgtcatcatcatcgatccaaaccgctttattccctctcgtagccatcgtgcatgcatgccattgccatgccagccaatcccttcttcttcgcgctagatctccattatttttctcatctcaacctaacaacttcttcctcttcctcgctatcttttctcgcacgggaatccggatgagacctgtcgcctgagctgagggtgagctcggtgtgtacgttgtcggggacgatgaggatcatggtgcgcacgctgcgcggggaccgggtggcgctcgacgtggacggcgccacgacgacggtggcgcaggtcaagggcatggtcatggcccgggagcgcatcgcggtggccatgcagcggctgttcttcgccggccggtgcctcgacgacgaccaccgcacgctcgcggactacggcgtgcgtcacgactccgtcgtcttcctcagcctccgcctcgccaccgacgcctatcagtacgtgcaaatttcacaacgacgacggcgagcattcttacgattttgttttgacgaaccgatcgatcgatcgatctatggcaggacggagatgcataatgtgcggttgatgcagccggagacggcgacggcgaagcaagaaatgcatcagcagcagcagcagcagttgcatgtccatgtcgccgccgacgacgaggagaaggcgatcaagaggaagccggtgtcgcggcgcgcgctccgcaagatcctgtcgcggctgcaggtggacgcgtggacgagccagcacgacgccaagttcctcgacctgctgctgcgccacacgggcggcggcggcggcgcgaggaacgtgggcgagctcaccggcgaggactggtcatccatccgcgccgagctgaacgccgccaccgggtccggcttccccgtggaggagctccagcggcggctgggcgagttccggcgggagttcgaggcggcgagccggatcaagaaccacccccggttcagctacgaccctcgccgccgcgtggtcgtcgccaagcaggccgactggaagaactacatactggtgcgccgccattgctgcatccttccgaatcgcgaatgtcttcttctcggtgagctgttcttacctcgatcgtttgttttggcggtttcaggagaatccggaggcggcggcgtacgaggggaggagcccgcggcatctgggccggctccgagcaatcttctccggcgacggcggcggcggcggcggaggaggagccaagtgccgcgagacgaaggcgaggagttgcctgaggaagctgctgcggaattttaggctgcgattcaagctgtagatagtttaaatttctgcaatatttgtctcaatttgatcgaggcgcacgaaattgttggttagttttagagcattcaattgagatcttacagtagttggagacacgactctctgagctgaagcaacgcatcttcagtcgcttgtaaagggtgctctgctgtttttgaattggctaaatgctactaatcggactgacattagtagaagcttgtgtgtgattgaaggcccgaataaattccaaatccatatggcatcagccctagttctcctgggccatctttgcatttgcccattctggctatgcgaaaatctgcagccttgaaaaatttccaaatcctctctatcgatctattgacacgaatctctgcagccctgaaaatttcagaatccttgattttttttttcgttaaaactttacaagtttgtggaatgatttaatttatcacataggagtattaatctatcttgttaaaaaaaattactacctccgttttttaatagatgacgccgttgattttttctcacatgtttgaccattcgtcttattaaaaaattttatgtaaatgtataagatataaatcacacttaaagtaatatgagtgataaaacaactcataacaaaataaattataattacgtaaattttttgaataagacgaatggtcaaacatgtgagaaaaagtcaatagcgttatctattaaaaaaggaggtagtataaatcatttagttgatatgtaaataactagtgaatgttcatgaaagttagaatagtttccctgaatatcgaagcaaaacaatcaaactaataagcctaatgctgagctgcctccgatctcagataacctacactgaattatttgagaacggaggaattaacagaggaattttgcctataaaggggctcaccggttggctcgtttgcttcaacgtacggcgatttgtccgaccgacggaggcagcgatccgcaatcggaggggacacggacacctcatgtatatggttaaaactggtactatatcatcttgggagaaatggaaaagataacactactgtacacatgagagttctggtgctagttaattaattatattagctccagttgttccaatcacgcgtgtctctgtaggaccaaattaacaaaacaattttgtcaagttcggtatgacatggacgaaaatgagtaaaataacaatacttggtccagccagagagatggagacataaagctaaagaaagtgtattatgacaaagaagaaaagaaaaaaagaaaagagaaagcgaagcacatcgtgatagcgaggattctgcaaatccactcataccatcccagcgattaattgagttgagcaagcacacacacagtgcttaactaaccttctttatttttctagtaggtggccagagttgattatcttgctaaaatccgggaaagctacaaagtgaagtgatatagtagctgcctagcactaaccggctgtctgatttgccatgcatggttgcacttccaatggccatgcatcttcatccccatcaatcttgtttattttttaatttagttttctttctcctaattagtggcgctccctagtcagccactatatatatagatcacaaaccacacacaaaaaaaagagtattgataaagttaattgatgggtactagtactaatgaccccaagtttctagaatgaattaattagctaattgagtagtacaatagttgggagtcgggttagttgtaaacatgctacctcatcagtagctccaagacgacgtgcatgattaggacctacaagtgagctggtatgacttgctagagaggaaaatgaaggtggctgtgtatgtaacatcggtttctcagacccatgctggttagctgactgtgaggtataaacttatataacgtggactctgatcctctgcactagccactcatacatattactaacatgcatgtacgagaagggataagattttatttcctccacacaacataaataggatttgagtttgattttgacaaacccatcaagcgtgattacaaagcctaccaaaagatatactactatataatctcttgcttccaagttacaaggagtagtaaatttctttggaacaggctggttgaaaccaacctttaacgtaaacaattctatcgatcgatcgatggcgaaaggaggggtcactttcttggagcgcaacacatcggacggacggagagcgtatacgtacgagggtggtgtctaggaaccggtaaaaataaaactttagctatagccttttattttcactacgtgtgttagtgtgtatctctccgtataaatttaaacacttacataaaatttaaactcgatccaaaatataataaattaagtaaatagaacccttctatttcattctaaagtagctaattcttctgtttcatattgtaagacttatctagatttggaagttgtattgtaataacatagattgaatcacgttccgctggcgatactcttcacctcaacgcgctacgcataacgcattccacggcccatctcctcgcgtgccttttagtattcttgttcaccatccagtcatccacccgtgccgcaaatttgccccgctgcgcccccgtcgccgcctgcgcctgcgggtaggaaaaagaaaaaagatcgtactccagaagccgtgaatccgacgccgcgcacacgtgccgcgcagataacggtgcgcaaagccacgcaacgaaaggcacgtcacgtcgccgcgcgactcggcctcgcgccctgtattgtgtctgtgtatgcgccgcgctgcccgtccgcgcgcgcgaggggaatgagacgatatgaaatatggagggggggaagagaagacgtgggcgaaagcggcaggcggggacaggtgcgcggcgcgggttgggtttgggcgcggattgcatgtactcctcttttcttttgctgatgtgtgctagcttgatcagcttgaggcggaggaagcggacaggctcttatccgggtgaaagcgacgcgtcgccaccaccacccactcttagctgtccatccccaacccgggacttccacgtcctgcacgatgaacacgtcgacgatgagcagagcatacttgctcgcgaattaaaccgatgaccagccaatagtaacatcgccagttcagatgacgaactactgtacaggtagtaattcgtcgtgtcgacttctggcaattgtcctgtactgcactggatgacccgttcgaccgtaaagagaccggtagaggttaagacgtgaggatattggatttgagattattgagggcgcaatcgatcgcaacctgtggtnnnnnnnnnnnnnnnnnnnnnnnnnnnnnnnnnnnnnnnnnnnnnnnnnnnnnnnnnnnnnnnnnnn

SEQ ID NO: 10940 - DNA, 18655 bp, Oryza sativa
cccttttgtgttgtccagtagtagtagtatcttttgcgtatggaagcactcatctgaacatgtactaaactgcctttgcaaagcttgctagctctccgcgtaacgtgataagatgatttgcactggcgtaatgcatgtgaaatgctacgaaaaaactttttataagggataacaactagaccttcaggctcgagctgatcaagcacagatcaaaaccatctttttgctgagctacacgagtagtactacataagttactaactgctgcttttttttctgaagactacacacactaataaaacactaatacaacgtactccatttacgaggccacgctgtgccatttgccaatcaattaatcaaccaaaagaaacattccccaacccatcctgttggattaaacaagcgccccaacttgcaaattcgccgatctccaggtgcaccaaaacactcgctctcgccttgaccaaagcccacatcgcgcaggcgcagtgcatgcaccagctttaacctggcgccaatggcgaacgcaccgcaccgcgagacaagtacgtgtcacccccttggcgccaatggacaaaaccacacccggccccatcgcttccccccctccatgcccatctcccgccatataatacgcgcgcacatactccatgacacgacgcaccacctcagctcgccagcagcaaccacggcggcgcttcggatgcacggcggcggagcctccacgacgaccaccgccatcgccgccgcgcgggtagcacatgttgcatgagcagcacgcgccgccgccgcagccggagccggaggtttcgctacagctgtcggcgcccgccaccgccgccgacgatgtcgctgcaggcgacgacgaggaggtcaccgtcgtcaccacgtaccgcgacatccaccctctgacgccgccgtcgccgacgacgacgacgacgccacccacgcggctcgggtccgccgcgtactcgtgggacacggccagcagccaccggtccgtgtcgtccgaggagcagttcatgacgatgagccgggagttcacggccatggtcgccgccgggacgaccatgcagactggccccaacgacggcaacaacgacggtgaccagctcaccagcatcggcgaggacgagctggaggagaccaacccgctggcaattgtgccggacagccacccgatcgccacgccggccaggagcagggcgtcccagctgaaggttgtccccgcggcagggccatcgccggcgccgccggtggaggcgaggcaggtgaagaaggaggaggtggagacgaaggtgtcggcgtggcagacggcggaggtggccaagatcaacaaccggttcaagagggaggaggttgtcatcaacgggtgggagaccgagcaggtcgagaaagcatccgcatggctcaagaagatcgaggtaactcaataactgattatgaatttatttatgactctcaagtttgcagatttttcatctaattcttgttgtccgtttaggctttgcaaaaatctgaaattatagctgatagattttgattccgagcaaagggaatccaactttgttcttggtgattaactcaaagcagagtagcagggtatctgttcttgcaagaaaatgttcagagtagcactagtactatctatcctttttggatgtaggcatgcgacatcagatgagttaaccactactcaatcatgcaacgttaggagagcggtctttgtcagaatccagcttttaaaagcctttttttctctctccattacatgctctgcaaatcatgcttttgcatagtgcagttttatcttttagaaagcatatctgattactgaatagtgcttagcagcaactgctatgtactccaaaatgttactcacgtaggtgttcttgatgactgaacaactaacgcagagaaagctggacgagcagcgcgccaaggcgctggagaggacgcagaacgacatcgcgaaggcgcggcgcaaggcggaggagaagagggcgtcggcggaggcgaagagaggcctcaagctcgccaaggtgctcgagctcgccaacttcatgaaggctgttgggagggtgcctaccaagcgatccttcttctagcttcctgcagccagcctctgcaaaccttcgatcttgatcgatctgctgctgctctgtttctttcagtgccttttgtgtgctggattaatctagctgccgttcttcgtgtgatgtttgcttagctgtgcgcatccgagaacctaattgtaaaaaagattttaaaacaagttgtatatttgctgttgctgctgttgccctctgctgcttgtgatcacagagtggcccttgtttttcccctggcttgtattatccatacggcataaatggtttgtttgctcaaatcttgcaaacattcagttcgacactagtactagcacttcatttttcttcagctctccatggatcaatctagctcaatttctcaaagcaatggtaccaaatcaattcgattactgtgagtactacgtgtggacattggatgtcaatctcaatcatcacgatgactgatggacgttggacggcaacctcgagagagagacggagaaagggagcactcgccctgagctacacgtcagtaggtttcgcccttttcctcatgataacgccattgaattttttttaaagatgaattcgatacagggaatgaggaggaggcatgaaagagattggtgggatttgaccggggataattaacggaaccgggggagattagcgtcggcaagagtagacgagggaatatggcatcttcttcttcttcctcgcgagccgcggccgtcagcatcaacaatggcgggggtgccacgcggcggggtcggtctcgctggcatatccgccggagtccagaccgatttgatggcgacggccacttttaggggctagtttgacacggcttcagctttagctccatttattttgatttctgaagctactaatcaaacagttttagcttcacttaaaatagaacggaaactggctgaagcgctctcacaaaattaaatagagaagttgagttgagtttagactgttttataatttacttcatatccaactcctatagttaaatttagggtctgtttatattactaccaaaatcagatttttagggtctgtttatattactaccaaaatcagattttctaaaatttggcattgccaaatttttggtaagttggcagtatcgccaaaattttggtagaacggaataaatatgttgtgccaaaattttctatgtattaccaatatttgataacaaactaaatacagtgataaatttatcaattttaacaagcaattgtatagtttaaaatgacaccaatctaaactgaccattcgaagttgaaattttaccaaacgggccatttcttgatgtccttatccagattcttgaggaacgggccgtgggctaggcctcgttgtccgacagagaatttcttggcccgataaaaatgagaatattttcatgggccggtgaggtggcccaaaatagattagccaaccggacccggcaaaagttgtcacacttgtgttacttggtttgaaatgtctaatctcgaatgtccccgatatgtatttctaatctcgcatttagatgaccacacttgttcacatttcttcacattcattttatcgtgttattttttaataatcatgacgtgtaagaaataagggaatatcttttgaggaattaaaagagtttcttatatatacacacactaatcctttgttctaaaatagaaattttctaggtaatttagcatatattagaactaaatgagaaaatattttgatgtaacgataagtttaagatagttgagtgatgggacaaacaaatgttgatgatacagaacggaagaagcatacaaaggtcatcatagcttttcactcgatttttttctacaaaatttttcaaaaagtgattgcgacgataatgaaatgagccggaatggaagtcatggtcaaggctgagatgcagtcgcgtccgtcagatcctggatcaggcggcggatatctctccacgacgacccgttctcgccgaccgccacgcgcgcgctctccggcagcgccgtcgccatggccgccgccctctccctccgcccgccgccgcccgccatgaatccggccaccgcccgcgcgatcacgccggcgggcacggtctccgcctcgcgcgccctcacgccgcgctttccgccgccgttctcccagacgcgcgcgccgaacgcggtcacctcggtgaccagccgctcgttgatgaattgctcgaacaccagcggccatgttagcgccggcacgccggccgccgccgcctccagcaccgagttccacccgcagtgggtcacgaacgcgcccaccgacgggtgggccagcaccgccagctgcggggcccacccgcggaccaccatgccgcgcccctccatgcgccgctcccatccctccggctcccaccgctcgccgccgccgtcgccggagtcggagcggatcacccacaggaatggctggttcgaggcctcgagccccagcgcgagttcgcgagtttgtgtcactgagaaatgggcccagctcccgaagcagacgtacaccacggactggctcggcttggtggacagccacctaaggcagtccacgtcgccgtcgccgccgcggcgcacggcggcggcggcggcgcgcgatggctggctgacggggccgacgaagtaggcgcggcgcgcgtcgacgcggctgaactcgtcgcagtagggcgcctcgagcgcggcgaaggtgttgaccacgacgccgaagccggcgagctgggacgccttgatgcggtcccacgacatggagaggtggtcgtcctggaccaggaagtccgggagctcggacaccgggatggtgatctccctgccaccgggcatccccggcacggtcaccggcgggccgtcggcgcctccccggacgatgtcggggcggacggcgacgaggttgttcatggcgagctgcgggaacacgccgacggggttgaacgtgaggcgcgggacgccgagctcggcggcgacgccggtggcccaccagaacggcacgtcggcgacgatggcgtcggggcggtggtgccggagcagcgactcatgggcgggccgcgacaggtcgacggcgcggtacaccctccaggtgtcgtgcgcggcggcggcgccgaggcactcgaccccgcgggccaggccgacgtcggggaacgggtagcagacgacgcgcacggcggcgttcccggcgaccgtggcggcgatgccggcggcgttggccggcgtcaccgccatcgtcgcctccacctccacggcatcagtgctcgccgccgccatgaggcacgcgaggtcggtcatggggatgaggtggccacgcgcgaagaatgggaggaagaacaccctcagccgccgcctcccgccatgtccgtccgccgtggcggcggccatggatacaattggcaagagctagtgaatcctcgggggctcaggacaccagatcgatcagggcgtttttccgctcgacgtccagtgcatcaaccgcgcgcgccccccgtgcatgcgtggtcgcgtggatggcgggaacgttgcgtcgaggactcgtggacgcatgcgtgggacactatcctaaactgtcgaggagacaactatcgttgtttgcgtaccatatgtatgtggtgtatgatcatgagattgtcatttcagcactactttgttgatgctcctgttacagatttgcagtctatcgctgagtgtaaactgattaggattaccgtggtggaatcagtttatctgatttaaacttatagatttgacacatgcatttacatttatggctaattattctttaagaggtagataatatatttatcgattttaaaatatgcggggccccatcttttaaatgtgttcatatggatagggtgtgcgcggatccgtttataagtacgagtgtttatatgtgttcatatggatgtgattacgagatactttcttggttgagttcatatcactagcgtaacgattgctcgcacctaggcttctcagattgccacagtatttttttccttccatcataaatatcttatgttttggataaaattagtcaagcttttgatattttgatcacaaatactccatccgtttcaggttacaagacgttttgactttgatcaaagtcaaactgttttaagtttgaccaagtttgtagaaaaaaatagtaacattttcaacccaaaacaaatttattatgataatatattcaattattgatttgatagaactaatttagtattataaatattactatatttgtcatgaacttagtcaaacttaaaacagtttgactttgaccaaagtcaaaaatatcttataacctaaaacggagggagtagtttcatataaaatacttatagtttaaaggaaagaaaaatggtgtgccgtaaattttatttcaaaaatacgatcatagcattataaactccttatattttacaaaccatttgttttaatgcaaaactaacggtcaaagttttaaacatttaacacaattttgcttttaaaacacaaatacatatacttcacccgtcaaaaaacccaattctatattgtattcaggttcaaacgtttttttagaagggattactatgcgcgaggagtgctctgttttttcctttttaagaacagagtactgcgatacaggctgcgtgcagttggcatttgtgtctatcacaacctcacaagctgtccaccctttctcactgacagtaggccccacggtccccacacgcccatcccggtcacactttctgtctgcatgcgaccacggtccagccgacgcgcactccgcccgtcactgccaggtgggccccacccccagctcacctcatccgtcacttcacttcactcctctccccgaaccccgtggagtaatcaaaaccccagcaacaacccaaccatctcatctcaaatgcacgccaaaaatctcgaaattttacgggggttttaattaccaatcaaccgctaaaccccggagtagagtagagtgatacgcgagcggattcgattcacttcacgctcacgcttgcggtttcctcatcctcgctggtgccacgtccttttcttgtcccgtttgattcttgcaagcctcctcatccagcttgtgctgctagctacgaggtcggctttggcggtggcggggggcgccttgaatccgaggcgatttggtgtctgactgattgatttgcctcacttggggtgggggggagttggggtttcttggtttcatcggggcggccgcggaatgcggtgaattggcgggagtccgttcgtggagacactttcttggccgtgagttcttggttcgtgcgccatggacggtgcggtgagtcgcattttcggggggaaagattcaaagattggttaatttgttgcgtggatgtttgggttggtctgagctctgaagcttttgcctttgtttgtttgtttcgtttggtgttgttgtatgcgcggcgaagaaatcggggaagcaatgccatgtctgccagatctgcggcgacggcgtgggcacggcggcggacggcgagctcttcaccgcctgcgacgtctgcgggttcccggtgtgccggccatgctacgagtacgagcgcaaggacggcagccaggcgtgcccgcagtgcaagaccaagtacaagcgccacaagggtataagttgcacattatccattcatccttctcttggatttcacctaaatacttcatctttggttaagaacagctacattggactgaacatctcgtgaacccaatcaggttgttgcatattgcatttagacaataatagtagagaagatatatatatgcttagtgaatatgctgagttaatagcacagagtcctgttctttagtgagctgtattcgaagttggtagtgaccagtgacaacataatttctttcctgtatgggttatttccattgagagaagcaaatgtgagtgaatttgttgagcttaacaagatatttaatctttgcttcagggagcccgccgatacttggggatgaaagcgatgatgttgatgcggatgatgctagtgatgtgaactatccaacatccggcaaccaggaccataagcacaagattgccgagaggatgctcacctggcgcatgaactctgggaggaatgatgatattgtccattctaagtatgatagtggtgagattggtcatcccaagtatgacagtggtgaaatccctcgcatatatatcccatcgctcactcacagccaggtttgttagaatttttgttgatagcgtgaagtcgttaacccttcagggtatgtgcaaagattgaactaatatttagtttcttcctctcgattaattctatagatctcaggtgaaattcctggagcgtcccctgatcatatgatgtctcccgttgggaacattggcagacgtgggcatccatttccctatgtgaaccattcacgtaagtttatctatcatcaagatctcatgtttcgttgcatcgactgggaaaatttaattattctttgttgctcaacagcaaacccatcaagggagttttctggtagccttggcaatgttgcatggaaagagagagtagatggctggaaaatgaaggataaaggtgcaattcccatggctaatggtactagcattgctccttcagaaggtcgtggggttggtgacattgatgcatctactgactataacatggaggacgccttactgtgagttctgatatgcttttgtccaccgttagtcatctatgaattctaccagtaattaatattccttgtatctggtgtactaacttgcactagtttgtacttggaagaacataggaaaaattcttgcataattcgaaatataattattttgtgtttacaagtataccttgctattaagcaaggcaatatgcacatttaatggatcagattctaaatggttgtacatctctgaaccttataatgcggacttatcatatagcttgccactataaatgttgtgctatctgtattacaggaatgatgaaacacgccaacctctatcgagaaaagtgccaatttcgtcatccagaataaatccgtacaggatggttattgtgctccgattgattgtcctatgtatattcttgcactaccgtatcacaaatcctgtgcgtaatgcatacccgctatggttgctctctgtcatatgtgagatttggtttgctctatcctggattctggatcagttccccaagtggtccccaatcaaccgtgaaacttacctggataggctggctttaaggtgatgtacaatatttacctctgatacaccattcctgcgttagcactgtagtactgattactgacaataacaaaatatcacttgcactctcaggtatgaccgggaaggtgaaccatctcaattggctcctgttgacatttttgtcagtactgtggatcctatgaaagaacctcctcttgtcactgccaatactgtgctctccatccttgctgtggattaccctgttgataaggtatcttgctatgtgtctgatgatggagctgcaatgttaacatttgatgcgcttgctgagacttcagaatttgctagaaaatgggtaccgttctgtaaaaagtacagcatagaacccagagctccagagtggtactttgcacagaaaattgattacttgaaagacaaagttcaggcttcttttgttaaagatcgtcgtgccatgaaggtaaatttggtttatatgtgtgtacttttttgttgttttttttttggtgtaatctcgcattaatgtctgttgcaaaaccaaaatccagagggaatatgaagaatttaaagttcgtgttaatgctctcgtcgccaaggcacagaaagttcctgaggaaggatggattatgcaagatggcacaccttggcctggtaacaataccagagaccatcctggaatgattcaggtaaatatcacttagatattgccattgtggtgtggttattgatccagcaattttcttactcttgacgtctggtcatgctcaggttttccttggtcatagtggaggccttgataccgaaggcaatgagcttcctcgtttagtctatgtgtctcgtgagaaacgtcctggattccaacaccataaaaaggctggtgctatgaatgcacttgtgagtagcagctagagtggtgttgcttaagtgagaagtatcttgtttaattcatttacttgatatgtggaatttgaaactgcaggttcgtgtatcagctgtccttactaatggacaatacttgttgaatcttgactgtgatcactacatcaacaatagcaaagctctccgagaggctatgtgcttccttatggatccaaacctaggaaggcgtgtctgttatgtccaattccctcagaggtttgacggtatcgatagaaatgatcgatatgcaaacaggaacaccgtgtttttcgatgtaagcttggttccctttaagattcttggatgcttcacttcacgctttagcaaacatcaataactgttgatggatcagcaatatttatgtttctatgtgatggatttgaacatttctggagtttgtcaagtaacttatctgcatttctgcttgctgcagattaatttgagaggtctcgatggtctccaaggaccagtttatgtgggaaccggttgtgtgttcaacagaacagctctttatggttatgaaccccccattaagcagaagaggccaggttacttctcttcgctttgtgggggacgaaagaagacaaaaaagtcgaaggagaagagcacggaaaagaaaaagtcacacaaacatgtggacagttctgtgccagtttttaatcttgaagatatagaggaagggattgaaggtaccatcgagtctggtttttgttcaattacatgtttttgctcttagatttttagtgatatttggccaccaccattgcattgcaccccacaacttttttcgcagtatttctgtatatgcttaggaagggagggacactaggcttaacttttctcttacactatatatttgacctggcacatcatttttgtggcaggttctggatttgatgatgagaaatcactactgatgtctcaaatgagcttagagaaaagatttggtcaatctagtgtttttgtagcctccactctgatggaatatggtggtgttcctcaatccgcaactccagaatctcttctgaaagaggccatacatgttatcagctgtggctatgaagacaaaagtgactggggaactgaggtaataaagctatggcattcatgctctgcattacatgctactagcctaccagtacaaattatacaatgtaacagaaaatgtcgagatatcaagtggtctttcttgtacaaaattaaggacgcaatttgatttctgttctgattcgcacaagtacttctgagttcatgcgaagaaacttgactaaattggcatctcctctcagttgccattataactttgtttatgatgctatgtgacttgcagattggatggatctatggttctgttacagaagatattctcactggattcaagatgcatgcacgtggctggcggtcaatctactgcatgcctaagcgaccagcattcaaggggtctgccccaattaatctttcggatcgtctgaaccaggtgcttcggtgggctcttggttctgtggaaattctttttagcaggcattgtcccatatggtatgggtacggaggacggcttaagttcctggagagatttgcttacatcaacaccactatttatccactcacatcgattccactcctcttgtactgcatattgccagctatctgtcttctcactgggaagttcatcataccagaggtaaatatgtagaattgtttttcctcttctgcagacgaaatcgcagaacagcatgcgctgactgacttattttggactgcagattagcaactttgcgagtatttggtttatctctctctttctgtcaatctttgctactggtatccttgagatgaggtggagtggtgttggcatcgatgaatggtggaggaatgagcagttttgggttattggaggtatttccgctcatctatttgcggtcttccagggtctgctgaaggtgcttgctggaattgataccagcttcactgtcacctcaaaggcctctgatgaagaaggcgatttcgctgagctctacatgttcaagtggacaacccttctgatcccaccgaccactattttgatcatcaacctggtcggtgttgttgctggtatctcctacgctatcaacagtggctaccagtcatggggtccgctctttgggaagctcttctttgccttctgggtgattgtccacctgtaccccttccttaagggtctcatgggtcggcagaaccgtacaccgaccattgttgttgtttgggccatcctccttgcatcgatcttctccttgctgtgggttcgtatcgatccattcaccacccgtgtcacaggccctgatacccaaaaatgtggtatcaactgctaggagtgagcaagatagtaggcaaagaatcgccagtttgctatccattctgttgtgtaagttattagtggatgactctatatagtctactgtaagatcttagctgccggaatgcttgttatgtattaaggagtagtaagtggtaccttgctgttcatctgttgataattaagttagtagaactactttgctgaaaaatgcctgacggcattctgctgcacttaatgggaatatgaaatcaatgttgctctgtatgaaagaatttacatgtatataacttgaatcaatttaacaaatacactctgtagccttgtaggcacactgcattgcaggttcctggtagaaaccccaatgagtgtatgcacaatgtatgcataaatatgactgattccttctgaatttttttatacacactttatacagtaatgaactttatcaggcccagttcctcctaatttgtgctggtgcatggttgtggaacaactgttccagatttcctccattttgcattctggcaagtacttcctgtggcaccattgtcatccaccatttccaggttgatgtcctgtaaggaaatgtcatagcatgggtagttcttgctgcagttcagagtgatggcactcttggaaattgttgtccctgcgatgttcttgaagaccacattgctaatctccactgctgatccctgagatccatgttcatggcaaatttgcaataattgtgtgatttggatgatttttgttgagcattactcactggtgttaaataaaggattggtttttgagagttgatgtttttgttacctcctgtgtctcgcatttcttagctgagtcgcagtagttttggtcaatgattattgggttcttgacactgttcatgaccatgttctggaatacgatatccttggcgtatccactccctccctgcatttgacaaaatccacatctatctctctcagattcacttgaaatacaaaaggtttgatgaaaatttcgtagtaagttcacacaaatctctgcaggatgagaggaggatatttacctgccatgtcttgatccgagctccattggtggtgccatagaggtgcacggtgtcgatgaagatgtcagacacctcagctctggagttgtcatctcctaagctcccaatgctaatcccatgcccgggcccacacaccagtctcgtgacgtgtaaaccgtgggtcccatcctcgatcgacacacagtcatcccctgcagagatcaacaacaaaaacctaatcagagtcatatccttttgaagattaaaaaaaaacatacccttttgggcttattcaagcttatgggcagggaattattgggccttccaaacaaggcctgatcatgtttctgtgcttaatttggcaattgattactcgctcagtttaatattataaatagtttttacttattttttctagttaattttttttaaatttaatcaaatttattttaaaaaatagtaatattttcaacataaaataaatactccctccctccataaaagttacacatattccacatttgagcttttccaaataagttgcacctatttgtaatctttatgcattcaagacttaaataaataaataaataaaatgtttgattagaatccaaggagacttctaaatactcattggttgcatgcttgcattacttcttgattttgtaacatccaagacaaattaatttcttattagtcttagtgataaaaataataggtataacttttgtggatggagggagtatattacaaaattatgttaaatgctatatttaatgaaactaattttgatggtttagatgctatatttggcaattgagtactaatttttttataaactagtttgactaaaaaaataaaacgatttataatataaaatagagggagtagttgcattacctgtcttaatggtgcagtcgctgacttggacgttcttgctgtgggtgatgtggatgccatctgtgttggggctcgtgccgggcgcagagattgacaggtgggccagctccaccccggtgcaatcctccactgacatgtggatctgctggctgttcaccatcttcagaccattcacgctcaggttgtcgcacgtgtggaaactcagcgcctgtattaattacaaacaaaatgaatcaaattaaaaggtactacaaaaattgagtaaatgaaatttggaaaaagaagagaaaaaaaatattgcatttcgcatgcatgcacgtaccgttggagctcccttgcatggctgaaaagtacagaggaaaaatgaactaggttagagagatccgtggccatcacaattgactaaattataaattgaattgaatatatatttgaatacgaaatgcacgagtagaaagtcaaggaccatgcgacgtgcaaacgaaaatttgaagcagccgccatgcataagtaaaccatcacatcaagaaaaacggcgcctactagaactagttataatttattaattaaccacctatctacgtgctagaaaagccaattcatagcgatttgaacttgaatttaatttcttgatcagtactgtaagtacacttacgagtgccctgttgatcttgcaggagttctcccaccacccctcgccgttgccgtcgatggtgccgccgccgccgacggcgagcccgtcgacgccgcggacgacgatccagtacctcctgttgctctcgttccagttcgacatgtccggcgacgccaccagcgtccccttcacctgcatattatccaaaaatcacgtcagaattacactaatttcagaaagattaatattaatggccgtgttaatcacttaatcagcttcagttccaagctgaattgcagctggatatggaagattaatcaactaatattctgtttgaattttttttaccatgagcttgatggtggattcgcaggggccggagagggtgacttgccggagcaggtagctcctgctctccgggacgagcacgacggccggcgccgccgaggcgcaggcggcgctccacgccctcgccagcgccgccgtgtcgtcgcgctcgccgtcgccgtgcgcgccgtagctgtcgaggctgaaaaccgcgctctgcgtcgtcgccgccgccgccgccgccgcctgcagcagcgacctgccgcctctaccgatcactgcagctccctctccaccaccaccgccatagatgctcggcgagccgccatttctgaccatggcggccgccgccgtggctgcgccgccggacaggagaaaggtcagcgcgagcagggcgcgtacggacgccatgaacgacgacctcacgagctttctcgcaccggacgccatgaattaattccacgcaaaagctcgaattaatcgctctcgatcacttacgctctgctactgtatattatcgatcacgagctagctagttaattagccagaacttgatcactacagatcgagctgtatggttttcaggctttgaattaagctattggattatggtggatcgatcgatcgatggagacgaaggtgcagccatggcgaggtatttatagattcggggtttgcatgggcgattgggcgggaaggatcgagttagcatgcatgcaatgcaagcacacgtagtacgtgcatgttgcgtttgcttccccggaagaagaaagaagcagcagctaattaagagggagatgcatggctgagttagttaattagctcgagccctaattaagtttggtacgtagctagatatgccttcaagcgtgtgtggctgcacacgcatcgtaggtacgtatcatcggtcgccatgcatgcacgcacacacaggacccctggtagaacacaaagattcttcgtgcacatgtcacaaattttgcctgcaattatgaagtgatcgtatagctaggtttaattttccgtggtgaaacctgtctatccggtttgtgtatctatagctatttttattcatacaatggtacaaggggagcagaggtggatccagcgtgggtgctggggggactcgagtccccctaccccgctggatcactaatgatagaaagggagatgaaaggagaacaatatagagaaaataaagagtagggagactgaagaagaaagaaggagatgagtcccaccttaaatattgttctggattcatccctgaagggggagcctccgccgtccgggttaactagcagaaactccatttaattttaatatttttaattgaattgataatgaaatttctatattaaataatggttataaacttataatgaagtttacccgggcttaatatttttctaactccgccatcgaaaaataccgaatgacagtaagatctgttgtggtgatttcaccaatcacaagatatatatatatatatatatatatataatactatgagtgtattaatctgtactctatcctacaaacaaaaaatgtgcctgaaattataatccacattagcggccggtgtcgtacgtcttggttgtatgcatgcagtgtagtacgcacttacctgcatgtgatcactgatcaggtcaactactcgatccatctctcttcctgaccgcgaaaataaaaagaaacaagaaacaagaaagcatttcatgcgtgtgtattactttctcggaagagaaaattaattaacgtcgacgtacgttcatgcgtgcctacgtacgtatcatgcatgtgcgttccatccatggatggcggctcaagctagctaagcgtacacaaaccacgtggttaacaccgacctaattaagctaatctaataattaatgatctagctaatctcttcctgctgcttgcgtcgattaatcactcgctttttccaacacacggaaaaagtgaaattaattagtagtcggaagatgattgatcgatcgatcgatatgacctagctagcggctggctggtgaatggtgatgacctgagatagagaggaccgagagaggctgacatgtgggcccggaatcccttttttaaggacaaaaggggacattccctgctttggttcgaagcaaaaacatcatagattggtcactttgtccctcaactaatcatagatcgcgatgtcaaaacgaaaccatcaaactgatcgagacacgtggcacacgtcaactgtcaattgacgcaatgcactgttaatgattggtgattataatttagttggttagttagttaaattaattaattcgtggacgacttctttgggttatctcgagtactatacgtacgtacgtctcgatcgttttgggtttgtaaatttgtcacagggaatttgacgagaaatatatttcataaaggactttaattaattaattagttactgcaaccactgaattgattatatatgtatatgtttcgcctaactagcaattaatcacacacgagaaattccacgtagcaatcattagtttttgttgcgaacggacgaaatcattaactttgtgatcgccaaacaagcaactcaagtaaacgccccccggatgcataaatatatgtatttccttcgaatttcaaatcaaaacgtgcgccgaaatatatacatacgaatccatgtatcgtaattacgtgttcgctcttgatccacaggtacaatgatacaacagtacaaaagagagatttaggggctttatagctagatttgtcaggattcatgaatgtcgtctactttcttttttaattaatacaaaaaacagcgtgcacgataagatttgtttgatttttgcgtagttagattagggtcacacacacgcaatcaattaattaattaagcacgaatcttagggcggaaacgtgtggacagatcgatcgattaggcatgatctgctcagctcaggcgtgatcggtgatctgactgcatgtgcgtaccatgctgccgctgacgtcatggctctcacgttttcaccttttcgcgtgcgattttgctatatctcactcgaaagattttatgtggcaagcgaactgggccggaacgtcaatgcgacagacgcgctgggcccacattttatgggccggaacaggactgtgagcagcgtgtggcccttatcaaggggaataag

SEQ ID NO: 10941 - DNA, 6268 bp, Oryza sativa
  unsure (1)..(6268): unsure at all n locations
nnnnnnnnnnnnnnnnnnnnnnnnnnnnnnnnnnnnnnnnnnnnnnnnnnnnnnntcatggattagatttcgatcacagttaagggtcacgaagtgaacttattccttatcaagctgcatgcggcctatactggttgggcctctgggccggatcggtacatcgagctccctgagatcagttactaactctgtttttaaatatacgataccgtttgtttttttataaacatttgaacattttcttaaaaaaacatttgaatatttattttattcaaactttttatatatataaaaataaattcatttttaaaaacaattgaatataaatcaaatcacaataaaatgagtgataattataattttttttcaataagactaatcatacatatcttgcacaacgttgtatattaaaaaacggagggaataatattttacgtagaaacgggaatgtgagcaccgtcatgtatgactaagaaacaatcaaattttacacgccatgaatgtgtcatattccaacatatcaaggggatcctttcgaacaaacgaaaaaagagaggaatttatacaattgaaatcctatgcaaaatttttccaggtgttcctttgaaataatggaatgcgcacttgagattgctacaaaatttctaacatgaggttgtacctcatgggaagctttcgtcgggtctatctctcacccaaaatcctatactttctctatgaagcatccaaacaaaaaaatcacatagttcctacattttaaaattcctaagcatcaacttagatatgccacctcgattaattcctacgtttttttaatgtttgtgttttttattcctgcgtttgaaaagagctctgcttttcttcagtgtagtttattatgaaatttgtgtcgcgcgatcaacagataaaatgagaaaataacaacagacatgccagcagatgacgtgcttgtgttgtaaactttaccagatcctctctagaaccaacagcaagagttgtaactcatgaaataaactgtgtcgacgaacttgacccaaattacaagtattagttgctacgttgtacttgtacactgtcgatgaaatggaccaaacagtttgcagcttcttcacttcactcaccaaatgaccaaactaaaccacacgctatcagctagatcttaatctatacttaaccctgaatgcatcttgaatttgtacccattacactggcttggtacattaattgtacacttaatatacatacatatacatcggactcgatcgagcaggaataatttagaatgctctacctaacgagctaaagtttaattaagttgagcaactcaaaaagaagtgtatgcgtcaggcagacagatcaggcattatttttcagccaatcttctcagtgttggtgtcgtctgttggccagatgaccgtctccatgagccgctctcgcatcaacgccaggttctcgtcagatatcctctcgtacatcatcgcatggtcacatttctgaaagatcaaaaccagaatctcatttggttacaaacttcagagctttgtgatggattatctaagagtaccaaaaaggaatcaccttgatccatttgctgtacaagtgaagcctagttatcatcactcgctctgcaagctcctgcttctcctataaaccaaaatgaacattcatgcgtgtgcaatttttctttagttttcagtttacatttgtatcgttcgaaagtttaaacaactgtggagtagtttatatatttacctttccaagagcacgaaggaacactttgccatcggtaggcttgtttacagcaacgaagctgaaaccaatgagaagcaagaacacaaattcagtaatctgacagggattttgctgattgatttgtggaataaatgggtggcttacttgtataaccatcggtagcttggtgggttcatttcgtagagctgcgtgagcacggtcttgacggctttgtaggtgaacacattaatcagttgctgcgcaaacaagaatgaacaaaaaaccaaatcaatcgatctcctctactcatcccaaccatgaaaatctcatcaaaatcacagcattttatatatcagcagtagaacttcaactctttacgttaggatctgctaacatggattaattaattagattcggcatgtggggaatgattataagccgcaacgcttaatagcgaaaggaataatttttcgataaaactttgttatatacacatatattctttacgacttaaaaaaaaattcaaaatcaactttaagattaaaactaaaattttaaattttagctacgtctgataagttaattaccacgtggatgtcctcgaaaccttcatcgtaggtgccaccgaggttgcagacgacggcgaggccctgctgctgctgctgctgcctcctgcccctgaccctggccgtgcacgccgcccggcgaggccgccgcctccagtctccggcgaacaagctgctcacgccgcggcccctcctctgccccgccgccctgcagctcccttccgccgtcgccaccgcccccaccgccggcatcacctgcaccccggccatcctcaccctgccactctcttcttctccaacgcagcagcagcagcagcagctaagatagtttcgtgatcgagcttggtgtatatagcaaccaagtggcagaagaagaagaagaagcagcaagaagaagaagaggaagaggtgttgaattgtagtttggcctcggcttctcgccgcttcgtcgtcgtggctggccagtggccgggatgcaactctgaccaaccaaattttgtgaggctcaggaggcagctacagcctacacagctcgtcgtcgtcgcggtattttcagcggaatgctggacacgcggcggcgagcgattgggcgcggggaagattccaaagggcgattcggcactgccgggccccacgtgtcatggacggagagaaaccggtcgcgtttccggcaggttcggtgaacctgaagcacaaagttggaacggcgacgttcgccacggcaagcaaaaagcaagaggatgagcgttttcttgcaggaacaggaaccgatttctggcaacttcttgtgtggtgcgatcgctgcacacgactacgagcacgagcacgagcaatgaatgatcatatatacttacagctatacaggacaattagcacattgtctaaacacgttgcgtcctcgtcatcaacagcataagcaaatgaaaactctgattttcgaattttgggggtaagagaaaacgatatcccagtattccgttcatactggtcgcagcagcacgagccagagcgatgaaccgatgaaagtgaaaccaccacaaattcagaaacggcagcagcaaattcagagacggcagcacagcaaattcagagacggcagcatgattaccaacttcaggtcggagcaaaagttaaaatgatgcaacaggaagaaaaacatcaccgcactgaacttaagtggtggtggtagtagtatatggctgtatatcaaaacagccagatcatgatcagaaaattgaaaacaaaatggaaaattaaggatgctctaaaacaaaatgatcaaggctataaagccatatactgaccatgatctataaccgaacacaacgaccctgcacccagtcatcttcagatactttcaggacaaaatggatcgataacataataattatgcagcattcattgataaaagcagtatcacagtaccatgatccaaaacttgacaggaaatagaaacatccagacgcagcacaatccaaggatgacaaccggttcttaactattgtaaaacaaagtgcatcagacaagtccgagctagcaaagactctctttactccgccatcctaagcctctacgttctcgacaggtgcatcaatcataagagccttagtcggcttggccaagaggtcggtgtactcctggaatggagacttgacgaacttggtgtccctccagaagtcaggagtaaggaatccataagtcttcatcaggcagtcaaaggtggcctgcacaaaacagatcatttggttttaatagaggataaacttaccactaagaatacatcaatcaagcaaggcaaactaataagaaggcctcaagccatcacagagtatatataacacaatcaaaccaaagtaaaaacgactgggtgtagaagacatgaaaacatattacatattagatattaacactccctgtttgagtaggacttgatggcatcaatgtgcaaacagggcatacgaaatgtttaaagaaaagtttctattagatgatacaatgtgctgtgtgtataggcacgatatcaagcagacaggatacactaataagcactgtggcataaggtaatgaccaatgcacaaaaagattaaagatcaaacaattacagcagcagcgtaagtgtcaataatcaaatagacccatgaaatggttcattgacagcagacaatagtaaatccatactgatgggcagtaagcctgtaacaaagtaaaatattttgaacccaaccagtttaactgtatcgaattagatgagtagaatactatgaatcaccttcaaagatgcatgtgtatgtacactaagaacagtagtctcattgaacaattgatgctaatatacaaactgtgatatagtgagaaactatagcataatgcagttatattccacccaattcacatcagaaatcaacaatactatgcctacttgccaagcacacataaatctatcattcagtaccaaacactaaatactcatagtcagagaatagtatataaaataacaaaaggagggatgtgttataccttgacgaagttgccaagggtcttggtggatccacgggacgaggtgaagacatcctcaatgccggcgaactgcagcaccttcttgggcacgcgggcggcgacaatacccgaacccctcggggcgggcaccatgcgcacggtgacagagccacactttccggtgaccttgcacggcacggtgtgcggctgcccgatcttgttaccccagtaacccctcctgacgggcaccacggacagcttggccaggatgatggcgccgcggatggcggtggccacctccttggcgcacttgacccccagcccgacgtggccgttgttgtcgccgacgacgacgaacgccttgaaccgggtgcgctgcccggcgcgcgtctgtttctgcacgggtgtgatcttcatcacctcgtccttgagccccggcacgagggtctccacgatctggtgctccttgacggggagggagtggaggtagatctcctcgatcttggagaacctgccttccttcacgaggcggccgagcttggtgacgggcacccacttctcctcctcctggcgcgggccgcggcgcccgccacggcgccttctgcggtcgccgcgaccgccgcgccctaagccgcggccgaacccgccgcgctcgccgccacgctcgccgccgcgctccgccatggctggcttgagagggtgtggattagggttctctgggggtgggggagtggaggcggctgctgcggcggcgcgaagagtgggagaacgagattggagaagggtatttatacgggagggttagcgcagctagggttttgaggtgaggatgcggcgggccaagtgggctgggcctcttcggcccaatatgtagctatttgagttgtttcaggcccatcaagtgcatgggccatggaattggggacgaatggcctttacctagcctgtaagcccattccgaattgccttcgcctagcggcttcctccaccgcgggatcattgggcctgttcggtagtttgtttttgcagctgttatggctgcactggatagtccagttgttcagctgtctatcaagaatgcatctcagccagctcttccgaacaggcccattaccatttgctgagcttgacaagtagcagcagcgtggctccgcttccactcgtgcggatccccactccctagggggtcggcagctctacttgccttccccggcctggccgagccatcctcctcctccttgttgtcgtcaatgtgcaccgctcatctctccgtcggacaccgtccttctcgccaccagctcctctcctatcggccaccgcccttctcctcgtcatccgctgtgccgtcattcctgtcggccattaccctacaggggattggaaagacaagggagggaggagagagaaaatgttagccacttatatggaggggtagtatgggtcccacgttgattcagcttgtcctgtcaactaaa

SEQ ID NO: 10942 - DNA, 3150 bp, Oryza sativa
  unsure (1)..(3150): unsure at all n locations
nnnnnnnnnnnnnnnnnnnnnnnnnnnnnnnnnnnnnnnnnnnnnnnnnnnnnnncctgtcggccattaccctacaggggattggaaagacaagggagggaggagagagaaaatgttagccacttatatggaggggtagtatgggtcccacgttgattcagcttgtcctgtcaactaaaataggatttcgaataatccaaatttgtaaaatgaggaagcccgttatatatagtatttcaatttagggatgaatttcaaactcgaccatgctagtgatccatctttggtgggccaaatggaggcccaaacctgatcggttgggctttaccttaggctgccgatggaagccttgcttctagcgttgggcttgctaataatacagcgtccggcgttcaatgccaacgagccctgatcccgttcctcacctcaccggcggcggcgaaacgcctccgactccgagcaattccacttcgtcggccggcggccggccgattacccacgcccgtttcagcagcgcagcgaccagaccatgtgcagcatcagcaacgacgccaacagcttcgacctcatcgatggtttcctataataaccttttttgccgacgcttgtgtccgcagaatcatggcttctctgttcgagcgtcgccgagatctcggaggagcccatgttccacacgccggaaaacaccagtgaaaccaactgtaatggtggccaatccggttgataacatcatcaacgatcgatagcgacattacaggcaacaataaccatgacacaatgtttagctagatcacacgaaagttcaatgtccaaaacccaaatcaccaatgcagagttttacagacacgacgtctaagtagagcaattagcaaaccatgatccgaaaggagagctctgaatcgtagggggatcatcacgccttcaatggctggaccttgacctgatccagcacggggccgcacagcgagacgccgtcgctcaccttggtgtggtagtacgagctgtagaaggtcaccctggtgcgcacgccggcggcgacgaaccggaagctcgccggcttgaacccgccgtttccgacggactcgaacggcaccttctgcgtcacgttcccggcgaacgcctccaccagcatcgacccgtggcagccgttcttggcgtcgccgacgacgaacgataggttgtaggcgcggttcgccaccgtgcggatcacctgcgcgatggcgctctccctgccggcgacgagctccacggcgtactgccccgccgggacggagaagtgcgccgcgtcgatgaagcggacggccttgagcgactcgatgatccagcccgggagcggcgacgtcgcgttcttctgcttcggcggaaggaggacgcccaccgtcgagttcttgaacacctgcggcccgatctcgaatccctcgttcttgatcaggttgtctgcagccatttgttcgtcagattaattaccagcagcaatccatcgttcagacaatgatgcggtctctcttacctttggttgggtatggcgttgggagctccttgatggcgacggcgtcgagcagggggccgcacgacgcgtcctcctggacgccggggttggaaaaggtgacctgcgcggcggcggaggaggcgcggaagccccacgcccaggtgtcggcggtgtcggcgctgtagagcgtgcggacggcgacgtcggcgggcggcgagagcgacggcgcgacggcgacgcggagcgcctcgtcctgggcgcacgtgcgcgtggcggcgaaggtgagcgcgtagagcgcgccggggcgcacggacacgttctgggacgccgacgcgcggccgcccaggcggagagcgtgcacgccgtgcggcaccgcgaagaacatgccgccgggctgcggcccgccggagacgtactcgacgtgcccccgcagcgtccaccccggcagcgagtggcggccgacgatgagtgtcttgttcaccttcctcggcgccgtctcgaagttgccattgatgaggaggcctgggtcaccattaaaaaaatatatcaaaattcacttgtttgcttcaaatgtctacatgattgttgctttctttaggattcaacagctaaatatagcgctgaagactcttaaccaaaatcttgcaaaatgcaaatgcattacagatttacagtaccacaccattctggggaaatggattgagcaacaacaaaaagtcacaaaaccgatggataaaagtgagatgaatataagtgatgcacaagacacgaaaatgcagtgtgccagacacattcttgggctcttgccaagaacatttccacaggtcgaggtagtaatgtgcttgcatgaatgtgatactgaacttgaaacaaaaatgcagaaatgaaactgtaataactgaatctttctttgcttaaaagaaaactgaatctttcttcttagaacatttacatctgcaagaaaatgggatccaagaaaaaaccaagaagatgtgacagagaagagaacacagtgagctgagacctgagagaagaaccataccttcagcatctttaggttgaggaggtgcatgggcaggggcaggagctggaactggaactggaactggagctttgacggcgagtgtggcaccggcggaggaggcggcggcggcgacggcgagcagcaccagcagcagggcaccccgaggaagctccattggtaagctcactctccagcctccactgagttcagctctctttcgctttcactttggctgcttctcgctgacgctgagagttacaaggaagcaagcagccttctattttttttcctcctttattaccaaaaggagtgggaaattgcatacagaacctcccacgctgtcggaattacacatcagagactcattggatagatataattaatctctaaataaatcgtgaatcaatatttagttgggactttttgcaggcttgatgactgcactgtgagaaacaaaaacaaaactaagaaggattactaatagtgaaaaccgttcactctagggctagtgtgtgaatctcacatttacaagaagggttaagattgttgcattattatatctgactgtcccttctgatgcgaatgaatgtatggggggggggggggtgcccaccgtcattggtcccccattttgtgg

SEQ ID NO: 10943 - DNA, 3032 bp, Oryza sativa
  unsure (1)..(3032): unsure at all n locations
nnnnnnnnnnnnnnnnnnnnnnnnnnnnnnnnnnnnnnnnnnnnnnnnnnnnnnnnnnnnnnnnntaagaaggattactaatagtgaaaaccgttcactctagggctagtgtgtgaatctcacatttacaagaagggttaagattgttgcattattatatctgactgtcccttctgatgcgaatgaatgtatggggggggggggggtgcccacggtcatggttcccgcgttttgtggtgtagttcccgcgcaatgttactgacgcgctctgcaaactagtacagacttgcataggacatgtactgatttactcctatgtgagtactgagtactatatactactactgctagagtgttagatccaccctaatgaatgactgaaactgtgaaattaacatgctaccgcaagcactactccatcatgcattagcactgttactactctactctactgtgttacatttacagaaggcaacagaggctaccagcagatgtatagtactagcagtaacaaaatatcacctagtacgatttttcatctagcagatgtatttcagtctctgttttctcactgggtcgaggagaaatttgcttgatgcagccctttgtacacttgcacgaagaggagcttctggagaaggcacagacatatcacatggccacatttgttaattagtagtactacactgtacccaggcaaagatacgtgcagtatactagcatcatctacgtatagtacgtgtacaccaagggaagggagacgagagcatccaaagctagaggagccggacgacacagatgttcttttctaccaaaaaaattgaatggtattagtatataattaattaagttttaatcattataaatataaaagtagatttgtttcatataacttatatacagaaagtttcgcagaagatggaccgtttaacattaaaatatgtgctagcacaaatcaacatatatatatatatatatatatatatatatatatatatatatataaacctatatatatataacctatacttttttcgtcacaataaaaaaacaaacatagtattatctcttttccaaaatttagtgttccttccgatttatgttataagtggtttttacccttttaaagtcaaacttctaaaaagtttgagggaatttatgaaaaatatagtaatatttatagcaccaaatcagtttcattacatcaaacattgaatatattttagtatcttttttgttttgtgttaaaaatattattatatatttttataaatttgatcaaaactaaaatgtttgacttagaaaaaaataaaaataacttataatatgaaacggatgaataaataatttaggattggattaaacacatcactgccaatctagatagacagagtatctatccagagtaattactataaaacgttagattgctgtattccggtgacggaaggagcagccggagggagaggggcgacagtggcggccactgcagcactgggcccggatgataaaagccggttcggcgcatgtcatcggctgggatggggaagaaggccgcgggaacagtggccgcggccggtggtctcctcgtcgtcgtcgtcctcgccattgagccccgcaccctgcacgccctgctgctgcctgctgccgacgcacgcggcccggcgcatgcatggcccccgtcatggcgaccacgcagctgtgccatgtgggcccctccccctgcacattaagggtctgtttggttcaatgcttcaacttgccacaccacactttaggctgccacatctccacacttgtctaacattgtctaaagtgagttatgacaatgttagttaagaaccaaacagcctctaactttgctctacccaactcaacgcgccattgcattttgcaccgcagcgaatcagcgattgccgttgtcccggggatggatggatggacggacggacggacggccaggatgtgctttgcacttgcaacagaggagccgcgctgctgctgcatgctgatagtttaaaatttaaaataaactcggtccaaatttatttccaaatctaatctttttgttcaagcaagtccagattagcgggcctgctgcgcgcagagccggcccattgcgaaattcagggcttatgttagcccaagtgctcaacactctcccagttgttcagtttacagctcgcggtacgtgtatttatcatggaaagcgtatggccgcagtccaaaacgcactggttcgtgtacgtgcatccgatatgtgttaattgtacgtacgtatgcctccgtctaggtacgtactgtagatgaacaatatgcattgattaatacgtatgtgctgactaagatatatgcatgtcaacaatgaccatactgatccattttgtaaactgaacaaccacttctgtttaattagaccggatggttacgtgatcgtttatggctagatcagaagatcaagtattaatcccgtgatgttgtgtttgaactgaagattataggggttttggtttactccctcactttgacaaacgttgccacactttctaggatttttacttgtttcactttcaaagttgcggcattgacaaagtttttctattcaaagacccacatgtcatacacctatcttttatgtcatacaatcatcttttagccaaatcttgtctaagatgtgccatcaatttataagccacacatttggttaggtttggcgatatttggaagtgaatcaaacaacccattttttccactatggtttgaaggttatatcgatgtcgttctaggtggtgtcgagacggggtgtggcaacacgtcatcaccattgcaggaccagacatgccatgccatgagccgactcatcgtgtgggttgtaccggcacagcccggcccggtccatttgtccagtttcctctcccaaactcccctattttttccattgtttttcttttttttttcttattttccttttttaagcaatagaaggagataattaagcaatgtattgattattttcgtcacgacgacacatg

SEQ ID NO: 10944 - DNA, 42393 bp, Oryza sativa
  unsure (1)..(42393): unsure at all n locations
tttattaattgaaccaaatttatttggacaggaatattttagatactctagccacgcatgagttaagagtgttgaattttactgaaacacggcaccgtgcatttaaatatgcctttaaaacaatattcttaagttaacgttatgtatatactactccctcgtatatactattccctctgtcctaagatataagaaactttagttggataagacacatatccaacctgtctagatttctcgtattaaaatatgtcatatccaactaaactttttatattttataggacggatggagtattggttaggaaactctagatgctgttaagataacattaaactgaatttttatatttctatcttattttatgtttccacgtgctttgctctcctactaatatactccaatactccatactactcaaacgaagagctcagatcggttgaccttgctgttattaatgatttttcattttttgctgttcaatttcataagcacgcgcactttgcgtgtcataggctcatagctgattacttcatggactatgtcggtgcttaagctaaagttgattttgaaattttaaattttaaatttagattattttaatttaggaggttttccattattttattttcagaaatatgtcacgagttattttatattaagatttgaagagagatttaccgtgcaagctacaaaacgacgaaggcatgttcggctgctggagctacgggcacgaacaataccgcactcattatacgcagtcgcagccgaagccattgtagccggcctgcctaataggcccatagtttagcaagggttatatatccatgacatgccttgtgggaccaaattcggcctaagctcagctgatggcaagaggctggtctctcgccatagtgtcgcctccgttaggacggagctcctgacaggtggggtttatctttataggtccacatgtcagtgaccatatccctctaactttacacgagtggagcctcttctcgcctcatccgttgtagaagtagctatgactacttccctctaaatctgggtttgttgattaaacaaacgattgttgtgcttcttttagattgtcaagcaaatatcgtttccattattttatcgactagctttgtaatggataaaccttccattgtatatatctttagaaaatacgcactgattgatttggattgaaacgagaggcgtatccttatgatgacggtacttagatataaaaataaattttttaagataacgtaactaaggattgcttggaagttttctttttataaaaaatatttgtggcttacaagccgaagacacatgtacaaagcaataaaaaaaactttagaatatgactttttatatttatactgcataaatttcacacaaaccctaagttttaggccatgtgtaacacaaaatcctaggtattatgattagctcaaaaaccctatattttgagacagaatatttcaagaaaccttatatttattaaaatactcatttatattattatacatggtattttttacattatatatactcacatataagtaggctcaaaatgcacattcataccacatagttttatcttcttcctcattctcacagagcaagattgcaaaattgttacatataaaaacaagtattgataactcacacatgttgacaatgtcactattgtataactcacgtaagttaatctctcagtactttctaaagaactataaaaagcatattataatttaatagaaatctgtctagatttattatactaggttatgtctgctatcattttatgttagggttttctcggacggccggagtttatgtcaggtagcaactagtaataaatagtagtacacactatcccgtaagtgtatgtgtccatctctaggtatggtcgatgagcggtgcatcattcatcggctgccgacacatctatccatgcaatgcaatgtcaacaacgaccatgaatgctgatccattttataaactgatcgagtcgcttctgttttacacgggtacgccgtgtaaaacaaatactccctccttccctaaatgtttgacaccattgatttttttaaacatgtttgaccgttcgtcttattcaaaaacttttgtaatatgtgtaaaactatatgtatacataaaaatatatttaacaataaatcaaatgatagaaaaagaattaacaattacttaaattttttgaataagacgaacggtcaaatatttttaaaaaagtcaacgacgtcaaacattttgggatggaggtagtactattttagatgctcatgggaaccacgcatctatatatacccgtacatacgctcctgaaaatgctcaaagggcaaccatatataataccttcatcttcaattcctcctgttccaggtattgttctcacctctcttagtcttatgtataacatatatactacgtgtgatgtttagaaactctatgcttttcttacatactagcaaattactcatgccatgtcatgggaaacgaattaagaccgctttgccgtgtttttttaggcaccgttttggttttgtttcctaattttttgtttttttttctaattggctagttttttgagaaaccgttcgttcttttctggaggggacgagggtaggatctgtttctaccactgaattttttgcagacatgtgggaagaacggtgcggagaggaggatgactcctcttttattgtagtagagatattagaaaaaggaatcagtaaatcagctttgattaagttaagacaacttgagttgatatgtatgcttagctttgattagtgtttagcatgcgatatcttgtgcagatcaacacacccacacacatctcaattttctctcagaaggtgtatatatatttgcagctgttgtctaatcgatctgcagactgaactgaagtataatgtcgaagacgagtgccctggatcttgcttcaggattaggagggaagatcagaaaggagcaagtcaaatcggccgtggatcagtactgcacatactttatttacccttctaatacgttaattaattatgcttgaattttatagtgatatagtaacaattaataaatttgagttaagtgcacttacggggcctacaggagattagggggggagagaagaaaatatgttttttttttaattttattatttttatatgaatgacatgtaggctccattaacacgtatgcgtcaacatggcatgtcatatcagtgcacgtagcaggttagactgttagaactcgtttgaatctggatacacctatgataaatttaggaacctatataacatatccatttaagtttagacagaccactggtgtacttcactctaacaggttttgaccaactcgccagtcgtttctcgcttcgtttatgctgcccctttgttcaacaatcacacactaaaatgttcaggtgttccatcgtgtcaggtatgagaattatcatgaaatttatggaggtgaagtggaatcaaggacatccaactacgctgatttggtacctttttagctggagtagttgtttttcataataatttgcatatagctcatgtgaaatcgatcaattgaattagcaacgagaattttggaggttataaccaaactaattagtgccaaatttaatgcatcaggcaaacaagtattatgatcttgtcaccagtttctacgaatacggctggggagaatcattccatttcggcagcaggtcatgccataattttgccacgccataattttgccactaattaagtttgtttggatgggctttaggttattctgattttgtttttcttcgctgattatctttcagatggcaaggagaaactttacgcgaaagccttaagcgtcatgagcattttctggccttgcaactcggcctcaagaagggcatgaaggtcaatgttatactactattaattacagttcaagaaaagagaataatctattaactataaatgtgattgtttctaatcttcatagtggagtcatttttccctgtgcatatattgcaggtcctagacgtggggtgtggcattggaggacccttgagagagattgccagattcaggtgacaatttcctgttgccaatttcacaaattcagagataaaaatcaagcgaactataattattccaatgctactaattatagctcagcatcggtgactggactgaacaacaatgcgtaccagatatcaaggggcaaggtaacgagttctgcattttatttaaccatgtgcatttcttttacagagttagatgtgaattatttgaaatatgttatgcatatattatcaagatgaagacatggatttttcaccatgagctagatcaacacttaaaagttaatttgatcttcattgtgcaggaactcaacttttctgtcggtttgagtgaaacctgcaactttgtcaaggtagagacatatatacatgccctccaatcaccaattcagttttaggtgacaaaagcaagaattgtcatgcaggctgacttcatgaacatgcctatccctgatgccaccttcgacgcagcctacgccatcgaggcgacatgccatgcccctgatgctgtatgcttagctcatttattttcctgtatcatatcactactcatttcgttccaaaaaaaaataaatctaaaaagggatacgatccctcatagtacaagtaacatggacagaattttgtttaagttcgttatacggatcacatctcccgcctaagtttagtattttttaggatagagaaagtatataggtaagtactattacttccgttctaaaatataactatctagataagtctaaaatatacgatattaggttgctatattttggaactgaggtactaggttggtaacatgaaaacttattatcttggtgaattaacttgtacatgtaggttggtgtctacagggagatctgccgagtgctgaaaccagggcagttgttcgcgttggacgagtggtgcatgaccgacaagtatgatccaggcaactcgaggcaccggagcatcaaggccgagatcgagctcggcaatggccttccagacatcagaaccaccaaacagtgcatccaggctctcaaagacgcgggctttgaggtgagctctactccaaatactacacatcacaacattaaaaataggagaaactcttttaatttcttgagggaagagatatctccttgtttgttcgaacaacattcaaataatcataaaaaaaatctaaaaaaatggactaacatttgtacaacatgtaactgtgatcgtttagggctagatcttaaatgagacctgaaaagagacgtccctccaaacatttatcttaaatgagatctgaagagagacgtccctccaaacatttattagtgtgagcgtattgaggattgaacacggaaccttagggttgacaccacacatccgttgtcactgcactatcaagtgcatctctttatagctagatcatcaaagatcaagatttatctttgtgatgatgtgtttgaaggttgtatcggtgaaggatctggcagaggattcgccgttgccatggtacctgcctcttgattccagccagttctcactcaatggcttccgtctcacccgtgtcggccgcttcatcactcacatgctggttcgtaacattttactgatataccatgtactccaatctagatttgtagtattatttgtgtcgaattcagttataagttactactacattttaagacggagcgagtacggaagtaaatgaattgttggtagagtgcaattgacgtcttaatttaccttcaaaaatcttcaggtaaagacgctcgagtgcctccatgttgccccacagggcagcctgagggtctccagctttcttgagaccgcggccgaagggcttgtgaagggcgccaagtaagttgatcggcctcgagcaaatctgaagcaagaaaattttgaatttgtgccgaatttatatcaatctccgaaacagtaatgctgctgaatgaatgctgcatctttttttaaacaacgctgcttaatgaagtgtgattttcatttccagggaagggatcttcacgcccattttcttcgtcttggctcggaaacctctggacaagcagccagagatctgaagaacagagcaaggtgtggtaattatcatcttcataagtgtgcaataaaaagaacaactgtttgatcagtgtgtacttctctgaacccagcgagatgtggtgttttatttggtcaattcgtgtcataaaaaagtagtaagtttgttcagtgtgtacgtaacagtttcgtctgggtatgaattcagtatttgtttttcagtcttatctttcttctctccagatagtctgcaagttcaacttcaacaacagatgggagtgtttgaatcaacactattttaccaaacgatcgagtagtaaaatgcttcaaagaccactagtctgagtacaaaatgtgtccatggttacatcgaagtcaaaaaaacaacaacaacaaaaaaaaaaaaacggttataaacccgcgggaaaacagtagagtgtctgaacacaatccacatatatctgaaatcgatcaagaaatcaaaaatcaacacaaaccacggtgaaagaatcgacaggagatagatgcatcgatcatggcgagagagagagaatcatcaaccggagatagatgcatcgatcaatgcatacgaacactggatcatatatcgaaattgattctactgtagcatcgccgtggcggcgaccagcgccaacgccacggcagcgaaggccgccttagcgccgccgccgccggcggcggcgctggcgttgggcgccggagcggtggtcgtggaggaggacgagctgtccgtggtgggggaggaggactccggcggcgacgacgagacggcgggggacggcgcggcggcggcgccgcgcttggaggcggcgggcgccggggaaggggcgtcagaggaggaggagcgctgtggcttgaggacgcggatgttgaccttctggccggcggcgcagtggccggggacgccgcagatgaagaagcggtggccggcggccttgatggcgatcttgtcgtcgccggaggtgtgcgtggcgatcggcgacgagttggtgcagctgtcgtagtccgccttcttcacctccaccacgttgtgaatcccctgcgggtacttgaactctgcccaaaataataaaattaaattaaaccattttttagaaaaaaaaaagctcccatcggatggcctaataagctaaagaaaaagccaaattttaaattttcaaacttaattttgatattgattttgagatattttcaacatagtttcttttttagcattggcttttaagtcaccaaaaacacatatataaaaattttacctataaatttattttattttctaataaaccgttttggcttattaggggaaaaactaaatgatggggcctaaaatttggcaccatgatcaactcgatgtagatttgctcgaaaagtacttccataatgccggatcgttaatggttactccctccgtttgatattataagttgtttgattttttcttcgtcaaagttcttaaggtttgactaaacttatcggaatatatagtaatatatcgaccacaccaaattagtttaatccaatttaacattaaatatgttttgataatatatttgttttgtattgaaaatgttattatatttttctataaatttggttaaatctaaagaagtttaaatgaaaaaaagtcaaacgaattataatatgaagcggagggagtagaattttataggtttataagaattttgtcctaaactataagcttttataaccggaggaagtactcaatttggtgccaaatcgatgtagatttgctcgaaatactgtcacaatatcgaaacctattagattttataaactcgttctaatataaaattagtagttgagattttaaaagtttgattgaaccttgtccttaacgtcaaatatatgtaaaccggaggaagtgctccatttgacgccatgatcatcacaagtccacaaggacagacgtagtgcaaattttatcttttttcaaacaagatatatcttttgaaattttcatcatcttttggtaccaaattgatcacgcgaaggcggcaggaagagaagtgtgaggaacgaaactaaaaacgtgcaacataaggtactgtatctacctgtcaaaaggattcatacaaagcacctctttttacaccaagagcaagttgtgaacaaagcatgcatttggatgcttctatactactcataggaaaaaagtgtcaaaagtgattagctttacaactaatcagtagttgacaaatagcatactgtcagatgaatagtatattgataagtagattgagctactggccatttgatacataagtataatttatctcctagagttttggatcaaaatttctatggcaactgaaataactacctcaataaaactaaaaaatttcagccggcattgttggatcatgtacaggacatccaggtacacgcaagttcaggatctgcaagatcctgtagccaatgtccaatgagcacaataaatgaaacagccacatatgccatggcctagtaattgtgctcaccaacactaccatttctgaggctttctgaatagcagttcagatggtccatgagaaaaatttatggatcatgctagttctatgcaaaggtagcagcacacggcgcaatattcgtgaaacgccttcaagactagaagtgtgaactgtgaagtgcaagaaagttgagataaattggccttctttttttaacccaaatttcgctgtcaatggcgtggttaaagtgagactcttcatctaaacgcaagacaaaagaggtaaggtgggttgtaaagtacaccggtgagggtgactgttcattaacattccatctctttgcagcagtaagctagcttgggtgaaggaaagaatggacaattactgcttaacatattaatagtccaattttattaattttctcgaacaatgctggcttattcacacatttcaccaacgaaaagaaaatcactgaaatacaaatgctaaactagctagaaactacttgtagtaagctgtagcgaatatatgcaatgaacaaaaggccgaagttactagcactggatctagcactgaaaaatttacacgatcaaaattaactagccttggcactgagcaaacattctacttctacatatacaaagcaaacaaaggttcattattcagatatttcaatgtgtataatccattaagaaccacagattgcatgtatttcaaatgtgtattgacacgcaagccttttgcatgttcgcgaaaaaaaaaaagataaaaactgcttgggaagaactgaaaattagagtgagaaatgagagagcttgcctatggtgtccccaacatggaaggtcttcttgacagcccagtcagtgtaattgacattgccgaggatggtccagccggaggtgtcgccgaccttgtagaccgccgccgacgatgtcgccgccattgcgagcccgagcatcagcaccagcacactgttcatggccattgccattgccgtgctacctagactgtgtggatggaggagatgaacagaggaggaggaagagatgctaagagcagagaagacgaaaagaatttagtactataaccttgcttgattgcttccaacaatgttatgccaatgaggaggattttatagtgccattgctcactttcagaactgaccattttgcccctgtacatttcctgtctgaaactggtatagctaaagtagatgagctatgtattatttttcatcttcttggatgatctatctattggtccttgagtaaagcaaacttaaaagctggccgtgtatccaagtcttgatcatgaggctggctgttcgatgaatggttaggtcagtgcagtgctcttcgccatgagtgagtggactctgctggtacgagatctcacatagactctcatagactcatacttgtttggagatctctttctttttgtcgaagcaaccaattgccaaacatgtgtgtatgtatgcgttgtttgttagtcgagatcgatcttccagttggtacccacttatctttttctttttcagctttgtttgagatgtgatgcacacacacatatagttttcagagtaatggaacttggggttcaataaaatttgagtttctttatctttctcttacccttttcttctcctttaatttaatcattacgatgtgcttgcagaagtctaatcaatagcaagcacctcgccgaacatgttcagaatttctgattggttgggatgctaatcatcagagctgatctactcaagctcagaacttaggatatctaagtatctaacactcatattgagatccattatctaaaaaaaacactcatattgagataatgctatcagtagttgaacagaaaactatttgtatttgcataaaaggttgtttctatttcgataaaaatcaggcacgtttggtaattaatcaaatgatccttgaaatttaatactacaaaattttatattaaaaaaaaaactttcttccatgtacatgtggattttttgactttttcaaatatgaatatgacaaaaaaatcgcatcgcttaaattggtatgagcattttttttccattaaactttgttatgttgtaagatatctaacattcaactgatttgtttatacatatttaattaaacgaaatttaattggtgtttaacaccacttatattttcttataatcagctgagattttcttatatgtctgccaactacctcggccatcaacctcggccatccgactgaaatcaaatggtcatcacattttcagcgtatgcgaaacgagacaagtcattagtgtatgactaggtgagtattaattattactaacttggaaaaatgatttatttgatattttaaaataacttttacgtagaaagttttcgcacgaaacacgtcggatagtagtttgagaaaagtgctagcaaaaccaaagaaaaaaatctacatctcaatcagaaaaaaaaaacaaggctgagcctttggatgaaccacaatcttatctcatcaaactgtcccgacaaacaacaatgtcatgtcgtgcattttgtcatggcttcccaagctaaggtggcaggattatgtcactggtttagggtgagggtggtcaagttagttggtgcagcgggtacgaaggtatgttgtagaggatgcatatcctctacattgctacacgctcactgacacaccagtgagtagtactgcatattgtagaggatctcgacgcatgttataggcaatggtgagagcaatccagtgaggtggaggtagcgccactgtaaccattattcatgaagaaggccagtggtgggtggatagtatcaatgttagggtcaatcgggacaggttacaaggcggcgagaaacaatagtcgatccaatagcgtaagccacaaaaaacggagaggtgaggaagcttattggcttgagcgctcttaaatagagagaaaaaaaaaagaagaaagtttgtcttagagcatgaagaagtttttatgcaccatcaagttgcaaacaaaaccgaccgacaaaagtgaaaatgcatccactatggttcaaatcctagtggttaacaggccatgaatatcacgtacacgtgcacacactttccataaagatttagtggactcggccaagaatatgtcgttagcccccgtcttttcaaacgtgtgttaggggtacactcatattgttatagtgtgatgtccgtgcccgacggtgtgggtacatgtgcgtttcccgtgtaataaaaaaataaaacctaccaagaaaagctaaaattcctataaccatatggcgatttttattacagagcatataggggaaaaaaaatccggatgggcgacgcgtggacgtgccgtggatccaaccgctcgctggcgtcggctccaagcggaagaaaaaccgagaggataatgcagaaagcccaaccctcccaagaatcgaagctccctctcctcccatggagctcctcctcctccatccttcttcctttcccttccttcttcttcttcacaaaccctaccactttcccttcaagctccgccatggccgcctgcaagaaccccgcgtcatggcgtccccgcaggcgccttcccttcccgctttcgtcgcttcaagaatcgagaagcgctcgtatccgtatcccccgcgacgagccgaggccgacgccgcccgcgcgcagcagcagcagggaggagccccggttcgtcgcggagaccaaactcatcaccgtgcattcctgcgcggggcggctcggggacgcacgggaggtgttcgacggaatgggccgcagggacctgctcgcctggtcggccatgatcggcgcgtacgccatcaggggaatgtacagtgacgtcctcgcgctcgcggtgaccatggtcgaggaaggggtgctcccggacaggttcctgatcacgcggattttacaggcgtgcgcatatgccgaggaccttgagcttggtagggcgctccattccatggctatcaggagagggttcatggggagggtaaaggatgtgccggttgggaactcggtgcttgtgatgtatgccaaatgtggagatttggggtgggcgcgcaaggtgtttgacaagatggtgtgcagggacttgggcacatggaattcgatgatttttggttattgccggtctgctgagtgggaggaggcacggcatctgctcgactccatgaggcaggaaggtacgcagccaggggttgttacgtggaatacattgatttcgagctatgccaggttcggggatcttgatgtggcaatggaattgcttgggcagatggaggagtctggagttgcaccggatgtcgtcacatggactagccttgtctctggctttgttcatatggataggagtgatgaggcacttcgatgtttcattcggatgcgtcttgctggagttgaacctaacggcatgtcaattgcatgtgctatctcagcttgtgccagtttgaagttactaaaccaggcaaaggagctccatagccatgctattaaggttggcagtgttaacaacgtgctctcagggaactccttggttgacatgtatgcaaaatgtggagaaatagttgcagcttggagaatatttagtgggatacctgacaaggatatattctcctggaattcaatgatttcagggtatgcacaagcaggttattgtggcaaagcatacgagctcttctgtaagatggaaaactatggtgttcggcgcaatgtgataacctggaatacaatgatctcagggtacatacggaatggggatgatgagagagcttttgagctattccagatgatggaaagtcatggagtaaaaagggatacagcaacctggaacatactcattgctggatcagtgcataatggttattatgatagagccataagaatattccggcagatgcaggcacttctgaggaggcctgactacattaccatccttagcattattccagcattcacaaatctagttgcgtcctggaaagtacgggagatccatgcctgtatttttcaccacaatttagaactggatggcaaaattgcaaatgcacttatcaatgcatattcaaaatctggtaatcttgctagtgcgtgtgctgtgtttgatatgcattcatcaaggaacattatttcttggaactgtatcattctcgctcatgtgctgcatggttctccaaatgaagccttggatcttttctgtcaaatgaagcaagaaggtgttgtgccagatcatacaactttggtcactgttatcaaggcctatggtctcacgggaaaggtatctgaagggtctcagacatttttcaacatggccaatgattacaatataactccagaattagaccattatgcagcaatggtggatcttcttggtcggtcagggagactaaaagaagcatatgagcttattgacgagatgcctttgatacccaattcaacagtctgggacacatttcttactgcagctgtaatgcatggaaatgtaagactggctcacctggcagctagagaactgtctgcgattgatcctggagatcccagagtccaaaggttaggttctagtctgcaagatctaactggaaaaactgttgatgtgccagaggagatgacacccaacaaaggaagaaatttagatgaggtcgagagctgttcaatagaaatcaggaataaggtgtatgtgttctcaaatggtgataatgttggcttggaggatacagtagcagaattaaagtcgatgatgtttaagatgggacattctatgcttgacattggcattggaactctagatgttgaagaagaaaaggaagaagttgttggagtccattgtgagaagctagctattgcatttgggctttctaattccccacagttcaaaaacataaggataatcaaaactgcaaggatgtgtaaccattgccacacctttgccaaactagtttcagagaaatatggacgccatatactgatcaaggatccaaagtgtttgcataagtttgaggatggaaaatgctcttgtgaagattattggtgaatgatgaatacaactagtttatgtctactgggtaaaatatcttgccaagtgtccttttgcaggattacacgctgctaacctcttgaacaggtaatatccattttgtcagattcactccaggagtttccttggggttgaattttgtctgtcacatacatagtcttgttgacaggattacttatccttgtagaattcaaacacttggaggatagcctatccatcaattcaacccccagacaaaaatatccagtactatgtggtatcagaaaaggggatctctagactgttctgatgctattccagcttcagtttaggtttattttgaacggcttgggagacagtactggtggttactccattccatcattcaagaaacagtttggtaccaatcacacatcttttaccttttgttaattgttccaaatagttagcaacttagtatctcacaaatttatgcttacaatttgatcatttctattgactataaaaagaatttcacttgccattaaactgattcatcaagttgatctgcgtgttggttcacatcgggaatattaccacattgaggatggccagacaaccttgtcaaaagggacagaggtattagaaggtggatacgaaaattgactgggatggaagaactagagggataattatagactaggatggaaaaactagaggcattgagaggcagtgttaaaggattgaatatttcttcttgattgatctcgtctgatgctgatgctctgtattttctctagatttgtccctaacatagtatatcattatacatagactcttgatttctaaccaaaaaaaaagctgacattacttgtacaatttagactctaataattaaaaactatatttacactcaaaaaaatattcaagactatattctaaacttgcagactcaatttctaatttaataggaccttaatgtggcagccactgcttcttgcagctgaaatgctcctgagttttcacaaatactccctccgtcccaaaaataagtgcagttttgcactattcacgttcaacgtttaaccgttcgtcttatttgaatttttttttatgattagcatttttattgctattagatgataaaatatgaatagtcctttatgtgtgattaaatattttcaattttttcacaaatttttcaaataagatagacggtcaaacgttgggcacggatatccacgactgcacttattttgggacggaggtagtatcacttagatttattccatgtgttatgatggtttaattttttccttcatcacatgcatacatgttttctttaaaatattacataatgctacatagaaacaatcttttaataatatagtttcagcattttaacagtgtcacacagcagcatgtacttattgaaatgggatggcagctattgtagtttcttaaattttgccggcatagtttgtgtctctatctgttttgttttccttttcagggtgaaatactaataccaatttcttttgcaggttcagaagcatgaacatggcaatgtaactttgagagttatagacttgaatggaaaaaatgaaattcttcaagtggttcctatttatacactgctggagcaaataagaattatcttagtagattttaatagcaccataaacattagggatagtgaggctagaaaatctattgtccacattcattaggtccaatctaatacggaaccatcatattacattacgcttcatttgcctcccgttcgatgacacaatttgttggatttgtttgcccctctgaccaaaggaaaccacgtggaaagcgtggttatcagctaatcatgtggaaggaggggatgaacagaggagaacgaagagatgctaagatcagagaagacagaggacgaaaagaatttaatagtaccactcactttgctcgattgcttccaacaatgttatgccgatgaggaggattatagtgacttgctcactttgagaattgaccattttgcccctgtacatttcctgtctggaactggtatagctatagttgagataaagtgtttagctaaaggtacgagaactctggtacttgtttggagatctctttctttttgtggaagcaagcaattgcaaatttgtgtgtatgtgcgttctttgttaatcgaatccgatcctcttttttttttttttttgagaacttcgatcctgttgttggtaccggcattccttttcagctttgtctgaaatgtgatgtacacatatatggttttcagagaaactagaattggttggtttctgaattctgaattgtgtgtgaaaacagatggatgggaggatcggtgggtcaaatctgagtggaagaaggaggacaacacagtcggcgagtggaaccacacggccggcaagtggaacggcgacaccaacaacaagggtgaggatcgatgcacacaccacgctgctgatttcgttttttcttttctgttccggcatgtgcgaagttactctgcttctctgtgcaggtatccagacatcagaggactacagattctacgccatttcggccgagtaccctgagttcagcaacaaggacaagaccctcgtgctgcagttctcggtgaagcacgagcagaagctcgactgcggcggcggctacgtgaaattgcttggcggcgatgttgaccagaagaagtttggtggcgagacaccgtacaggtgatggtttgatcaccttgcattcccttctgtgtgctcatttcagagcgcaacatctttgattgatcggtttcttttgaaattgcagcatcatgtttggaccagatatctgcgggtatgccaccaagaaggttcacgctatccttactaagggtgtgtttgaggagaaggagatagagaagattgggaaggtacgcaaaacgaggtaagtcattagcgcatgattaattgagtattaactattttaaactttaaaaatggattaatatgattttttaaagcaactttcctatagaatttttttttttttgcaaaaaacacaccatttagtagtttgggaagcgtgcgcgcggaaaacagaaacaaactcactccctttgttctccaaacgaacgcagcctaagaacggcaataaccatctgatcaagaaggacgtgccatgcgagaccgatcaactgacacacgtctacaccttgatcatccgtcctgacgccaaatacagcattctgattgataacactgagaagcgaactggaagcatctatggtgattgtgataatcttcctccaaagaagaagaaggatcctgaagccaagaaggtaatttagagataattcactggctgttctgaataggcagtctgtgctgttctatttttacagaggtcataactaatacggtaaaatgttactgtttgcagccagaagacgggctgtgtttagttcagcacaaagtttgtattttggttgaaattggagataatgtgactgaaaagttgtgtgtgtataacaggttgatgtgatgggaaaggactgaagtttagatccaaactttggatctaaacacagcctgggacgacaaggaatcattcctgatcctgagtacgagaagcctgaggttgctttcctttgtttgcgcaactttagatgatatttctgtctgaagattaattgagtttttactaataccactctactgagtttctaaatgaaaatgggtggcagttttgtactgtatgttgtgagcttgctgctcctcagatagcaatagagtacattgtgttacaaaagcatcatgaggccatatttgatctcatcaaaggctcatcaaagagcaacaatggcatcaatcaagtgacttgtaacagccatattatggagtatttgtatcacaataacagtgaatcctaggcttgtacacatacaaatcctcaatataaaagaggacatattgagatcaataaaatgggattcactgttttcactgtttatctatcgttttctaacacgttatcagcagctctaccaagagagaatagtgaaaacacttaccgacacttaccggcacgtgcatcatgttttcctctgtcactgctttgtggtgctttcgaagcccctcatctccctcgtgagagctagatggagtgatggacaattatttattttgcatgtcaatcatgttttcctctgtcaccgcttcgtggtgctttcgaagcctgtcatctccctcgtgagtgagatgtcaatggtactgttaacccatggatgcaaagtggtacgatcttcctctctcatttccctaatgagagctagatggagtgattgacaattatttattttgcatgtcaatcatgttttcctctgtcaccgcttcatggtgctttcgaagcctgtcatctccctcgtgagagctagatggagtgagatgtcaatggtactgctgtgattgacaattatttattttgcatgtcaatcatgttttcctctgtcaccgcttcatggtgctttcgaagcctgtcatctccctcgtgagagctagatggagtgagatgtcaatggtactgctaacccatggatgaagtggtacgatcttccttttctggttgatcgtccatgttttttgcttttttcttctatgttttcctctgtcaccgcttcatggtgctttcgaagcctgtcatctccctcgtgagagctagatggagtgagatgtcaatggtactgctaacccatggatgaagtggtacgatcttcctcttctggttgatcgtccatgttttttgcttttttcttctatagaggaataggtggtagtgaggactaaggcgagaactatacgttcgaatttaaagaaatatagcgagtccggtattttcgcggatacgctattttgactgtggttatcttagctgtgcagagtctaggagtactctcggtgtaattggatcacctcgatttataattatttggactgataactatgaaagaagcttaattcttttatggtcagaaatgacaaattcatcaaaggtaaatgataaattcatcaaggtaactgattaaatagtatttttcaatcattaaatgatcattgcgtattagtcgttaatcataataatttacagagttaaacaatgcaatgtggcataaataatgttgaaattgtgttacactcggataagaattctaaacaagccaaaaaaatatatatcttctaaggaagtttgaattgataagctcaatacagacatcaaatattctgaggaagtttgaattgataagctcaatacagacatcaaatatgcatttgttgaattcagacgacacactacaaaatggaatgagtgaccatgctgccccaattaaattcaatatatatatttatgtatgatatttatatttcatatgatttgaaaagtttcaatcatttgaattaaatggctacattgaaaaattttctataggattgaaatcctataaaatcctacatagatctttggatttaaagtagcgcttatttacttaagtatttattttttatattacatgtatttaaactaatgtatttataaaacaataaattatctaaagaaatgtaaaaaattcaatacattataaaaatagactaaagataaactaaatctcatttttatatgtagatctcattataatgcataggcatgtaactagtaaatagtgaatatcacaactcacttgaataatatatatcacattatgatcattggattcataacaagtgttgatcactacttcatccaaaaaaaattatatgactatatcgtttaatattattaaactttatagcattctagattatatttagcaaaaatatctttctactaaaaaactagtcagataccttttataaatacaatatcatttacaaagataatagttattattttctcatataaaaaacatagataatatatattacagagcacacacacacataagctagctgctactgcctccgtctctaaatataagggattatgtctagatttattgtactagaatgtgtcacatctaaccaaaatcgcttatatttagggacggagggagtagtattcatgtgcaagtaatagtgttgagtgctgactgtagcaatattattatcaaaaataaataagaatgagaaaacaagaagaagatggaacaacaaaagaatataaggttaaagttgttagtttcacaccattcactacaaagaacaattttaataatattaatatattatctattaatgtgagtatataccataccatggatgtgagcaaccaccctcatgtgtttgggctagtgactaacctcctctttttcttacttcttttgaagttctctgaacgtatttaggtaaaagatgttttgttttgaataaaaaagaaacaatttaactagattattttttagagagaatccatcgtgtgccgctaactttgtcactgttctataatatgccactgagtttgttaagttctacaatatgtcattgtattttgcttaaattctataatataccatcgccgtccatttagattctgttagtactttataattttgtcctaatgattgaaatatccctaggacaaaattttctaaaatttggctgaaaattccaaaatatcatattataaaataggcagagaagttgcccatctcaaactttgtaagttttacaatctgtatgataaaattgtacaatgctaacggaggctaactagacgatgatggtatattatagaagttaagcaaaatgcggtgccatattagaacttgacaacccaatgacatattgtagaccggggacaaaatcagtgacacacaatggattgtctctattttttatggttgttcggttaactacctatctactatgatgcggcttttttagaaaaaaaagttaaatcttacactataagtccatatcttacacattaaattacatacacttataatataattttcaaattttaaaatgccctattctcattttataggagaattatggaaaaatgatttattgtctatttaattatgagaaaaatattagtccaaattaacatatatgtagaaaataaaaaacaatatgaaagaactacggaaatacctactaatgtagtaatcatatatcatgcaatgaaaaaagaagaccatagtcgaatactttattattgagcaaaaatgatggtattatttttatcatcttttagcggaatctatctaaccataattaatcatcccgtgttttttgtgggacaaaagggagtaaattatagcacatactatggattcttaaaaattcttaaaagttttcatataatattatcctttaaccattcttttcatttacacaatagccaactttacatttcaatttggaccaccttattctatccaagtccggtgattcagcaatgactctgcacattaactctctctctctctctccattttctttttccctccaacagttggataaccaatagatctagcaagaaggagcccaaatatagcgccttcgcgcttcgtcaggtcagctcctgcctcccaaagtccctgcaagcctgacttccccgacctgaacgacaaccataacaatagtgtgcatcacgataggggagggtaaaaagacatgtcggttactagagggtaaggctgcgcatgtaaaggcaagaggaggaatgatgatggctcatggagaaagagtggtggtggtggtgcgtagagtgacagttagtgtttgttggtggtatgaggaatttgttgttgacacaatcgcttaattttcctttaagtattgatgatacgtggatcaccagttatataaataaatagtaactacttttaataaaatagtaaaaatattgagataagggctatagatggccatttggccctcctggtatggcccggcccaggcacgagcaaggcacggccaaagaagaatcaggccggcatgacacggtcggctctttgtgccgggccgtgccggcccacgtgctacacctcaggcctaggcacgacccactagcagtcgggccgggtctttgggatgtgacatatatataactaaaataaatatattttatgtccatattcttttggccgtgccatataatacgtctatttttgctcctactgtgtcttacatatggttgaaaattagtccgttatgtatcctgaacttcgtaccaggcttggctgtgccatcccggcccagcgtgccggtggggaagcccaagcatggcccggcggtcgggccgggccggcacgggcacaacccccagtcgggccgtgccgtgtttgggccgggccgtcaggcttggaccttgtgggcatctataataagggcggagtagtcgagtatcgcgtagaagaaaaagaaatctgccgtctcgctctcgttgtctcctccgctccttgcgccgccgccaagacgagtcgcggctgaacaggggagcgccgggcggcgagctccatctggcgagcagagcagagcagcggaggggaggggatcctggtgagcatccgcgtcctctctctttctgattcatctctctcttccaccccaccgggactggaatttgcttgcgttcgtgaacccctactagcttctcttctagatctggaagaagctcttctcctcctccttaatttgatagccttaaacctctcttaattcagtttatttgttcacccaaaagtttggtggttcagtcccaagttggatccgcccctgtagttaaatatccattttttgggctatctactgatttcccgtcaatgattttgttgctgaaaatttccagccttttctgcttcaggaatcaggacatagatggatccagaggtgaaggactcaaggccatcgaggtctcccggcgaaccaaatcttttcctgcaatggggcagccggaaacgactccgctgtgtcaagacgagggacgacggctcgccatcacctgcgcggaccgatgttcttaggcgcaccataccacgagtgaatcgcccgcttggcggtgatgttgccccgtttcgttcgccgcggcgcccgagcacgctgaaccgaaggtagcttcagtatgccatagaacacactcgcatcgactggaaatatcgagcaattcttcctaatataaggtaactgattgtctgagagcaggaaaaccgagccatttgtgagcgataacaggcactccatgtcactctcgccagagaaggatcgatattactccactaggggttctccattcccattcgagggaaatgggtttgattttggtggtggaatggaagaaaagggaaccacagcactgccaaggttcttcatttcattatccaacaaggagaaagaagaggacttcatggcaatgaagggatgcaagctcccacagaggccgaagaagaggccaaagttgatgcagaagtgcttgcttgtaatcccttctttcacaaagattactgcaaaattttgttcttttatgtgatcatgctcacttttttttaacccttccatattctgtttcattgttgggcttgttgtagatggtaagtccaggagcatggctgtctgatttgtctcatgagaggtatgaagttagagagaagaagtgcgctagaaaggtaaacctagctttgttgttattttccttttagctccttgtccaaattttagtttgatggttgctaattcaaggaaaaactttttgcagagggctagaggattgaaggctctttgcaatgagagtgattcagaatagaaatacagagcgggatcaattttttttgacttttgctggagacagttaggtacaatgctggttcattcattaactagacagatctgagcggctaatttagagagggaggatcaccggctctcctactatccttatttcaccacccctgtatctccatcctttttttgttcattcgttgttccaaacaaatcgtcatctagaactaagcctatcgaccgaaatagttgtatattagatcattcctgatctagcaagtttgtagctcagaccttaaaggcaccgcggagtttggtcaccactgaagtgaaagtaaatgaaaacgaagagagagagcttaagatggaaggcagcaatgcatggtctatgagtctatcatgatttgggattgagaaagaagatgggaggttgttgggtatggtgcatggtgcattttggtgcctcaattgttgtaacagtaacaccaagttgggaggaagatttgaggccagctggccattcaaataggttactactgaatcccaaatattgtaatcctagttgatgttgaagagaacgccgtgtgcaggccatgcctgggcatgatcctggattcatggttagactgtttctcctgaaatatatatcaaattcgcagagttgtttgaccttctccataagtcttgtgttacagtttaagttctgttggagtgatggattgtgctgtgtcactcactcctgttaataattctgcttggtatgttacgaccgttgttatctttggttcgtttcagactcagtaatctgtctaggcgcctcgtcaggctgctgaaattgagcattttgtggggagggccgagatggtggtcgtgggccgtaattgggagcccatgaagagaaacccggcctgccacgggctgcctcgatcaatgccgccgcaggaatttgggcctccatttggcctaccagtaaatggaccgctgctgcccgtgggctgtacgagggagcccaagcgaagaaacccggcccacctcacaaatttgggttcgttttggcccaccaagaaatccgtattgggcctagagtggagtaggagagcaatttcacgcgccgagaaatggtggctgtcggactattttgggcctccaaatggcctgcttagaaagtgggtcgtcgtgggccgtttttagcgtgacaggccgagttggagcccaactgttcagccatcctcggccatcgggaagtccgtcgatccatggcaaccgctcgccggaaagtccgtcgtctccggcaccggcaagtgtacgccactccgtcatcattttgcttgctacacgtccaagacaggaactgcttggcatgtgagcaccaccaaggctcctgcagtgtccgggtctgcgagtgcatcatctcacttctgactaatttaggctgtgtttaggttacgggtgtaaagttttggcgtgtcacgtcggatatacggatatatatttgaagtattaaacgcagtaacaaattacagaatccgcctgtaaaccgtgagacgaatttattaacctaattaatccgtcattagcaaatatttactgtaacaccacattgtcaaatcatagcgtaattaggcttaaaagattcgtctcgcaatttacacgcaatctgtgtaattagttatttttcgactatatttaatactacatgcatatgtccaaacatttgatgtaatatggtgtaaaattttgccagggatctaaacagggtctaataactgactggaactggacagtgacacatctctacttccagtgtttctttttcttcagagaacagacaactgagggggcccctctctcccaaacaccccctcagtgacctcacctatgatcaggagtacaccatccttctgttcagggaggttcagagctttcaaaattcaacacagattcatcagagaaatatagtactactgtacaatgcaaatgttgatgatccacatttgtgtagttctcttcgaaccaagtcaaaagaaaacacatcaaagaagcaaagggacaactaccattgcctacaggatttgagcattcatcaccagtagccaacaccgagtgcctcattagttatccaaaagcttattataagccataacagcttattgagataaaaaaaaatgtatatacatatatgtttttaatgacttaactaatactgaaaaaaaaaactatgttgaaaatatgttaaaatcaacttcaaagttaagtttaaaatttgaattttagctttgattttgtttttttaggcgcaccgatgaggctaagcccttgtttagttcctaactttttcttcaaacttctaacttttccatcacaccgaaacttttctactcacataaacttccaacttttccatcacatcgttctaattttaaccaaacttccaattttaacgtgaaaaaaaacacaccctaagattcagaaacaattaaggagaagaagttggcctgaggagttatggcactggcaaacatggacctagtttcagaatggcccaaaatttcaagcatcttcacatgacacatatacaaactcctgcatatacaaacatgcacatttgagttgaggctgctctgcccccaaactgtctctgaatctggtcctggcctgtcaaacagcatgggttctcttccaacccaccaaactggagcatatactatgaaacaagggcaaacaaaccagacctctagaaacactcctcaaccaattttgttcatctgcacatgactgttgatggcattaagatggtcaatgcaatgtacagtacctcttacaaatccttcttcatctgcaattgacaaaaatatacctgacatttatgctccccatgaatactagtactcacaatattcaacatactactatttaggtctgatgctttcatggttggcagaagagataaatggcacaacattttagttattttttgtgctttttatagcctactaccagatactcctccatgggaatggcatacaagttgctgagtaactgaatcctaccaattcctctttcctatacaccactgacattcaaaggaggtaaaggtgacatgagaaaaataaagcatggccctctgaccctttagttaagcccaagagagaagctccataaccagaaagacaagtgaatctaccatataggaaaaaggaggtaggccatcaccacaaccaccaccagatgccattgcttctcttcagaagacttggcattacaaaaaaggaagaaagaaagctcaaggcagagagagattagaaagcaacaccggggacccattcacatgacacacactatctagggctaaaaaactggagcagatggtgtattacacttgaatggttaaacacttgctcagggtgttcagttcagttttcagttgtcatgggcagtttgagctccttccagggcctccatagtagaagtatgtgccccagtcggcattgttaccgttttgcacgtcgtagcagttcgattgctcagtgaatgtgcccacccccttgggggctttcaggttgttggtgctgtccaccacctgtatgttcttgaagtagcttgacttgctgaacccttcctccgggaagtgaccgctgcccatctgcgtcgacgtgtgcacgccatcgagctgcgagtttaccacctccccgccccactcgatcatcgacgcgctgtcgccaaggtaggagaataggaaggatggccaatagccaagaacataatccttgccaaactgcatccaccagttcccctcctttggatcctgctcatatatatgtccagcaaatttcattagagcaatgcattagtgcattactaaaaaatccaatgtaccaatatacagatgtatttagacattaaaaccaatatatcaatatacagatgtatttagacattaaaaccaatatatcaatatacagatgtcttcaattatcaatatacagatgtatttaagacatttgcaccgacatatctggacttcagtacacaggcattgtgcccatttagtactacaataggatgcctcgcattcatgttgtactaagcaaactatgtttgcactcattactcgtgctcaatggaaatgaaaaacagcttgctttctatcttgcactttgctcggcacttgcttgcttgctgaggtgaaaagtagcaatggttctttcttttggaaaacaatgaaactagagtaatcattaaggataagaaaggctgttgaggaagaaaaaaaaagtattatgaccacactaccacaggggcacagggtgaggaggaaactattttcaaagcccaaagggtatcagccaaggagcacgagtaagagcacagcagcaagtgggcagagagattctctggcctgcatgttttgtgacaactctgaacttactactactactactaagcgggggcatgtggtgagtaactgaatttctagtttaattttctagctcaccttccaaatcattatactgatatcgtattgggagccagagtagcttgagatggggaagatgctggctcccatggcgatctcactgtttatctgcacgaatcctgcacacaatacgttgtagcaccctgttgcctggtatgcatcgctctgcagaaacccaggtttaaacacaacgaattagacatcaatacaagcacatttcaccaattcttcaggctttaattcattctggaatgaacaaacaaaacttacagtccagtaagtgaacagcctcgtgttgttgtcgccgtagaggtcggggctaacctgaagaaaatcaaaggaaaacacaaaagcagattcagagctcgtgagtgacacagcacgcggggcatcgcggcagaaagggggtattgcaaccgcaagaacggtgccgcatttactcgccaatgcaaaagctcacgcatgagatgagatgaaatcatgaacatgaacatgagattagtttctttcggattgctacctgccatccagcctcgatgctgttgaggtcctcgccgaaggagccacccaagatccagagctgggacaagctgaactcgttgggctgctcgatcttgggcgcccagacattgatggttgccttggcgccgtagtacttgtcgccctggacgtacgcgatggcatgctgcaaaacaaagaaagataaattttcacccaggcaaatcagtaaatgagccattgctggtacccgcagtgcaacaacaaacattgcaagcatggaggtcatagcgcatcaatggcgaccccctctcattcctgggtgaatatgtgattgtgacgtacctggtggccgccctcgttgagcaggttggggtcgacggacatggggttgggcgccgggtgccgcttcttgccgtagcggcgcatggagctcgcccggagcaggtcgtcccgcttcgtacgccggattgggacggtgtcctccgggcacctgccgccctggtgccagagctggaccatgggcttctcgccgccgccgccgctcttggattcgtcgtacaggccatcgggatggtagttcggcctcatctgcggagagcatgatgatggtcaccgccattgttgcggaatccaacgaattgaggtttgtagatgccattgttgcagctgaaggtttacctggatggtgtggttcttgaggaagggatgatcgaaagctggctggtgtgagatgtgcacgcaatctatgatgtccccatctgggctctatttgattccacagttcgaaaatgacacaaatcagatgtgtttggtggggtaagaattgccagagatagctgcttgggtatccctatgaaaacttgctaaattttgcacaaagttaagcaagatagaagaacttgagaaaagaacaagcacaaagtgacagccaaaaggaaagtcacaaaatctttgctggtacaattttttgcatatttttcacccaatgtagccaaaaggaaggtaaaggttttgaacgaatggtaaagagagaaagtgaattcccccaagatcaaccacaaagagccacagaaaagacatcttctcttttgaatcagaataccaccttgcactttgaacgattagcccaagagcaaacctaccaccttgctcgtgcttcctcccaaatcctctccccccaaatgaagctacacacgcttaactttgaccaggacgacgaacccatgatagataccaattaaaaaaaaagcaaattcaaaatcttcacacatgacgcacctcgatgctcttcaccgccggcttgttgagccgcttcaggtgccggtgcgccctccccgccggagaccttgccgccgccgccgcgcacgacaggcagaccaccgccaccaccaccaccaggcaccccacgccgccacccgcgcgcgcggtggccatgtgcggctctcgcctcctcacgccgccaccgctccctcctcaaatcgcacttcacttcacaccccccccccccccttcctcttcaccgacgaactcacctcgccgccggtgaccgcgccgccgcagcccgagggccgatttgagaaattcgaaacaatgcggggggtgcagcagcaggagcagcagcagcagtggatgggtgggtgctggattcttgggcggctcgtcgtcttccgctacagcagcagcagccacgaggatccaagtgggcagtgaagcgaagacacacacacacacacactctctctatctctctctctctcagcttcatcagctttcgcagattacgagctttatttttggggcttctggactggaccaaaatgccctccatgattcgcaaattattacgggtaccgggcattccacgccaggaccacgggtaacgcccactgatttgtggggtccgaggaaagcctttctcaagaaatggagtaatagccgctgtgttagtgaaaaaaaaaaagagtgaattgtactttgggctatgttttattgcgatagtttcactttgaactaccctgtatacaatcttttcacgttggactaaataattttacctttgttgcataatggaccaccataaatcttttcgctagtgatgtctagcgtctctttcgacaaatgtatggcatgcatattggtatgaaagtttactggcatgtcgttaacaatttgctcgaagtcatcgaagaactgaagatatgttttggggtggttcattgtgcaacaaaggtaaagttacctagtccaacgtgaaaagattggacaaatggtagtccaaagtgaaaattttggcaataaaatatggcccaaagtgaaattaactcaaaaaataatgtactccgttccaatgctaaattatactacagctatttctaacttagtataccttgttttaaaataaaattatttctttatctgttctcttttttttaatcaatcacaatcattttctcattcatttatttacctactttctcttcgatcattttttatatactttttaatagccgtgtccaactaaaaatatacttaaattctgttgtgattctctaatcatttttatctactttattaatacatgtgtctacctagaaaatacttacattctcaaaccgaggaaatatgttgttttgcgatataaaatccaacactatctatattagtgagtgatactttaaagattatactatctatatctttagtgaccaccaaatttttacaaaatatattggggctcaagaaaaccacttcccacgataaggtataaatattagtttgttttttgaacttaccaattaatcgagtggtttcatgtatcagacaacatcgagtggtggccgtcaatatttgaaaccttcatattcgtttcgcaatccggcttaaatttgaataaatggaaatgttgttgtgaagaaaataggtagttagacataatttttgtaataaatataaatgttgttgtgaagaaaatgggcagttgactgtaatgtcgcacaatgataataagagttaaacattagaaaagtccacaccatcaacatgacaacatgcattaaatgtattaattatactaagattatccataatatgcactggcataagattaattaatctaagtcaatgagacttttttttccttcggacttcatgccagacgatctatagctagcatgatctagctttgactattacagttcgtcgtagtgcttcctagattttctgtcatagctgactctcaccatctcaaatccgtaatacgtttgtctttcacagtttgttcctagatgtttatgcacgcattgcacggtggttcaaacggctaaacccgacttcttcctcctcttggggggcaaaaccctgggtatggttggtaattttctttattcgggccactcacgtgggcccccaccaacctgcccactgtgccgcggccgggcccccgttccgtttcccccaacacggccccaccccccacccgcggcccggcacgtgggagcagccggcactcgtgccaccgccccacccgctgaccagtgggtcccatcttacgtggtgggaccggacgcgtgagcttttcgcttctctctctctctcgcacgcgcgacgcgagcggcggtcgcagcattggatcccggcggggggcgcacgcgtgcctccgtgcaccggctaacgaaagttttaaggaaagtgattaggcagtgcttaaggtacggtgagctttggaaaaggggaccctgcaaagtgcacaccatgcttacagtactgatatattacagttaagtcattttgtttaacggtagtactacgagtagtaggtaagtacagtactgatattgcagttaagtcgtttttatcattacccgcatgcgaagacatgctaatacgtattaatggtgtcgagctagtatactagtatactctagtttttaatgacattcgtcaggtctacgcaagagaagtaactcaactgtcccgtcttcagatactccttccgtccaaaaaaaaaagacaatttcatgcctaacgtttgaccgtccgtctttcaaattataaaaaaaaataaaaagacaaatcacgcataaaatattaatcatgttttatcatctaacaataatgaaaatacgaattataaaaaaatttcatataagacgggccgttaaagttggacacgaaaatccagggtttgtcttttttttatgacggaggaggtatgttcaaatagaccccacacaaatacactatacggtatacctggataagatagtagtaggagtacattataaaaggaacattgtaaaatggctggtgaaatgaagaccgaaatgttaacctatcctataaaaaaaaagtaacgatcaccggtatgacacgtttagcagcaaaaagcaggtacagttctacgtataaaactaaccgcgaccgtgcactcatcactccgttttttaacccggcctttgctccagaatgtttttcacgctagtaacactaatcagaggagggtgaggactaaacgtggagggttaaaaagataaacatcgtctggtaacaacctgacaacagtaataatagtgcttgcacagtcgccctgcctgccacgatggctggttgtcgaagcagtaacaacagcacatcacatgcattggtcaatccagaccctgctaatgctacgaccgttgaccggtctcgtcttgaccggatcttacagcatcggacctcttggtaaacgggtaaaaaacctagaaatacagcagcagtaacatgctaaacagatggatacaaaatttatttagtatcggagtagtattacgtgcggtccatactggccccacctgtcagtaggccctttgcattaggacaggctttggatgttttcagtttggtccgtagtagttgaaatttttttcaccggctcagaagacagtcataataattcgaggcacacctatacaaataatgagctcaaatagacactaatagattttacttcatccacaagctgaatcgcccgcgaatataaaagcatataaccacgtcagagaaggaggaatccatctctcttctactggcttttcttgcacaagcacttgaagttgaagggcacctttatgtacaatttccaaactacaaagaattgaagcaaggctaccaaaagccagtgattctatacaaatggtcacttcccaacaagcggtgcaagaatcgaatcattatccaacatagctagctcaacaacgcactgaggatgtgcaaaaatgcagcttgtgtactagcaacacacacgcaccaagatggatacgaacaattatacgtggatacatgcatgggggctgatcggttagcatcagggcatgggggacaaagtacaaagcaggctacaagttggggataaggaaacccattacacgtcagctttagccttggacacaggaatgcataccaggtaagaacagtagaggagtcatgggcacaatcacaattcaaagccgttatatcacatggttcgctgtttctctcagtgagccaccctggcaggtttgtccagttatgataaagaggctaaacagataaacacacagggcatcattttcagtctccgtatgaacaattgtttaatgtcataaactcctgaagcagatttttaatatagggtcgcaactcacaagtgacatgcttgatcggttgatcctaggagctaggactccataaaggtactatatatattttgagatgttgagcaaatagtcacattgtaacagctgctatttaagtgctactgctaaccagctaaaattagcctgtattgacagagatggattacgtactaataactctaaagttccaatcagtgtcattacatacatttattcagggattgcccccatcctaatcactctccatcagctatcattcttgaaaaaacaaatcacctaccaagatactccctccgttttttaatagatgacgccattgactttttctcacatgtttgaccattcgtcttatttaaaaaatttacgtaattataatttattttgttataggttgttttatcactcatagtactttaagtgtgatttatatcttatacatttgcataaaatttttaaataagacgaatggtcaaacatgtgagaaaaagtcaacaacgtcatctattaaaaaacggaggtagtaacatgcatgggtctgcgactctaaattcaatctacgcaagcttaaaaggacattactcaacagcaacattcaaggggtcattttcttagacaaaagggtaatttacatccaacgggactgcgtgcatggtctttgggctgtaagctcatttatttgagtgctttcctgctgtgtgtggttgagctgccaaatcagttgcctcaccaaacgatagcatgtgcctttaccaggcatcaggcatatgaacggtgattcgtgctggacatggccctctctagtttgtaccgcaattccatgaatggttcttaaactttacttgcttaactaaggcatgattttcctgtaccacaaaactacaacacaacgtggtacagtgtgttccaacttccaagcccgatacttaaatctgactgtgaataggtttcaagtaattgggtttcagttctagaaagatctcatgctgcaatatgccaccagacgagttcaatgaaagcttaattaagcaactaatgccaggcaatctacctatttgtaacagaagattcccagaccctagttccacttagcagtacttttcagccttcaaacagagagcagaaagagactttcagtgcatcataaatcgtaacagtataaaagacccaaggccagaacggcatagtttctattgggcaggcatatcgcttgcccgtgaagcaattagttgcctaggagactaccaaccaagcttatttatcagtactcctctaggttccaaagttgagattaatggctatcgtccagtgtctacaggacagaaagagcagagacacgcaataatagagccatggctaaaaaagcttgtgttactatggtagcaccatttgcctttccatgataagcagagggccagaggaccctacgtgttcacggttcatgaggccactgacatgtgcgaggttggtcacacttcaacacttgcaatgagggcctgtttcttctcccagtctatttaatcagctaacgaggtatttgaacgctacatttcaactctagcaaacaatttattagaattaaatgattacggacatgctcaattctatgaaaaatttgatataatcaacctaaatcatggatatcgtataagataacggataagtggaaaggcaatctttggtcacataggaaatggatgctttctagttaggcagtgagcaatttacacaaatagtgagtagattgaaacagaacgatataaacaagctacctcatacacttcattatagagttggaaacaaacataccttcatggaatatagcattttatatctcttgcctcttcaaagcttgaaccgagagaaaaagaggatatccagaggcagtaaagctggaaaagggaggggacataagatcttcagttaccttgataggtgatcacaataaacaggatgaaccattttcactgtaacataacagaagcacaaatcacatgcaatgaatcagagatgtgctcacatgcgatgaatcagatatgtgctctcactccctccctctctctgctgcaccaccttgcccaaagcccttataatatttcttgacttgggaaatgcaattccacaaactaaataagtcgctaagcagacacaaaaaaattgatgactacacatatagttgccaaaatgcaatgctgaatcattacagaattagtgcttctgactaaaatccacttcacagacagaagcacaaacaaaagttttctgtaatcaaagattctccttgtcttcacaacaatgttcaattcctgaacaaaaaaaatatgacctattttctttctttaagactatattaatcgttttattaccaacatttatggcaacctattttagtataggaagaatggaacattacctttactcaaaaaccgacatggtacagagcacagctgtaatccgtcagacagcaaaagtaatccatcagacagcaaaagatgacaagatgatagatccatttccttgttctgtcctgtccttatagagagaaagatgtgctaaataccagtgtactcacaacgaagatgggcgcttcacaatgctgtgtcatcattcatcaagtataatacataacatattttcaacaaagaaaacagccatcttcaatcaatatctggaattgcatttcaacttttaaatacagtgtgtggcgttcatcagcactacccagtgatgagttccccaataaaccaatgcaatcataaaaatagagcttctaacctatggaactattatcaatgaacaacctcagaacgtgttaggttctgagtgctagatgcaagggcgaatgattttgcatcaggtacagaatgcaagtatgcattcaatctttgcacctgaaagcccaaaagttgcctcccacagagccttattcctaagcaacctgaaatagacgaaaattagagatgatgggggatcaacaaaacaactcaagttttaaatccagaagaggtcctaagaaatgaaccacaattcttaagcctcaaacatgcacgcctgctttgtgagggtgacggaaaacatattaaaagatcaatgtgcactgaaatatggaagttgtaagttgtaaatctcttcacttggttactttatttcccatgcaaaaaagaatggttttagcacattactttcactaaaaaatgatgcattctagttgagctacagcttgactttaactgcgcacaaaatagtcccaaaatatatagttctataccatcttttagaagctagaaaactgtcaaggttgagtagaaaaatctactcaagaaatatacccaaatggccaaatgaagcaagcacaatatatattctaaaagttcaaaacaaattatgaatacagtcaaactgcacgaactaatgttgcatttttcttcaggagtggccagagatccatctagcttgttttgcatgactgaatgagcgcattcaacaaaaggattttattccagaagcatacttcctccctgagcatggaattaggcccatcaaccaatttaagaaaacggcacatctaatgtttccagcagattgaccatacaaggcaccacccatcatcacaatgaaggtggaaacagcaagcaattatgcagatgcagacagaagtttgagaactatgtccttctcatcatcatcttatagctatcaaactgctgtcagccagaatgttgaacactatcaggttaacctttcaagtctgtcagggccaactgtcattgattgcacaggaatgaggcatacgcaaataactgtatccactactttctagtttctatagatgccaacatagattgaataataccacaacaataggctaaagtaaaacacggtatgcaatcttatgcaagttcacggaacagacagtctaacaaccttatatcagatttctaataagtcaacatggtacaaatcaattgagtgtgcatagtgttatagaatcactctctccacttaaagtagtgaggttggatggaaaattattttaaaaaagaaaatattaactcaaaaaaggtaattaaattctaggttcattctgatgttatcaatggttcgggtctcatttaactatattagctgactaatttgactaaactacacctaactgcatctgtagaagatggtaaataccgatcgaacaatgaaaatgcacactaatccaaccaaatatcagcagaatttcagcacatgatgacctactgacctacgtgagatatctcctccagacatattgaggattagcatcatataaataaatttcagcggcttacaagttatactgtctagtaagcaggtccccataactgagtcatcacatcacatgtttgaactttaaattttactgtggtttgttcaagtgggcgacctaacgaatgcccaatgagttcgggtagttagactactgatcctgaatttgcaaaaaatttcacaatttgacccttttgcaaaaactattttacaaatgaaccgtcagcaaaacttatttcaaaaataacccttggcgctgaacttagacacctcagcgccaaatagcgtgacgctaaatatgcattggcatgctgacttagtctcccatccgcggtggcacggcattcagcgccagttgacatggcgctgaagtgtctaagttcagcgccaggtgatttggtgctgaccaaaagagtcatttttgaaataagttttggcagcggttcatttgtaaaaaaagtttttgcaaagggacaaattgtgaaaatttcagctgaatttgtgtcatttgtcactagagctacatattatccagagttccacaattcacaattcctttccacacgctaggattgctagactatgaacaaatggatacgaaatcaaaggcggtaagtgaccagccgcgaacctcaatcgaagtgaagatgaacaatctccccgtcctcgatgtcgctgtcgtcatcgtcatccgacgaggacgaggaggaggaagggaaaggggagtacataggttcgacttcgacgaactcctgaggcgggaggaggaggaggcggcgcgggtggccttgcaggcgaggggagaggaggcggggcatggcttggacggggacgaaggggatgcagaggaacgcggcgaggcgggcgaggaggtggagcggcgcgcagcagagcagcccgaggacctggtcggcggggagcgtctccgggttgcacgccacgcgctgccacgccgccgccgacgcccgcgccaccgccaccgcccaccccggccgcaccgccattaacacgatgccccaaaatccaaaatccgaattcccctcctcctaggatgaacctaggggtgtcgtgacgaggaaggcacgagcgcgcgagcgcgcgtggggcctcgccggccgccgggccgccgcgaggatctcgccggcggggctcggattcggccgcggcggcggttttccgtcgttggatcgatcgatcacggtggctgggttggcgtggcgaggtagccaactttatctactcggatgcgcacgtggactaggggggaggttgactcgacggccgacggcgacgggtggaccccacatgtcggtgggatattccttcttccgggcggaacgctcggatctccgcgatggctctgcggagaaaatatctttcattccattttttacgggaattttgtgaaaattaaactatttcctgcaaaatatctgtaaaatccttgcgttagtaaaggagtcctaaagcattctagctgagattactgcataatgaaccctagctaatattagggagtaattggtaattgaaattggtttaaaccatgtgctacttgtcactgcgctattaagtacatctcaagagcacctatatatccatattcaaatcttgaagttgtttttttccttttaataggagtagaagggcatgtttggattgctatcataccaaattgttggtagtgtcaaattttagacaagttttgacattaccaatattttggcaaagatttctattgatttggcaagttttggcatcaatccaaacatcacacaagtactatttaggctaccaaaaaatttggtagggcaagatttggcactaaaccaaaacagcccgaagttattttagctcttatggatttcaacaggccaagagctctattacgctctcattactattctagatcgtgccggagtatatttgacaaccaaaagctgatactttcatggacttgaacaagctgagagctctaatgctattttaggggtttacaaaaccgcgcggtaaccttttcagtttttgaaaccacggtatgtctcgtggttaccgtggtaaccgacttaccgcgggggtgcggtaaccgcgccaaaaataataagaggaaccctaactcgttaggaagaacaagccggaagctctattactatactagctcgtgctcgtcaattgtcataaccagtagctgctcaaatgaaaggctgcaaaatcatccatgacatatgcaaaataatactctctccatttttatctcattttacattataaggcatattaacttttttatttaagtcaaaattgtttaagtttggctaagtttaataaaagtatagcagtacctttgacaccaacaaatatattatcaaaatatttttcatgttagatttaatgaaactaatttggtgttgtaagagattatacattttttttatattagaaaaaaagtcaaagcgtattataatatgaaacagtgggtgtagttgtaaacataaagcaattctttgctcaggtgaagcacaatatacatgaataatcgctcaaatgcgactctgcacaaacaaccatgaccaagaaccatggcataatcaaaacaataggtggtaaaacaaaagccattctgagcaaacaacagacattcttctcatgtgaagcacaatacatgaagaatttacgacaatgatgtaaaagaaaaattgttgctgttaaattaacatatttgaaaaggatgcgaagtaatcagtgacgaccaatgcatcacacacgaatatatatgaaaatggaacttcaaaatgagagacagtatcatgagtcatccactgcattttatttgatgcattgtggtgggaaaaaacagcagggcctatcaagataagacttcagggaagggtcctctggtgaaggggaagggctcccagttcttcacgctctaatctctccttcttcacctgcaacaagggggggaaagggcatttagactagcannnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10945 - DNA, 1195 bp, Oryza sativa
  unsure (1)..(1195): unsure at all n locations
nnnnnnnnnnnnnnnnnnnnnnnnnnnnnnnnnnnnnnnnnnnnnnnnnnnnnnnnnnnnnncccttttaataggagtagaagggcatgtttggattgctatcataccaaattgttggtagtgtcaaattttagacaagttttgacattaccaatattttggcaaagatttctattgatttggcaagttttggcatcaatccaaacatcacacaagtactatttaggctaccaaaaaatttggtagggcaagatttggcactaaaccaaaacagcccgaagttattttagctcttatggatttcaacaggccaagagctctattacgctctcattactattctagatcgtgccggagtatatttgacaaccaaaagctgatactttcatggacttgaacaagctgagagctctaatgctattttaggggtttacaaaaccgcgcggtaaccttttcagtttttgaaaccacggtatgtctcgtggttaccgtggtaaccgacttaccgcgggggtgcggtaaccgcgccaaaaataataagaggaaccctaactcgttaggaagaacaagccggaagctctattactatactagctcgtgctcgtcaattgtcataaccagtagctgctcaaatgaaaggctgcaaaatcatccatgacatatgcaaaataatactctctccatttttatctcattttacattataaggcatattaacttttttatttaagtcaaaattgtttaagtttggctaagtttataaaagtatagcagtacctttgacaccaaacaaatatattatcaaaatatttttcatgttagatttaatgaaactaatttggtgttgtaagagattatacattttttttatattagaaaaaaagtcaaagcgtattataatatgaaacagtgggtgtagttgtaaacataaagcaattctttgctcaggtgaagcacaatatacatgaataatcgctcaaatgcgactctgcacaaacaaccatgaccaagaaccatggcataatcaaaacaataggtggtaaaacaaaagccattctgagcaaacaacagacattcttctcatgtgaagcacaatacatgaagaatttacgacaatgatgtaaaagannnnnnnnnnnnnnnnnnnnnnnnnnnnnnnnnnnnnnnnnnnnnnnnnnnnnnnnnnnnnnnnnnn

SEQ ID NO: 10946 - DNA, 720 bp, Oryza sativa
  unsure (1)..(720): unsure at all n locations
nnnnnnnnnnnnnnnnnnnnnnnnnnnnnnnnnnnnnnnnnnnnnnnnnnnnnnnntcgcatgcctacatccaaaaaggatagatagtactagtgctactctgaacattttcttgcaagaacagataccctgctactctgctttgagttaatcaccaagaacaaagttggattccctttgctcggaatcaaaatctatcagctataatttcagatttttgcaaagcctaaacggacaacaagaattagatgaaaaatctgcaaacttgagagtcataaataaattcataatcagttattgagttacctcgatcttcttgagccatgcggatgctttctcgacctgctcggtctcccacccgttgatgacaacctcctccctcttgaaccggttgttgatcttggccacctccgccgtctgccacgccgacaccttcgtctccacctcctccttcttcacctgcctcgcctccaccggcggcgccggcgatggccctgccgcggggacaacctccagctgggacgccctgctcctggccggcgtggcgatcgggtggctgtccggcacaattgccagcgggttggtctcctccagctcgtcctcgccgatgctggtgagctggtcaccgccgttgttgccgtcgttggggccagtctgcatggtcgtcccggcggcgaccatggccgtgaaactccggctcatcgtcatgaactgctcctc

SEQ ID NO: 10947 - DNA, 655 bp, Oryza sativa
tatatatagtacctttatggagtcctagctcctaggatcaaccgatcaagcatgtcacttgtgagttgcgaccctatattaaaaatctgcttcaggagtttatgacattaaacaattgttcatacggagactgaaaatgatgccctgtgctgagagatcccctcataatttccccaaaacgtaaccatgtgtgaatagattttgagtaagcagggttgcagccacgagtgagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgatttttt

SEQ ID NO: 10948 - DNA, 544 bp, Oryza sativa
  unsure (1)..(544): unsure at all n locations
cccatgactcctctcctgttcttacctggtatgcattcctgtgtccaaggctaaggctaccgtgtaatgggtttccttatcccaactttgaagcctgctttgtactttgtcccccatgccctgatgctaaccgatcagcccccatgcatgtatccacgtataattgttcgtatccatcttggtgcgtgtgtgttgctagtacacaagctgcatttttgcacatcctcagtgcgttgttgagctagctatgttggataatgattcgattcttgcaccgcttgttgggaagtgaccatttgtatagaatcactggcttttggtagccttgcttcaattctttgtagtttggaaattgtacataaaggtgcccttcaacttcaagtgcttgtgcaagaaaagccagtagaagagagatggattcctccttctctgacgtggttatatgcttttatattcgcgggcgattcagcttgtggatgaagtnnnnnnnnnnnnnnnnnnnnnnnnnnnnnnnnnnnnnnnnnnnnnnnnnnnnnnnnnnnnn

SEQ ID NO: 10949 - DNA, 742 bp, Oryza sativa
  unsure (1)..(742): unsure at all n locations
agaatttaagtatatttttagttgaacacggctattaaaaagtatataaaaaatgatcgaagagaaagtaggtaaataaatgaatgagaaaatgattgtgattgattaaaaaaaagagaacagataaagaaataattttattttaaaacaaggtatactaagttagaaatagctgtagtataatttagcattggaacggagtacattattttttgagttaatttcactttgggccatattttattgccaaaattttcactttggactaccatttgtccaatcttttcacgttggactaggtaactttacctttgttgcacaatgaaccaccccaaaacatatcttcagttcttcgatgacttcgagcaaattgttaacgacatgccagtaaactttcataccaatatgcatgccatacatttgtcgaaagagacgctagacatcactagcgaaaagatttatggtggtccattatgcaacaaaggtaaaattatttagtccaacgtgaaaagattgtatacagggtagttcaaagtgaaactatcgcaataaaacatagcccaaagtacaattcactctttttttttttcactaacacagcggctattactccatttcttgagaaaggctttcctcggaccccacaaatcagtgggcgttacccgtggtcctggcgtggaannnnnnnnnnnnnnnnnnnnnnnnnnnnnnnnnnnnnnnnnnnnnnnnnnnnnnnnnnnnn

SEQ ID NO: 10950 - DNA, 676 bp, Oryza sativa
cgtcggatagtagtttaaaaaaagtgctagcaaacccaaaaaaaaaaatctacatctcaatcagaaaaaaaaaacaaggctgagcctttggatgaaccacaatcttatctcatcaaactgtcccgacaaacaacaatgtcatgtcgtgcattttgtcatggcttcccaagctaaggtggcaggattatgtcactggtttagggtgagggtggtcaagttagttggtgcagcgggtacgaaggtatgttgtagaggatgcatatcctctacattgctacacgctcactgacacaccagtgagtagtactgcatattgtagaggatctcgacgcatgttataggcaatggtgagagcaatccagtgaggtggaggtagcgccactgtaaccattattcatgaagaaggccagtggtgggtggatagtatcaatgttagggtcaatcgggacaggttacaaggcggcgagaaacaatagtcgatccaatagcgtaagccacaaaaaacggagaggtgaggaagcttattggcttgagcgctcttaaatagagagaaaaaaaaaagaagaaagtttgtcttagagcatgaagaagtttttatgcaccatcaagttgcaaacaaaaccgaccgacaaaagtgaaaatgcatccactatggttcaaatcctagtggttaaca

SEQ ID NO: 10951 - DNA, 703 bp, Oryza sativa
aaccattcttttttgcatgggaaataaagtaaccaagtgaagagatttacaacttacaacttccatatttcagtgcacattgatcttttaatatgttttccgtcaccctcacaaagcaggcgtgcatgtttgaggcttaagaattgtggttcatttcttaggacctcttctggatttaaaacttgagttgttttgttgatcccccatcatctctaattttcgtctatttcaggttgcttaggaataaggctctgtgggaggcaacttttgggctttcaggtgcaaagattgaatgcatacttgcattctgtacctgatgcaaaatcattcgcccttgcatctagcactcagaacctaacacgttctgaggttgttcattgataatagttccataggttagaagctctatttttatgattgcattgttttattgtggaactcatcactgggtagtgctgatgaacgccacacactgtatttaaaagttgaaatgcaattccagatattgattgaagatggctgttttctttgttgaaaatatgttatgtattatacttgatgaatgatgacacagcattgtgaagcgcccatcttcgttgtgagtacactggtatttagcacatctttctctctataaggacaggacagaacaaggaaatggatctatcatcttgtcatcttttgctgtctgatggattacttt

SEQ ID NO: 10952 - DNA, 681 bp, Oryza sativa
agcggtgacagaggaaaacatgattgacatgcaaaataaataattgtccatcactccatctagctctcacgagggagatgaggggcttcgaaagcaccacaaagcagtgacagaggaaaacatgatgcacgtgccggtaagtgtcggtaagtgttttcactattctctcttggtagagctgctgataacgtgttagaaaacgatagataaacagtgaaaacagtgaatcccattttattgatctcaatatgtcctcttttatattgaggatttgtatgtgtacaagcctaggattcactgttattgtgatacaaatactccataatatggctgttacaagtcacttgattgatgccattgttgctctttgatgagcctttgatgagatcaaatatggcctcatgatgcttttgtaacacaatgtactctattgctatctgaggagcagcaagctcacaacatacagtacaaaactgccacccattttcatttagaaactcagtagagtggtattagtaaaaactcaattaatcttcagacagaaatatcatctaaagttgcgcaaacaaaggaaagcaacctcaggcttttcgtactcaggatcaggaatgattccttgtcgtcccaggctgtgtttagatccaaagtttggatctaaacttcagtcctttcccatcacat

SEQ ID NO: 10953 - DNA, 709 bp, Oryza sativa
ctgatagccatggaatggagcgccctaccaagctcaaggtcctcggcatatgcgcacgcctgtaaaatccgcgtgatcaggaacctgtccgggagcacccctccctcgaccatggtcaccgcgagcgcgaggacgtcactgtacattcccctgatggcgtacgcgccgatcatggccgaccaggcgagcaggatcccctgcggcccattccgtcgaacacctcccgtgcgtccccgagccgccccgcgcaggaatgcacggtgatgagtttggtctccgcgacgaaccggggctcctccctgctgctgctgcgcgcgggcggcgtcggcctcggctcgtcgcgggggatacggatacgagcgcttctcgattcttggagcgacgaaagcgggaggggaggcgcctgcggggacgccatgacgcggggttcttgcaggcggccatggcggagcttggaggggaagtggtagggtttgtggaggaggaggagggaggggaagggaggaggatggaggaggaggagctccatgggaggagagggagcttcgattcttgggagggttgggctttctgcattatcctctcggtttttcttccgcttggagccgacgccagcgagcggttggatccacggcacgtccacgcgtcgcccatccggattttttttcccctatatgctctgtaataaaaatcgccatatggttatagg

SEQ ID NO: 10954 - DNA, 572 bp, Oryza sativa
  unsure (1)..(572): unsure at all n locations
nnnnnnnnnnnnnnnnnnnnnnnnnnnnnnnnnnntgatgtctggatacctgcacagagaagcagagtaacttcgcacatgccggaacagaaaagaaaaaacgaaatcagcagcgtggtgtgtgcatcgatcctcacccttgttgttggtgtcgccgttccacttgccggccgtgtggttccactcgccgactgtgttgtcctccttcttccactcagatttgacccaccgatcctcccatccatctgttttcacacacaattcagaattcagaaaccaaccaattctagtttctctgaaaaccatatatgtgtacatcacatttcagacaaagctgaaaaggaatgccggtaccaacaacaggatcgaagttctcaaaaaaaaaaaaaaaagaggatcggattcgattaacaaagaacgcacatacacacaaatttgcaattgcttgcttccacaaaaagaaagagatctccaaacaagtaccagagttctcgtacctttagctannnnnnnnnnnnnnnnnnnnnnnnnnnnnnnnnnnnnnnnnnnnnnnnnnnnnnnnnnnnnnnnnn

SEQ ID NO: 10955 - DNA, 873 bp, Oryza sativa
acataaataggatttgagtttgattttgacaaacccatcaagcgtgattacaaagcctaccaaaagatatactactatataatctcttgcttccaagttacaaggagtagtaaatttctttggaacaggctggttgaaaccaacctttaacgtaaacaattctatcgatcgatcgatggcgaaaggaggggtcactttcttggagcgcaacacatcggacggacggagagcgtatacgtacgagggtggtgtctaggaaccggtaaaaataaaactttagctatagccttttattttcactacgtgtgttagtgtgtatctctccgtataaatttaaacacttacataaaatttaaactcgatccaaaatataataaattaagtaaatagaacccttctatttcattctaaagtagctaattcttctgtttcatattgtaagacttatctagatttggaagttgtattgtaataacatagattgaatcacgttccgctggcgatactcttcacctcaacgcgctacgcataacgcattccacggcccatctcctcgcgtgccttttagtattcttgttcaccatccagtcatccacccgtgccgcaaatttgccccgctgcgcccccgtcgccgcctgcgcctgcgggtaggaaaaagaaaaaagatcgtacttcagaagccgtgaattcgacgccgcgcacacgtgccgtgcagataacggtgcgcaaagccacgcaacgaaaggcacgttacgttgccgcgcgactcggactcgcgccctgtattgtgtctgtgtatgcgccgcgctgaccgtacgcgcgcgcgaggggaatgagacgatatgaaatatggagggggggaagagaagacgt

SEQ ID NO: 10956 - DNA, 730 bp, Oryza sativa
ccgcttccactcgtgcggatccccactccctagggggtcggcagctctacttgccttccccggcctggccgagccatcctcctcctccttgttgtcgtcaatgtgcaccgctcatctctccgtcggacaccgtccttctcgccaccagctcctctcctatcggccaccgcccttctcctcgtcatccgctgtgccgtcattcctgtcggccattaccctacaggggattggaaagacaagggagggaggagagagaaaatgttagccacttatatggaggggtagtatgggtcccacgttgattcagcttgtcctgtcaactaaaataggatttcgaataatccaaatttgtaaaatgaggaagcccgttatatatagtatttcaatttagggatgaatttcaaactcgaccatgctagtgatccatctttggtgggccaaatggaggcccaaacctgatcggttgggctttaccttaggctgccgatggaagccttgcttctagcgttgggcttgctaataatacagcgtccggcgttcaatgccaacgagccctgatcccgttcctcacctcaccggcggcggcgaaacgccttcgactccgagcaattccacttcgtcgggcggcgggcggccgattacccacgcccgtttcagcagcgcaacgaccagaacatgtgcagcatcagcaacgacgccaacagcttcgacctcatcgatggtttcctat

SEQ ID NO: 10957 - DNA, 641 bp, Oryza sativa
  unsure (1)..(641): unsure at all n locations
nnnnnnnnnnnnnnnnnnnnnnnnnnnnnnnnnnnnnnnnnnnnnnnnnnnnnnnnnnnnntccattagtaaggacagctgatacacgaacctgcagtttcaaattccacatatcaagtaaatgaattaaacaagatacttctcacttaagcaacaccactctagctgctactcacaagtgcattcatagcaccagcctttttatggtgttggaatccaggacgtttctcacgagacacatagactaaacgaggaagctcattgccttcggtatcaaggcctccactatgaccaaggaaaacctgagcatgaccagacgtcaagagtaagaaaattgctggatcaataaccacaccacaatggcaatatctaagtgatatttacctgaatcattccaggatggtctctggtattgttaccaggccaaggtgtgccatcttgcataatccatccttcctcaggaactttctgtgccttggcgacgagagcattaacacgaactttaaattcttcatattccctctggattttggttttgcaacagacattaatgcgagattacaccaaaaaaaaaacaacaaaaaaggtcacacatataaaccaaatttaccttcatggcacgacgatctttaacaaaagaa

SEQ ID NO: 10958 - DNA, 736 bp, Oryza sativa
  unsure (1)..(736): unsure at all n locations
nnnnnnnnnnnnnnnnnnnnnnnnnnnnnnnnnnnnnnnnnnnnnnnnnnnnnnnnnnnnnnncgatgaaatggaccaaacagtttgcagcttcttcacttcactcaccaaatgaccaaactaaaccacacgctatcagctagatcttaatctatacttaaccctgaatgcatcttgaatttgtacccattacactggcttggtacattaattgtacacttaatatacatacatatacatcggactcgatcgagcaggaataatttagaatgctctacctaacgagctaaagtttaattaagttgagcaactcaaaaagaagtgtatgcgtcaggcagacagatcaggcattatttttcagccaatcttctcagtgttggtgtcgtctgttggccagatgaccgtctccatgagccgctctcgcatcaacgccaggttctcgtcagatatcctctcgtacatcatcgcatggtcacatttctgaaagatcaaaaccagaatctcatttggttacaaacttcagagctttgtgatggattatctaagagtaccaaaaaggaatcaccttgatccatttgctgtacaagtgaagcctagttatcatcactcgctctgcaagctcctgcttcttctataaaccaaaatgaacattcatgcgtgcgcaatttttctttagttttcagttaacatttgcatcgtttaaaagtttaaacaactgagaagaagtttatatatt

SEQ ID NO: 10959 - DNA, 925 bp, Oryza sativa
tgtttcttttggttgattaattgattggcaaatgcacagcgtggcctcgtaaatgagtacgttgtataagtgtttataagtgtgtgtagtcttcagaaaaaaaagcagcagttagtaacttatgtagtactactcgtgtagctcagcaaaaagatggttttgatctgtgcttgatcagctcgagcctgaaggtctagttgttatcccttataaaaagttttttcgtagcatttcacatgcattacgccagtgcaaatcatcttatcacgttacgcggagagctagcaagctttgcaaaggcagtttagtacatgttcagatgagtgcttccatacgcaaaagatactactactactggacaacacaaaatcccagtatacgtccaatccgaagactccaaacacgtacgaaggcaagggtttgtgaaccaaactaccaatgaccacaggttgcgatcgattgcgccctcaataatctcaaatccaatatcctcacgtcttaacctctaccggtctctttacggtcgaacgggtcatccagtgcagtacaggacaattgccagaagtcgacacgacgaattactacctgtacagtagttcgtcatctgaactggcgatgttactattggctggtcatcggtttaattcgcgagcaagtatgctctgctcatcgtcgacgtgttcatcgtgcaggacgtggaagtcccgggttggggatggacagctaaaagtgggtggtggtggcgacccgtcgctttcacccggataagagcctgtccgcttcctccgccttaagctgatcaagctagcacacatcagcaaaagaaaagaggagtacatgcaattcgggcccaaacccaacccgggccgggcacctgtcccggcttgcggttttgccacgtcttttttttccccccttcatattt

SEQ ID NO: 10960 - DNA, 615 bp, Oryza sativa
caaacgtttttttagaagggattactatgcgcgaggagtgctctgttttttcctttttaagaacagagtactgcgatacaggctgcgtgcagttggcatttgtgtctatcacaacctcacaagctgtccaccctttctcactgacagtaggccccacggtccccacacgcccatcccggtcacactttctgtctgcatgcgaccacggtccagccgacgcgcactccgcccgtcactgccaggtgggccccacccccagctcacctcatccgtcacttcacttcactcctctccccgaaccccgtggagtaatcaaaaccccagcaacaacccaaccatctcatcttaaatgcacgccaaaaatctcgaaattttacgggggttttaattaccaatcaaccgctaaaccccggagtagagtagagtgatacgcgagcggattcgatttacttcacgctcacgcttgcgggtttctcatcctcgctggggccacgtcctttccttgcccggttgattcttgcaagccctctcattcagcttgtgctggtagctaccaggtcggctttggcggtggcggggggccgcctctgaatccaaggcgatttggtgtctgac

SEQ ID NO: 10961 - DNA, 690 bp, Oryza sativa
gcttttgtccaccgttagtcatctatgaattctaccagtaattaatattccttgtatctggtgtactaacttgcactagtttgtacttggaagaacataggaaaaattcttgcataattcgaaatataattattttgtgtttacaagtataccttgctattaagcaaggcaatatgcacatttaatggatcagattctaaatggttgtacatctctgaaccttataatgcggacttatcatatagcttgccactataaatgttgtgctatctgtattacaggaatgatgaaacacgccaacctctatcgagaaaagtgccaatttcgtcatccagaataaatccgtacaggatggttattgtgctccgattgattgtcctatgtatattcttgcactaccgtatcacaaatcctgtgcgtaatgcatacccgctatggttgctctctgtcatatgtgagatttggtttgctctatcctggattctggatcagttccccaagtggtccccaatcaaccgtgaaacttacctggataggctggctttaaggtgatgtacaatatttacctctgatacaccattcctgcgttagcactgtagtactgattactgacaataacaaaatatcacttgcactctcaggtatgaccgggaaggtgacccatctcaattggcttctggtgacattttt

SEQ ID NO: 10962 - DNA, 439 bp, Oryza sativa
  unsure (1)..(439): unsure at all n locations
aaaaataaaaccgatttataatataaaatagagggagtagttgcattacctgtcttaatggtgcagtcgctgacttggacgttcttgctgtgggtgatgtggatgccatctgtgttggggctcgtgccgggcgcagagattgacaggtgggccagctccaccccggtgcaatcctccactgacatgtggatctgctggctgttcaccatcttcagaccattcacgctcaggttgtcgcacgtgtggaaactcagcgcctgtattaattacaaacaaaatgaatcaaattaaaaggtactacaaaaattgagtaaatgaaatttggaaaaagaagagaaaaaaaatattgcatttcgcatgcatgcacgtaccgttggagctcccttgcatggctgaaaagnnnnnnnnnnnnnnnnnnnnnnnnnnnnnnnnnnnnnnn

SEQ ID NO: 10963 - DNA, 649 bp, Oryza sativa
  unsure (1)..(649): unsure at all n locations
nnnnnnnnnnnnnnnnnnnnnnnnnnnnnnnnnnnnnnnnnnnnnnnnnnnnnnnnnnnnncaccacacatccgttgtcactgcactattaagtgcatctctttatagctagatcatcaaggatcaagatttatctttgtgatgatgtgtttgaaggttgtatcggtgaaggatctggcagaggattcgccgttgccatggtacctgcctcttgattccagccagttctcactcaatggcttccgtctcacccgagtcggccgcttgatcactcacatgctggttcttaacattttactgatataccatgtactccaatctagaattgtagtattatttgtgtcgaactcagttataagttactactacattttaagaccgagcgagtactgaagtaaatgaattgttggtagagtgcaattgacgttcttaatttacctctaaaaatctttaggttaagacgctcgagtgcctccatgttgccccacaaggcagcctgagggtcttcagctttcttgagaccgtggcccaagggcttgtgaaaggcgccaagtaagttgatcggcctcgagcaaatctgaagcaagaaaattttgaatttgtgcccaaattatatcaatctcccaaacagttatgctgctgaatgaat

SEQ ID NO: 10964 - DNA, 620 bp, Oryza sativa
  unsure (1)..(620): unsure at all n locations
nnnnnnnnnnnnnnnnnnnnnnnnnnnnnnnnnnnnnnnnnnnnnnnnnnnnnnnctaagtagagcaattagcaaaccatgatccgaaaggagagctctgaatcgtagggggatcatcacgccttcaatggctggaccttgacctgatccagcacggggccgcacagcgagacgccgtcgctcaccttggtgtggtagtacgagctgtagaaggtcaccctggtgcgcacgccggcggcgacgaaccggaagctcgccggcttgaacccgccgtttccgacggactcgaacggcaccttctgcgtcacgttcccggcgaacgccttcaccagcatcgacccgtggcagccgttcttggcgtcgccgacgacgaacgataggttgtaggcgcggttcggcaccgtgcggatcacctgcgcgatggcgctctccctgccggcgacgagcttcacggcgtactggccccgcgggacggagaaatgccccgcgttgatgaagcggacgggctttgagcgactcgatgattcagccccggagcgggggacgtcgcgttcttttgctttggcggaaggaggacccccaccgtcgagttcttgaacacctgcggcccgatcttgaat

SEQ ID NO: 10965 - DNA, 649 bp, Oryza sativa
  unsure (1)..(649): unsure at all n locations
nnnnnnnnnnnnnnnnnnnnnnnnnnnnnnnnnnnnnnnnnnnnnnnnnnnnnnnntgcctttaaggtctgagctacaaacttgctagatcaggaaggatctaatatacaacgagttcggtcgaaaggcttagttctagaagacgatttgtttggaacaacgaatgaacaaaaaaaggaaggagatacaggggtggtgaaaaaaggatagtaggagagccggtgatcctccctctctaaaatagccggtcaaatctgtctagttaaagaaagaaccagcaatgtaccaaacagtctccagcaaaaggcaaaaaaaaaagatcccgctctgtatttctatactgaaacactctcattgcaaagagccttcaatcctctagccctctgcaaaaagtttttccttgaattagcaaccatcaaactaaaatttggacaaggagctaaaaggaaaataacaacaaagctagggttacctttatagcgcacattctttctctaacatcaaacctctcatgagacaaaatagacagccatgctcctggacttaccatctacaacaagcccaacaatgaaacagaatatggaaggggtaaaaaaaagcgagcatgagcacataaaagaacaaaatttggcagtaatctttgggaaag

SEQ ID NO: 10966 - DNA, 1221 bp, Oryza sativa
cttatttgtgcttaattgcaggtcattgctgagcatttgtctgcagaggaagcagctgacataaaggacatgtttgataaaatggatgtgagcaagaatggccagctgacctttgaggatttcaaggctggcatacgtaaacttgggaatcagatgcctgattcagatcttaagatattgatggatgctgtgagttatcattaaaaatggtctaaactagaataaaaaggactggttctggttcttggcgatacatattgatgttcgctcattgctttgcaggctgatattgacaaaaatgggatcctggactatcaagaatttgttgctgtgtctatccatgtgaggaaaataggcaatgatgaacatatccagaaggctttctcatattttgaccaaaataagagtggttacatagaaattgaagagcttagagaggccttggttgatgaaatagatggcaatgatgaagacattattaatagcatcatccgtgatgtagatacagacaaggtcagcttaatcttttcttaaccagccattatattgcatgacattgttcttggtatctatgcaatgacttcaattatataaaagttataagcccacagctagtgaaatctatgaatatcatttgctagaagctgaatagtgccacatacttgattacctggtagccagggttcaaatgtttctacctttggctgcaaggcagggtttatttaattaaagggttggtgaatgttatcattgacctatactatcatataataagttgtaaccggatggacaaggatagtctaattagacgacataaaacaaatgacataacaaacaaacaactggggtaggcttactggagatgattctagtgcaattgttagttgaaagtaacattagcaaagtatgacctgttcaaattccgtgtgattgaacttgtcgatatggtcatcctaacaacaatgcaatgttttcttttcatttattcttttctcaggatgggaaaataagctacgacgagtttgccgtcatgatgaaggccggcactgactggaggaaggcatctaggcagtactcaagacaaaggttcagtaacctcagtctgaagcttcaaaaggacggatccatcagtgacgacacgcaatagactggacagagaaaaaaactacgcttacgttttttctttgctgtgtgctggctgttacattattttttcacacc

SEQ ID NO: 10967 - DNA, 878 bp, Oryza sativa
atgtgtgtataaaaggtttgatgtgatgaaaagttggaagtttgaaaaaaaactttgaaactaaatagggcctaagtctgagttacaggacacgttaaaaaaaaagaagaagcaggaggttgtagaggtcacaccaatgggttagaaggaggatggaattcaagttgccgattgccactgcagtgcaaggctgctcattgacaccgacagtgccctgtgcgtccgtgtgtccctcaggcagagaggcccagacaccactgccattgttgggccgtttctcgcatccaaaacctatactatttcggccgggccgtcgcccccgcccccattagtccattccacctcccgccacggcacgcagccaaagctctcgttctcctcctcgctgctgtgcccgccgagcgaacgatcccgggacaccacaccacaccatcatttgcacgggatatccgatcgatttgagtcgtactccagtggcgagcacgtacgtacgctttccgcggccgtgtgcccgcccgtgcgtgcacgaagctagctagcgccatgattcgcgaccaggagtccgcccgcaaaagagaggcccccggcccggcagaatgtgcgcggtgcccggctggccgtgtgcgccgcaacgaaaggttttgccagcggaaaagaaccaaccgctttacagccaacagaaaaaaccggccgcactccatcgcatttttcttttgcccgaaagctcgccccgttgtctagtttgatacgagtactcgaatagctcgccagcccagccacctctcgccgtgcgggcgtgcggcaccgcacccatacgacggtagcgatcaggttcacagttttcttcgactccaaactttaactttcttattttccat

SEQ ID NO: 10968 - DNA, 577 bp, Oryza sativa
ttgatcccagccgttcccggcccaaccgaacaatgccttacagttttgtaatagcctggaaacagtgctactatggctccgttcaagtttactgcagtaaattaagtacgggcatgaaaagaaaatcattaacatataattaattaaactttagttactttaaacataaaaatagatttatctaatattttaaaaatagcttttatataataaattttctcatgaaatatgccgtttaatataatttaaaaaacgtgctaacgaaaactgaagtaacatctgtatctagccgggcctgtggtctaatcctgaatacgtggacatcacaaaccgatcctcacatggcctcttaaattcagcacagtacaattgaatatagcgtcgtgtatctacatccttgatgatcttgacgacgtcggaaagcgattcttgatactcaagtacgagatttatgaatcctcaattctcatgtcccttgagcagtacgtggacttctgctgttgccgactgaattcttggcattcaattctcaactgatcaacctaattcagctctcacatcaccgccggccacttgg

SEQ ID NO: 10969 - DNA, 714 bp, Oryza sativa
tagcaaattggaggaatcttcccattaaaaacaataggaggaatgacccaaagcaacagttgctaacatctaaatcttttttttttctctgattcttgtgacagagctgagtcacatttttctatttgccggaacaagtttgacaagctttgccaaatcataagacttgaaatctcttccaaaacacaagcttatatccaaggcagtccttccatcctgtaaccaaatctgagatcagaaagcagtattggcctatagactgtaatacaaagctgatgtccatggaaatacgagcatttgagatgacaatgccatagaagtcaatttctgtgaagcggctaaaaatgacatgaaaatgtatgccaatttgccaaataaaatcaaggctctgagtgcacaagaggcagctgttataggtctaattttttgggataatgcaattccggaaaaaaaaacccagtaaaccataggggcataacataccttggttcttctcgtcttatctgcaccattgacaagcaatatctttgctatatctctatttctactctgtatagctaaatgcaacggtgtccagccatcctgcatgaaacgagacaaaataaaagaaaaatcaatggcactgaaaagggttgaactaataagaaaaaaaaaagcaccatagcacattacattatcagcaacattgacatcaaccctattcttaatcagtaa

SEQ ID NO: 10970 - DNA, 698 bp, Oryza sativa
  unsure (1)..(698): unsure at all n locations
gggcgaattcgagctcggtacctgatgttctcaagttcaatgggaaaatccaaacccttaaacttggttggtgccaggtaatcttcataactgaatggaatcgcggatgcagatttaagttatatcctcttcagcctggttacatattttgcagataggtgtatcaggtgcagaatttgttgctgattgtttgaagtacaacacaacattatctacattggatttgagggcaaatggacttggagatgatgtatgcacaatcttcgttgaattttatttataacttgcgctttgattcatacccatgccttctgatccttctctttttgaagggtgctatctgcttggctcgaagtttcaagatcatcaatgaatctttgacttcacttgacctgggctttaatgagattagagtaagtaaacactaaatgcagtgtctttttctttttgtattttctattggtgggtctatgcagatctccaccatgttcaataccctttatgctcctaacaggatgatggagcatttgcattggcacaagcacttaaagctaatgaagatcttgcagtcacatcattaaatcttgcaaacaacttcttcactaaatttggacaggtcagttgccnnnnnnnnnnnnnnnnnnnnnnnnnnnnnnnnnnnnnnnnnnnnnnnnnnnnnnnnnnnnnnnnnnnnnnnn

SEQ ID NO: 10971 - DNA, 373 bp, Oryza sativa
tggaggaggatgaggcgagtgccaagctaccagaagacagtacgacctttgagaagccatcggagaaagatgatgctggcaccaagcagacagaggaccctgtaactcttgagaaggaaccagaggaagacaagggaagtgtggagccaacacaggacaatgctggtcttgagaaaccgttggaggaagacgaggcgagtgcgaagccatcagaggacagtgtggttcttgataagccatcagtggaagatgatgacagcgccaagccatcagaggatagcatggaccttgaaaagccagaggctcacaaaccatcagaggaagaagatggcgcgaccaagtcatcaccggaggatgctgtcgttgaggaggc

SEQ ID NO: 10972 - DNA, 571 bp, Oryza sativa
aaacccaatcaccaacttgaaattccctgaaactcctcttcttatctgccaagtgtttcatttgttgctgagctctgttcagatgttgttgaagcaggtgttgcataaatttgcgctgctgcaaccattgagacacatttggtatggcacagtcattgaggctgatgccaaagtgactaggtttatagccatacaggacttcaaatggggacttgttcaatgtggaatgataagaagtgttataccagaattctgccaagtataaccattgggaccacttagtcggagtggcatggacaaagcatctcagataaatttcaaggcattggttcaccctttctgtttggccatctgattgaggatgatacgcggagctcatatgcagttttgttccagacctcgcaaaaagttgctcccagaagttactggtaaagactcgatctctatctgaaatgataatgttgggtaacccatgcaacttggtaacatgtttcaagaattcaagagcaacagttgcggcagaaaatgggtgtgaaagaggaacgaagtgagcatatttagaaaacttgtc

SEQ ID NO: 10973 - DNA, 706 bp, Oryza sativa
  unsure (1)..(706): unsure at all n locations
nnnnnnnnnnnnnnnnnnnnnnnnnnnnnnnnnnnnnnnnnnnnnnnnnnnnnnncaaagtggtactccttcagatatagcaactagttcagctttaacagtgtcttccttttgagaaagggcatcagcagccgagttgtgaattcctttcctgtaacatattttgtactgcagtcccaacagcttggtataagctttttgttgccaaggtgtgtgtaatctttgctcagacaagtgcttgaggctatgatgatctgtgagaatgagaaattctgcatgctgcaaataaggtctccagtggtccacagctagcagtatggccatatattccttctcataagtagataaccccttagacttgggacccagagccctgctgagaaatgctataagatgattgtcctgtgatagaacagcaccaatggccaactcactggcatctgttttcaggggtaactgttttgtaaagtcagggagagctagaacaagagcagataccagagccttcttgagatgttggaaagcattgtcagtgtcctgagtccattgaaatggaccccccttccttagcaattgatttagggatttgttaatctttccaaatcccttcacaaattttctgtagtatcctattaaccccaaaaattcccttagttttttgacagtatagggtacagcccagttaaccacatgttgtattttttta

SEQ ID NO: 10974 - DNA, 10876 bp, Oryza sativa
  unsure (1)..(10876): unsure at all n locations
ctctcagacagctcatgccagctggttgttaactggacccattggtcacccttgtagcgtggattggccctccttgctcttggcccaagctggactggtacttgcttcttcttggtcttgaagtctggttttcctccttgttcctgggcatctgcttccttgtcgtcaggctccagcacctcttcctcttctgctccttcttgtatcatctcttctgtatcttctcttgctcttggtggagatggaggcctgacaagcccccattcttggaaaccggcttgcccccaagccggtgcctgaggaaatcttgactgcaagtcctccatgtcctcccatgtagctgcagaagcatcacaacctgtccattgagttagcaattgagtaatgggagtgttacctcttttagtcactctataatcaataaactggtgaggaatctgaaaatgattcagatcaggaggttgattagagtgcactggatgagagaatccctgggctgctttcaattgtgagacatggaatactggatgtatgtgacaggaagcaggtagttgcagtttataagctactgagcccactctggcagagatttgaaaaggtccaaaataacgaaaagataacttgtggttggctctagtagaaactgatgtttggacataaggttgaagtttgaggtaaacccaatcaccaacttgaaattccctgaaactcctcttcttatctgccaagtgtttcatttgttgctgagctctgttcagatgttgttgaagcaggtgttgcataaatttgcgctgctgcaaccattgagacacatctggtatggcacagtcattgaggctgatgccaaagtgactaggtttatagccatacaggacttcaaatggggacttgttcaatgtggaatgataagaagtgttataccagaattctgccaagtataaccattgggaccacttagtcggagtggcatggacaaagcatctcagataaatttcaaggcattggttcaccctttctgtttggccatctgattgaggatgatacgcggagctcatatgcagttttgttccagacctcgcaaaaagttgctcccagaagttactggtaaagactcgatctctatctgaaatgataatgttgggtaacccatgcaacttgtaaacatgtttcaagaattcaagagcaacagttgcggcagaaaatgggtgtgaaagaggaacgaagtgagcatatttagaaaacttgtcgaccaccactaggatgcaattaaaatgatgggacctgggtaaaccctcaatgaaatccatagagatagtatgccaagctgctgcaggaacaggcaggggttgtagcaaacctgggtatttggctctgtctggtttggcctgaatgcatacctgacaggtgttcactctggtctgtatcattcttttcatgccagcccaagcaaaaagcgctttaattcttctgtaagtaacagggaatcctgagtgaccaccaatgggtgcagagtgtagagcatcaataattttggattggaggtcaccattctggccaacccagatcctgcccttgtacattaatatgccttgcttcagtgtaaaatgaggtctggcattgggattgatagacagttctgctagtaattgtgtggagttggaatcagtctcataactttgaatgacatcctgcatccaaagtggtactccttcagatatagcaactagttcagctttaacagtgtcttccttttgagaaagggcatcagcagccgagttgtgaattcctttcctgtaacatattttgtactgcagtcccaacagcttggtataagctttttgttgccaaggtgtgtgtaatctttgctcagacaagtgcttgaggctatgatgatctgtgagaatgagaaattctgcatgctgcaaataaggtctccagtggtccacagctagcagtatggccatatattccttctcataagtagataaccccttagacttgggacccagagccctgctgagaaatgctataggatgattgtcctgtgatagaacagcaccaatgccaaactcactggcatctgtttccagggtaaactgttttgtaaagtcagggagagctagaacaggagcagataccagagccttcttgagatgttggaaagcattgtcagtgtcctgagtccactgaaatggaacccccttccttagcaattgagtgagggatttgctaatctctccaaatcccttcacaaattttctgtagtatcctgctaaccccagaaatccccttagttttttgacagtattgggtacagcccagttaaccacatcttgtatcttcttaggatcagtggaaaccccctcagaaccaatgatgtgacctagataggatatctcttgttgtgcaaaagaacatttggacaatttcaccttccagttgtgttcagatagcagctgaagtacttgtctcaaatgctccagatgtgctgtgagggttggactgtagatgaggatgtcatcaaagaataccagcacaaatttcctcaatacagtggccaaggttgtattcattgcacccaaaaatgtggcaggagctcctgttagtccaaatgacatgactttaaattcataatgacctgagtgtgtttgaaacgctgttttaaattcttccccctcagccatccttatctgatgataccctgctcttaagtccaatttggaaaaccatttggagccagccagttcatccagtaattcctcaataattgggacagggtatttactcttcactgtgacagcattcagctgcctgtagtcaatgcataagcgccaggagccatctttcttcttaactaagagagcaggtgatgaaaaggggctctgactaggttggatcactcctgatttcagcatctccgccacctgtcgttcaatctcatttttaagtgcaggtttgtacctgtatggtcttaagttcactggtttagctcctggaataagtggtatgtgatggtcacaagttcttttaggaggtaagccagtgggttcagtgaagaggtcttgaaattcttgtagcaggggctgaacctcagcaggcacttcactagtttcttgttcagcagtttgaatgagttgcaccatacattctattgaatcagttttagccataccttgcaattggtggacagatatagtatcacactgatccaactgaggaatcagtccctgtaacctggtgagctgctggttatactagaattctaaccatttatgggaccaattgatttgcataggactatgctgctccaaccaatccatgcccaatatcacatcatatgaacccaaaggtaaaagtctgaaatcagtcttaaaactgtgtccctgagtccaccagctacactgtggtataatcctggaacaaggaatctggccaccatctgctacttgcactttcaaaggagactgaagagcttgcaagcctctcatgtgttgacctttttgctcatcaataaaagagtgtgtgctgccagaatccacaagcattaaaagttctctgttttgcacccatcctcttaacttgatagacttagaagattcagaaccatgtaatgcttgtgaagatatggacataagtgtatcttcatctccctcaggaacactgctttgatttgaaataatctcaggatcagcctgaattgcttccaatagttcctcaaccacatgtaactgtattgtagtagcacacttgtgatctctactccatctctctccacaggtaaaacacaatcccttagatcttctgtaagctttcagggctgatatcctatcttctctcactctaggtgattcaatgtttctcttgtcttcaggggattggctgggactggatctgtatgagttaggagaaatgggaggagtagcacttctgggtggggatttcaaataagttccactatcagatctcttgaaactatttggttttgattcagcagcagtttcttcctgaagtagagctaaagaacacgcagtgtccaagtcttgaggcctttgcatcagaaccatggatctaatatcatctctaagaccttccatgaattttgtaacgaagtaaatcggcggaacagcttgctcataagccagtaactaatgcattacacaatcaaaacgctctacatactctccaactgatcccccttgtttcagatgaatccactgtcggattaaggcctgttgtctatcacgcgaaaatcttgcacacaccttctcgcacaaatcagaccaagtaataccaatcagttgattcctcacagattgaagccagaatgccgcattaccacaaaaattcagagtagccacttttacccaattctgcggtaaaactccatagatgtcaaaataaacttcacaatttgctcgccacatctggggattatcaccgttgaactgcggacaagtcatcggaggaacactaccacaaactccagtggacattgcagagaaagtactgtgttgcgcagacgaatcaaagctgaaaggagcagcggagtcaggaggagattcatgcgtaccctgggcagaagccggagtcctgaaccctgcggacgcagccgccacctcttcgttcgtgttcatcacgcgcggcagctgcttctccaaatgctcgaccttggagttcagctttcccagggcagagttcagatcctccacccgcttctctacctggggaaggcgcccctccaccatcgccttgagttccatcagatcttctcgggtccgatcttccgccgccatcctcttcttctcattctcagctatggtcttcaggagtacatcgaactttccttctatatccatggcgctacacactctctcacttgcccctcaaattcccgctccaaattcagctaaccagtcaaggcaagttgccttttcgcggaaattccacctccgaagagacggattccaatccttgaactggaattttacagccgaaccgagagattgtaggaagagtggctcaaatttgcgctctgataccagattgttaggaactcccaacgattatctctcaggaactggaattaatcacgaattgcacatacaagatttctcaaccccgaaggatcgagccgccgccgcctacgccaccgcgcatattccagttcttagccgccttctacttgttcttcgtttgcgtttatattacatagtttcggctgatctctctctctctcagacagctcatgccagctggttgtttactggacccattggtcacccttgtagcgtggattgggcctccttgctcttggcccaagctggactggtacttgcttcttcttggtcttgaagtctggttttcctccttgttcctgggcatctgcttccttgtcgtcaggctccagcacctcttcctcttctgctccttcttgtatcatctcttctgtatcttctcttgctcttggtggagatggaggcctgacaaggcgccgccgccgttatctttctttgtctgctggactggttttcctagcagttgtgggcatggttcttacatttctggtggtaacaactgatctaacattggactctggcaacagctgggacgatcttattttcagtattaccgtcggtgtgttcgtatttcttctgatgtttggtcgggtgattttcgttttgtcaatcttagcaatcccgatatgttggcggcttccaatgcagttgtggaggggcaatcatctgcatttctggcaggacatactgaaagtaatagctgcagctatctttcttgtttatgtatccctcggttttctcatgaccgtgttctctgtccttgaagttgttctcgcatttttctttgtggagattgaaaatgtcactcctagtagtatagaattttgcagctggcacgggtgtgtgatccaacatggtgacctaattgctttgtaccccagttgaggttttgtgaaaatctcttagcttttctcggctactgctgttgcttttatcagtcgtggttctgtaatacgctgctttgctatcgaactgtagctgtagtcctttgtaacagaatttgtttttcatgctatagaaagctctcctactaggcactactacagagtaccttatcactaataggtgaaaagcatcatcaataatggttccttttacccattacagtatttgtgtcactggcatgggatatatcatccataatggttcatgacccgttacagatccattgatctctaacggttttgttaaagtttgtgtcaaatatatatataaagtcggttacaaattaggattaaagttgtattgtattctaatagaagtagagtaatactcttcctaaactctctttaaatagagagacacttgttataaccgcatgacgactgtagcaaatgagggaatgattgaccaatagtgttgtaagtcaaacagtataattgccagttaatggttgttgatacccttatatgtgtaattatgttggattagggaggagcgcctataattagtgtctcggggatataggttccagctgaactttagttaaatatcatggcacgatgtcgccaccacgtttggatcttagtgtatttttgcgtttgattgccaatgtctatttcggtgttggttttataataggttcacaattataaactattatagatgtgaaatattagggggaaatattccgtttacaagttataaaccgataggttatagatgtggattattgagacataaaagaaagaaatggcacactggcggatgtcaacagctcgcccaccgtgcttgtcacaacctcacagaaatcacaaaaggaaatgcataatagaacttatacattctggcaaacatattcagaatcatcaaaaagaattgaatgatgttccgtgaaggaagaatcaaaatattacaatgatcaactcaaaggaaaacaagaatgatatgaaggtgccaagaaagctactaacaagtttcgggggaaaaaaagcagtgtcctcccttcttgatgcagaagacgttcacctgcaacaaacagatcgtcctcatctcatcagcggcaacaatcagttgatcatgcacaacgaaaaaaaatacattttacaccctcgatcaaagcaagtacgatgtgtgtgtacaaaggtgtgtattcgcttatttcttacatctaattaaatgaagatttagctaggttagggtcagcttgaatggactagggtgtgtttagttcacgccaaaattgaaaatttgtttgaaattagaacgatgtaatggaaaagttgaaagtttgtgtgtgtagaaaagttttgatgtgatgaaaaagttggaagtttgaagaaaaagtttggaactaaacaaggactagcttatatggttatacctagacttgaggccctgtttagatcccaccccaaaatttttcaccctgtcatatcgaacatttgaacacctgcatgaagtattaaatataggctaaaaaataactaattacacagattgtgactaatttgcgaaacgaatcttttaagcctatttactctatgatttaacaacgtggtgctacggtaaatatttgctaatgacagattatttaggcttaataattaattcgtctcgcggtttactgacggattctgtaattagtttttttattagtgcccgaacaccctttgcgacaccctatataatacatgaggtgacacgctaaaattttacacccctgcatctaaccaccccctaaatctataagagtactccttagctgaaatgggagtggcttttggagcagctagagagttggactgaagtctaaagttttgggtttctggaacccttccataggcggtaggaactgaatgtggtcagatgatacggtaccaaagataccactataatccactcatcaaatgaattgaagcatgcaaagaccaacaagaagcctatagggttagaacttagaagagcccttagctttgagccaagctataggccggtctgtggaatatgcctatgcatattcaaaaacattacaatgaactttagtatagtaaaaatttgttacaggacatggcttttgccggtagacattgcaaaattttggatttgctgaaagataatgaaaatttgttgggtgcatactgagcccattaaaatattattttctattgagttagagagagatatttgtatcgaaatattttgctacaaacaaaccccatattcctcttccattttctctctttccccaatctttccttttcatctacacatgatggtgggcagggtgatcatggaggaagtatgccagatgctggtaagttgtaccgtcccaagatctacttggcttcgagctctttggtgttcattcgatctgttcatcatgagccccccgccattagatttgaactcccatgcttggatttgccaatgttgtgactcgatgaagaataggatatgcggtgatatatcttgccggactctggagcttcgtaatatgttccatcttcctagcaccaaggaagataagcttcgtcatgatactctacaccattcctcaagagcatgggaaccaccacttgatctagatggagcaagacatggatcgaaagttgtgaagaatgtcctcttattgcccggctatccatccggacaaacactaggagcctagttgccatatgggcacatgcgaccgtgttttgctcacagaattcatcaaatcattggatttttatcatgccgccaacattgccgctaatctttgcataaaggttttgctctcactaacatgttgttgatacatcagttactctgattcaatgtaattaggaggtatggttcacttacacgagagaagagatagcaaaaacggataacagacgagatgggcaaatattatacatttctctctctaacacaatggtaaatgatatattccagtaggcttaatatacatgagtaatttaccacaatctttccgtccatagtggtctttaatttcccaatcttgggctatgcccaagtgttacaaggcctaggttattaactgttttctaaacacgtaattgctaaatggcatttaacgaaaaatcgagagatatttctcatatattttgaaccaaccgatggtatttaacggaaaatcgagggatatttctcatatattttgaaccaaccgatttgcttggagattcgtgtgcccaactccttctcctctagctccgatgaagctctagcgagtgacgaggtcttgggttggggtaggggtgggatgagaaagaaggagagatcgccgggcttaaagggatggccgtgagaggtagcggctcgatagtgagtagtggacacgggcaggtggtgagacgtcggcggtggtgccgaagccacaaggatggaggagcacggtgggtcggtgttggtggtagggccagagcgaagcgagtggttagaaggcgatagtcgatggtgggggaaccaatgatagggaactgtcggagataggaaagacggcgggacggggcactttactgccgctagcttaaggaggagaagaggaaaggggaaggggcttgccggtgccgttggcgccttctagccagccggtgagggcgggggaggcggacgttgcgacatcgacatccagtgaacgagcattctgtcaagaagagtataaggtgaaaacactatagttgcatgaatcttaaatcaatccgagccattcaaaagtaactgaaaatgagggagggtttttcttgtaaatattatacgtacgtttagcgatcagacggatagcaaaaccgactgagatcagccaaaaaaagtgtcgacatctttttatcaagtccgtttctaaaatacatacaactattttcgaaatgtttatttatctataaagtccaaaagcaaaaagacactgcttgcaaatcaatcagtctttctctctccgattctctgtacccttatcagctcctccatctctatgagacgttcctatcgccggccgggccgcttcagacgacaacaaccctatccgccggaagaaccaagaaaatttggaagagacaattcacaattgacgaagaagggaaaaatcctccgattcctccagtctcccatcgagcggagcacacaaaccaaaccaagaaaaccggtgatgcttccccccgccctcctcctcgtcgtcgccgtcggcgccgcgctcctcctcgccttccgccctccgctgccggccctcgccgcccgccccatcgtcgccgccgccggcggcaagcccgcccccaccgaggccgccgccaccgcgaggtggctcgccgcccagaacacgtggggcgtcctcaggttgtccccctcccaattcctttgccttcttcttgctcgtgatcccctactgtttggggggactgattggttgatgcctcggttctttaggagatgacaatgggtggctcgatcgaaattgggggttcttagcgcggccaagtgttggtagtggctagtaatctaatcgcctgaggctgcttagtattgagaaattgttggtgctcttcccttacttgtgtgacattcagtgtcatgatttacaattgaataggtgttttgctaaattgccgtcctactgtgccaattggataacgaaaacttacagttccatcaaaattcctcgcaaagaaaataaataaatatagacaatattcttcaaattggtgtgaagttggaaacctctggccacgttttaatgtctgcatacatcattaggtcaaatataccagacagatttttatctagtaatgaaaagctatggttttagcatcaaggtcaatatagnnnnnnnnnnnnnnnnnnnnnnnnnnnnnnnnnnnnnn

SEQ ID NO: 10975 - DNA, 3329 bp, Oryza sativa
ctcgtgatcccctactgtttggggggactgattggttgatgcctcggttctttaggagatgacaatgggtggctcgatcgaaattgggggttcttagcgcggccaagtgttggtagtggctagtaatctaatcgcctgaggctgcttagtattgagaaattgttggtgctcttcccttacttgtgtgacattcagtgtcatgatttacaattgaataggtgttttgctaaattgccgtcctactgtgccaattggataacgaaaacttacagttccatcaaaattcctcgcaaagaaaataaataaatatagacaatattcttcaaattggtgtgaagttggaaacctctggccacgttttaatgtctgcatacatcattaggtcaaatataccagacagatttttatctagtaatgaaaagctatggttttagcatcaaggtcaatatagctttttccccccatattatttagagcataagttactcatatgtgtcatgtattacttgaaattaattgtaaaagtcataaaaagtatgaaagtttcttaactaatattttagtacttgttcaggtgaaaacaaggatattcaagattctaaatagtctttgatttctaagaaaacaaatttcaaattaagcaggcaaaataaaactattgataaaaactaattgattgagtagcggtacagcatttagtggatttagcagagttgtcatagctgccttcgctggtttttacatgatactacaatagcgtagcagtcactgtcaaaaaatacttacgcgagtgcagttggctatttaaaacactattgtatattgttttgactttcttttaataatgtatctgctagatgtccactgattgttcactcacatatgcaatttctttttgcagcacaatatcaagtgatctaagtggagctccttttgggtaatatttcttgttttggtattgaaaacaaccaacgcacatggttacaaaccctttctgattgctgaacttagttccctgcttcctgtacatacagcaatgtagtttcatatagtgatggagtgccaggtgagagccatggaatcccctacttctatctgacaacgctagatcccactgcgagagatgcattggaggatgaaaggacctcctttacccttagcgagttccctcttgggacatgtgggaagattgatcctgaaaacccaacttgtgcaaaacttactcttactggaaaggtacagacaaattgcatccatggtaccatgattattcacttgctgtttatctatctatttctattttgctttggtagtgactgatctggttatcttcttatatctatttttcttggtgctgactggtctaagaatgtacagtagttaatttctttttattaattcatacttaattcagcttgaagttataaattgctgtagagtgaatacttactgctggacttgagtcgtaaccaaacattatcactgttttgtctgccttcaactttatagttttgggcctcaatttcttggcatggggatgagaggttgagagacttcagcaggagagctcaggcttttggaactttggagccttgtggatggtttagcttgtggcattgtagttgtaggctcaatttttacatgttctttgcaagttttcttcacaactaggtggactggtgaccaagttatcgcctagtcttccagttgttgtggagataccctcagtagacaatatgataaccatgatcgagagacaaaacaactatactccattgtcttatagttttttcccccacgttcctaactgtgtccgtcccctctcaaattatctatcatggattcactgtgagcaagaaaacagcagatggtcaagaaatcatggtttataaagttatgtagatgatatttcatcaagaaattatagtttataaaactgttgtgacatgtgagatcaatgaagtaggcaagtagcaggggctataggcacttcatttaatctcagccataagaaccatacatagatgtgatatagttggatcatttcttgacttactaagttgtaatggaaccagtgaattgcatgttttcagttgaagttgattgaccctcaatcatctgaagcagatttggccaaagaagcactttttactaaacatcctgaaatggagggtaaatccaagtatttctttgtgtcttttactaatgtgagattaactggtgattattttatgacaacattcatgtatggctgtttgataggttggccaaagaatcatcatttccaaatcttcaaattggaaatcaaaaacatatttttgattgattggtttgggggtcctaagcctatatcccccactgaataccttgaatatgagaagtgagtatacaacaaacttgcagatatgaacttacaatgtgcatctgatctattgccaagaaaccattttttaacataattatgatttatgcaggaaccgggccttgctgaagtcatcctaagcgacgcaccacgtttatatgtatgttgtaaagataaacagtaaattaattatatatgctatgtacatatttacatactgtgaacacatcttgttcatcttgaataaaaacgttattatgtttgtttatggaaactgagcttctctaattgatctgaatttgttattccaacaatgaccattgatctgataagatagtactagcaaaagaaacatgtaatatgtctattccagtactttgggacatgcctgacaatattggtatatgatacagtgtaaataaatacgaagaaattgttctcacacataacggaaatgtgtatatacaagcttagcaagaaatatggaatcaacaatactatcaccaaataatctaatttccttacactatatacaaatttaagcaaaccatttcttaagcaaaatgagaaaaagatcaaaccgttcgagcacggtacgaaactgacactgggacccacacgtcagccgttgggcgcttgcctgagcctgtcgagcgccgtggtgttcgaccgcggcggcgccccgtgcgcgtgcgcgtgctccaccagccgtctcgggaactgcggcatcgccatggccttcgacatgacgctcacgtcgtccatccacggcgcggcggcggcggcgtcctcgccgccgtacagagactcgccgggggcggcggcgggcaccccgcccacggcgcgcagcgtccggcacgccacgttccgccgcaccccggcgccggggccctccgcgacgcgccggagcacctggccggcgcccgcgggcgcgccagcccgccgaaccggacgttgccgcggctca

SEQ ID NO: 10976 - DNA, 4474 bp, Oryza sativa
ggctccagcgagaggttgaccacgcacgccgcggcgctgaccctgacgccctcgtggccggaccccatcaggcggcgcagcccgtccagcagccccggcgtgcaaagcgcgcgcctcaccccgttctcgccgccgcgcagcgtttggtttagaggctccagggcgccctcctgccgggtcggcttgtagttgagcaggctcaccagaacagtcttctccaaggtcaaccccaacgcctcgaactccggcgaggacgacgacgacgactagaaccgctcgccgatgactcccccggcgcgaccaggctcccgcataaacatgaggtggcggacaatgcccctcgactcctccggcgagacggcgagcggacgcggcaagccgacgcggtcggagtaggaagagatgggcttcctgaggttggcgttcgggatgagcgccggtggcggcgaggcggcgaggtccacggacagtggcagcgccgccggggtgaagcccagcgccacgcaggcctcgacgcagccgcgctcgaaggtctcgccgctggggacgatcaccgggtcggccatgagctcgccggagatcgggcacacgaattccggcggggtggcggcggcggcggcggcggcgcccgccatggcacgtggtcaagtcaacggcgaggcgcacacactggtctggtcgttttggcggttagagagcgtctcacaggacagggttaagttgaatctggacagctggttgaatggtagccttggaaattttctttttacaagatgatttttttttggttgttgttgttcttgtttttattgattaaataatgagtgttattaattaaagtgtgaacaaacaacatgatccttaaactttcgcttaaggatccataaagtctttggtatttcgtattatccaaataagtccctaaactttattatgttatttaatatagtccttggatacaacgtctacatgccgcatcacccgtgcatgcaaattcaacatttgaaacatccatctagctacccttacattctccgtaggaaataaataaaaagaattagtaaaagaaaggcatttggccattggaaaaaagatgttgcattggtaactaaagaatgtggtatttttcttttgttttatgattgctttcttcatgttttttcttttttttctcttttttaaaagaaaatgtaagggtaaaatggatatttagggtttgttcagattgtagccaaaataaacctactgataacattttggcaagttgccaatattaccaaaattttgtcatgatttcttacgtgtttaccaaattaagtttggcaacaaactaaatataggcattttttggtaactttataaaaaaaatgatatgattgaaaataacatcagtccaaataggcccttaaatattgactgtacatgcatgaatgatgtgacatgtcaagtgtgtccaatggctatatttagtcacatgacaatctttagagatttgtttggacaatacaaaacaccatgaactaatttgatccgtgagcaaaagttcaaaattgaattggctattcacccttaatttaacttcataagaaatggaagatctcatggatcaatgaaaatgtataggccacattcgaacctatgacggacggaagattaagtaccaacgcataaaataagagtcactgatgttgaggtttaattattttaaacttgaccaatgaatttatataatattttaaaacaatttttatatagaaaattttctcacaaaatgtatagtttagtattaaaaaatgtgctaaaaaaccaaggtaaaatgtgtaactcaatgggtcatacttcattatccgagccaattaggattatgaatgcctacaactggttacaattaatttattattatgctgttgattacgcgcagttacgtgctggatttatagtctttgcttatgtcaaatgggggatttacgcaagtagctgttgtgtggaacggttcgatgagctgagatgtggtgaagacattgccagagtgccaagagttgacctcttctggagaagtgaagagtcgaaggaagaaggaatggtattgccttaaattctacttctaggcttttggaatataaggattttatagggttccacatgaactctgttttatttacatgtaatttgggaaaagaatgatgcattcaaaatgaggactagctttggtaacagcgctttaaacagtttgtttgtcaaagtttatccaatgaaaagagttctagaaccgtgttcgtctcttaaggttcccaactttaccttctcattttttacacgcacgctttccgaattgctaaacggtgtgtttttcgttaaaaaatttatatgaaagtttctttaaaaattatattaatttatttttaaaattttagttaacaacttaattaatcatgcactaatctactgtttcgtttttcatgctaggacggaaggttcccaaccttaccttaagaacacacccgacatatcaaaagttttgcactgtcgcatactatttgttatagggtgtttagatccactggcaaatttttttccccgtcacatcaaatgtttgaacacatgtacagagtattaaatattgaaaaaaaaactaattacacaatttgcgtgtaaattgcgagacgaatcttttaagtctaattgcaccatgatatgataatgtggtgatacagtaaatatttgctaatgacatattaattaggcttaataaatttgtctcgcagtttacatacggtttatgtaatttgttttattattagattacatttaacactttaaatgtgtgtccatatatttgatggaactaaacacagcattaattgagtttgcattggttgagaagataccgagaaatattatggtttctaatgtaaaatttaatttgtagttggtgacaaccatgaaatgctgagatgatacttgtttccgaacttcagctgaaaccagggttcacaatttcgacgaaaaccggtcgaattccgcgaaatttcgaaatttcgacgaggctcgaaagtagaagccgtctgagattttgataagtttcatcaaattcaaatttgaattgataaaaaggaaaaaataaataaaatcttataaatagtatgatattcatagaacctattgggatatattattttaaaaaatgatgtattccatgtatttagtgaaatttataatgggaaataaaataataatgaattaaaaagaggggaacactttcagtttacctctttttctagttaccgattgaaatttcgatgatttcactcggaatttcgtcaaagccgaccggttttcgcaagcttatccgtaaactcagagaatttgtattcaaattttggtttatgaaatttattcagaatctaccggctttacaccgaatttcgcgaaaaccgtaattccgccagatcccgaaacggaaggccatctcggaatcgtaaaccgtagatgaaaccatctcgtgctaatcaaactcaatcatggaagctaaacaagtagatgcattctgagaatttttacatgctacaacttccaaatattatttttagaaaaaaagaacaccgacatcccaaatatttcacaagaacaggaaaaagaactcagaaatcccagtaacacatacatacatacataccttctaagagaaccgatggattaatgtacagacctaatttggataggtgtcacagttctaggttccactattcagtcataaagaatttaacatgtgcaaagatccaattaaattacagcttaattccaacaaaagaatccaccatccaattacaccaacaccattcatcagaagtagttaaccaccagattttttggggcctatggcaaatacagttccaaatacttcaacaagagccagcaaaaaaaaaaagaaataaaaaagaaagaaataaaagaagagaagcgaagactttgacttttcagaactgcgtggtgtttgacccggacgccccggcgccgtagctgctccggcgcggcggcggccgccggatcgacacgagcccctccgacacgacgctcccgtcgtcccactgccggccgagcagccccgtggccgtgaccaccgcctcgtcgtcctccccgcgcatcgcccggagcgtccgccgcgccatgtcccggcccacgccgccggcgccctcggccaccggcgtgagcgcggcctcgacgccggcggcgcgcgcgagccctcggaacctcaggctcccccggctcatcccgtacagcgacgagatgcagtactcctcctccgcgctccccggcgcggcggagccgctgctcatcagcctcaccacggcggccaccgcgccgccgtccatcagcgcggtcctcccgtccgggcagccggcgaggttcgcgaggatcatcacggcgatcctgcggagggcggcggcgtcggcctcgttggcgcggtcgtccc

SEQ ID NO: 10977 - DNA, 8556 bp, Oryza sativa
gcgggggaggcggtggcgagggcatgagacggcggacgacgtcgcgcgcggtgtcgggggagagaggggcggggtaggggagggagagccggtcgcaccagttgagtatggcggtgcggagcgcgacgttggggacgaggacgagaggggaggaggcggagggcgggagggaggagaggtcggcggcgacggccggcggggagaaggcgagcgcggcgcacgcctggatgcaggcgcgctcgaacgtctgccccggcgggacgaccaccgggtccgccatcagcgtcccggagatcgggcagaggaactccgccggcgggtccgccgtgaacgacgacgacggcgacgacgacgacgaggacggcatcggcggcgaggacggccgccaccgtggccaggcggtggccatggacgcgttcgtcggctgcgtctcgtgtgattggtttgtttgcttggatgcgctgcgcaccgtggtttgtagcgacggctacttgtggtggtcgccaacgccaatcgctacagcgtttcaagacgcgccatttgggagacgatgacttttttagctggaatacttctagtaacaaaaaaaattcttacaaaaatgctttttaacaaaaaaaatcctttttaaatacagtcccaaaaaaattacgctcatattcgcacgcgcaaatcacccatacgattatgatgggttgaaaactcaaagggggataataaggcggtgtttagattaggggtaaaaaaaatttagcttgtcgtatcgaatagacggacacatatttaaagtattaagcgtagactaataataaaataaattacagatttcgcctatgaactgcgagacgaatttattaagcataattaatccatcattagcaaatggttacggtagtattatactgtcaaatcatgtagcaattaggcttaaaagattcgtctcacaatttacacgcaggctgtgtaattagttatttttcgtttatatttaatactccatacatgtatcaaacattcgatgtgacagggtgaaaaattttgccagtggatctatacaggccctaagttgcacaccataacgaggctaaccaatcaagttacgttcactttgttttagacagaattttggttcactagcaaatggtaaatttcatctaagataagggaacatgcaaatttatgtgatatcgtgacttgttgcaacttccaaaaataccttccagtaacataatgcaacagctaggccttgttcgtattatgacgtaaagttttttttttcataactggaaactgaaaacctccattattccatatatattctactagcagctgggcaaaaattaaaaaatagaaataaaaactagcagttgcttctgtccgtaaacgaattgttgtgcacgagctctttgatagcgatagaatttagcgacagctgaggctgagcttatggcatggaaggcacgtcctgggagaaaagcatcaaagaatccatatgatccaaacaaaatcggtcaaacaattcccttcgattttaaactagctttgccttttttaaatttctcgatctccttttggccactttttgcgagtggagtgatggctcaaaactgcaaagtatgcttacacttaactacttaagctgtgtctttgcgacaggatcaggttacaggcaaagaatccaggcaagcaaagcacacacaggcgcacggcgatctgctttgcagtgatcttttgtaaggcaagatcgacacatctatatactactagcctctaaggtaatcttttggcgctaccacatcattaagtcggaacaagatccttcgccctaaggctgtgtttttttaaaaaaaacgtagtacaatagtatgtgctcataaaattaggcggcatatcttgagattaataaagtcactttatatgtcttgatgtcaacgagtacgtcgtgaaaaaaaaactagttgtaaatgtgagcacttatgtcaagtctacttgaacatgggtgggcacccgtgtttggtatatacccgagtgagcaagtttcatcacaaggaatctaatcagttgagttaggctcgctttgcttaaggttttgttcttttgaaaaggttagaaacattttcttcccgcaagaaaaatggagcagcggattaacgcataattaattaagtattagttaaaattagaaaatggttgatatgaccttttaagcaactttcttataaaagaagttttaaaaatgtattgtttaaatgtttgagaagcatacacacgaaaaacaagtttggaaaagttaggaaagtatgatatagaacgtgatcttagataggtgaacatatagctattgacatgtaggtatactttggagaaaattctctgtgtatctcggaaagttcgcccaatcacttctatacctatgagatttgctcattcccttccatgtccctaaatttcagtttggatcccttctatacccctcccgtcagttgattgttagttgaccattaaattcatatcataaagtccattttaccttttggtatcaataaaatataaatttatgaggtatattgatagagtgtataaatttattgtatgcggctattatatttatgagtttatttgtgagatattatttaacaaaaataacttttatctcgcataacaagatttatcttttaaaaatccgtactagtataacaaaatatgttatatataccgttttcaatggtaaagaatattatttttttgttttatctaaaatagattttatcatagataaaaattattttgttttccctttgcgatgcgaaactaaaatattacttttgttaaataatatctcacaaaataaacttatgcatataatagtcgcatacaataaatttataccctccatcaatatacttcataaatttatattttcttatatcaaaaggcaaaatgggctttataatataaatttaactgtcaactaacggtcaactaatggaaggggtataaaagggatccaaactgaaatttaagggtatgatagggaatgaacaaatctcaggggcataaaagggattaggtgaagtttcacgggtacccaggaaaattttctctatactttgctatgtaaaagttgtgtaacttaagatagggaatccggatcccattcagtaactgtgcctcagcctggcttcagtgtcattgtctgtgctagtgtcagtgtcacgcctctttccttgatagctcccctcgtaattaaggcatggaaatgactattaactgcaccaggatgagagattaattaaagatctctgaacaatgtttactactagtaagagacaacttgtggcatgatctgtggaggaaagagattggcctacctactggcctgaagatctctgaagttctgaaacagctgttctcggaaaattattttacagtacgatttgttcagcaatcagcactgacctcaccaattaacggttgctgctgtcacctatcaggttggatccagtcatcctgccacatggagagagttgaatcgtgtgatattgtttgatcatttctgcacaaacacacggttgttaggaggtcatgtagaattattagtgtgcgttttacacttgtctcgatcgagcagctaatggtggtacggcacagagaagagagcaaatcgttgtttagaacagcatgatggaactttttttttctaatgacggataagacaaggctaataggcttctcgttgacaaaagatgtgctgagttggctgctctttggttaaaataatttgggatttgtggcttaggaaataggaattggtactgctctgatctctctcgatttgtttatgatcaacagacagattctgaattctgttccttgctggctcataaaaatataatgttcttttgaagttttgatccggcaacttatcgtggcgagatctatgtgttggctctctctgatgatgccgattaaatagcattttatcagttagttgtaccttggagctgtctatgtttaaggagagtgttttcttttctcaagaataactgacaatatttaaagaacatacagtactattgaatcaacgtcaaatttggggtaaattcaacacacacacacacacacacacacacaaagcttcaagaaaaatatgaagcaacttaccaacacaaatcatattatgtatgcaaaaattacacatgtactaagattttgcaatactgaatctacaacgaagaacttcagaaatgcacatgtacaaaaacatattatgtatgcagaaatacccatgtatagctattagctagaagaactgcaataattggcttcatagcttcctcccaatacttgggtcaacatagagaatgtcaatggcgtttttcttatctgctggacgagatgatgccagactgatacggaaaatacgggatgtgtcccagtgattaagataacgctaacttattaagctcaactaatttgctgtctgaatggagcactgttgtttataagaatttcttgactttcgtgttccaatttagtttgctgctcctctctccctcgagagagaatttctggtacagctcatgagcctgtaggttgctaccagctggaattacgtatctgatgctgctgcggacgatgccaagaatggggcagctaatgatcctagccagtgtgtaatcagacagatttctgatttttgtacaaacttcactgctttattcagagatgagaaagaacattttgtttagcatagttcagagttcaaaattcttcagtgctttatttactccatgaaagagaagagaggagcaaaagcacggcaaagttcaacctgtagattcatcgcttttcctttttgccctgtctttttgttttcgagatgagaaaggagaatgggttgagctgcgggaaaggttcaaataatactccagcatcagtatcagtactatccttctggtttttgaatgcgctggaaaggcaagaaatgaattggtcagtaccgagaaattaaaggtgcaaggctagctagatatagcttcatgaacaaagttctcgagcgccatgtcgacctagctacaacaatttcgaatctcctaaattcatagctatagtttttcttttttttgataatccatattgacgtgatcaaatcatgtcttacattcaacgtaaaaaagaagtcgaatattcaagaaacactaataaaaaaaattattttacttctccaaactatttcattgaatcatttaaccactaaaaatatatttttttctcattttaccactaaactattaaaaatgttcactttactttaataacagttctcctctttgtttctctttatgcgagtgatattttaagctgaaattttatagagccataaataacaccatatcagaataccaaaatagtttcaaaagttatcatgactattcggaaatctcgatgtttaaaccagtctcagacgctttcaacatatataaacaatgataaagcatttctaaagaaaatttgttgagaggtaagttataacacatctatcaatcctcctgctaaatttcattgcaaaacgagaaacctcattagcacatgattaattaagtattaactattataaatttgaaaaatagatttagttgcttttttgaaaacaacttttatatagaaactattttttaaaatacacatcatttaacaatttgaaaaatgtgctaacggaaaatgaggaagttgaagtttggagttgaagaatacaacaggaaatactattacgaagtaagtgaaccattttcaataattctcggtgtaaaataagctgagaaattatttaggaggttaagttcttcaaggagatagtctaaaggagtaaaatggactttttctcaacactattaatcttctaatgagtgatcttttgagtttagacaagcactagttgaaaaatatataatcatagccggttaggcgtgctcaaaagcaattgagcattactaagcggcccaagagtggaaatcagggttggttcgtggcaagggccgacggtgctttcaatggttcataccttccgtcttcggctcagatggtccagagtgcagactcaattatactttggaccaccctaacttttatttttctccaactctaacacatcaagaacctcaaacacagcagctcttgcacaccaaggaactctcccatgtgtgccttatgcccacgtggagaagatgttggatgccgattgataaaagagttgagatggtccgtctaaagtacaataatgataaattctaaaaatgaaaatattaagtaaagaatggtccaaaatatacttttttttcaatggtccaaaataaagtttgaagcaaaagatgtcgaccgcaatctagtcttgcctaaatgggttcccatcctctgccgttggggggagaacggcaaaggcgcacagttaaacgtgagggaagctacagtgccgtgcagtctctacagtggaaaatactgtagctacagtgaaaaatatatattaattattttcatcgttactgtagtgtttaaactcttgcatccaaaacttgatccaacgggtataaatgcccccaaaggcatggcactgtagctctctgccgttccagttggaacggcagaggatgcgaagcctgcctgaatgggtagtttggttttctcaagagggagtctagtgcacggcattccgtccgaacaggataattaaatgacacctccacctccccgagcaagatatggataaggatcaaagatggactcggctagcctgacgtatcaatatgcatggctttcacaaaaatctgcacataggaattaatggtgggcccccacgtgtatctagcgcttctccttgagtttgtaggtcagaacaagcatgtgtagtgcatcatcaactattttattaccacgctattctactagtactaactagattgagacgatttctaataggtatcatatgatacttgtgagatatcaccggtgatatttatcatgtatcagacgattccaatcaggtttcacgcgatttctaccaggtatcaggtaatacttgtgaggtaccacttgatagatatcacctgataccggttaggtatcaggacatgatacttgaaaaatatcagaacctgatacatgtttttatccaaacggtgatacttattaggtatcagacgattccaatcaggtatcacgctatttctaccgagtatcatataatacttgcgaggtatcactcgatacctgataggtatcacctaataccggttaggtatcaagacaggatacatatttccgtccaaatggtgatacttatcaggtatcagaaactggtattaggactacccgatacatatttctatccaaacggtgatactcatcaggtatcggatgattccaattaggtaccacgcgatttctaccaagtatcaagtaatacttgagaggtatcacctgataccagttagatattaggtcatgatacctaaaagatatcaagaactgatacatatttctgtccaaacgggatatggtcttgtacaattcatggaatgagaacagcacaatttccaaagagacgaacgattaaaaaaatactattaaagtcccatgtcttctcagtgtgaacatgcacccataaatacactgatttgcctagctttatcatattgtattgtcaccaactcagatactggtgtgacatgtctgctcgtgtcacgtgcccacgagtactcatgaggattgcaggcctgcaacacacttagctgctcatgtccgcgtgtcgctggaggtatgattgtgcacgaaatcaggttgacttatgtccgtatcgaggaagtcatagaatacttcattaaactattccgttcggacggtatcccgtacaataatttttctcttttctcaaagcagggggaactacatttatcttcctgcttttgttcccttcttaccgtgtcctcctttttattgggcttaaccatcgcagtattgttactttcttctcaatccacccatccagtcaatccccaattatataggtgtaggccgtgctttattcctaatctgtccaaccaactattctttaattataagggaagggcatgtaccattacaaagcatgatcaagccttaaaaagagattcttcatgttttggtccaagatcatcttttcagcatggcccataagcacggcaaggcccatttcttcaatctcttcgacgtcctcacctcaaacctgcccactccaaccaccaacacggctaggtggccatatggaccgggccgaggcataccggcctgacaagacagcactatagtcggcccaagcacggccactcgtgggttgttccggcacgacccatttagccgtgtcgtgcttggagcgacgcttgagtccatgggctggcacaggatgacacgatttccattgggctagcacgctacggcccaagtacgagcatggtcggaattttttcatttttaaatttatttgtttaatatttacagaaatattatatcggcggattgatt

SEQ ID NO: 10978 - DNA, 12357 bp, Oryza sativa
ttgcacggaggcctcttgccgcccaaacagagggcggtaagggggccacgcccaaaattcgcagccccctaaaaagaccgtcatgcgtccgtgtgccacgtcagcttgccacccaaatggagagcattagtgtctatttttgtaaatcttttcgccgatataatatttctgtaaatattaaaaaaataaatttaaaaatgaaaaaaatcgcatggtcgatcgccccaccaaattttccccataatttttcatctgttttttccatttttcctatttttaaaatatattttgtctattttctctcattttcccaaattttccatatgttcttttctttttcccactatttttgtcattttttctagtttttccccataattttaggcctgttcactttgatgacattttcaaccttaccaaattttaataaagttgccaaaatagtggatacatttagtttgctaccaaatttggtaactatataagaaatcctgccaaaatttttggcaaattttggtaaggtttttttcatcaaagtaaacaggtcctttctttttttttcttttaattttcctttttatcttatttctcttttttcggcctcgtattcaaattctgtgggccaaacgtgataatgggcctataccggcccacatgtcatatttgggcccgtgccggcactgcccgtattttccatggaccgtgcttgggccgacgccttagcacatgggcctgcacggtacggcccgctacaggagccatgcctaatcgtggctgggccgggccatgacgttcggcccatttgttcacctattgacggccacacgcccacaccacacctcgtcgccggcaaccgccacctccacggcgccgccggccaagccgcgcaggccagcgagatgacccggaagcccaagcggaagcctccgccctcgccggagccgtaccacgaccacccctccccttcccccgcccaatgcctcgccgtccgcgacgccctcctcgccttccacggcttccccgacgagttcgcgcccttccgccgccgccgccgccgcctcggcctcgacacatccccggacccggaggaggacacggatggcgatccgtctccgccgcccaccgtcctcgacggcctcgtcacgaccctcctctctcagaacaccaccgacgccatctcgcgccgcgccttcgccgccctcaaggccgcgttccccacctgggaccaggtttggtggccgcatccaggaagcttctagaagctccctcgtgtcctctgatgcgcgatttgttttcgtttttggaggtggtggatgaggaggaggggaagaggctggaggacgccatccggtgcggggggcttgcggcgacgaagccggcgaggataagggcgatgctgaggggcgtccgggagaggcgaggcaagatttgcctcgagtatttgcgggatctgtccgtggatgaggtgaagactgagctatctcggttcaaagggatcgggccaaagactgtgagttccatctctctcttctcctgtttcttcagcgaatttggttttcgtcctgttggatttcatcgtaatgtaaagaatgctagtattgattttgttgtgaaggatgaggaattgataaaatgtgactagtgagaagtagttgtagtttgcatgatggtagataatgatcaaaagcaaagcaagttgcttttcttgttgccatgtaagttaatacagcctgaactcaagtttccgcaaaagcctgcaaagtattttggctaacagtagtgttggtactaagttgtatgaaaaggaaattagagaaagtatgcccttgtgactgaaatcatatgcttgtgtcggttatacttaaatattgctgtgtgattatggatgggtgttagtcaccaacaaccagttttgctttgcaatgaatggctaacagaaacaggtgcctggtagcctccgtgcaatggcatggagcttcttctagattcttgtattcggagtgcaattgtccaactattttccttctactaagggtggtagttacaatcatggctggagttgtcaatggaaacttttgcaattatgattgacagtggaattcaaacagcattcccaaatcaaagaagggaccttacttgtgaatgtttataatatctttttacgctctttgattgcttgcttaatactatattggctgcttgagtaagtgtgcatatagctgatgatctttctaatatatgcaattatgcatgttatgacaggtggcgtgtgtgctgatgttctatcttcagaaggatgattttccagtagatactcatgtatgtgtaactttatgtggttcttgtccataccaagaagtcagtttagtgtgtatggcgtatatgtaataacatacatttctataataggtactccgtattacaaacgctattggttgggttcctgcaacagctagcagagagagggcatatcttcatctgaacagcaaaattcctgatgatctaaaatttgatctgaattgtctatttgtaactcatggaaagctctgtcaatcatgttccaaaaagttaggaggccagaaaaccaccggttcaaattctatgtgccccctagcaagttattgttgcactgaagaaaagatgaagcaataggccaatagccaaggtaagctacttggtcccatttcgaaatgatatgtatatgctgcgtgccaactatattgtgctctccagtaaatgttcttcaactagctgttttattattcgaaagttagatcatgagctggtttctcaactttagaattttcgtaagcactacacttctgctgcacatcttaaagtgcataatataggcccaaaatttatcctagagaggtcaactattacttgcttcttgcttattaaggaagtacctatgtttaaaagagagttatagttggtatgtcaaaaataaagagagttatacttcatgggtaacatgctgagtttttacaatgctgttttattctggtgtcatgaaatttattcaatgaaaattctactgtgttatttgcctatgggaatcatgccctctttattgtgttgggatattgtaagttaatcatatgaccttgcttgcagctactttcttactggcaaaagcactctgaatgatgtaaaatatgatacctaatcgctgttccagtctccacccaatcattcatgacataatcttttgcaaatgtaggaattgtttgtggttattgatattttctgaaggtggtgtcataacctcccaacaatgctaatggtaaaaggatttatgcgctgaaatgtctcatctgatggaaacctcaggttcggtttcttgttttatcagtagagactagagagcttccaggcttcagttgtatgatatgaactcatttctaccatgtaagtgacactagctagggaatttagtttggaactttggatgagaagcaaaacactgggggaatatcgacttaatcgatacatatctcattgattacactgaccaaaggaatcctaacatttttgctctaaagtgcgctaaacagagaaaaaggcaccaacagaccacaaccaaaaccaattgtatgcaccaggtatcctcgacttttctggtgcacatgatgtcttgtgcctgacaaggaggcttgtgatttccaggcaagcagtggctgacggtgagctaaagattctggtatgtcacttagattcagcatatgttctcggtcaccatcagtgcaatcccatctgagtctcgccaccccacctgccccaatgggacgggcaattgtgcaaccaggtttcagtactaaacttaactgtagtcgcttttgaaaatcttgattgacaacgtactggaccttgatgcacatttggtaccgtatgctttggagtagagcaatgtgctgccatgtgatgtgatggagcagctgggcagtttgcttcttgctttacacgaagtttagtactgcgaatcatttgatttgatctttggttaggttgcaatgcactctgtcaagttaacctgagaggcttgtcttaatgggaacatctggagtgaaagtcaagtgccttttacagttattgatctgtcttaacgctaacagagatacaagtgggctgtaccactggctgaaaaaaaaaaactagcatactactccctcttgtcataaatattcaatgtttaggaaaagatctgtttaaacttttaagattccaaccatcaatttgtagaactttataaaatctaagttttatgatcatgaaagcactttttagcaaatctacgtataccctttgttttgttttagaactaagcatttgggaaattattaattgtctgaattttaaaagtactagcataatacctatgcattgcaacggattttttttaaaaaaaagttaatatatatttttaaagcctctaagagaagttattactattaattaatatatcatagagatagagcgatgaaatattccataataagggtatttaattctcgtatttatcttgtgtgaggacttgcctgtgtggcttaaaaaaaaggtaaagtcttctcgcactttttgccgaccctatacgctagttgtgggtatagatgatcgaattttattataaatgtcaaaaaaatttcatcagaaatagtagtttatttttgattgactagtaaaaatagagttataaatataactacattattaagtgggttttatagcgacttactgagcctacttaatgggcatcatcagggcactgttaaatacaatatcaatctagatcctctacagtattatttaatgcagtattgcatactccctccgtccaaaaaaaagataaaccctggtttccgtgctcaacgtttgaccatctgtcttatttgaaaaaattattaaaaaaattaaaaagacaagtcacgcacaaagtattagggcccttttgaatcaaaagatttatgtagaaatttcataggattcaaatcctatagtaaattttcctatttggccctttgattcaaaggattgaagctttccaaatcctatgaaattcctatggaatggcacattgcatgtggattttggaggaaatttagcaagagctccaacctcttgaaaaatttcctttgagtctatctctctcatccgattcctgtgtttttcttgtgctccaatcaaacgaccattcttgtgtttttcttgtgttttgcaatcctctgttttacacttcaattcctgtcagaatcctgtgtttttcctattcctccgttttttctaccatgcgattcaaaggggcccttaatcatttttatcatctaacaacaataaaaatacgaattataaaaaaatttcatataagacggacagttaaagttggacacggaaactcaaggtttatctttttttgggatggagggagtatgtagtagtgctcacttgtatatataggctcgaggatttatgaggctcatatgtatctagcattctagaggacctgcatccatcatatatctttttttaaacaactgtcatatatccttgatcaattggaaatggatcctctgccgtagcaactatctacggaggttttacagtgtccgtgcattaggatgcacgtacacctttcgatcagcaatagatgcagctacagtaaatcgcatcgcccgtgcattggggtgcacgtacaccgttcgatcggcaatatatgtagctacagtaaataatgctatagtggtctaatgttgtatgcacgtttttctgcaccttaacagtacaaatcgaggaaatagatcatgattagctatggtcttagcttcaaatattgatcatgtcatcaactaaaggagctgtagtaacatcgcgcctgtcaatatagcttaagctctaatgatccatagccaaattttaattttagaattaactttagtgtttttcttttttcagccatgacttttgaaaatgttaaacgtaaaagtataagtcatatcctaaaattagttttcgttgcctcaaatcctagatcacgtgtcttaacttatagttttgaagtatttggatcgaccagtcatactcgtgtactctcttcgttccaaaataactcaacctttgaattattttgagacggaggggtaggcctataaagtataaactacgagggtcagatctaggattttaaattgatggtgttaatgtcatctctatgtaatgagtatagacagcaagaaaataatgcgatgcgacaaggtgaaattggattttctttcgaagaaacattttatcatatatttatactatccatctaattcagtgaaaatgaaattgtaaagcacaaaactaaagttagtgagtacacatgtacacaaaaatatatagcaacacagctgattttattacatgaacataatatataagaatagaattcatggaggttgcaacgtatcttcgcttataagccgtagcaaaaaatgcattccaaacagattctaagaataatccccaaatgcttaaaatctgtttagctcaaaagtcccaaacctaagaaatcgttaactttagggaaattgatcggttgacccgctaagtaagtaggctagagcgtaattaaaatgaaaataatatgataaattgaccattttctcggagttttttctaaaaaaatctcacttctgctactcagcggtttttcgagaatcagtggtgtgatctgaagcctattcactgggctaatttatttagctcaagcccaaagaaatttatggggtggtgtcatttctttgacggaagtggttaggttaggtctaaagcttttggtgttatcctcgcataaagaaaaccgtgatgatgttacctaacaacggtactattacattgtctctgtctatataagctgcagcctaaaacataaactttaacagatcatgacagttttaaactacaagaacatgtaagcgttcactacttatgtttgcttattaagtatcatcatttgataaagtctaaaggcgtgagcaaccgtgcaaatgcaacaaaaggagtcactccggtcggcaacagcctcattgggcccggctcatcaatcaaaaacacgggccccacatgccaggggcgagagggcaactgaaacttcatacatacctcctccgttttttttaaaacaatatgcaatcgaagacgcttacaacacgcgtacactcacctcctatgaatacacacacgcacatcctacccctatgagcatagccagaagactgaaccgatatatcttgagatttacaaagtcaccacgggtgccttgttatcgacggatacgtcgcctaccgcaaaatagccgagcacctgtgtctaagttgaatctgagtgggttggtttcaccacaagaaatctaatcggaacgctcacttcgcataaatgcttcctctgtttcatcatattacgagtcactttcaccttttctcaagttcaatttatttaagtttcaaattcataaaaaaagatagcatttctaacacaaaacaaacatattattaaaatattttgtatttaatcaaactaatttataatataaaacaaagagagtatgtagttatagggctctgtttggtagagctccaacttctaaatttagctatagaagttgggtctggagtagagttatggagcaatctaaacctagctccacttctctagttcattttgtgatagtgttccatccaacttcgctcctagtttatgtggagctgaaactgtttggttgggcttcaactccaggagagatgaagcatgagttgcaatggtgggttgttcggtctttttacgatggttggcttttaaagaaatctgtttatcaaggtttacggattttatgagaccaaaaatgtttttatgtgatggtggaggatcactacaagtatgctataacgggatcataagttttttgggtggtttttttatggatcagtttacttgagtttttttgaaacctttctttaaaggagaggaaagagaacgactttgcttttcaaaacagttaaaaagaaaaaaaaaaagagagattattaggctaatagctgctatcactaacatcaaagatatggagtactcctagatgtacctaagagcaggtacaatagcaggctacaagctagctacaaacatattataaagagataaataagaagagagaaaagcagtgggctatagatttgtagccaaatatagcacggactccaagacatagtatgtatatgacatgtgggaccagatattaatagtgtagtactacctccttccctaaatgtttaacgtcgttgactttttaaaatatgtttgaccgttcgtcttattcaaaaacttatgtgaaatatgtaaaactatatgtaaacataaaaatatatttaacaataaatcaaatgataggaaaagaattaataattacttaaattttttgaataagacgaacggtcaaacatatttaaaaaagtcaacggcgtcaaacattttgagatagagggagtatataactattgtatgaatgagctattagattggttatagatgaattagagttagtagttggctatactattaaacttgctctaatgtttcaaagagaaaaatatatactctagtagagaataatggccgctatcactgacaggcgtgcccccacaaggccacaaggccaaggccaggccaaccgctgtcacgtgtacagcgaatggctacaactgacggggcccacactacaccaacacccactgagctgcgggccccacggccccaccacgaggtacacctactatgccacctcttccccccaccaccaccacctcactcccacgcctccctcctcccattttcgccggcctcgctcgccgccgcgtcgcgtcgcgccgccacctcacgccaccgccgcgcgggcgcggcttccccttgccttccactccgcctccgcctccgctgctacggcgcgagccagaaggggcggaggtcttcgccgcgacggggatgagggggcggtgagcctgcgcctactgccccggccgcaacagcgcagcagccactgccgccccccaccgctcggcgcgagatccgagcgcgacgcggctgttgctgttgctgctgtgaagagccgggaggggttgacgcggcggcggaggagaggtcagggaggaggcggaggccatggcgggttcgaggttcgggtcgttcaagtcggagaagggggacccggccgccacggcggcgcagaggagggacccgtacgaggtgctcggcgtggggcgcaacgccaccgaccaggagatcaagagcgccttccgccgcatggcgctcaagtgagcactccccgcctcaccctcagattcggccccctcattcgatccttctggcatcctagtcctagatgaacgcgtctcgcgggaattcgtgcgagataagataaattataggagcttatttactgtttagtgaacttttggagggatttgggggcgcatttaatcttgctagccattcttgtgtggagattggttcttctttttttgctttgctatcaatgttgcaatggtttcagaagttttccttgcaaattgaggcaggtaccacccggacaagaatggcgatgatcctgttgcatcagacatgttccaggaagtcacattctcctacaacatcctgtcagatcccgataagaggcggcagtacgacacatcaggatttgaggttagttcttgcatgaactggtaatttttaatctaccatgttatggcaactggtgcaatttgttcaggccatcgaagccgatagccaggaattggagctggacctatcgagtctcaataccgtgaacaccgtgtttgctgctcttttcaggtaaaaacattttactgatgttatatttcttttactgtttgctactagcttgttatgctgctttttttttcttcttaactgtgcgtacgtatgtgcagcaaacttggtgtgccgataaagacaaccgtatcagcaacagttttagaggaggcattgaatggatcggttatggtttctcagctccagcttggaaactctgttcacaggaaggtaggtaatggcaactagctgtccatcatccaatgcttcttttcttgatgttagcaactaaataattgaaagctgcatgtggccaggtggaaaagcaatcagctcatttttattctgttgacataacagaaaaggaagctaaaatggggttagtttgtcgtgtgaaatcaactgatagaagcaaatttaaggttggtttttgttagcaaatgttttatcatgtaacctgtgtttcgtaagtacatttcatgcggttctggtgttgtcagttctgttttaatttattttgatctagacttgttcaagttgtgtacatttatcctgcgtagtgaagctatccttgtttgacaatgagaaaatttgcccttcagttggtgaaatttagatgatttacttttgacatatagtactccctctgtttcatattataagtcgtttgactttttttctaatcaagtttgaccaagtttatagaaaaatatattagtatattcaacacaaaataaacatattatcaaaatatattcaatgttagattttgtgaaactagtttggtattttgaatgttgctaattttttctatgaacttagtcaaacttgactaggaaaaaagtcaaatgacttataatatgaaacggagggagtaataaacaatggtaacctgtcctttaaatgcatgttctgtgtgatcaataagtactggctgtgctgcatatatagaataatcacacctatggtacaaaaaaatattgttttgttgtattcacttttggaagggttctttgagagggctctgataatgaaattattttgatctggcagtttaaatgatggaatacaacatgcatcatccacatgtgtttctgtaataattatgtcagcttttgtttatcctgttatctcatggctttgataaagttgagtcacacaatgcttagcatgtaaaacatttattcaatactattgattgaatacataaaattctcttggtttaatgtccttttcctttacttagacccttaacattgttattcttgcatacaatttcagttgctttactttgagcttgaagaaaatggtggcctgagccttgctttgcaggtaagagtgccagaatcctgttcttctgcacataaatttaatcagctttacatctgagcatgtagaggttttggatagagattaaaaccctgcctacctcaaggggttgcgcgcaatccctatctaaactatccattactaagaaattggtctcgctatttaaacattgtgtgtgcaaaaatgacttaaaagttagcttattatctgcaaaattatcatagtttcaactatgtagcaatataaaatgctgcatagttgtcagtcctgcagattcacaaacaagtttgagtagtcctatactcttgtctattgaattcgctattaaactgtaacaccatgtaatgagcaaaccggtgaatatgtttttgctttgacaacctttgcttcatgcaatatgcaagtggcttaagtttgttttctcttgttccatctgcacaacctttcgcaggaagacagtgtaaagactgggaaggttacttctgctgggatgtattttcttggctttcctgtgtatcgttttgaacaaaacaacctggtgagtttacatatgtgtcatcgttgttgaatcctccaagtgcttctctgtgattcatttctcacaagttccttttaatttcaggcagctgctgcaaaggatcctgatagtgccttctttaaaagattggacagcttccaaccatgtgatataaatgaactaaaaccaggcacacacttctttgctgtctatggtaatcactttgtttgttggtgcagtgtcaattacttaagacagtacgaatccccttaaactctacgcttcactcaggtgacaatttcttcagaagtgtgaactatactatagaggttgtatgtggtgaatctttccctgctgaaaaggagaagctccagagtgttgaggcaaagatactcacaaaacgagcagagctatccaaatttgagaccgagtacagagaagtatgtggttgctgcctttccccttgttttccctcacattctttctatgcactgggcgtcagctgtcaacatttttcatattccgagattcacaggttttggcaaagttcactgagatgaccagcagatacacacaagaaatgcaagcagtatgtacaattctattgcatagtcatttttgtactccgtcccataatataagggattttg

SEQ ID NO: 10979 - DNA, 4898 bp, Oryza sativa
ctaaaatcccttatattatgggacggagggagtattctactattttcttagtccacatggtctttttgtagatcgataatcttctgaaggaaaggaatgaaatccatgcgtcctataccaacaattcaccactgaagaggagttcaagcaggagtaaagctaaatcgccttcaaaattttccaaaggtgaggaggaaaacagtcagagaaaggaaaagaaagtgaaagaccaacccacgggtggatgcagaagtgcagatgaagattcaaacgaaaagaaaaccaaagagcggttcccaaagaagaaatggttaaacattcctttcaaaattgacaggagaaagccatgctgagtgatgtaatatattcttcgctgtgctatttttagtattttcttatgaagtatcctcagtatacttatctttcacctttggtttttgcaggtaattccctgcatcatactgtttaaccaaaatacagagcattttggccctgaccattcataacagaacccctccctggtttattctagaaagattgggtgcaggcctgagatggttggagaaatatttttttcgatccccttgaagctccttttggtcagtggccactcatcgaactgtatcaaaataattaagagaccgagctcgtgatgtgatcgtgagatagaagcatccatagcttgtcatatgtgcagccaccattgtccaattatgattcttttcatcgtatattcgtatgtttagttttgtttcgattccctttgtaagcagttgtaaatataggttcttttcaccatatgcttgctgtacataatgtaccttcttccctcgtctggattcctgatgtgtaagaaagacaaaccatttacccagttttggatttgtcattcatgtgtagtttgttgatgcatgctaagctggagcaaagtattcttgcatcgaactaagttgccgtttttgcaaaattctgaagctatggaatgttgccatgagccataggagatgccaactccatggaatctctcttttaacaagcaattcacatctcaagttgtcaacgattttgctagcactgaatagcgtcctttgagatcctcaggcaaaatttattcgttccaaaaggacccaaaatgtaattgatcatgtgatcgccgtcagcccaaagcatgtaataattacaaaatggattaaaacgagggcccaaaatgttattgatcatgtgatcgccgtcagcccaaagcatgcaataattacaaaatggattaaaacgaggtaacatactattatatgattaattaagtatattagattaaaaattgaaaaatacattaatggttttttaaagcaacttttctatattttttttaaaaaaaacatattgttttagtagttcggaaaacgttcgcgcgaaaaacgagggagtagaaattgggaagaggaattatcgaacgcaactaactcttgtttttattgaattactacctccgttccatattacttgtctttttgagtttttgtttgtcaatgtttgatcattcgtcttattcaaaaaattttggaattattatttattttgtttatcatttgctttattatcaaaagtactttacatatgacttatctttttttatatttacactaatttttttaaataaaacgaatggtcaaacgttgcaaataaaaagtcaaaaacgtaagctattatgggacggagggagtataagataatttcaaattattccatatttccattggacaataaaatccccttttcattttcgaagtaaaaaccgctcctcatcaacaacgaagaaccaataaaaatcgacgattttcgatcaatgtcgtacagaacccggttaatatcgatcggtttttacgaaccaagacctaacggtttaacgaaaatcgatcggctttatgaactctgttgacaccaagtcctgagaccattccctaccactctctttccctccatttgctctcctccaagaagctctcccgccatctaatccttcctccatccatggcgagatctcagatacctgaaggtaagctagctagcaaaaggtaggtgtagcatcgcacgctgccaagaaaccgaccatggacactcacctcgtcgtcgtcctggcattgctcgccgccgccgccgcggcggaggccaagatgtcggcggactactacagcaagacgtgcccgcgcgcggaccggatcatcgccgacgtgctggcgcagaagcagatctccaaccctacgacggcggcgggcgtcctccgcctcttcttccacgactgcttcgtcggcggctgcgacgcgtccgtgctggtcgcgtccaccgccgcggcgcgctccgagcgcgacgccgacgtgaacctgtcgctcccgggtgacgccttcgacgccctggcgcgcgccaaggcggcgctggaggtggagtgcccgggcgtcgtctcctgcgccgacctcctcgccgtcgcggcgcgcgacctcgtcaccatgacgggggggccctactacccgctccgcctcggccgcaaggacgggctctcctcctcgccgtcggcgcccgacgccgagatcccgcacgccaacctcaccgtctcccgcctcgtcgccgtgttcgccgccaagggcttcaccgtccaggacctcgtcgcgctctccggcgcacacaccctcggcttctcccattgcaaggagttcgccgcccgcatctacggcggcggcggtggcggcgccgacccgaccatgaacccggcgctcgcgaagcggctgcaggaggcgtgcagggactaccggaggggcccgaccatcgcggcgttcaacgacgtgatgacgccggggaggttcgacaacatgtacttcgtcaacctccggcgaggcctcggcctcctcgccaccgaccaggagctctacggcgacgcgcggacgcggccgcacgtggagcggtacgccgccaacgagacggcgttcttcgccgacttcgcgcgcgccgcccggaggctcagccaccacggcgtcaagaacggcgccaacggcgaggtgcgccgccggtgcgacgcctacaacggcggcccgcgcggctgatcgcggcgcgcacggtggcggcggcggcggcggcggtgcctcgaagcattgatagtctaatcttagattagtgcaggaagataacacggagaaattcaaattagtaggtataaaaagaaaatatcttgctgttcagagaggaaaaaaaaggggaaataatcaactttcacaagtgaaatcatttcgtagtcatatactttaggctgtgttctaacgattatcaaggcacgaacaaataaattaaatactactccctctgtttcacaatgtaaaactttctagcattgtgtctagattcattaatatctatgtgaatatagacaatgctagaaagtcttatattgtgaaacggatgaagtagtatcaaggtaaaagtaactatttaaaaccgttctctaacaaatgttgattgtcgacgaagaaagttccacttcctgctacagtattcgtatgtatagagttggaacaatcggttagtatgaaatgcaaatgaagatgtagctagagacaggaagaaaaacttttatacagttttaatcctcgtaaatggtatgccatggccagattgggggcggcgtgaacttgcctgatctgggggtgatgtggctaggcttggcagctagagggacaacgcgatggtctggtgacgatgttgagcaggtgggttgtgtggtgttggatgaaaattgttggtgaaagccttggctagcctttggctagcttgacaacgacgaaacccttaggtgttgtttccctccttggaggcgtcgttttggcgtcatttctcctccactatcaagaaccttgcctgtgcaacaatggtcgttggtagactccagtgtcgaaactccataggcttagctgtttggcaaggcattcaccttctggcttttgtcttggttgtggtgagcatccaactttcttcgtttcggctaggtgaagtcgaagctacttcgttgtggtgcaacaaagctcggcaacgataacacgttgtagtctctaggggtgctggtgttagctgtttgcaagaagtgtttgcaagaagtggtgcttggttggcttgggttgatgtccaaagcaagcagttggtgttgttttgttcgttttggcgatacctttggcaatgatgatgtaacagctgtgaagttggagctgctatgtcgctaggcgacaagctcggcaatgataacacttgtctcgtgaagtcgaagactttgtgcggccttacgataagctcttcttcgatgattgttttgggctccgtttttgtcttttttttcttagtcttggtagcttagatagttagaatgtgcttgtgatatgcatgatgtgattgtggaaagagagatggatagtgttggggcaccctaggtaataaactatccaatatccaacgtgatcaccaaatgtatttttatcctacttatccaaatacatgtgatggtcccgttggacactggacggtatattacttagggtgcccgcagatagaatattttttgagggcagatagaatattcatatagcaataaccgagcatacaacgctgaaaagatatctatcagtactttatggctcagtgcagtctatatgaagtgggatccacctttgtcgatttcaatacaaatagaccctttaggggataaatgctactagtgtaattatactaggtcggggggagtgatttgtgaacacacttggtatacattgagggggaaagaaaactctaactctaacctattatactctctccgtccctaaatataaggaattttggtgggatgtgacacatttctagtacaacga

SEQ ID NO: 10980 - DNA, 8185 bp, Oryza sativa
aggggcgtctcgccgtacgtcgtcccggccgcggcagtcctcgccctgagctttggtacggcctttgccttgtttcctcctcctcctactccccctccccaggcgcggagcatccttttgattcgccaattcgactcccattgatccaacatgcgtggggagctctgttccctgcacattagatggcatcgtttcacaggacttggtagaatatatctgaatatgtgcacaattaccacagttgcaagctcatgcgaatttctcaagggcttgtaacatttatatctcgcggatatactagtacaccgttagatgctatatattttctccatttcatattataagccgctttcacttttttctagtcatttttttaagtttgattaaatttatggaacaaaattatcaacatctagataataaattagtttcattaaaactaacatttaatatgttttgataatatgtttattttgtgttaataatgttgctatatatttttttaaaactttatcaaacttaaaaatgtttgattacaaaagaagtcgaagcaacttataatatgaaataatgaaacagagggattattatgccgaacttttcatatttttatcacgttatgttacagagcatgtaattttttctgcggtgtgtggaatcaatactaactctctgtttcagaggacagtcatatggagggtggttcagaatttgcttcccgggaagacaaaggaccagagttctggagaatctaccccttctgggatcatgtggtcctttgccgctggttccaatttgtcaacatctgcaagctttaatgctgaaaaggaatcaaggaagaatttaaataagttctataaggaaatcaggactctgaaaaatgttaacatggcaggtaactagagtctatgtgtacttaagttaaaatatttgaaagaaaatgctgaaaccaagctctgagccttcagatttgtgttgcatattgtacacttaaaactttacttactcggcaggtcgtcaatttggggatgagggtctgttttttctagcagaaagcttagcctataacaaggtcagatatccgatatatcatatattgttttggttgcaatccatatatgagcatgagtacatgcttactttcttaccgatttttccttactaatatactagctcttttgaatactttttgaaaacgagttgttctctgtattcacagagtgcagaagaggtagacttttctggcaatgggataacagctgtggggatagaagcctttgatggcattcttcagataaatacagccttaaaatctctcaacttatctggaaatgccattggagacgaaggagctaaggtcttctcaatcttattgcctcttcgtatcattttgtttttgtagattgttggtgtgatgtatactatgcagacaatgttctcttcttaatttcattttctgaagtctgaactcatatgattacataaccatgttattacttaccttttaacttgttatcaaaaggttggctgtttcacattagcaccttttacgagttgcattgttattgtttgcctttatgcctaactggagtttgtacactgtgatagtttatcgattattcaaatactcatcttgctgatattatcattcattgggagcaaatatgatagaacctacccagcatgatatgtatagatgtaaacttaactttaactaagtcctcctgactgaatgtaacactcatgaatacttacagtgtctttcagatatattggtagagaatgtaggtatccagaagctcctattgaacagtacaaatattggagacgaggtttgtatctctccctccttccctctctctgtctctcttgcactctttgtgtgttgtttcatgcgcgtgcactgcaatgtaacatgatattttcttttcagggggcaaaagcaatttcggatatgttgaaaaagaacaagacgatacgtactttacaactcagcaacaacacaatagaatacagcgtatgtatatgtatccacttcatcgaagacatgcacttgaatcacaaatagaaaagaaaaactaaccatatgattgtttattgaaggattgctatttactatatctcctttttcttggagcagggttttgcaagtattgcagaagcactccttgagaataatgtgctacggagcttatttgtcaagttagttgctcacaacccagtggctttatatgtgatatatgatgagtgtgcatatgaagttgtgctgagatactgcggtagtgattacattggtagttcattttctggaactaactgacatgtactttgtctatttactctagtggcaactatggtggtcctcttggtgcatccagcctagcaaaaggaattctagggaacaaaactttgagggtacaactccacacatacttgatgaaatacttcagtgtagtttgattgttcgaatgtttggtaaagttgcaaatcttgtgagcaaaccagatgccattctatctttttggttttattttatattagggacatacaatatttatattggattactgatggggtaagtacttttttgtatgaatgatatcacatgcaaccaaatttctctcctacttctttctgatggtttcgtactatattgactttcttctcaaatttaaagttgaaatgctgagtggatgtttaaaaaacgtgagcacttaaaaatgtgacattctcaatattaaaggatgcatggcacaagatggttagaccttctctttttcttttttacgatgcataagattgttagactagcttttgcacttataatcatagatacctacaagcaaaaaaggaacccatataatagatacatgcatctccaaaggcatgtgaagctacatgtactatcctataccctttcaaagtgcgttgaatttaaagtttgcagcaatcatggggagcagtgcacagttgtgattgtccatgtactgcacccgcatttttgtgctgaactctctatgttgtgtaagaaattggatcaaattgccagcaatacacaacacgtgcatcttaaaggccagttaattaaattttactcaatttaaggaaaattgtactcctattggaatatgaaatttttgtcacatactccctccgtcccataaaaaaccaatatagtattggatgtgacacatcctagtactacgaatccggacatacctctgtccagattcattgtactataatatgtcacatccagtcttagattcactttttttgggacggagggagtattggttagctgatatccttaaactccttcaacaccaataccatgtattactaaaagcaaacaatgtgttaagaatccatgcaagttacaaccttttgttcaatagtaaactaggaaatttttccatgagctattgttttaccatttttctcaattttcttttcgaatgtatggtattttgttcctgtcttacttaattagtcaggtgcacattcattataccataataactagattgttgattgttttaaacctttgttaggaacttcatttgcatggcaatggttttgggaatgagggagtacgtgcattgatgtcagcgttgtctgctcacaaaggtattttctgcactaaacaaatcaactagtagcttcttacgggattagtttacccctattttggccttcttggatgaactacagggaagatcactgttttggatattggtaacaacaacattacctctgaaggttctcttcatgttgctgagttcatcaaaaggacaaagtctttactatggctcagtctatacatgaacgatataagtgatgaggtagtacttctgttatcatttacctgttctgttttatgccagtgactgaaattttctgattgctacatataataggacatgatcaagctagagaaatttgcttatcaaacacccgcaagattttattaagcatttaatgatgcttatgccaaaccaatatataatttctgctattatggaactatgagctaaatagagtactgctttagaacttaggctgttagttacttaggtttaaacttcttgcctaaatcctgtttcttgtaaaattgacatatacatgatgctccagttcttattttatactttataattcgatgctacccccatcactctttaactccatagtacatcaaagagcgggagatttacttgttttcttaattcatatacatggtttttcacatgtgatccaacgtatcaaatgggtacacatttatgtaattatgtttactttgtttggcatttttagagaaggaaggtgattttgtttggttttgtaacataaattaatatgaatgtcaccagggagctgaaaaggttgcagatgctctgaaacagaataaaacaatttctactgtagacttggtaagcacctatttgactattaataacacccaagagtttcatatactaccctctgttttgtaaattattattataatatcaccatataatctcagaacaaagtttcaggtttctcctctttatatctttgttcttttataaagagtagttcagttgattgtgtgttctaccgtctacagttcacccactgacccagtcctacttcaataaatcttttgtggctagatatatgtagacaagtatatggttgtttgcatgattctcttaaagaaactgcattatttgcacatctgtatatttatgtgattgatcgtctccatgtagtaaactataaattttctagatttgatgttaattattgtcttcattgtaatattagatattataatacttattcggatcagttgcaacgtgcgggactgccatgctagtatctcttaatccatggactattgaattccccataaccttcagggttgcttttctaatgttgtaaagtgagtgtagaacctatacaacaaaccttattcagaatagaggaactttggagggaaaaaaggaactgtattctttagatgtcccagcattccaaatattcttgtaaacaggtatacacatgctctaggtcttaagccttttaaatttgcagggtggtaataacattcactctaaaggggtaagtgcaatagctgaaactctgaaggataattcagtggtgacaacagtaagtcatcttattctgacttttttagtctgcacaagaaggtagtgctgtacttgcactaattctgaatgttgtctgtagttggagttgagctataatccgattgggccagagggggtaaaggctctttgtgatgttctcaagttcaatgggaaaatccaaacccttaaacttggttggtgccaggtaatcttcataactgaatggaatcgcggatgcagatttaagttatatcctcttcagcctggttacatattttgcagataggtgtatcaggtgcagaatttgttgctgattgtttgaagtacaacacaacattatctacattggatttgagggcaaatggacttggagatgatgtatgcacaatcttcgttgaattttatttataacttgcgctttgattcatacccatgccttctgatccttctctttttgaagggtgctatctgcttggctcgaagtttcaagatcatcaatgaatctttgacttcacttgacctgggctttaatgagattagagtaagtaaacactaaatgcagtgtctttttctttttgtattttctattggtgggtctatgcagatctccaccatgttcaataccctttatgctcctaacaggatgatggagcatttgcattggcacaagcacttaaagctaatgaagatcttgcagtcacatcattaaatcttgcaaacaacttcttcactaaatttggacaggtcagttgccgtaccagttggctattcatggtgtcatttgagttatgttttattcatgctggttgagtcaatgcaggttgctctgtctgaggcacgggatcatgtatatgagatgagcgaaaaggaaatagacattttcttttaggtgttcttgtttatttttgcaaagtagcttcgaaaaaatggcctaaaccatgacttctgcttggaagggatactttctgcataattagccacacaatcatggttgttttggcactacttgaagaaacgaaagaagaacatggggaagagcaatagagcatgatttatgcttgtcatagaaaattttggtaaactagttaactctgtaggttagtcattgaactgtccatatgcattttttctggaagcattgatctcaaattgatcattcatattggttgaaatagaccatatgatgaacattatatattatattataatggcttcactctttgcatgtctggattttgagcagtaagtgctcttatgctagttttttactttttaagtgtcattggttgtcctttattgtactttgtgcatacgatagcttgtctgttttagaactaggagagagtattgtagtacttgagttcctgtcttcccggtataaccgcgttcatgcccaaggattttgttttgtgctcgtcttgtgttctttaaacctgttgactcatgccatatccatgtgcacatgtgatgatcttcaattatgcagacctcacatctgtcggtgttgggcacactgtccacaacaatagcatgctttgaatgtcacacaaagaatacacgttatgatccaaatttgcaagatcatccatgtagaatgggattgactgagttcatgtttaattgttataattccatggaaatatgctaatcccttgctgggcattccttggatgatttccttaatgcagatgcttctttctcaaatgaggaagcatataagattaggaagcaccatgcttcatgctgcattactatataattttccatcatatatttcttagatatgtcgagtgccaatcatatgtttaattgttgatggcacagacacacttgccttcatcgatgctctctgagtttgacatctttttacattatgtattaaagctatgcaaattattttgggagaacaattttatatgcgccggtcttcttatttgatcagttttctgtatttgatatgcaaaccaaatttactcctatcgatgttgcgtggttgtatgtttaatttcttaaatggcaaagtaccaattgtgacatataatgattcttgcaatctactacaataatttatcgtgttgtcagtgatcttgttcaacatatgtaataaagcactgtttaagactactacttgggatattctagagtgtgtcgttcatcgacagttcgacacaaattaaactaaaaatgggagatgtcgatgccattggttactaggctagtcctcagattgaattggttgtcgtttgtgtcaggcgatatttgttgtagttggacggaatttgttcagctagtaatcctgccgtggtcaaaaccctaattctgaacaaaatctttcattggaactagcattagttgcaaaggaatgttttggtttggttggtgacatcacgaaattggtgtctttcaccgtgcctattctctggaatcttgtcagcaaccaatttccccatatcatttctgtcatttctctaaatcaagtgcaataatttggttaatattggaagtgtttcaaggaactgaagacacaagccaaactctagctaaactttgccggactaatactatatccgtaaaccactatcactagcatacgaattctcaaatctcaagcccttaatacatatgccagtcctcacaggagacaaccaaataacaataatgaaaccaatgaactagcaccaaatacatgctagttgtaattttcagtgtatggaaatttattccaatgtatgatgagtggtggaatgttccacgatcagtcgatcactatatatatatatatatatacacacacacacatgtgtgaagaaaaacatttgtatatatattgtggaaatttattccgataaaaccatttttttttctaaaagaccacatcagtgatgggtgaagggtggtaattaaaagatgcacgttacaaataagccccatccgtatcgggtgagaatactacttgacacggcccgtaaaagatgacctagttatttgtgtcggttaatttctttcctgtgacctatcaagggtaccgagctcgaattcgccctata

SEQ ID NO: 10981 - DNA, 4876 bp, Oryza sativa
  unsure (1)..(4876): unsure at all n locations
tatatatatacatatatatatatatatatatatatatatatatatatatatatatatacacacacacacatgtgtgaagaaaaacatttgtatatatattgtggaaatttattccgataaaaccatttttttttctaaaagaccacatcagtgatgggtgaagggtggtaattaaaagatgcacgttacaaataagccccatccgtatcgggtgagaatactacttgacacggcccgtaaaagatgacctagttatttgtgtcggttaatttctttcctgtgacctatcaaagatgaagtcattagggcaagtactataatgttccatatgttgcccttaaaaataccatattggatagagtgatgaggtggaggagagaagtgaggagagagaagatgagccatccctaagtcaagaggcaacatctacacaaatttcaagaagagtgtgagagtattagaaatatttgtatttgtgtaccaaatacgatatattgtatgtgttgcatcttaattcatgagtgaataaaatagataaatttggagatggtagtcacatctaccatagcacttgcccttaggaacaggtgatagaacaaaggcaatgtttttgctaatcaagtaagctgatgtacacacaacgctaatcaagttggcttctgttcgaactccatgagaagctctcagggccaggcaggcaggcagataaaacgtacactccacagctcacaccttcccaaatcaatccgtttcatgcatcatcatcctcctgtcgatcgaaaaatctccatctgatgatcattgctactatatatcaaatctagctcggatcagatcatcatcaagacacatcaacactatataacggactgctagctagctagctagctaggtgagctacgtacacaagaacttctccattgcaataatcaatcgagttaattaattagttagtactagcaaacattggctaaagtatatatatggttttccaagtgcagccgccatggctgctcctcctccacctcatcgccatcgccgtcctcctcctggccgtggatagtgtgccgccggcgccggcgccgccgccggcggtggcgacggtgttcgacgacaactacgtggcaacatatggtggagacggctaccacctggtcaaccagggcacgcagattagcctcaccctggacaagagctctggtatacacacagatagattatatatatgacactgttagattcagcatttagatcagcttgatcatagtttttgcttcttttctctctctattttatgcttaactagcttgatgtgatcatgcaaattaattatcatgcatgcaggtgctggattcaggtccaagttgatgtacggctcagggttcttccacatgaggatcaaggttcctgccggctacactgccggcgttgtgacagcctactatgtgagtgctaaactgctaaatcaacttcacttaattatataagtgttaattcctatcacatgttctttaatattgactaaaaactaagcaccagtaattaactgaatgtaacaattaatttaatttatttctgaaattgcacgggtagctggcgtcagagccagactgggacgtgcaggacgaggtggacttcgagttccttggcgacaaggatggcaaccccatcacccttcaaaccaacgtcttcgtcggcggccacggcgaccgcgagcagcgcctccgcctctggttcgaccccgctgccgacttccatgactactccatcctctggaaccccttccacctcgtgtaagctcagttcaatgtcaccatgacggccgtatacacttttgttttaaaacaaatagtagaaatagttacatctttcgtctctaccaacaaacacttgcacatacaataagcgatgggataaatccagtgttttaaatagcgggctataacatttagcagttgacccttctcaagcagctctagacggagatttaaaacctggataaatctaactcctacaaaatgaccacctgaattctgtagaagctaagacaaatcacatgtacaagccatcgatttgattaattatttggcaggatattcgtggacgagacgccggtgagggtgctgaagaacctgacgagccggggcccggagttcgagttcccggcgaagcctatgcggccgcgggggagcgtgtgggacgcctccgactgggcgacggacggcggccggaccaaggtcgactgggcccgcgcgccattcaccgcggccttccagggcttcgccgtcgacgcctgcgccgccgccgccggcggcggcgtcagctcggacgactgcgggtcgccggacacgtggtggtggaacggcggcgagtacaggaggctgacggcggcgcagcaggcggcgtacgatggcgtgagggggaacctgacctatgactactgcaccgacaatagcaagaagcgcccagtgccgccacccgagtgcagcttcacctaagctaactgtgaataaattcactgcacaaaattagcagaattaattgcgaggatgaaaggtgcagcagtatactggtatatgttagcaattaagccccgtgttcatccattggaattcggaaaggttgtgattacagatagccattccgatataaatatggtgtgttcttgacttaaggccctgtttagtttcgaaacgaaaatttttcacctgtcacattaaatatttggatacatgtatttaatgtttggatacatgtatagagtattaaatatagtaaaaaaactaattacacaaattacgtgtaaattgcaagacgaatcttttaaacctaattacgccatgatttgataatgtggtgttatagtaaacatttgctaatgaaggattaattaggcttaatagattcatctcgcagtttccaagcaaaatcgtttcgttattagtctacgtttaatacttcaaatgattgtccatatatctgatgtgacacagcctaaaattttcgttcgcgaactacacaagcccttactagtacaattttgcaaccaaaatttttttctatacctatatgttgtagtcacattttagtaatgctgtgtttagttcacactgaagtttggaagtttggttgaaattggtacgatgtgatagaaaagttatgtgtgtataaaaggtttgatgtgatgaaaagttggaagtttgaaaaaaaactttgaaactaaatagggcctaagtctgagttacaggacacgttaaaaaaaaagaagaagcaggaggttgtagaggtcacaccaatgggttagaaggaggatggaattcaagttgccgattgccactgcagtgcaaggctgctcattgacaccgacagtgccctgtgcgtccgtgtgtccctcaggcagagaggcccagacaccactgccattgttgggccgtttctcgcatccaaaacctatactatttcggccgggccgtcgcccccgcccccattagtccattccacctcccgcccggcaacgaagccaaagctttggttttcttcttcgttgctgtgcccgccaagcgaacgatcccgggacaccacaccacaccatcatttgctcgggatatccgatcgatttgagtcgtactccagtggcgagcacgtacgtacgctttccgcggccgtgtgcccgcccgtgcgtgcacgaagctagctagcgccatgattcgcgaccaggagtccgcccgcaaaagagaggcccccggcccggcagaatgtgcccggtgcccggctgaccgtgtgcgccgcaacgaaaggttttgccagcggaaaagaaccaaccgctttacagccaacagaaaaaaccggccgcactccatcgcatttttcttttgcccgaaagctcgccccgttgtctagtttgatacgagtactcgaatagctcgccagcccagccacctctcgccgtgcgggcgtgcggcaccgcacccatacgccggtagcgatcaggttcacagttttcttcgactccaaactttaactttcttattttccattagtatattttttttaaattgttaaatgatgtgtgtttttttttaaaaaaaattctacatagaagttatttttaaaaaaattaaataaatctattttttaaatttataatagttaatatttgattaatcatttgctagtgagttttcttgtttcgcgtgcaccggaaatctttcttcaaactcatctatcgaaccaagcctgagtgagatccgatttggatttcgtgaaaaccggattaaaaatacaaaccactctttttttttccgttaagttcaaaaatccatagtgaattttaaacttttgataaaatttgccggattttatcggtttgttaataggttccacgaaatctgatgatacagcttgtgagtggattttgatccgatataggggctgatcttttgtgctgctttgcagcaagctatggctgtggctgtgttgtatcggaaaaaatttgtaaatatactttttttttcaataatttaccattatatatatgcatggaaagaaattgtaaaaatatacctatctcgcgacggtcccacaggacggtagtgctgcaccacgacggtcccacggatccaaaatgcgggaccgcgacggtcccgcgcgaccaaaacacggcaccgcggctagagcgattttattatccgatcggcactgtttagtactgttttaaacactgtttagcactgtttattacagtcccgcagacccattgtgcggaaccggcatgcaaacagtgccaaatagtaacattgccagatagtgtnnnnnnnnnnnnnnnnnnnnnnnnnnnnnnnnnnnnnnnnnnnnnnnnnnnnnnnnnnnnnnnnnn

SEQ ID NO: 10982 - DNA, 2837 bp, Oryza sativa
  unsure (1)..(2837): unsure at all n locations
tgtggctgtgttgtatcggaaaaaatttgtaaatatactttttttttcaataatttaccattatatatatgcatggaaagaaattgtaaaaatatacctatctcgcgacggtcccacaggacggtagtgctgcaccacgacggtcccacggatccaaaatgcgggaccgcgacggtcccgcgcgaccaaaacacggcaccgcggctagagcgattttattatccgatcggcactgtttagtactgttttaaacactgtttagcactgtttattacagtcccgcagacccattgtgcggaaccggcatgcaaacagtgccaaatagtaacattgccagatagtgtgtgaacagtataaaacagtgcgtgaacagtgtcaacgcattgataaaaatcgctgctatggcggtgccgcgttttggtcacgtgtgaccgtgacggtcccgcgttttagatttacgggaccgtcgctcccgtgtttttagagctgcgggaccgttgtaggatgggtatatttttataaatccttacaatacagatatataaacgtaaattattgaaaaaaataagtatattagtaatttttttcgtgttgtatctacagtagtagacattatattaggtttgctgcagctgttgcgatcaactctatagcctcatcttttcgcccatacttatcatttaaaatttaaattttcaactttaaatttaaaagttaattttggattttttttatcatagtttattttttagtcttacttttagatcattaagaacacgtatatatataagtttttttatttatatacgtgacaaacgattggggctgaattgggaaccctggtgggcgacagcgccctacgggctccgccagaaacggacggcgctcgcggcgccgctcggcgtcgggagggatgacatcgacggcgccggacggtggggccacaccctgttgcactttcggcgaatcggccataataagcccaatccgcaatccccgatcaaccgtggtaggctacccctttgcatgacaggtgggcccttcaaccaagaggcggggtctgtcagtggaacttgtagggtaggtacatgcatggtgagtacgaaaaaagcggaggagatatgcaccggcaagagttggctgcgacgggctggatcggatttggagaggggaaagaaggaaaagaaagaaatcgtcgccgggggccacttcggtggggaaagtcggggggtgaaatggtacggtcacggagatgttgcacacacagacacactcttgtttgttatttttgacatgtgggtgcacgatagtgtagggtctgcgtgtcatgctcgtgtttgggtgggctctggataatggaatggtaaaggtgcaaataaatgctcccttagtaggcaatgataatgctgagagtacatgttttatgtaccaaatgtctaataatccattttcttaaacggttaaatgaatattagtagatgctatcttacggtctaactttattgacatgacaggttcctatttaaccttgtgttcgtgtgatgcaacatttacggagccatccagcgaaacagcttatttgcaaatggaaaataattcgtgaataaaacttttatatacgtgttcttatcaatctaaaagcaacagctaaaaaataaatttcgatgaaaaaacctcaaaatcagctccaaatttaagattgaaaatttaaattttaacttataagcataagtataagcgaaaagaagatgccttatttgcatatgtgttcttgtctaacgatcaataattttacgtttgacaaaaaaaatactttcttttacgttgggaaagttgtttttttctattcacgcaagtgatcatactgcttgaaatgtaagagaaataaaagaacaacttgttaaaaaataattataaaacagtctagaagtatagtaacaatgaatgaaaaacactaccaacacatataacgctatggatcattgatgagcacggacaaccgtttatactagcgcgtaccatctataactgataaagcataaaatgcattggacaattcacatgtattcatctatgggttttccattctgttcaaaatcacacagacaatattaggtcaaagtttaaaggctagtagagagaggcgatccttcgcttaacttcatgtgtagttagtgtcactaacatagcacatcatactatgcatgtctctagtagggcagtcgcagtctcgcagataattatggccccgttaatatggggaataggtcgagcttattaaccgcacgtaaaattgatctaaaaaataatttgtaaataaaacttttataaacgtgttcttagcgatttaaaagtaaagattaaaaaataaaattcgagtaaaataaaccttaaaatcaatttaaattaaatttaaggttaaaaatttaaattttactagctgataagtaagcggaaagatgaggctcttattcctttttttctcgtcggagtgcccgtagcatttccccttccctcctttttgagcgcacgccgcacccactcccccgtctcctctgcgctgccgttccccgttattcgccaacgcttccctccacccgccccctccccaagctgagctgtgctgccgctgctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10983 - DNA, 5183 bp, Oryza sativa
catcgcctcctcctcctccttctcctcttccccaccaccttcctccccacacacacacaacctcgcgcgcgcgcggcgagaacgagaagcatccagggcggcgcggaggcggaggcggaggcggaggtggagggggggggggggggaaaccggaatggcggcggcggcgtggggcggcacgacgcagaagtgcgactcgtgcgggaggacggtctaccccgtcgaggagctcgccgccgacggccgcgtctaccaccgcccgtgcttccgctgcacccactgcaaggccaccctccaggtcccccgtcccctactctgctcgatccatccattaattaccagattttttttttgtactggctttatgccttgtttttgttaatctgggtcgatgctattattgcgagtactatcggcttcctgaaatcatatccatcttggaatgctttagttgttgttgctgtactgtatggcctgcttttttctttttctttttttcttttctcgagaccagtcgaagatgggagttaggttgcatgctcatttcaataatcaagttgcgactgtgattgactaactggataaccaatcactttgctatccgtttatgtgataacgaacccacgaagcatcagtaaatttgcctaaccacggtttatttgtttaatccatcttcgacgcaatttcttggcgtcttagtaaatatcccaattatttttcttgttattgtggcatgagggatggactggaatggatagggtagcaaataaatgtttgttttttttggtacaactgttgtctgttcatcatattcctgaactgactggttcacctattaaatatagtgctggctgatttgctaggttggtattatgctgttggtgagtgccgtatgattagcctgccttttgaaagtaataacatggaattaatcatgctgtcctcaatgcatcatggatgtaaatgcagctagcatgtttttttcttggttttggtatatttctgttgagaataataatgatcacactaaatctttatgcctcatcatactagctagaactacacctatcttgttctgtttgcaactaagctacatatatgaaaccagctaatatttttttattatcttttacagtttagtaactattcttctgtcgaaggtgtcctatattgcaaacctcactatgaccagatattgaaatcaaccggcagtttggagaaaagttttgaaggtactgaagagaaaactaaatccactgggcttgatgccttaattattgctagtgtctttacctcgaaattgttgctattgtctcatgatttttaggcctgccctaaattttgactatattatgccagggacatcaaaatcagctaaagcagaaaaatcgaatggaaacaaggtatcgtaatatatttctaagatatgctcttttatgtttttgaagcacgtccctagtatctaaattgtttggcagctttgatgtagaggacataacattcatgtccacttcctcttttatgttatccaaactgcaggggcaaccgaacagattctctagcatgtttgttggcacacaagacaagtgcgtagtttgtaacaagactgtgtaccctcttgaaaaggtcagtattatactactgtattatttaatcttcccctgttcaacttcaataaatgttataaaccaacagcttgcatgcctgcaggtcgtcactcatgtaatcgcccttctatttatgatatggttgacaattgagcattgtagttggcctcatcatcttatgtgctccatcacaagactaattcagtggcaactgctaatgcgataaatcttatcgtgcttgttattagaatatatccacaataattagaattactacatctgataaagttttccagttgtaattaagtatcaataattttcttctcacaagcaaaaagagtggcaagctaagccaaatggagacttctataccctttcctaaaatactgaattgctgtcaaattttcacaatgttgtagaatcagttcattgacctattttttgacaatatttaagaacacatttattacatgccaatatgctatatttttagcaatatttgggcgttatatacttttttccctcatactactgcattagtcattttctgtggctaacttatgtaagctatagaagaatgcaatgttaggataaccgataagaaatgattaattcaattaatattttgcaggttaatcttaacgggagctcatatcataaatcatgcttccgttgcacccatggaggctgtactcttagcccatccaacaatgtcacacatgaaggcaaactttattgcaagacccatcactctcaattatttatggttaagggaaacttcagcaattttgaggatagtactccaaatgcaaaagtggatatcgagaagcaaccagaacatgaagatgctaccaagaatccaggaggcccaggtcaaggtgatgggctcactgagaaacctttagaaagtgaactcactcctgagaaaccgtcacaagacgatattgtggctgaaaagcaatcacaaagtagcgttgatgtcccaaaacaatcagaaagcagcacaacagttcagaggtcagaagaaggggaaagggttaccaagggtgagtcaaatagtcatgtagtcagcaagaagccattggaaagcagtgtagaaaagccattccagagcagtgcagttaacttacagccatcaggaagtagtgcagccgtaagaaaaccatggcagcgcaatcttcccacagataagccattgctgagtaacacaaccactgaaaagtcaactccaagcagtgctgccattgaggaatcattgccaagtaatggggttgatgcaaaacagccagaaagcagcactgccagcacagtggtaaaaaggccatggcaacggagggtagctacggagaatctaccgcagagcatttcgccatcagataagccatcatcaaccagtgcagatgatgtgaagccatcagaaaacagcaaattgatcagaaaaccatggcaacgtgctgtggctgctgaggcgcagatacagaacagtggaccaactgagaagtcatcattgacaaatgatacaaagccatcagaaagcaccacatcaattaaaaggccatgggagcacaaagtggtcaatgagaagccactgcagaacaatatagacacggagaagccactgcagaacaatacagacactgagaagtcatctagcagtgctatcgatgtgaagctggcagaaaccagtacaacacccactgtgccacaggaacacagtggaatcacggagaaaccttcacagaccagtgcagatgatgtaaagccatcagagagcactgcagcagtggttaaaaagcaatggcaacgtaacatcggattccagaaacagccccagagcagtgtaactgatgcaaagacacctgaaagcaggggaatgggcaaaagattgtggcagcgcaatgttccaactgaaaagcaatcgcaaagcggtgcgtcggttgtgacaccatcacaagttagtgtggctagcaccaacccgctccaaagcagcgtggttgtgaaaaagccatggcaaagaagcgtgtctagagaaaaagagccagagaaggatatatctagcaacaaaccgttacaaaaccgtgtacttgctgaagaagcagagaaaaccaatgtgactgctgataacaaatcacagatcattcaagataaaaagaacaatggtgctaccacagagaattcatcacaaataagtgaaagggccaaaaaactaccacttactgcaaataaatcgcaagctgatactttcacagaaaaattgtcagaaagtgacatacttgctgtagcatcatctcagatcactgaaccatctaagaagccatcagaaaacactgctgaaaatgagaagccatcacagactgatattgctactgacgagctacccctgacccaaagtgtagaagccatgtcagaaccatctccaagtgatgcagctcatcaggaaatctccgagagggagatactgacagataaattaccagaaagtaccatggctgttgagaagctatctcaaactgctactctaaccgaaaagccatctaaagaagatgctgcagagaagctaccgcaaaccaatgaaccttctgagcagccacacgagagtgaagagactgctgagaagccacttcaaaatgaagctaatgctgaaagcacaacaaaacaaagtgatctcagtcttgagaagccacctcaggttgatgccaatgttgggaatcctaccgagcctgaaagtgatgccacttctggtgtgaactcatcagatgctcaaatcaggccaactgctgagcagttagtaggacctcaaggcattgtatctgccgagaagacatctgaccagatattagaagctaacaccgatccagctgctgaccagtcatcagagtcccaagatgttgcacctgctaaagttgcaacggagcaaccattagaaaatcaaaaggctgcagcttcagagcagccattggaacctcaacacgaagcatatgaagagaatccacaagagcataatagtgatgcaactgccaaggagtcatcagaacctgaaagagatactgcttctgatcagttggctgagcagccatcagaatctcgaactgcaggtgagaaggcaacactgcgtgaaagtgatgtggttaccgaggatccagcagaacctcaaattgatgcagctgctgaaaggtcagctgaggtgttatcagaatctcaaactggagttgagacaccagtgctgcatcaaagtgatagaactaacgaggttccatcagaacctcaaactgatgaagcttctgacaagtcaactgagcagccattggagcctgaaaatgatgcatctgtcgaggatgagaagccaccggaaatcgaaagtgatgatgtgcatgataaaccatcagaaagcaccccagatactgaaaccctgcctcataacactccaaagagtagcataagcattagcgaagctgcagacggcaacgtttctgaggaggcaccacctcagagcagtgcatccatagaaacgccatcagaaagtgccatagctgtcgaggaaccaaaacacgacgaacaggccagcataaagccatc

SEQ ID NO: 10984 - DNA, 7791 bp, Oryza sativa
aaagatgatgctggcaccaagcagacagaggaccctgtaactcttgagaaggaaccagaggaagacaagggaagtgtggagccaacacaggacaatgctggtcttgagaaaccgttggaggaagacgaggcgagtgcgaagccatcagaggacagtgtggttcttgataagccatcagtggaagatgatgacagcgccaagccatcagaggatagcatggaccttgaaaagccagaggctcacaaaccatcagaggaagaagatggcgcgaccaagtcatcaccggaggatgctgccgttgaggaggcgccattgcaaggtgacacagaaacagccactgacaaaccctcactagaagcagacaccacagaaactgcctgagctggttacagttagttagcaacagtacacagtttttaacccagatgggtggatactactgttgatactttggtttgccattttgcttgttttcttgttttgtacaatgcttgagttgtaaaatttgagggaaaacagaaaaggaactataggtattgatttgatttgctcacaagcaataagcccctcccaatattaggaggagagcagcattgaggatttgagctttacatacttacaatatagattttgcgtgtggcttgattaatttgttgtacatcggatgatgtaaatgatatttatgcaaattactgtgtgcttttgctcatttgtctctgataatctgtggagctgttcttgattgtgccttgtggcttgtggtttgaatttcaattcatccacaaatttcagaaataatttcttggacaacctgtcaggccttctttgaaatgggaaaaatttaaaaggtttttaaaataactgaactagtagattctacgaaaatccagtaaattctaaattttagggttttaaaggaaccctgatgaagaagaaattctaaaacctccccaaaacccctgtggctctgaactctgaagtcagcgaggaagggagaaggcgggagttctccatggctccgaagcggaagccgccggcgagggcggcggcggcgaagttggaccccgacggcatgttccgcggcgtctccgccttcgtcgtcccccacgccgtccagtctcgccgcctcgaggtcgcggctccaccgagcaatccatcccaacccccaccaactctctctcctgtgcttagggtttcctggctttcgtcgtcggtgcaggtgtggaagcagaggctggcgcagatggggggacgcgtgcaggagaagctcgccgccaagggcggcggcggcgcggtcacccacgtcctggccgccgacgccaaggcgctgctccgggagctcgacgccgcctggctccaccgctttcgcggggtaatcggcttggctccctagcttgaaaccctaatctcctctcggcaagcttggtgtgccttgctaccatctgcattttcacagcccaaatctactgctagtagtagtactacattgagttatagagatttcataacatggaaagatttctgctaacatcaagtgattgtgtttctttctataaggactggatttttgttgcagagagatctcggctaacatcaagtgattgtatttactactataagaactgattttttttttgattgcagagcgtggtgtcattcgagtggctggaggagtgcctcaaatccggggagaggctaccggagcacaagtttgctatcaactacgaagaggaatttaagccgaagaaggaaggtggtgctgcaggttcaggtgtgttgcagtctgcaaagaggagcaaaatatcatcagacggtcctgagaatcggaaggaaactgctgggggtaatcgagaatctcgagatgcaattgcacatccaaatgaagattcggatgttgtaaaggggcctagcacgtgtacaagtagccaaagtgcctctggagattctaaggaaaccatagcttctcaaaatgcattcaaagctgaggtataagcatggtcttataaattatagtacaaactaactgggctctaaagtctgggttatgttgttttgctgcacttatcctctttggtttgctcaaattcgtacaagctccattctgaacatatgtaaacaaaaaagaggaaacactttttagcttctcctttttgtaattagcttactctaagctctaagttacatctacactgacttcaacatgactagacttgagactgtttttcttctgctataaaaatgtacgcagttgcctttatctgttcaaaaatgaaaacactgctgtagcaactttaagacctttggtggtcagctgtatatctattttgcaccctcaatggtgatatattgctctgtaccatacaacatataactcctgaaccctgaggatttatatttcctagtgttgattcattgcttatataactaggaagcctcttctggagaatcctcaacgtatgctcctccagacttgaacaggaacataactgagatttttggaaagctgatcaatatatatagaggtaaggacattgtacagaaatcttctcattcttcttattcattgtattaacatttcatatactttctctacaaataacatttccttccctttcacttgaagccctgggagatgaccgaagatcatttagctattacaaggctattccagtgattgagaaattgccattcaaaatagaaagcgctgatcaagttaaagacctccctgctattgggaaatcattgaaagaccatgtatgttaatccttttctaccattaattcatattaattggtgatttacaagtcaacatatatatttttggcctttgtacaagttcatgattctatttttttatccactatggtctatgggtgatgtagtaactgtgtcataactctgttttcttaaaaatatgttggtcttctattttgttttgctgttgagggctgaaaatttattcacaccttcattgagcaaacaggttctaaaagtaccacagaagttccaaggaaaatatgaattcatacattcatcgttctacatgtaatatctcaggtgtttgattgtctaactacccttgtatatgcagattaatgagatagtaaatacaggaaagctttccaagctagagcactttgagaatgatgagaaggtaacttggttttcagtgaacaggagtagctcttaagcattatccagccatactccctgatatttactgatttgcatatcaccttaaaggttcgaactgtcagcctatttggcgaagtttggggtgttggtcctgcaactgctctcaagttatatgataaaggacatcgtacactggatgaccttcaaaaagacgattcacttacaagtgctcagaggattggcctgaagttctttgacgatatcaaacaaagaataccccgacatgaggtatgtattctgtaagcccattgaattgttttcttttcctattattactagctattcgaagtacaatctaacattacacgtattttactctcctgttatctaggttagtgagatggagaagcttttgcaagaagttgggactgatatcttgcctggggtaagttccatatagtatttaaaggaaccatttgtctccattacatataactacacaagccattcaaaaactaatactgaagcatcagttccatgttcaatttgtctcaacatatgcggtggttattgtttcctgtagcagctagttgcttacacctattttttgtagttccctattagtctgaacctgactacttattttgtttggagaactagatgggttggttcatcaccattcctccagtcatcctctgaaagtacacatccagtacaaaaatgaggaatggggtcatcctatcgagatcctaggccgatttgattcttgaaaacaaatagctcatatatttaagattttagtagaacaataatttcccttaagtgattattgggttgttatacatgatcttttttatttggaggtgataattgtatgtgggggatcatacagacgtggaaaatcttcttgtggtgacatggatattattatcactcatcctgatggtgaaaggtatacttcaaaactttcaaaaattgttggttattgagtatgccacgtgatttttatttaagtatgatgagaaattacccatctgctgtgcgttcagtgtattctattgaattcaacactgaaccttggcaccacaccaaacagccatttagttattttacagtcatggaaagttattttctggcaacttgtaggtttggtttatcaatttgtcatctatcataagcataattattcattatgaccaagtttctattatgcggtctgcacacaacacatttttatataagaacatcaatgattaatcatctggacattgtaaaagggaccatacatttttctccagtcatgtaggctttttaccaaaatttgttcagcgcttgaagggcatcaattttttgagggaggatcttattttcagcatacacagcattgaggtaagttcttggccactactttcagagattttgagaagagtgattataaacaaatgggaaagatcacatttggtccctccacttctgcttggatttaatttatactctgaacatcaataccgcttagagcacatgtttcaaccataaaaactgttcaaataacatcccgagtatattttttatggtgattttgggtgacaaggtatcctatttacttatgggttgatatgctttaataatttaccaaagaaaatttttgttctggttttttccccaaatgaggtggtgtggataccatgattgaaaaggcagccacgtaatccagaaacactcaagaacttctatgaatgtaatttacactgctttgatagtcaatggatgaaagcaaaacaatattaaagttctggatgtaagctagaatgctagatccgagcaagagttaaaggaccaaaagtggactttttcctaaacaaattgagaaaaaaaaagataagatcatataaaagtgggctaaatgttcatatttcaaagtgctatcacacaatattggttttgtagctattaagaatatattttatgagaaagaatgaatgatcagtttttaatcttgaaggctttttaagatcaaaatatatcttataaaaatcgatggaagtagtacctttttaacatcttgagaaattgtgtaagaagatttgaacgaactggcattgctcatctcaatgcagggaactgattgtggagttgacacatattttggtctttgcacatatcctgggcgtgagctgcgccatcgcatcgacctcaaggtataatattattccagcaggagtaatttggttcatgtcatcttcatttgacaggatttgtttcttattgattaaaactaaacaaatttcaatgttccttttgctgtttgcatctccagtgtcttcaatagtcttggtcttatgttcgtgacacatcaacaaagcactgctttgttctttgtccttttatttatggcattggcatgaatgtgattataaacttacaatccttcatcttggtaaataaaacaacatttatagtgatttccccatcgactatgccatgcaatatatgctgcataacattcatgtaccaactcatgctgataaaatggtgacaattcgatgttagaaggtatacccaaggaacagacatgcatttgggctgcttgcttggactggcaatgatgttctgaatcgacggtatgcatttgagctctttagtcatacacgttatcatgatcaggaatgcaagaccacagcttttttttacaagtttcgtaattgaaacatgcagattaagaatactagcagattccaaaggctacattcttgacgacactggtttgtatcttgctacaccgggcagtggtggaaagcgtgtatgtacatgtgatttttcattccaaatccatacaagttgtttgctttgctccattcattgtgagtttttgcaggggggaagatcagatgctataattaattgtgacaccgagaaggatgtgttcgatacacttggattcccctggttggaacctcacgaacgtaatctctagcctttgtcgaaacccttctgtagaaaatgcagtttgctagagctatataccttttgtatttcccctactttctattgccagtaggctggctgtttccaaacctgtctgtagaaattaggaaaaatgtagatgtagtttgctagatttttatagttttgttttctcgtactgcagaaaagcagagttgtttttgtctttgacacttgccgcaatggtcaaactctcttttgctggcatgtactaactgcagacaacagtatatatataactctgttgtaaatccatttcttatgacctctcagacatcacaatggtttgcaaagatcataagcagagtttgcaccgcagttgtgtctatttttcagtcaaatcaagattatttctaaattcaacaatgcaaggcctcacaaactatcaagcaaccatgcatgataacacaacggcaaaaaaagaagtgatgttaaaccatatcccatcggggcaacaatgaacacaaaacatacaagaattcaggcataatgtggttcatcttgaatgttcttgtgaaatttgacaggtcaaaaggcatttcttaacctgttacactgagataataatcacaatcctaaaactctcctttctcttgacattgcctatccaagttccgcatgcagactaatgataatgctgcatcccggacactagtagtggtgtcaaatttgtaggcataaacactcaaaagtcaagaaaaccctttagtccataagtagtaccctacatggatgtgatcatgtgaagattatttacatctctctgtgcctaaacctacaactggaactaagaagtggaactagggcagcaaaaactgtgatcatcagaagctattgctgggaccacctccaagcatctcctccctgtcgatgaagcgctcaagaagctccttgttcttggtaacgatgcattcatcatccttgccaaaccaatcgtagcgattctttgcaatgtaatcgtagattgcatcccgcagtggggcggggatgatcagcagggagctcaaagctgagtagggaagaggcaggtacgatgcaactttcaaagcagctgcaaccaaaacatggaagatttagtaccctgattaccacaggaaataagggtgggcaaatatgacatgattaaacagcaaaaagtacataaagaattgctgtttattttttttccctaaatgagtatcattaaaaggatccttcagttagtactttcgatcttccagttagtgctgctatatggacagtacaaccatatctataatctatgtattctgccagattaattggtgtctcagggaatgattgagctacattatgaaaggaactgtggcctctagaaatttgtacttttttgcaggagcacagcaatggctatcattgcaataacttggttgaacaaatgcatgatccaaaaaaaaaatactagagtgtaaagcatgttgctctcatgcattactggtaaataagggggcacacctatctatcacaaacctagcaaatgttgaatcctgcatttgacacaactcataaacaccagaaagaagttcagaggtgatcccattcagaaaatcaaagccataaccacagacactagatggtactgaaaatcacccaaagcatttatcaagtggcctctaaactccaatgccctccatg

SEQ ID NO: 10985 - DNA, 5202 bp, Oryza sativa
tatagccaatgaaagagccaattcatacaataggggcatattacactattaatatccggtcccacctgtcatacacacattacgttatggagttcgtgctgtcactggatacagatctatagcccgctgttcttctctatctggcatttatctctttaaaatatatttatagctggcatatagtatgctattgtacctgctctaacaagtagccaacatgttcttggaaagatcacaacattgccccgatttccgaatcatcagagatgcaatgctaacctgtggatccctcgtagtaggcctcaggcccctcgatgaagaggactcgccgcagcacgtcctccctgtccatcccgaccagtctcaggtacggctccccggccttggactgcacgcagcagaacctgatcttggcgtgcttgtccgccttgatcacccacttcacccctgcaatgcaaagccccaaaccgcatttcgatcacaaccaaatgcccccaattcgtcgccgattcgaggtagaaatgagtccccccacaattgggggcctgtacatgtgctcaccgcggtggcagaggtggcagacgccgtcgtagatgagcacgcgcggctgcaggacggtgggcgcagtggccgcgatggagacggtggcggcggcggaggcggaggacgcggtgcgcggcgggggctcctcgtcgccgacgacgacgaggtcggcggccgcgcggggcgcgtagccgcggaggcccgcggcagcgaggagggggcggacgcggccggcgagggttcgggtgagcattctctctctctctccgccggcggcggcggcgcggcgagacggtggttctacacacaacacgcgggtgttggtttccttttgcttgaccgctcactctctccaatttattttggacattaaaagggccttctggcttggagggtaagtaaaaaaaaagttttatttttccatttgtgcttgtgtagttgccaaagattatgtgtgcttatttttaaagaattatgctcatctgcaaaaaaaatggtgcattttaattaaaccctaataaaattgatttgctattacaacaactataaaaaaggggttcaatttactccatcacggtattttctctccatatgtaagttgtatttcacactgaaatttgattggatgatagatgggtaacaatttacaacttatgtcttattatccttttagaatattttttataggtgtttacataggttggaaatacctaagattaattttgaactttgagattttaaagttcaagtaaacgatcatgaaaaaagttgcaaatattatttgaactttgatagtggtgtctctatggtttaaaaaatttcaggtataaagagaaagaaaaagaagaaaaaaatgctattagtgagtacagtgaatcattttcaatagtttagagacaaaatgaaccaaaaagtacttaggggtaaattagaaaaatattttagtggttaagtgatccaaatgaaatacttcgagcgagtaagattgattttttctcctttttgttttccaaaatagatatcataaccaatttagtgggattttccttggtcttaccactcggccctgcacctttagaattctaaaaggcacatttttttttgtcaaaatttgaataataaaacttaattttagagttaatttaaagatttttcatcgtattttttaaacattaacgtttaagttgttattagttttaaccgtaaattatttttaatcgataatatgttgtttggcgcattatccgtaattggccaaccgatgaaagcctgagaatgaaagtatatactaacatttatattaaaattatttttcattgctttcatcactaatgcttcgttcgttttttattaacttttgcaactccattcaccgtgagcatgctttctaaacatcaattgaatggtgcttttttttacagaattattttatatataagtttttttaaataattcaaataaaaccatttttttaattttgtaatagttaaaacttaattaatcactactccctctgtttcatattataagtcgcttttgatttattttctcatttcgtaagtttaaccaagtttatagaaaaatatagtaatattttcaacccaaaagttttatatgatcacaatatatttacattcaatgttacatttattgaaagtaaatttaaagttatagatattgttaattttttttgaacctaaaaaagtttaattatacaaaagacaaatcaacttataatacgaaacgaaagtagctaataacatgtctcagtttcatgtgcaagaaaacagctcagtacaaccgagtatatgtcccttttcaagtcacattcaaaatattgtaaaatattggggattctaaaaagttaaaaggcagttcagattgtaatcaaattaaaccttatcaaattttgtcattggcaacttagtaatattgccaagttttaacatgatttcttatgtatttattaaagtttggaactccctccgtcccattttatgtgcaaccatgattttccgcgctcaactttgaccgtccgttttatttgattttttttcaaaaaaattttaaaacataagtcacgagtaaagtactatttatgttttattatcacataacaacaaaaatactaattataaaaaaattcaaataagacggacaatcaagtttgtgcggggaaacttatggttacatttaaaatgggacggaaggagtaaaaactaagggcttatttggttctctaccctacctatttattggtagtgccaaaatctaggcaaattttggcactaccaattttttggtagggaaaagttaattagactacttttggtttaataccaatatggagccaaattttagtagtatggtgaagaatattctagaatatgtccaaattgagtatgggcactatcaattgtttggcttcaaaccaaactagcatatttactatttaaattaccaaaattttggtagggcacagttttagcttcaatccaaaacggtcctaaatagatgcacatctttaacgacatttcttaaaaaaaattggtatagtttaaaatgacatcaatctgaacaatccatagaaacatcactagcctaatgctgtatagagaccatgatccatggagtagttttttctgaaaaaaaaatgtttttttcatttttttatcacatctccttccagattttgttcctttccaaacggtgaaacggtagaacccaaaacctcaactccaggagcttccagctccagctcacccctcctctttcacgataagaggcacccagacgaacacctaagctacgcgcgcgatgctcccatgggcgccgccgccggcgacggcggccaccacctccccggcctcgtcggctccgctcctccgcgccatgccccggcgcgcgcgctctccgcgcctcccaccgcccccgcaccacccttcccctcctccgccgccgcttctctcggttggccccggggcggcgccgcgcgccgcgcgcccttcccacggcgacgtgttctgggaggagccggacgacggcggctccgggagcgacgacgaggatggggatggggcagaggccgaggccgagcggcaggaggccaccgggcggaggagcagcttctcctcgttcccttccccctcgctgttctccaggctcggcgccgcgcggcggcaagagcagcgagaagaagaggagcttcgaggaggtattggttcatctgctgcatgcgctagacaaatcaaattttcttttttcatttttcagtttcttgatcagctgaattgaaatgcttcatgttctacacttaattctgtcgaatttttctgtctagaaatcgagcttctcttgacgcctgaagaaatggctatcctggatcagaacgagaccccggatatcaccaaaatatcatcagtaagtgtcactctgtaaatgtctgacagatattatattttggtgtgtcataaatttgttacattgctacagaatcttgattaaggaaatgtgcacaccattgatattttaactgttcccaattcctgaaattggactgttttgtgcagccgaaatggcatccacttcatagttacgcattggcgctgcagatacctctcatggacagcctgctcgatagtggtgtcgatatcaatttacttgacaaagtatgttctttctacataacatgttgaggaagcatgtttcatgctcatgattttctattttggtgcctgtgaaaaaccccatcttggattatgcctgtgaaaagcttttgcgcattcacgaaaaagaaaaccgtgttaattttgggagtgctgatgatacaggatggtttcaccccacttcacaaggctgtcataggcaaaaaggaggccgtcattagccatctcctgcgaagaggggcaaatcctcatgtcagagatagggtaaccttgcaaggctgcaatctctttctatgaattatgtgttccataataacattagtatgtggaatatagtaaactttgtgatgttagcgcctatcacattgatctggtttctctctctagcaacataagtacataacaatttccactccagtttgagatattttttatgtcatgttggcccttgaattaaatctgtctgatttgcaggatggagccacaccattacattatgcagttcaagttggtgccctgcaaactgtgaagttactgattaagaatagggttgatgtcaatgttgctgataatgtaatgtgctatggtgcttttttttttcttattagttcaacccttttcagtgccattgatttttcttttattttgtctcgtttcatgcaggatggctggacaccgttgcatttagctatacagagtagaaatagagatatagcaaagatattgcttgtcaatggtgcagataagacgagaagaaccaaggtatgttatgcccctatggtttactgggtttttttttccggaattgcattatcccaaaaaattagacctataacagctgcctcttgtgcactcagagccttgattttatttggcaaattggcatacattttcatgtcatttttagccgcttcacagaaattgaaatctatggcattgtcatctcaaatgctcgtatttccatggacatcagctttgtattacagtctatagg

SEQ ID NO: 10986 - DNA, 7555 bp, Oryza sativa
cataagcgagcgttaattataaatatatttttttcatatcaaagccaagttttaaacctcaaatgatttcatttggcgtttaaaaagagttgagaaatgcacctgtctaggcaatgaaacaaaatgggattgcacataaacctcaaattttctgaacatgcaattatcacacgactagctacagtaagggcgcatgtttctacagctacagataagacacatgtttctacagtaattcatggggtttggcaacatgtcactgcaaacttccaaacagagcatgtaaggtagacaaacatttcacacatcattactatggtatgagtaactagtacaccttaaacagcaaaattcatgcaacataaatttgtagagatgacacaaaatccatacaataggtgcaatggcactgcaggctagtaaattcaagagttgcctactcttgcaaggagatgcgtctaaagatggcctggaaagtctgacctccatttcttgcaaccttctgaccttcttcagtggcggtagacagtagcttgacaactgggtctgcttttgtctcttcctctgggatagcttcgaacagcgggtgtttctccaggcatgaccgcatccattctccgagctcctccacatctgtgattgtatatatgattcctcccacttccatcacataagcatactcatctagcagctgcatgctgatcaccctccgccggtggttcttctccttgaagtgaggatcagggaacaggaagaacattttcgaaagctgagccttcctgaaatagtttggaatgtatttcatcgaattggtgcgcacgacagatatgttgtcgtactttcccggattcgatgctcttaaagccaaaatccgctctttgacatactcagtcacctgaaaaatatagacaacgaagaaaaaaatgaatcaaaagtaaatacgtactagctttgaaaagaaaaaacttccagttcttttgttaagtagaaatacatgtctattgcataatataataccatcacaaactaaactatgcaacttttgtctagtagaaatccatatttactatagaatctaaattggaaggcaacccaaattcccaatatttggtacactaaacattcatgaagtaaaagccatgcgcgatctaatcattctacaaaggaaagctcaaatggtctctatgagtaatgtaacactgaattcttcagtgtcaccttgtgctgttatccattcacacatgaatgtatctctactgcccaatcaaagtttagggggaaattctaacaaaccttgtccctgagctccatgccgatcatgagggtgtccgggaagagcgtagagaggccgacgagcagcccgccgaacccacacccaacgtccgcgaagcggatccgtggcaccgccgcgtcgccctggcgggcctcgccctcgccggaggggaagtaccgcgggtagtgctgcgagaggtctacctcgtcgggcgatatcgggatcgggaagtgcgagtcgctgagcgggttgctgtgcgcgcgcgcccggtagaaccgcttccgcgggagcttcccctgcccgccaccgccaccgccgttcgcgccgtcgccgctcgccatcgcgccgccgtccccgcctgcagctgcttcttggtctgggagaggcattacgccgaacacccggtgagcatgtcactcgacgcgagcggtgttgtgggagagggaagcgggagaggggtggggagggagtacgaaccggagagagagagagccctcgcgagtcgggagagcgggggattcgccggaccggtcggcggcggcggcgtcgtgggcggaagctggcttggcagcgagtctcgagccgcgcgggttagggcttggatgttggagagggaaatggaacgaggcgggggaaatggattgggccgcgcgagttggtttaggccctaagctgcagcccagcagcgacgagatgggccaagtgccgcgaaggccccgagcacaccgggtgttcggcgtaaggaaaaagttcagctgaggtcccttatgccttatcttgttatcgtttttaaaattattatccctgaatagcagatataacacatcccgaattttacaaaaccggatcacattggatcccgaggcagtattgcttctggttttgtacaaataggaagtactccctgtgtgtttttcttggttttgtcctttatcaaactatgcaaattttaccaaatctattaaaactgcgataatattacaatatcaaattattttatttaattctaccattcaatataattttttagaatatttttgtttagtaaacttgattagagtcgacttgataatgtttgatttatgacaaaaccagaacacctgatattttaaaacggagatagtatatcactacgttagtcatcataaatacgtctgtaatgtcgcatgatttttttattatatcttggttgatgttaaaagtgataatcagaatgagttttgcaagagcacaaaaaagtggaattggtgaaaaattgcggctgcatgcgaagctatatagatgtagcagcatgcaagttgtctacttgtctgcgtataaatctaccgcttcaaatcaaataatgatgctcgtcatagtattatcatttcttcagaagaatatcttcggctattactccctccgtttctaaatatttggcaccattaactttttagtacatatttaaccattcgtcttatctatatgtatacatatacgtacatttaaaaatgaatcaaatgataggaaaagaattaataattactaattttttttaataagatgaatagtcaaacatattttaaaaagtcaatagcgttaaatatttagaaacaacggagggagtattattcacaggagcatatctctggccacatatatttctttacaggctttagcagtgaagattaatgcatggctagctagctagctactccctccatccataaatataaaggattttggttggatgtgatatatcataatacaacgaatctagacaggagcggttggatgtgacatattctaatacagctcctgtccaaattcattgtatcaggatatgccacattcaagcaaaattgcttatatttagagagagacatagggagtagttcgttggctctgcagactgcagcagtgtcagctcgtgatatactcctccccagtgtgttgaatattggggctgtcagtaaaaacttgagcacagaaaagggaccttactaaaaatggagcatacaacggtaaagttcacccgttgtggaaagttcccaaacgttgtttccataggagtcgggccgtgtttcaacaccgctgataattcaagtttagccagtcaatttcgtccttttaataaaaccagtaatcatgcacgtgcaatacatgttctttccatcataacatgtttcgactaaattttacaatttatcagcatgagcccttaaaaatattggcggttcatcttgagaaataaagcaacacttcaatgtgtaaaaatacccactattatacactggaatccatgtagctaagaaataaatctatttaaacagaagtgaaacaagcatcatttctattttcatgcaaacataaatgaacaaacaaccaattcgtgcacataggaatccatgtagaatattaattgagaaaacacactcattcttacaatctaatttgaagaggaggtatatattataaatccacactcacattattatcctttcatcacaacaataccatatagatacacccccaagtgttgcacataattttgttaaaacttgagtgccccgggccatacctggaggaccacctcaacaaatccacaatggatttagccatgcagaatcgatcatccaaaaacaaattcctaatacatgaataaagataggtcacaagttttagctgagaaaaatatcacacatatacaattgtacaaataaaaagttatatctgcaatcgtaccagcagacctgtaaaggcacctcaactctaatgctaacatatttgtttccatttggcagtggaactgatcatctgcacagtcagaagaaaaagaacataacagtagatttgtcaggatcaatggacgtgcaaaaattcaccgtataaatgttcaatgggtgaattaacaatgaaaactttgatgtcaggtcacaactctaggatcccacttacagaacaaccaagatttttcaagaaatttatttctgcttcaatctgcagtttccgtttaaccaatcatgaggcaagtatgccaaaattttagtggtttttcctaacaatattgcctataaactataattacttcactaatcctgaacctatttcgataaaagaaaacctagaaaatccactttgcagtttgcaccacgtcgagcattctcattctcattgaaacaaaataatagatatttttgtgtcattccaccaatcatatagatcatctcctccaaaactaatttgtgaactatgggaatttgtccatacatattttagatcattaaagcatctgatagtacatcacattgtattcctaattctgtaagcaagatatttgcacgcaggatgtttttttagagaaaaggtcgaagaacgaccctgcttatatagaaagcaaatttgtcttgctggggattccagcttacatcaatgtgcatacatcgaccaaaagaggcccctccggcctagagaaacaaccaatttttagacagcagggacaacacaagacccataagtgaagatacagcaggcgcatcgattcaaaaagctttccaaaacacctccacaaagtaacagacagcaaaaaaaactctaactaacccaccccagttctgatattttgcagtccagcacagcattccttcagtcttcttgtcagcaactccagttcatcagtctccacacctttgaaaagtggtttccactgcttgtctttgcactcaggatgttgataaaatacaaattaattagcctcattttgttggtaaagggatgatgcgagtactattgcaactgcctcctagcatcctttccattttgttttcctggccctttagctcattttcacttctagaaaattataattggtaccctttatatttagtctaaatcaagactaattacctcgtctgaatagaagccaaagcatgtgtaggcaccaattgttcataatttactttccaacttccttaaatcctaattaaaaaaagtgatcatgatataccggtaatcacatgacctgtagcagacaacgtggtatgttcaatttataaaagagcgtatgctataaaatttatgtgtattgctcatgtatcaacccaacgaattcattgtaatctagtaattcaggttcagatgaaagatcaacatattggctattcacttaataaaatagcatcaatatgaataccaggtataggtacataccaagaaaatgttcaggtttgctctgttattccaatttcttacagattttcctacaaaattaaaagaaactgcagtatttagcaccaaacacagccaatgattatgcattaaggaaaaactacataatttacaaatctaacctgaagtagttaatgtaaatcttcattggtcatgagagcaacatcatatttcaaatagcaaacaccatgttcaaaactattatacataaaaatattggtaattggtgcagcccactaattttaggatgattttttaaaaaattacctcaacacaattagaagaaggatcgatgtagactattgtagggtttacgcaaatacatggggtgcttgactgctcgatccagcggttgtggcatggcggttgtgggtaggataatggcattgatgttgtctcggtagcgaccggggcgcagtacaacggagtacttgaatatgttaaaatagctcttcaatttggtgctaatataaacagactcatcaaaattccccaaatctacctcttgaaatgttgatgctttcccttccttttcaatccatcttcccaattcccaaatccacaaatcaggtattacaatttgcaaatcacaaataagtatatgagaagagaaaacaggatcccaagcccagctagcaaatgctggccgactgatgcggtcctgtttgctgcttactagggaggcagctgattgctcctcggcgcccacccacgtgctggctttctgcccgcacaacacagttgcattgcgctcttgtggcgccgccgccttggcctctggtagtcaggcctcggcccaccaccacgccaccgcctttggtaacgcatgccgcccgtgcccgatcaccggcgccgcctccctcaatctcatacgctcgcggcggtagtggcggctagggacgacctcggctccggcggggacagcgatggagggcagtggcggctggggacaacctcggctacgtcagggggcaacggtggagtgcggtggcgggtggcggtggctacggccgggggcgaccacggctcggtcttcggtgggggtagctgtggagtgcggcaacagcggcgacagccgggggagacctcggttccggcggggcagcgatggagtgcggcggcggcaacacggctggggacgacctaggcttcgacaggagtagtggaggaatgcggcagcaacggggacaagcaaggaggagcgaggagcgcggaggcggagtcttcgcgcgagctaaaatcatgatggatggatagggtgaaatcacggtcgctgtgggaagggtgaaatcgccggtgaacggtgcggattagggattaggcgatgcggatgcggatgaacggtagggattgattcgggtgatttggcctgtaggattggagggggacaactcctcctttttatattagtatagatatgatgttgtaagtttaaccaccagccaaacaacgttcttttgctgagttgggatcctctcctgtaatgcatgtgcagtaagtgccaatgacatgtgggcccggtataggtgggacccacatgcatgtcagtgacacgtactgcaggtgcagtacagcagtggatttgcgtcctcttttgctaggttctcaacttctgcactccatcgtttttagcttcccgagctgttaaacatattttgcaaaaattttctatagaaaaattactgtaaaaatttataataatctattttaaaaacttttatttactagtacttaattaatcatgtactaattcattactctatttacgtgtcggtgtgaaatgttcccaacacagcctgacgaacgacacatcatcctcatctctaggtagcgctagctgcgcctctcgcagattcactacaaatgaagacttaccggcaccggccgcgggttttttgtcatggttgtacaatggcactgcttttatcatcatgctatgcacactactacatgaaagatttttctggacgccgaacccttttgtttccaggcggaccatatgtggaaccgcacaggaaaatggggggaccggcgctaggccatcgctcacacagaaaaatcaattttcatgtgcgg

SEQ ID NO: 10987 - DNA, 17169 bp, Oryza sativa
  unsure (1)..(17169): unsure at all n locations
nnnnnnnnnnnnnnnnnnnnnnnnnnnnnnnnnnnnnnctgagtttttcaaagtaactaaggagatatataaaattaaattggaaaataattgtgattagtttaatgagctgaggaagcatgtgtatgaattaaatatataaaggatgattgtgattgtttaggacgagagaataataattttattgtggattgtagggaataagtacctagctagctagcacacaaggctaacgaatgtttttggcagatgcaactagtagcagcaaattaattgaggtcattagggatggaattctgaatctatgttaggtggctagtagggcattattctctgtcagaggatgtgtctattcaacagggaattttaactttcccattagtagacaaaaaacatgcatgtgaccggtgatgccattttctgcccaggtgtgccaccacaccaagattgagaattatgattggcaggggcactattttgatttggatttggtctcaatccccgatctacatggtcactaccctgattaagaggtaggacaaggcactttttcatggatcgacgttctacatatttttgcatatgattatcatgatccctctgctacagaaagccacagccattccttttcttaaacggctccaatttataatcgtctatagaaaaggttggggccgttgtaaggtcataggctgcctgtgaaaatatgtcaccatcgattacttaagaaaaccgcctacactaatgaattcattattatttgcaaattcctagagaatccaagtcagtcgtaagttcataacagttaatatcaatctgaaaatgactctgtacaccacacttgcaattgctacatagagttgtcggtggttgtactattccatcatcaattctcattgtgatcagttgcatggtttgtgatttgatgttatacttcagatttttctcttcgaacaagatttcttttaatcgatctcctcttgttccccaatgcccagagaatgcggtgcattctttgttaatgcagagatagacagctgaatttccagttatcttaagaactctactcatctgattctagcttattattgcaatttgatttctttcacccaggatcatggttgggcatcccaattgctatgtgtggcttgcttgtctctggctgccaagatggaggagtcctctgccccacccctccttgaccttcaggtaactaacttgatgtgaatagtgagtactcaatgtctttatttgcttttgttatgaatatgaatttcagcaaatgcaaacagattgaaggaacaagattcatttttgaacctcggacgatccagaggatggagctcatcgtcctcgtggagttggattggaggctccggtcagtgacgcctttcgcctttgttgatttcttcgcttgtaaggttggctcctctggaagaagctcaaggatcttggcattgcgtgcttgccaaataattctcagtgcaattcatggtaatgctaacgttttctttttgagggaacagaaaacaaaattttactctaggatgcatataggttgatcatttattcgcatgccatataatatactagatgaataatcaaaattgttttcgttagagtctagttaaaatatctaaaataagcaaaatgttgattatattttaattttattaccatactatcactagtagtaaaaggtggcataacataagtaaactaaatgccaatgtcaagaggtgcaaaatagtacaatgaaatataatttgttgttttcattgcctgaataatattatcattgcatctttgactctctattgaagtacttttttgttcccctctctttgatgaaaagatgaatcactggagttatggtgtgagtagtgagtactcaatgtcatggtcccgaaaactgttggttttaccggtcaataaccggatggcaaccagttccccgggtagttaccggtcggaaggatgcgaatataaataaaataacatattgtaaaacttgaatatagaactattctgttcgggaacatgtaaaattctaaatttagatttgaattcaaaattagcatttaaatttcaccaggcctgttcctgccaaaccggtattctgaaccttgctaggtagcactatttgcgtcaggattaagagggtgtttggatggtgaccacactttaccacaactttaccaaaatctgttgtagtacataggaaggagattattggatttccatttcaatcaaccagttagctggctaaatgatcatccactacctgggccaatccaaacacatttgtaacatcctggattcctggtgacagttcaatgtgacaagagatcagatgctttcttaaccctgctaaaataatagtacttgcaccattttctgtgaaaaactacatgagtctcatcatcattaattacatattgaaattaagtgctagtaattatccttaaacatcccaactaatgctaaacttgtccttgaatctcgctgcatccaatgctcgctaattgatccaagaatcttcttgttgccatccgtggaacagagctcgagttcctgaaccactgcgcctcatcaatggcggcagcggcggtgctattcgcagtaaatgagtcgcctgcagccatgtcgcacaggagcagcgtcagctctgaatcagctgcctcgtggtgcattggcctgactgaggtaagtaacctgatctctgacgtcctgaccaacccaacccacgacatgatcaattgaaagatcttgtagtttgcaaaactttgtcagttcgtcagtaactttgaaatgatcctttttttaaaaaaaatgtttttatatttgttattacaggagaggatcagcagttgctatcagctgctgcagcgagctctgaatgctactgcgaggaagaggaagcgacatccgatgatacttgcagcttgttcatcagtaacaagttcatcttcccggagcaaaaggcgcaaacttgatggccattttggagaagattgaatctttcttttcttttcttttcttttcttttatttgagtctgaattatattacattcctcggcgatttctgttcctggatgagctatttatttgtttatttttgcatccttgtggttgttgaagctttgataattttgtagcttaattcagaaagatgacatatttgaacataaatgtggggatcgagactaggattaaagatttctcaaagaaaaaaaaagagtaaaattaaaagaggagcacctgtatgatgaaatcgatggggaccaatagggcagcaacctgtgtgtatttctttctgcaaagtgatgcgaaagtgaagcaaaggatgcattcgatacgacactttggactattgggcacactgcactttgcagggctgatcaagttagctaccactagattagcaaaagcttcctccccttgtttagccctgtcaaagatttgtgtttgtttagctagttaaacctgattagtattatttagtagtactttttttttcactgctcaggaggactactcctaggacagtaggacctccattttcagtgacatgcttatactacttctgttttaaaatatagctatttctagcataatatcttgtcccaaaataaagttatttctccacatacctcttcctctcatccaatcacaaacattctttttttttttgaacggaaaaacagcactagagtgccttttcattgaatagagcaggagaaaatacaaacccctaggggtaaaaggaaaacagagaaccactatagaaccactatagctgtatagtgtgcgagattaactcacgcaaccacttagctcctgctaaagccccaaaggctcgcctcctctttgattttcattagtaggaagttcgttgccacctatttgtgatcaaaaatccgccgattcctctctttccaaatttcccagacgactaacagaatgagcgatcgaagtccttttctcgggacactaggcgtgtttgcaatgttctcccaccactgtttgactgactgggcttcctcccattccgttgggtccatctgctgatagcccacccatgcagagacgaggtgccaaatcctcttggtgtatctacaagtggcaacaaggtgcaatgccgtctcaatctcgcggcggcaaagagggcaacaaccattgttctgccatcccctggtcgcaagccggtctgaagtccagactctgttctgaatgatgagccaagcatgaaatttgcatttccccgacgcccaggctttccaaatcaaggaattgaattttgtgctcggcgccccgcagcactgtgcatggtaagccgaggaggccgtgtagtgcccgttgtttgtgaacttccaagtaatctgatctggttctctaacgtctaagtgcacatttcggaccacttcccacagtgcggctagctgttcgacaaggtcgattgtgatagatgattgtgaatcaagcttcaaatcttgcacccaggtgtcctcctcctttccttgccgaaggggttttcctctgttttttgagatcgcatagacaagcggcatgaggtctttgggtcttcgcccaccaatccacgtggactcccaaaatcgcaccgtgtttccgtcccctattgttatgtttgttgaggcggcgaagaggttcctatctatttcatcacatggcgtctccagccccacccaaggtttggtctggtccttccattcatgccacaaccatctcaacctcaaggccctcgtgaatttgtccagatttaggacccccaatcctccttggctggtcggcatgcacgtctttgtccaattgaccttgcatttccctccggtaataacacctgtgcctgcccagaggaagcggcgccgctgcttgtctagctgcttgagggattcctttgtgattttcagagcggtcagaaggtagattggttgcgccgttagcacatatttgacgagcgtagttcttccagccgctgccatattttttcctctccagcttgctacccttccggaaattttgtcaaagataggttgcaagtccaccttccacagtcttcccagagctagggggaggcccaagtacttgatggggaaacttgccctcaccacagggatgccctcaagaacctcattcaactcgatgccgccgcatctgatgggcgccacttgggatttctgaaaattggtgacgagcccagttgcagtgccgaagtgctgcaggatgtccgtgaaggccgtaacatcgcctcgggtgggattaatgaagatgatggcgtcgtctgcgtacattgagatccttagcctagttgttctcccccgaattttcgagattgcgccgagctctgtagccttgaaaaggattcgctgaagggggtcaatcgcaagtatgaaaaggagcggcgatagggggtcaatcacaaacattctgtttcatctctttttctcttctcaaccaatcacacactttctctaatcatttccacctactttcttaatactcgtaccaacctaaaaagtacttacattttgacacggaggaagtactaacaagataaattaacggttaagatcacttatatcgatgataatactaaatagtagtagataggggtactcgtttgagatcaccataaaggtaagtcgatcatttcattattcagagtacattttaagtaaacaaaataactataggactctgaattttcttttttcaggagaccatccatcctatgaacttgaaaagattcaggacacttcatattacatatttatagttgcatgcgtgtgttagttagacctaaaccactgtgctacttaaattttgcctatggcaacacgacaaccagttgctatcttcagggcaagcagcagagagaggccccaaattcttaccagattatttgtcctgcctttatgtaaagcagcgtcgtcgtcgtcacagtggcaaagatcatttgctcaccagctcgatgcgcatttcgaactgctgcctgcagccagccaagcccagcttcgtgacacacatgtatttatttaaaagatgatctgaacaatcgatgagatcgactcctttcccagacaaatgcattgccccagctgctactgaagctgaggtgtcgtttaatccctgcactaatctagctatgaaaaaacaaagctctttgcgtaaagataacctaatcttggtcagtgttaaagcaggcaatgattgttgatatattgagatagtgtgatgacactgtggttttgatggatctgtgcataatatcatattatcatgggagagatatctttgcgtaatctgttcagtttggggctttgtagattgtatcattgtggtgtttgcctttggcaggtattatctctgatgatggatgattatacactgattgattaagatccagcttagcaatgtgctatagtactaaaactaactgaactgctgaaggtgataatttatttaatttgcaaaagatgagaagtgcaggtgtggtgcagttatcaagtttctagtatagtttttcataaaattgttgagtttctactatttgcaacagtgagctggtggccggccaggcgctctccttttctgcaaaaaatttaccgtgaccttaaaaattaaaggcataagggcatctccaatgtgcatgtaaagttaaccttaagcactaaaataatatttgtagtataactttatgtattgggaagtaaactcacaagagaatatatggctatggctaaccttaagagcaagtataataggaggctgtaagtcggctaaatgctgaggtgatggagagaagagaggagagagaggagaagcgggctgtaaatttacagccggcttggacgcaagaaccaaaaaattctgtgagagagacaaatgggcactatattaattataaatagttaactattatatttgtaggctaagaaaaaattgcaaagaaccttataaccaacaagtcggctgtattattagccttgctctaagcttagagctagccataagaaatataaaattaatttatatcttttcaatgtgtatgttggctttgaatcttcatgctaaaatggacgaatacaatttgttttccttggtgggccacaccttaaggtgaagaagagatgttatacattatagcatttaccacgagtaaaaatatatatggttgtgggtttcaccttatggttatggtgtatcttaacactgaggataccctaatgcggggacatgaggagtggtcttgctaggccatgtgggagccaacttatcacgtcaggcgaagcagtggctccgcatgaccacgcgtgccctagagaagctatggatggcttcccaaggaaaaacgttccgaagatgaagccatgctcaggtagctccattgctcgccgtcgtggttccaatctcatcgtcgatatgttctactgcgacctttgctcaaggctgctttgttgctaggacctttgcccagacaactccaccgtcttgtaatcaacctggttactccaccatcggtgccccttgatttggcctgatcatattcgtgacctgatccaatgagcacatgaccatattgctaggagctcaaccaccggaatctagtccgctcggagcgcggtggccggagtaggattgtaggaaacacaatggcgattgaggtagagatggacgatgcgcatagtctgagaagggagatgttggagactaggagaggatagcaatggtgattgaggtgttcgggagaacaaggaaacgacagcaccagtatggtaaagcaaccgacgtgaggcggacaaagaagcgaccggagaatggaggagaggagtcgtcaatgaacatatggaagaagggactgatcagagggggaggggttaggaaaggaaaaaagaaaagaaaagggagggtgactgacaggtgggtccacaagaagcttaagggtctatatgtatttcttttattataatagggtttaaatcaatttataaaaaaaatattatgagagctggtatataagctatccatggactcagccggtttgataaatgataatgaacattttcttcaacatgatatttttaaaggcatggatctaatcaaccattttcaaatttcaaattttttacatttgcatgcgttacaatctgataaaacgctgattgaaaccgctcttccacatgcaatggcagcttttaccagtcaccaccagtctaccacacgcgcgtgcatgccgacggacggtccgtcctcccctctcgcgcacgacaacagaacaagagatggggacgagaaagaaagagaccaatgacggactcacactctcgtatatcctccctcctctcctctttcccagtggaatccatggctcctctcgtcgctttcgtccctgcccatctcacacgcacgcacgcacatcacgcactgcgtctgcatgcatgcgtctggccggctccctccccctttcggcccggagaaaggcggagtacgtcagtcccatcaaaagaagccccgagtgcgcgctggatcgagagccgcgtgacacgatcgtcgtcgttgatccattccattctcgttggatgatcttggaaagtcatgatatgatgaacgtaacgtcccgttcttttctgattaagatgtaaattttattttcgtttttatttgtttgatttccaaactgctagaacagtgtatattttttcatcttaagtagaaacgaacatcacctaaaggtcctgctcgtcatggtcctagttaatttttacttccaaattttatactagtaagtggtaaacaaaattatgaagtgggtttttatgcggcagcgttggtaacgaagattcgtgaacggaagccggccgccattgatggaagtggaggatggcagtggcggtggagcagagtatgccacatgccacgctttgaaagcctgaatcaatcgggtattgttcgatcgatttgtgcgttctctgaagaagaatgggtggctctttcagctttggctgaatctccatcgatcgatcgatcggcaaggcaatcgatcaagctccccaacgttccgaaatgcagccgtcagaaaaagagggaaaaaaataaaggagttaaaagcgactttggtttggtcaacctggtaatcaagcactactgatcatcatcttttttttttacgtgccttgatttgtgtggcactctgccatggaatttggagctctttctttcacattctatctactgaattctgtaccggccaaccaaccagcaatgattgatttttttttctggtgctttgttgtacagccacaaacccatgttgttttggacagatgtgctatccaagcttctgaaacttttttaggattggtatttgtaaatggaaattgtatgagtaggtttagctcgaaaagaacttgctttcctgatagcattatgatttaggacaccaaagttgtgtttgggacatgagagagtaggattcatcaagaaaggaaaataaattcagattagggtaattatccccaacagaacatatttgcatcatgtacaaacatggcatgatgctccagtgtccctttgatgatctgttctgtcaatcatttcagttcttcaactaccaaaccttgttcattgcaggggaactcgagttcaggtgttggcacctaacttggcaaatctctagcacttgtcttactaccaactgcatctgcaggaaacaatatacaaatgtgcaggcctaataggccgcgaatctgaagatgtatgcttgcttccaacacataaagctcggattccagctcctgtgttctatgattgcggcgatccaatgatcacaaattcggcacccaaagagcagcagtaaaatacacaagaatccttaaaaagctatctgcaaaggatgtactttgcatcttaaactgaatatataatagtacatcaccctgcttttgattaataaatacccctctgtatgtgccaactctaagatgcaatgcaaattaaggtaccaacttacttcccaagccagaaacaatcttgacctcagtaaaatggcctgagtaagattggtgatttcttacagtgacttggtacctactaactgaaactctgaatatgatgcattcagagctactgatcatcttcttctctgttgagagatgctgaacccaacacaaccaaactgaacatcgcatcagctgaaaatgcacttctgatgaaatgatgagcatgaactctaaaaacacagatcagttcaactggccggccactgacgatcgtgtcagcttctgacttcggcgatgctgtgcagtgatgggcgccattgacgatgcctagaatgtgtcgccgagctgctccgttggccgtctctgtcatgctgcaaaccacaataggatgggtggcagatgagtaatcagaattcagaacatggcactttgttaatcttttatatagtttaggagaccttggaatcaaatcaaattaaagataaagcaaaaattggtacaatccaaagaattagtgttggatgattcttcatgaccaatagttaatttttaggagttaggagtagctgcaagattttagactattgaaagtctggcctttcttggactttctgctatcatcttgtaaactagtaggttccatattccccatgtatctgacatcttacaagagaatgtcaaacttgcatgtttttatttaggagatgacaggaaagaaaaataagtaaaccacccatccatgcctttttccatgtggtgtgaggaaatcatggtatggcacacaaggttgttgtttaaagcttggtttgggaataatttgtccactaagtacataactaaacagagccattatatcatgtttaagagtacattattgctaaacatattcctggtatcatgatcaggtattatatgatatctataatggatctggttagttggttaggtactagtgtgtcacaaggagggtggccaactaaacatagaaataacagttgggttgagcaatagcctaagtaacttacttgcctcataatatactccaaatttagaatgttaaccaactatgtgctcacctactcctagactcctagtgttcactcaaccaaaagaaagaaattaattgcattggaacatagagctaaaattcaacatgcaaattcacaaatttaaatttcaaacatacaaaaatctgtcccttttgctcagaaattgagttctggatactttacttatgcaattagcacatatatcaatcaaattgttgcttccattataggagtataattaagttgatcgaatagtaggattataggagtaaattggccatggtaagaacagctgagatgatgaaaatcttgcagcaagaagattgtgacaaacctgatcaagattctcatcgagctgcgtgtggtcgtcgccgccggaattgatcctaactccggcggcgacggcggcggcggcggcgggcttggattccaggtgatgatgctgcgccgccgccctcctcgacttctcctccttcttcgcctgcagcgccctggtgacctcgtcgacggtgatgaggcggtaggcctggccgaggagcagcgtgtcccgcggcttgagcagcttcacccgcgtcacccgcaccgtgccggtgccggtgccgcgccgttcggcccgcgccgacgacggcggcggcggcagtggcgcccgcttctcctcggcgacgcgaagggtgacgagcgcgacgtagtggcccgggttggcgcgcatgacctcggcggcggtggtggcccagtagagccgctccacacgaccgcccgggtgctgcaccaccaccgtcgccgcctccgccgcctggcagttccccatcgagaaccgagaacaaaactaaagcttaacttccttcctccttgctggcggcgagcggcggcgccgcgtggcggcgagagcgcactggtggtagtacggtcgtcgcggaccgcggcggtgggcggtggcgcgacgcgacgcgacacgagagcgatgcgatgcgatgccgccgttggcgctcgcgttgggaactgaggagggtgaccgtttatatgtcgccgcgccagcgcggtgggtcatttacggcctaccgctcacaatttcgtcctactttttttaatgttttttgaggacaaagttttgatttttttttttaattaggcaaatattgttcaaacttagcaaaattttgtttaagttttttttttgttttcaaattttagccctctataattgtttactcatccagaaatatagttatatgctggcgcatatgcatgactttactctaatccatttgtcagggacttaaataagaggatcgcatcccgtataattgtggcatcacaatataaactctggtgggtttgagctatacaataagaggttaatgttgtttcccgtattcgatcgtttacatttcaacattaacctcttttttaaaaaaagattaataacccggcctttacatccacaaccaaagttaccctctcttttactctcttttacatgactgttgtttgggtttacttgaaaattttacttttccatgtcatggaagaagattttgcataagaacaaaggatggttctaaagggtcggtgatcatacatcctatcaatgatctatgcctctatggtctaacaaccaagcatgcagttttcaagaacacttgatcggaaagcaagaaaaaaaggcacaagacaaatgaaaagttattggcgatggcgtgtccagatactactttaatttctatttgacatctagtgttggcaatttgctgtagtataataaaagaagctttatgaagattatttaacttacttttcttggatacaaatagccgttttcggcgcctcatatctggaactgccttttcgcctcgttgataataatttttttagataataatggctgttgatagtagtgtctgttagtatagcctgtagttctgtaattattttttcccgttatatcgatatgaaacaccgaatcatattttttgtttgttttaaaaatatgtatagcagttgttgttactttctactctctctgttcgatatcataaactgttttagttttgtttaagtcaaatttctctaactcgtacgagcatcgatctctcgtgtaagatgttttcttagcagagtaatactgattaattaataaatgtgtccactaaacatgaacaattcccttgtacgagcatctcgtataaacagtatacttaatttctcattcaagtaaagactttgaagccatcccagattagtactgtacggtctgtaccagagcttacagccacaagcgttaccgtcagatttcagaagtactgaagcaaatgtcaatggtttcactctgaaaactttaaccaccaccgatcgctcggagtacaagtatatgtggtttgttgagattgtatacgaaatactcttgttgtatgacgttgttaatttttagacatgacgtatgatcatttatttggtttgaaaatttagtgcaaacacaaaatatatttctcatgcttaactcatcatgtacgtgagaagattgaggactatacgcatacatgtagctactcgggtttcatcaatagcactacaaaacgaaaagacaacatcttcatttaagttttggatgcatgtaactataaatattttatcttatgtgaaaaaagtaaaaaaataaaataagacttttggatgaagagaatacttttaataaaaaataattcacaataaaataaataatacttaatatcgttattctaataaaataattggtcctatgttatagcctagaaagtcaataactacatctagatttcctgaaatcacacacagccgcaggcatatgtcatttttggatcttcccatgaacattttccccccatcaacgcacaatttctccgccacggttgggggatcggctcggccgccacggtggcatgaggtcagcgccaatgggcctggcgctgacacgcgctaagccgacggcctatttttggttaaagtttttggcaaggttagtttcgaaataagttttcgaaaagggtcaatttgtcaaaaaaaaagggcaaactcagaacaaaaattatcaggatccaatacatattaattatctaaactagctgggtggtccgcacaattgtgcggctagcatcaatacaaaattatctattttttaacatgttttttcttgaaatttattaaatagatatctcatcgtcttaagatttgaaagaccaaatcttatcatctctgtgtttctaattttatagtttttaaaagtcacaccagttactaatgttttacttctatcatcccttctttatttgcttgctcgatcgatctaccactacttctattcattctctttggaacctttaaaaattggacattatagcttttagagtttattgtcttattgggttttggtttttataatgtttagaaatctcgttaaatactgtcactatactcctctacatcttgttaactgccttctctctttattgttattggcattttaaaaatcaaacgcttgccttcattttttactttctagaagccctgccaaaccgttaacggctttgccactgtactcttttgtgacttgcccgctgcctcttatctttattgtcattgagattttaaaatcgaacatgattattattggtttattttttactttttaaaagttttgaacctttaaaaattggaccatatagtttttagagtttactttctcgttgagtttcatttttataatatttagaagtcccgtcaaacacgctgctactatacttctttatgacccgtccactgcctcatctttttattgttactgagattttaaaaattaaacataattatcattttgggattttttttttactttgtagaagtcccgctaaaccatccacagctttaccactgtactcctctatggctgcacgttgcctcccctctttgttgtcattgagatattaaaatcaaacatgattatcattatcttttattttttaccttttaggcgtcccgccaaccgccttgactatgttggttaacggcctgtccatcattcctcgttttaatcataattgggattctatttagagttttgttagtagtttttagatgcccaatcaaccgtcaccactcaactctttacatgcacattgcttctcccctctttattatcatctgtcatttgtcatcgttgtgttctatatgtactttatttttttattttgaaaatttcatattttcattccgatatgttttatttacaaaattatattcctacttgaactcttatagttatttttctattttcaaaatttattttatttgttattctgatttttaattaatctcgtcatgtgttctggatggtctcttctttcaatagtctttatttttttattacaaattttggttatttataaattgtattcaacttttttctaatttcagaatttattatattttccttttttcctacggttaatgtggtaatttctagcatccggattgagtttttattacatttgtattttgaatttaaaggatttttttcaagaatatgcaaaagaaacatagaaacaatatagatctggtgataatgcacatgttcttttgctagtttttagtgtgcccgttaatttttattggaaggtgtaaatcactgttaaaaacaatgataggattatacgcgtatgcaaaagaaagaaacaatctagatctggtgataatgcacatgttcttttgctagtttttagtgtgcccgttaatttttattggaaggtgtaaatcactgttaaaaacaatgataggattatacgcgtgcggtacaactattttactgctgcctcacatgaaacctactctagttctgtttcgttttgctaagttatattcctttccaaatagagtctggtgtcctgatgctactactatacgccatactcaatctgagttgtatcatactaacatgtccgcttctatagtgcttatgtggaacaacagtatatttccaaaattttacgcattaaatcttaacccttgagatctagatttactatgatttagtggtctatatttttctctttttctccgattaatgtgggagtttctagaccccacagcgaacgtagtgccttctttcaaaactgttttaataatataataaatagatagattatttagtgatatactagaattaaataatttaaccaggatcccgaccctagttaatagtactacgtatgaacgctcctgtgtataaatgatgagattgtatacaaaatactctcaatggttttaatatgtatgatgccgttaatttttagacatgacgtatggtcattcatctggttcgtaaatttaatgaaaaaaaatatctcatacttaagcacttttaataataaaataaataatccccgcaaaaaaataataaaataaataatatttatagttatttcaataaaattgatggttatatgctatagcctaaaaaagtcaataactacatatagatttcctgaaatcacacacagccacaggcatatggcaattttggatcttcccataaacattttcccccatcgacgcacaatttctccatctactcgagataccagatgtgactgatcgagctcaagctagctcgtggaatagaagaaaaataacttgcagctccaagtggccggcggtgatgtgagagctgaattaggttgatcagttgagaattgaatgccaagaattcagtcggcaacagcagaagtccacgtactgctcaagggacatgagaattgaggattcataaatctcgtacttgagtatcaagaatcgctttccgacgtcgtcaagatcatcaaggatgtagatacacgacgctatattcaattgtactgtgctgaatttaagaggccatgtgaggatcggtttgtgatgtccacgtattcaggattagaccacaggcccggctagatacagatgttacttcagttttcgttagcacgttttttaaattatattaaacggcatatttcatgagaaaatttattatataaaagctatttttaaaatattagataaatctatttttatgtttaaagtaactaaaggg

SEQ ID NO: 10988 - DNA, 708 bp, Oryza sativa
  unsure (1)..(708): unsure at all n locations
ggcccggccatctggtcgtgctccggcgccgacgccgacgccgaccgcgtgttcagctccggctccgacttggccggcttgggcttgggcttgggtggcttcggcttcggcggcgccttgtccttgtccagatccggcggcggcgccgggacacgggagggttcttggacgccggagaggagaggagaaggaggaggagagggttcttggttcttggcccgtagcatctctgtaagactcgccaaaaccctgatgaaattcagagtcatgtagatgtagttgcagttgcaggtttgcgaaatctgaaggaattcagagtcatgtaatggcaggtgcagtacagaggagtttcttctttcttttactttccaaagttgcagggttcgaacttgattcttctcaagattgcaaaatctgaagaaattcagagtcatgtagatgtagttgcagttgcaggtttgcgaaatctgaaggaattcagagtcatgcaattgcaggtgcagtacagaggagtttcttctttcttttactttccaaagttgcagggttcgaacttgattcttctcaagattgcaaaatctgaagaaattcagagtcatgtagatatagttgcagacttgcagtgcagagatttccttttttatttgctggtaataaggtgtcaacaaatacaggnnnnnnnnnnnnnnnnnnnnnnnnnnnnnnnnn

SEQ ID NO: 10989 - DNA, 652 bp, Oryza sativa
caaacctgcaactgcaactacatctacatgactctgaatttcttcagattttgcaatcttgagaagaatcaagttcgaaccctgcaactttggaaagtaaaagaaagaagaaactcctctgtactgcacctgccattacatgactctgaattccttcagatttcgcaaacctgcaactgcaactacatctacatgactctgaatttcatcagggttttggcgagtcttacagagatgctacgggccaagaaccaagaaccctctcctcctccttctcctctcctctccggcgtccaagaaccctcccgtgtcccggcgccgccgccggatctggacaaggacaaggcgccgccgaagccgaagccacccaagcccaagcccaagccgcccaagtcggagccggagctgaacacgcggtcggcgtcggcgtcggcgccggagcacgaccagatggccgggccctacggcacggtgcgtgcgacgacaggaaagggagaagagaaggaaaccctaaccctaaatttgaaagaggaggggaaaggggggaaggaagcgtgctcaccggagagaaggtgcgccggaggagagagctgtgcgcctccggatcgcgccgctcccgccgtcgcgtccgggtcttcgttgcgccgccgct

SEQ ID NO: 10990 - DNA, 925 bp, Oryza sativa
atcccaccaaaatccattatatttagggacagaggttttatccagattcgttgtactagaatgcgtcacatccaccaaaatccattatatttagagacagagggagtattagggtctgtttcgcacagctccagctccagctccacccctcctggagctggagctcagccaaacagtttcagctccaccaaaactgggagtggagctgggtggagctctctcataaaatgaactagagttgtggaactgggtttaggtagctccacatctccactccagaccaaactcctggagctaaatttaggagttggagctataccaaataggcccttagtttaagagaagtgatctcatcatctcatcaggattgttggtggctatcttctaggattcttccaaatgtcaactcatggtttatgttggatgacttttgcttcgagaggaaagagtggttaatacaaagagtgccctccatacgcaaaatttgtaaatctatagattaaattggttcctctcaaataaatatcgttttaacgaatcaaaaatcaagataaaaaaaggttgaattggccagccaggctaaaaactggataaaccaaaatactaaaaaaaaaaccaaaaaaacctgacatgatccacaaccttaccttcccccctctccgactctccccttcctcgtctccatctgaacaccacccctcccgcttcccatggagtcctcccttcttctcaagcccttcgttcttctccccttcgccccgcgccgccggcaccatcaccacctctccctccccacgccggcgaatcggcgcctcccctcctcttggtcctcgtcccgccacgcatcgcccgcgtcctactcgttccgcgtaacccgcaccgcgcgcagctgttcgacggcagcgcggacaggccccccgggggg

SEQ ID NO: 10991 - DNA, 786 bp, Oryza sativa
  unsure (1)..(786): unsure at all n locations
nnnnnnnnnnnnnnnnnnnnnnnnnnnnnnnnnnnnnnnnnnnnnnnnnnnnnttcctactgcatgtttgtatatcagtaccagcaaactgaagtactgttgtacaaacaaaaacatatatttgccgtagtgagaattgcttgagttgtaacaattccatgtactctctattattaaaagagctctgcatagccaagttgtacacacgcacatgctctgaatcatgtagatctagatggttaagtgccaaactgagctgaacaatccatttataatcactgtgcgttccgcacacagctgcgtttctgctgagagacaacttatcagatccaccattatcatgtatgagaagctgagtacttcatcctggtattcagttcagctggcacgacttacactgccgccccaaagagcttaatttgttcgtggtttaacattttgctttttatccgtgtgaaggctccctacaagtgcagaatacagagcatcatctggggtcaatccatctcccagcatattgtcgtacaactggaatgcctcctctgatcttcctttcttggccaggccggatatcagagcagtatatgccaccaagttgggtttagaccccctctgtttatcttttaaacaggctcaatgccacatccacctttccattgacacagtgcccatggactaacgctgcataagagtatatgtctgggacaagccctttcttttcatctcattttgaacctctcagcctcccgtagctccccttttgatgtaccattcatcataacattg

SEQ ID NO: 10992 - DNA, 802 bp, Oryza sativa
cgccggcgactcggagtcggacgccatcggcgggggagcgaggtgaagaggggagaagacgagcgagtccaaatgggctcgacctgcttggtgtccaatgttgcagatgcttttatgggcttaaaatctcggcccaataatatattgactgaaatgtcagcccattatccccaaggcccataaagagcaggagccaccggcccacctacaaacacatacatgcaagaggaattgggcgggcctttttacatacaaatgtgcttcgttgctatatgggcgggccgtgtatggtggagcttgaagaaaactgaaaatgtaaaatgtaatattcggtgcaaatttctcaatatattacgttacattatcagccgatgtaaactggagaacaatatgtacctctaatatttccaaattgatcagcttatatgatttttacagcattagctaattaccatattaaatagcctccgtccatatattcattcatcacgtacttcctctgtcaaaaaaaaaatcgatctgttgagttggttgagttcttttttagatggaaggtgtacgtggcagacggaacgacgaagggaatgacatggggcatggtggttgagtcgagagaagttcacgagcggcttgggaaccgaaaaggcgagacagggtacgacgcggttgtggcccatgggcgccgggggcgtagtacgtactcgtatcttgcccatacgggccacgggccggccggccctgtcgcgtcgacgagacaccaacgcaggagcacaacaacaacacacgcatgtgtgcacagtgc

SEQ ID NO: 10993 - DNA, 1196 bp, Oryza sativa
  unsure (1)..(1196): unsure at all n locations
nnnnnnnnnnnnnnnnnnnnnnnnnnnnnnnnnnnnnnnnnnnnnnnnnnnnnnnnnagttaaacgaaatactatcaagagtaccactggtaaatgctaatttaaacaactccattcataattaagaaaaacaaacaagtccatgtccactctcatagtctcatgcccttgctgatttgtccactacccttccattatgctttccccaaaataatcaaatcaaggagcgtatcacagaacaacgcaagaatcattgcattacatgtggacaactctggccctttgtttaatttgcagagtaatcatctcataaacaaaagcctgtgagccaacaggacgccagcttaactagcctggccaaagactcttcttggcgccaaatgtgcctccacttgcctcacaattcgaagtggtaggtaacatcacatcactgctcaaattcaaaatatctggtttattttgtttgtgtaatgaattagatacctacaaattcattaaaaaaatcatgcattttacaaggttttcataaattctacttttcagaagggcccatcatttagaaaataataaacaaccaaacaagttaattaacaaaagaagatattaagggtactaaaatactcatctcattacatgatgcactaagagcattttaaaatgggaagagaaaaaaaagtctggtcaagaagaggtttgaccatctaattaacagtactccactctagctagcaaccacacgagaggagaggcttctattgagaagcctccccgtcaactacagctcgatcggtcccgtgtccggcgccggcgatcgtcgccggcggcggcattacatgacgctacacgagctcgggttctcctcgttgaacatgttgctgtaagactcctgcggcggcgacgaccgcatgcccggcgggccgtacaggtactccggcggcggcggcggcggcatcatcatgggcgggtacggcgagtagccgtacgacatctgcggcggcggcggcatgggcgtcggctgcatggacattaccggcgtgggcgcgtagtacgaggacacgctcgcgctcgggtgcgccacattgtagctcatcaccggctgcggcgagtagtacgggaacccgccgtgagggcgctccggcgacgacagcgttggcgccggagcgggcatcgacggcgcgggtgcggccggtggcgcc

SEQ ID NO: 10994 - DNA, 7835 bp, Oryza sativa
tccttcgccttcttctccgcgcccttcccgcgctccccggccggcgtcggagcattagctggtggcggcgcggcggcgacctcgtcgggcttctgcttcgccgcggcggcgaccggcggcgacggccacaccgtggcgtgcttccctgacttgtgcagccgcctgacgagcacgtcggcgccgacgctgctcgtcaccgtcaccttgtgctgcgccgcgtcgattgtcaccttgtacacgcctgcgcatcaccggaaaaccaatcaatcaccaagaaatcgatcaaatctcaatcaaacctgcgaaaactacacataccttcgatgttctggagcaccttcttgaccttcttcttgcaaccctcgcagtggatcgacactcggagcacggtggtctgcaccaacaagaacagcaagacgtcagcaaaacaacaacaatggcgtcgtcgtcgtcttcgcaaagatcgagcattagagctaagctctagcctccaatggaggcattgatttcattcagatcaaggctcaccgtgtactgcagtggctctgcttctcctgacgccatggatgaaggcttagctagctagctacctcgagacggagtagcttcgagctaagctgagctctgtggcggcggcgcgtgcgagtgagaagggaagctaagccaggagggggtgtgttgcttagggaagctgagctttataatggccaacaagtgtagcactgtactagttgagggtgctatttgcaaagtgccagcgtgtcactgacctgtgggcccaggtctactggtaccctgtacacgtcaatccttgaaggacccaggatggtgacatcagaaccacataaatatatttgtacgcaatgatcatatccatgatgatggcagattgaagcttagtgctccctgatgatcagttctggctagtactagctttttttcctgattatcctggcctaaatgttttaggtgaagattatcatgtgatctttgataaggatctccattaatctgtgcaagtgtgtgcatgcaattctggcgatcgatctcttttgttttagtggtgcaatcaagacctcgtaattcaggggtttggtgaatgagtcagacagggccattacattcagcaacaacttaacagcagcagcattcaaaacaaaagggtgtctctcattatggagcaccacatgcacgtacgttgttttcagagcaggtaactatagctcctctagtggtgtcattttcacttgtgctgcagctgtagtacccgctaattacagagtatagttaagagtaattaagttgcttattattgtagcagcctcatctgatgaaatgtccattctgcgactgactccccgggtagaaaactagaattcagatattcaggttaatttcagagaacaaaatgtgacagatatgagtagtattcagataaaatgtccagaaccgatgatggttgcatgtttgcagtagtttcttcagacattatatattcaggtttcggaacactcgaaaactactgtaccccagtacatacgtactgggcgttactatacgattggcctacagttacttccacgtgacgtacgtacattatactacttaaatacgccgtagggtcgaccagaagatacgtatcagaattcagaatatcagtggtcgcatattagtactgtggttatagctgggtcaggacgtacaagtacagtatgtgtgtacgcaccaacgacgtatatacagttagctagacaggtgaaatgtactgcactgctgctgtcagacacgtctcccgttggagatacaattcattcatggcatatcaacagagcatccgtggcatgttcgtgcatgtgagtacatattagtatgcattcaagcaaaaaactctcggttcggtctttcggtgtttgagaaaattttgtcatctaatcgaacaattcgatcggttttgattagctctgtccggtcctgaaatactactatgcgacggtttcaagagacaaaaaatcaaataaattatagagcaagattttctcagccctttctagctcttttagctaggattctttgacaattgtagcacaagataacgaccaacgacgtataacataccaattcatcaagatagctagcatcaatcatagcagtgatctatcttccaacttaaccaagatagtagctacttgggcttctttcctaatttcggctaaattctatcatttcggtcaatcgagaatgataaccaacttaatttacctaattaattttagtaagtgaaaaaggcctgatcgaatttcggagtgaaaaaatggtctcggttattttttggctactgtaactaacgaggctaaagattattcatgcgacgtcgccgaaggcgcgaaatggaaaaaggataatgtactgcactacgtatttactgaatactgcgaccacgagtgtaatactgcaagctccttcactatctgcacggcgaaaattggtatagcagtatcagtgtagtaactgctgtacgtgctcgatccgggaccttcctaccatcaattgttggcaatgccaatcgttggcatttctcttgtcattcagtttggaaccaaaatgtattgtctgtactgctgcatacatctccattgaactactcctatataaggttcattacttaagtgcgtaaacggtagtttgagcaagtaaatgttggaggttgggtttaagttgatggagcaaagtgcagcaataaatctggagacctagctaccaacctccctgcagggttagtaaattgtgctcggccaaggctgtcaatctaacagcagggtaaggtacaattctccaatctccatcaaaggcgatggcccaccagatatgtttatgacaggtagagtcagatgcgagtactgcttttttctagtaataaaaataaagttaggacacgtaaaataaaagatttgttagcgtataaatttagaaaatggatttatttttatatttagcgtataaatttagaaaatggatttatttttatattttaaaacaacttttatatataaagtttttacacgaaacacactatttaacggtttaaaaaacgtgctaacaggaattgagataaaataagtatcttaatctgaaaataacatcatctagtactatatagccttgtttagagatataaggatttcgagaagtagttggttgatagcttttgataatctaaaataaaactaggttttagtttttcatcttctttatagtttattttgtaaatataatatgtgaagtcctgaaaattatgaaagaagttgtagctagaaactctgtaaacaaaagttggataaacttttggatactcgtggcacgtttttcaaactattaaactgtgtgttgcgtgcgaaaactttctatgtgaaagttgttctaaaatatcagattaatccattttcaagtttgtaataattaaaactcaattaatcacacgttattatcatctcgttttacgcgaaacacttaatctttatctttatcttcaggagattcaaacaccacctatagatttagtgtaatcaaggatgtgccgttggcttctgtatctttagagacatgtatcaagggacgtattgacgagagtgtaaatgtagtattgcgtgtgtaatggtgtgtgcattgtcatgtaataaaaaaaagaactccgcaaacaaggactaggccaagtttgaaactaagtttcaactagagttgttggcggctcgaaaaagaagttctagatgattaattaaatattagctattataattttttaaaataattttatttccttaatataaatattatatatatatgtatgtatatataattttttatacaaaacataatgtttaataatttaggaagggtgtaaacgaaaacgataaaattgtcattttaaattgtacttagaactcagcctctacttcactccgaagaagacccttgaagagagacaattggtctgtttgggagcttataactgctgtagcttcttccagaatcagaagctcctctaaacagtctagcttttaatatgaattatgagaagctatagttatagaatctagaaaataaactaaaaatcaaatgctgaaaaacctagctttttcagatggttttcagtcagatgctttttagaatgttaaattcgctaaacaagctcaatgaaagagctctgctcctaaaataaacatctctgtcagggttgtaattattccttgtccaaagaaaaagctgctggccgcgtccttgccgccgtataaacatattattacctcgccggcgtgggccccacccgccgtacgcccggctacatgtaccgccatgtggcccgcgcgcgggggagagacatagatgctctcgcgccgtaatttaacaccaccatggcattggggcgccatggatgttctccctctcgcggtgcagtccagctcgaggtgcagtttttgagcagttcgaggtacggacaggcacatggctcgcgtgtttattcgactcccggagtctttcacacaatgcttaatcaagcttagtattatagagcggtgtttgattagtttcctcgttaattgctcggtttttcttcctttttgttgttgttgttgttgttgtttaccttgcccgatgctagctgcaagcctgaaatagtgcgcattgttgcctagctcttatcttgtctactttgatcggctggaaaacctgacgttttagctgtaaacagttgggttttcgcaaatttaagctctctcctgtgtcctgcctaaaatatcatctgtcatgacgcagttatggttagatcatgctcgctgagcaagcagcaaccacatcatccactggccacttttgtgtttctgtcctgaatatactgatgttgcactcctaaatttgagtgtgtttgagataaggacaaagagtaaattacgaagatatgcaaaacgggattcgtcattagtgtaattaattattttaaactttaacatagtttgtttatggtttcttttaaaaaagaatattgtttagcggttttgcaagcgagcgagaaaagaacgcagatatatctaatgcttcactctcttgaagatgaagatggaacgaaaagcagcaacagtatagtatggtgaagatggaaaaacgaaaagcagttcgggattcactcattcaggggactgttcacagaccgtaatgggatcaaatcgatggatctgatgttccaaggacgacgaatatgcaattgcaagaaagggcaaaagttgcatcgccaggccacaccccgatgatcgatggcctgatcagatactcctccatatccttctttttcttctttcccttcttttctccatatcctcttcttgtgtgtgcatatactgtgtaagagtaatcagggtcaggttcataaaaccgatgaaattttgtgaaaccggccagtattagccagttaatatatggtgttgatcaaatttgtcggtttttattggttttcggtcggattttaataaaccggttagagcaattttttacttcgaaatcgaaaaaggtaaatcgtgatttattcagggtttatcaaaccgttttgggtggggttatcttaaatttaaatttttaaccttaaatttgaagccgattttaaggttttttttatcgaagttaatttttttagcctttgtttttagatcgctaataacacgtatataaaagtttatttacaaattatttttcatttacaaatataccgtttgatttattttacatacaagccaaatgatagggctaataaacgcgtggttttgttaaccctggcagtgatagaaaaacattgatcatcaggcagcctacccggctctatgtctatggagtagtagctgccgcggtaagtgtgctgagctttctccatcaaaagcagtgtctccgattataaattctgcctgcagaaaggcagctggccggcgccacaaccgtcctgcttgcttggcttggctccaagtttgttaacccccacacacagttgagtgacacaggtgtttcccttgcatgatcacacagtaacagtatcactactccaccgacgccgcaatccgccgttgtaatgcagacagaataccctcgccgccgcctagcatgcggccgccacactgtgctggtattaagctttcttaaaacgtttggaggaatgttattattggttaagaatgacaggtaaaaaaaatacttttactttgaaacaaattattatgtcggagttgactatgggctggattggtttgaggcctaaattagacttaccaatatttgataattttaatagtgtttagtgtctatttggtttgaagacaaattttgacatacctaagaaaataagaaaatatacaatttcaatagtgaacttaggctattttggcttcaatacaaacacaactttaccttacaaaaattagtcataccaaaacttgccaaaaaatggcattgacaaaatttagtaaggcctatttaagctacaaaccaaactaaccttatattttagaatggagataactaacactactacttctatagtatatcacatgtatagtaccaacacaaagctatcatctgttttaatttgcaaactttaatatatttatcgtcacttcctcgaattccaatatatctatacttttctatatagttggtactcactaacaattattagaagctaaagctcaacatacaagtatgccacatcatcacccactagcaattactattctagcctatttaaaatcccatacaagcataccacatcttcactcgctagcaataattactgttctagcctattttaaatcccatgcaaacatgacacatcatcaacaagcatgtgccaaatcattttcttcacattattttcttaacatttcaactctcagcatttcgacaatatttaacatatacccatccataaatcccgcagcaaagcgcggggtatcacctagttactacttcctccgttttacaatgtaagactttctagcattgtcatatagatgttaatgaatctaggcatatatatttttttagattcattaacttctaaatgaatatgaataatgttagaaagtgttagaatctgaatcggatggagtactaattgtgatggagtctttataggataagtgaaattatgccaaaaacaaataaagtttttattttttttggacgtaacgtaagtatagtactattacaagtcggtgtgttaagcgaataagcaaaatcggtatgtattgtgtgcacgtgtgtgtctgtggagcacgcatctagtcatgtagagggttcccgatatgggcaggcacgagggcgagcacgtacacgtactcctcctcctactacgtgatgagtagagccgagtagtgcgacgtggtcgtgtacaggcagaggcagcactgtgcacacatgcgtgtgttgttgttgttgctgctgcgttggtgtctcgtcgacgcgacagggccggacggcccgtggcccgtatgggcaagatacgagtacgtactacgccccccggcgccatgggccacaaccgcgtcgtaacctgtctcgccttttcggttcccaagccgctcgtgaacttctctcgactcaaccaccatgccccatgtcattcccttcgtcgttccgtctgccacgtacaccttccatctaaaaaagaactcaaccaactcaacagatcgattttttttttgacagaggaagtacgtgatgaatgaatatatggacggaggctatttaatatggtaattagctaatgctgtaaaaatcatataagctgatcaatttgg

SEQ ID NO: 10995 - DNA, 3159 bp, Oryza sativa
  unsure (1)..(3159): unsure at all n locations
gagctaaccgtatcccgcctcggggggcttgacccccgttccctcacctcctccctcctctcgctccggcgagcaggccacctcgacaccgccgccgacctcctcaaacaggctgccacttcttgtcctgactccgtcacgcctctctcggcgtctgtcgtcgtcgacggatactgcaagtctggccgcgtcgcccacgcccgccagctgctcgacgaaatgcctcgacacggcgtgaaggttaacgccttgtgctataactcgctgctagacgcatacacgcgcgaaaaagatgatgatcgggtggcagagatgctaaaggtaatggaaaatgaaggcattgagccaacagtcgggacatatacaatcctcgtcgatggtttatcggcagccagagatatcaccaaggttgaggctgtgtttgaagagatgaagagtaagaatctctcaggggatgtctacttctattcttcagtcatcaacgcatactgccgtgcagggaatgtgcggagggcatcggaggtgtttgatgaatgtgttgggaatggcattgagccaaacgagcatacgtatggagcattgatcaatgggttctgcaagattgggcagatggaggctgcagagatgttggtgacagatatgcaagttcgaggggtgggaattaaccaaattgttttcaatacaatgattgatgggtattgtcggaaaaatatggtggacaaggctcttgaaataaagatgatcatggagaagatgggcatcgagctggatgtgtatacatacaacacactagcatgtggcctccgcagggcgaatagaatggatgaggccaagnnnnnnnnnnnnnnnnnnnnnnnnnnnnnnnnnnnnnnnnnaagggtgtcaggccaaaccatgtaagctacactacgttgatcagcatccattgcaatgaaggtgacatggtcgaggcaagaaggctgtttcgagagatggcaggaaatggggcagaacctagtctggtaacctacaatgttatgatggatgggtacatcaagaaggggagcatacgggaggctgagaggttcaaaaatgagatggaaaagaaagggcttgttccagacatatactcttatgcagcgttagtccatgggcactgtgtcaatgggaaggtggatgtggcattgaggctgtttgaagagatgaagcagagggggtctaaacccaacttggtggcatatactgctctgatatccggcctggccaaggaaggaagatcagaggaggcattccagttgtacgacaatatgctgggagatggattgaccccagatgatgctctgtattctgcacttgtagggagccttcacacggataaaaagcaaaatgttaaaccacgaacaaattaagctctttggggcggcagtgtaagtcgtgccagctgaactgaataccaggatgaagtactcagcttctcatacatgataatggtggatctgataagttgtctctcagcagaaacgcagctgtgtgcggaacgcacagtgattataaatggattgttcagctcagtttggcacttaaccatctagatctacatgattcagagcatgtgcgtgtgtacaacttggctatgcagagctcttttaataatagagagtacatggaattgttacaactcaagcaattctcactacggcaaatatatgtttttgtttgtacaacagtacttcagtttgctggtactgatatacaaacatgcagtaggaaacttgcaagtatgcattcgagtttggcacatgtattttccaaaactcaacttcatatagttacggagcattttcgtgcaatacattgaatggaaccaaccgtctgtatggagcaccaattcatgcttccattgcagtttgtttttccatatgagcatcggtatcaaactcctgtgctggttctcgaggctgcggggcttggtttgtgtcttcgttgctctacaacagaagccaagtcattgcagattcaggactggcagcaatagctcagtatagcacatcgcacaggtactatttctatgaaacaaacataaagatggcattaaccttctctatatctgcaaactgagtctgtaaagtgcccttttcctcctgaattgcatacctgatttccttcatttcctagaatcatatgccagaaccatgagcagtacgacctaagaatcagaacaaacaaagcaagaatatgaaagagaaagagagagaccgatttcagcagctccacttcagaatttagccccttcttcagctccaaaagttcctgcatgagttgccatcacctgctataagatggtcccgtacgttttgcttcaggaaagcaggagtctttcttcagttctgtacagagagatgatgaaacagtactcacattctggcttgtcttgacctgtgtctcgaggttggagcgccagttctgcacctcctgcaaaagcacttctgctgctcattctccatcattttgccatcaagacagagaaattctccaataatccaattctattcccaatcacagcagcaacagaggcaaagaatttcgcagtacaattcataccagtttgagcttctggatcctgtccagcaactccccctgcgacgaggtcagctcctgcaatcgaaacgagacacaggataaaatcagccgaaaatctcaacgccaagaaccaacgccgccgcccaggaattcaccacaccttgatgcgcgcgtccaactgctcgaaccccgccaatctctacagatcaacaagaacaagcatgcataattgcatatcagcagaaattgaactctgaacacaaaaacacccagggattctgaattcagctgtcaactgcatgtacttaccggaggagtcgccggcgccggcgccggtgccgttagaggtggtggctccgccatcgatcagcaggagacaggtagaattgggccagatcaagcgtgagttgtatggctttattctgtacaattgtactgtacctcacctagaagaggacatttttcagatgcaagcaaaccagtcgtcgatcgggttggtggatggatgcagaggggtaaatctctcgcctgcaaaatcgcaaatgcgacgtgagaaaacgccctgtcagctggtggttgcagaacacttgtctcccggct

SEQ ID NO: 10996 - DNA, 4655 bp, Oryza sativa
  unsure (1)..(4655): unsure at all n locations
nnnnnnnnnnnnnnnnnnnnnnnnnnnnnnnnnnnnnncaacttttattggagaaaaaaaaccataccttatatagggttggtatcaggttccatgaccatcaaattgatatcgtattcgccgtgtgtctgtccactacataaacagtatattcataaactaggttgtgtttagatccaaagtttggatccaaacttcagttcttttccatcacatcaacctgtcatatacacacaacttttcagtcacatcatctccaattttaaccaaaatctaaactttgcgctgaactaagccaatgtaagttcatcaaactctatccctgttcgtcatcagaatatttctcctggtggtgggcccatccggccgggagctaagctaacttgaccgggacatcactgcgagagtgaaaagatagatgctgcgttttattccagccttctcttagcgatagtggttccggacaaacatgcacgtaatacctctattcagattctttttctttttcttttttttaaaaagagctccttgttctatgttgacagatggatacaacgacgacaaacgggatactatattgagcgtttgatgagaacatgcagttacagtcgtacacatcagatcatgctagcttgcattattagggcatgttcaatgatagagacgggtatgacctcttaaacaatacaagattatttagagaccatgtctttacaatagttgagacgacaaaagctctaatcattaactcaaaaaatattccttttgttaatattcttttcatatttttatcctcatgcaatcatatttctatattatagtgactaaaagtcgttgttaagctgttgtcatgcataacaatccccgatgttttgtctctcctctttctctttccttcatgtcaacaagtattcctaattagcaacgctaagagaccactattaacaaccattgtacatgtccttacaagctgatcatttacatcaatcacagatacagattcctcctcctcttctactttgttttttaaggttccttgttactatacgttgacaggtactccatctgtccccaaaaatagcaattctgatacccgaggcaattttagctaccactattaaagacccaaatacccttgtataagtacaacatctattccatcattcaaataaaaaaacaaacttccgtgcacaagtactactctcgtacagagtgcatgtgtgaatgagagagggagtagacgagagaaacgagagagaatagagaagtttgcgtgaacaagtggatagactactatcctggttgctcagctgtgactgtactgctatctcattcaatgcatcactaatcgcttttttctgggacaaatgcttctctccagaaatcgattctttctaggaagaaaggagtacgatacaacaacattgtatatcggaaaagttagttggcgcgcgccctgcgaacacgcgtttttagggagtaataagcgtaactaataattgtattagttatagatagtgacaataattaaggtaagtcttcccttttctccggttgttttttttaactaatagattgaaaagaaatctatactaaaagaaactttcacgtaaaatttaaaactttctaactttcaacgcaaactgaaactattcttaaaattttcaacttgaaatttgaactttcaaggttttgacctaagatttaaactttgaagtcaaaatttaaaaactttcaactcgagatttgaaactttcaactcaagatttgaaattttcaactcaatatattttgaaaacacgtgtgctaacgatttttttaaaaaggaaaaaaacataaaaatatgcgataaaatacgaaaaaatgcatgcgccgccagctagcgtgtgcaccagttacggaactggcgtgcacgcgccaactagcaacccccattgtatatttttacacatacgggatatatatctctactattataaacattcaagatgtttttactagcactttggtacgtcattcgtgaatgagtcggtttttatgttcattcgcttttggaaataaagatccgtatttgagtcgagttttaagtttgttcgtttttagaaataaagatccgtatttgagtcgggttttaagtttgttcgcttttgaaaatacatatgaaatcatataagaaatctctttaaaaaacctgcatgtatttgagtcatgctttaagttcgttcgcttttaaacatacagaaggagccgtataaaaaatctatttaaaaaaactcgcatgctgatttgagatgattggactcctatcatgattttctaggaaaatatatattcaagcgaattctcatagtgaattttactttaactaaaccatataataataataacattaaaataagcttcacccattgtaacttacggatattttttttctagtatagatatatattgaacatttgattttacaatcatatacatatatatcaatcacacagtgcacattacacacttatatacattacattaccagtgatcgtacatgcatgcattacgccatctgcatgattatgtatgtatgcagagattaaaccaaaccaaaccaaaccacaccacaccaaattaagcaaagcaatatatatatatatatatatatatatatatatatatatatatatatatatatatatatatatatatatatatatatatatatatatatatatatatatatatatatatatatatatatatatatatatatatatatatatatatatatatatatatatatatggtttntgcantcatatgtaatcagtgataantctaggtgtgcaggtcgacgaccttgaagtggtcgcggttcttgacgacgacgtcgtacatgtgggtggagcgnaagctggagaagtcgcgggggatggagatgaggtcggcgctgccgtcgcgcctgtgnagctgcagggtggcgcggtcctcgtagtagcgctcccaccccagcgcccccagcctccgctccagcgcctccgtcgaccggatcacctcgctcgtcgccacatgcaccagcgccttcctgctcgtcgcctgctcctccagctccatcaccccgttgttcctgaacacccacacccctcctcccgccattatttctatctacctatctatcctcttcgatcgatctgctcgttgctgatatgatgctgctacctgcgtctgcatatcaccgtatatataggcagctagctatagctggatgcagtactgtacatactgccagtgtgtggtagtacacctggcttggctaagagatactgtatgtagagtggtgttgagatcagatgcgacgatggaatcgattaccacgtagtacagcgcgcgacgacgtcgactgatggggttttacccgtgaatgaatctattcttctccttctaattaacaccatggtggcgtatttggttaatgagaaatgcaaaaatcttcaggaaccaatcaccagacatcccgcagactataactgctataatggaagacattagagatcgggattttgttttcaaaccgcgctaatttattactagctctacttttctacctatcttttcttcccaagatgtattaatctttctaagaactatgctgtaagactttattctacctcctaatataatcggcaattctcttgccgctttttcttcaaaaaaaaaatgaatctattcttctcatccttctatatcgaccggtttcactttcatgccaaccatgataattgtgctttcttcacatgcatgacaacaatttctacggggacatttcaacagcgtgtacctcgtggtaatatatataggttccctaggatttttgtggcaacatgtattcatcttttctttttaaacaaagtgaagattcggcctctacatcaactaaggatgcatggcaatttttttacagcacctgaattaaaatatttaagaagagaaatgagatatgaaaaacatcatgctgctatatatatgtataacggctaatataggagaataaaacttgtcgatttacagaccaagaatagataagaggatatatataaatcaacttatttttggataatttttgtaaactgtaagaatcaacttgttttgaaacaaagtttgaattcttagaatcagcttagtctattttttttgaacgaatcgacgagcgccaatttcattgaatagagaaggagaactttacaaagcgaaaggaaaaaagaaaggagctaggacctttggtccgagctaactaaaagaaagcagctattaagacttctcgctcctgctaaggcccaagttttggcctcttccttgatcttggctaaaagggaggtagctgaaagctccttctgttggaaggttctgcgattcctttcgttccatatctccaaggcgaccaacaacatcaaagtgcggagtgccttcttaggtgtctcttgtatgtttgcggtagcctcccaccaatctagcaccgttgaagtttgcctccattggctaggatttagttgctcgcacgtcgcccactccgctagtgccgcccagactctccttgtgtatctacatgctgcgaggaggtgcagagttgtttcctgggtccgacgacataaggggcaaatggaaccgtt

SEQ ID NO: 10997 - DNA, 683 bp, Oryza sativa
aagcagctattagacttctcgctcctgctagggccaaggttttgccctcttccctgatcttggctaaaaggaaggtagctgaaagctccttctgtggaaaggttctgcgattcctttcgttccatatctccaagggcgaccaacaacatcaaagtgcggagtgccttcttaggtgtctcttgtatgtttgcggtagcctcccaccaatctagcaccgttgaagtttgcctccattggctaggattaagttgctcgcacgtcgcccactccgctagtgccgcccagactctccttgtgtatctacatgctgcgaggaggtgcagagttgtttcctgggtccgacgacataaggggcaaatggaaccgtttggccaacctcttgtcgccagcctgtcagaggtcctgactctattttggatgattagccaggcgaaggtcttgcacttacacggcgcccaggctttccagattagcctattgaagttagtagcggtggttccaagaagttgtgcgttatatgctgatgctgtcgtgtactcgccatggttagtaagcttccatgttatattgtcctcctcgtgctctaccaggtgtatagcctgaacggcgatccaaaccccgacaagttgatcaatcaggtctgtcgtccagctcgcagtccctggcaagtccaagtcaagaag

SEQ ID NO: 10998 - DNA, 685 bp, Oryza sativa
  unsure (1)..(685): unsure at all n locations
nnnnnnnnnnnnnnnnnnnnnnnnnnnnnnnnnnnnnnnnnnnnnnnnnnnnnnnnnnnnnnnnnaccataataaatatgtagatgcagtggtaagttcacatacaggaaaacaaaataaaactacaaacccctgcactgcagatatttggaaatgtagtaactcgcaaatacatgtccttcaactgacatatgtcttgcccaggtctttacaggtacagggttggtgatgtgcttcaagtgacaggcttctacaaccgagctccgcagttcaaattcatttgccggagaaatgttatcctcagcatcgattctgacaagaccaacgaggaggatctccacaacagtgtcaccactgctaagaaaatcctggagaaccaaaattacctcctcctggagtacactagctacactgatatttccactgtccctggccactacgtgctgttctgggagatcaagtccacccacgatgaaaggccggcccctcttgacgctcaacctctcgagagctgctgtgctgctgtcgaggagtcactggactacgtctaccgtcggtgcagagcccatgacaggtccatagggcctctggagatacggcttgttgaagctggggcatttgatgctctgatggatctattggttagccatggcagcttcattaaacagtacaagacacccagatg

SEQ ID NO: 10999 - DNA, 630 bp, Oryza sativa
  unsure (1)..(630): unsure at all n locations
nnnnnnnnnnnnnnnnnnnnnnnnnnnnnnnnnnnnnnnnnnnnnnnnnnnnnnnnnagttgctgaaatatctgcgaacatgttaaggagcttcatatacaacattaatacttttctgaacaatcaattacattagtggaacagatgccagtacaagcaacacttatgcaagggtagttggtgatgaaaggatacataagcatgtctcccaagtgaactaaaaataacttcatcgcctccaaccaatgtgaccttagcagtcttatctaataccttcccatttacatggacagctttagatacgtaaatctcaagagcagcacccctctggtacaaacaggtcaaaaattgagtaagaaactcaaaaaaaaaaggcaagatgaaaacacgtaagtcaaaatttagaaaaaagaatgtgcaactataccttaacatgcttcaatttgcaaataagtgatccaggaaatgactctgtcagcctcaaatcataatttccaccatggccaaccgtaaaatgagtagtataaataggtactgaaggagactggaaaggacaaagatgaacacaatcatgagcaaagacaaaaggactccatggggcaaattaacactttagaagtaaatgaggct

SEQ ID NO: 11000 - DNA, 782 bp, Oryza sativa
  unsure (1)..(782): unsure at all n locations
nnnnnnnnnnnnnnnnnnnnnnnnnnnnnnnnnnnnnnnnnnnnnnnnnnnnnnntcatgccctataatatatccctctttactgtcattaaagaaattactgttaatattaggccttattgtgtttaaagaatttaatacagggccttgctattcacttagtgactgtgcttttgatgctaattacataattaatttgtagctcggggacttctcgaggtgagccaagattgatgccgtccatcttaaaggatcttgaccgtcgaacctacctctatagtctgatcatgcctatcatgaacaagtaagtttatatcttcttatggaaatattgtgatgtggttatgacaacttcattattgtgtaatatctggatccagttgtatgcctaatctcctttctgcaattttctaaccttcttattcttgcaaaagtaatgagataagtagttaattattgcattaaccaaattttgtttttgtttgcctcaaacagatgatatcatttgtgaagctctgttgacactgaccctaaaattgacagatcctgagaggccgttgtttgcatgcttcctgtttgacattttttttggattattcacattagtaacacaacctgggtccagtacttcagttgcaagacgcaaagtattggacaataggtaccgcatatgccactgcttgcagctcaaaaacttaaaaataaagtcatatattggttgctgcttagcaagtatcaagcaatgccagatatacatttgttactcatacacatcaagaaac

SEQ ID NO: 11001 - DNA, 697 bp, Oryza sativa
tgcaacgacggtagacgtagtccagtaactcctcgacaccagcacagcagctctcgagagctgagcgtcaagaggggccggcctttcatcgtgggtgaccttgatctcccagacaagcacgtagtggccaggaacagtgaaaatatcagtgtagctagtgtactccagaagaaggtaattttggttctccaggattttctaagcagtggtgacactgttgtggagatcctcctcgttggtcttgtcagaatcgatgctgaggataacatttctccggcaaatgaatttgaactgcggagctcggttgtagaagcctgtcacttgaagcacatcaccaaccctgtacctgtaaagacctgggcaagacatatgtcagttgaaggacatgtatttgcgagttactacatttccaaatatctgcagtgcaggggtttgtagttttattttgttttcctgtatgtgaacttaccactgcatctacatatttattatggtgacaagcactacttcagtgaacataaataatccgtttcacttgtctgatccctaaaaaaaattgaagcaaaaatacctgacagttgacacatatattgtattgtgaaaattgaagttttgacaaaatgatagtctatattaatgttatagataatttcatgtcaagaaaatttcttttgatcatatggagtaaaagctgatg

SEQ ID NO: 11002 - DNA, 614 bp, Oryza sativa
cccaaagagctccatagcaccgttgttcttcttgcttcttctcaagttcatgtagaaagccatcagctcacagagccatggggattgaagtatttcaatatgcagactctgggcttgagctttgaattcctgcccttgcttcgagtaatgtatctggaaaagagaggcttttagttaatagtcttacataattattaatataaccattgaggaccgtcttaaatccaaagacaagaacaatgatagatacgttaattctaacaaaaatagtcactagaaagattaaatatataaatacaactcaatcatcctctgtgtgtgtgtgtatatatatcctcgaagataccatatgagtatatgacccattgacacctatatagactagcattttgggcttcaccaaactcacatgcttataactaaaagtgtgtgaaatttttgtgttcctctctcaaataatggaatacttatatagttatcttcccccttcgttcggtttccaaaaaaaaatattccccctttgtccttagtaagctttaaatgtttctaatgcctttaagagataaagagaggtgcaaagattaaagtttaaggccatgccttgtcatatttct

SEQ ID NO: 11003 - DNA, 744 bp, Oryza sativa
ctgtaaatcgacaagttttattctcctatattagccgttatacatatatatagcagcatgatgtttttcatatctcatttctcttcttaaatattttaattcaggtgctgtaaaaaaattgccatgcatccttagttgatgtagaggccgaatcttcactttgtttaaaaagaaaagatgaatacatgttgccacaaaaatcctagggaacctatatatattaccacgaggtacacgctgttgaaatgtccccgtagaaattgttgtcatgcatgtgaagaaagcacaattatcatggttggcatgaaagtgaaaccggtcgatatagaaggatgagaagaatagattcattttttttttgaagaaaaagcggcaagagaattgccgattatattaggaggtagaataaagtcttacagcatagttcttagaaagattaatacatcttgggaagaaaagataggtagaaaagtagagctagtaataaattagcgcggtttgaaaacaaaatcccgatctctaatgtcttccattatagcaggtatagtctgcgggatgtctggtgattggttcctgaagatttttgcatttctcattaaccaaatacgccaccatggtgttaattagaaggagaagaatagattcattcacgggtaaaaccccatcagtcgacgtcgtcgcgcgctgtactacgtggtaatcgatttcatcggcgcatctgatctcaacaccactctacataca

SEQ ID NO: 11004 - DNA, 10539 bp, Oryza sativa
  unsure (1)..(10539): unsure at all n locations
nnnnnnnnnnnnnnnnnnnnnnnnnnnnnnnnnnnnnnnnnnnnnnnnnnnnnnnnnttatattgatagagtagaaaaaaaatacaagattacaaccttggaaggtcgtaaccaggaaaacgaagaaaaaaataaccccacccaagcattgacaactccaacacacaatcctactaggagaaagcgcactggaccgaccgccgctagaccaacaaagggacaatagttaggatcacccaaaacccaaccctaacaaacggatacaaatctgcactctatccacaactatttctcgtgttttcttgatcgggcatgtgtgtcgttaacattgtgattgcatgcagaagcttgcattcggcaagtgggaagggtacaaatggagcagcggcgagaggcaacgagacgctgccgccggtgcaggagcaggaggggcgtggttcacggtgacgcggccgtgcagcagcatcctgttccagcggaggcgccggccgtcgtcgacgtgcgagttccggagcggcggcggcggcggcgacgacggcgggcgcgccatgcggtacaagatggacgactgcagcggcggcggcggcggcggaggtaagcagcaggcgtggtgcaggatcgtcgacggcgccaccggcgccgtggtggcggaggtgaaggggaagacgacggcgggcggcgtggcgctgggagacgacgtgctgacgctgacggtggagcccaacgtcgaccacgcgctcatcatggggatggtgctcgtctacggcctcatgaaccacaccatgtgaaattgtgaatgcgatgtgatcgatcgagcttgatgaattgctgcggtgaagatcgaagcaaatgaaaattgaagcatagagagacgcgcgtgataggatttcttcctcttttgttctggtgtacatgtatgtgtacttcggttgaggaaattttggtgaaattaataatacaggtttagttttgggatttttgagctggtgctttctttaggagatcgtttgagggctgagggagtcgggaaccaacccaaccaaactgacatagaaccaagacaagttgttagcaagtgaagactgatctctgagtaatttcttagtcggaacaccgctctttgatcgatcacctattttctttcttttgtggaaggcttacggtctaacagcacatcaccgatctgcattcaaatttttctagtaatattcgggcacagaagtttctttagtaatcggccaagaattcggacaagatagttcgggcactattttatcgcttaagattggccggttatgattttctcatttaggagttgatcttcggacaagatagttcgtgcactattttatcgcttaagattggcaggttacaaccgattttctcatttaggagttgatcccttaaaaaaaaacaaatctagaattgaatgcctggatctagaattgaacctgcagcactgaagcattaattcattgaacaaagcaaatgcactattttgcacgctgccatgaaaaccaggtaccacggaatgaagaaaaagaaacatggataaacggtatataccaattgaactgcagagatacgagcatcaattgattaaatgaattgcactggctgtcgacataaatcaaccgatctgatggtcaggcttacaggcttgatagttcaagttccaaaccggtttttctacgctacacttcggcctaacgaacttacagttgacatgaatagagagatcaacgactaatttgactgggtatcacctatacatgaacaacaacagaagagctatttcttgtctatctcccggaccgctttacgctaatgcttatgttgtatgtacataggctagcgataggctacatgaagtagcttagagaagtcttcttcctggacccgccttctccatatagatcgttccactgaataagctcagtcatatttctcgaatcagatgttatacttgcacatacctatacataaagtagtttatgttagcatcatatttttatataagtaatttagagactacaaaacatctgatgaccatgtagacatgaacatatgagttctttcttttctcctgacacaccactagggctgtaggcagcaattatacgtaatgtttgagatggaaatgaaaaccatcgatacgtttattagaaattgcgagttttgagacatcagatcttgtagtagcctgagtctctttttgtttttcccttttcctcattttcttttcctgaaaaaggaaagaagtggcagtaacattacctgctcatgtgcatgtttgaaatcgttcattcttagggaacgaacatcactgctagaacgagggggaggtaatggtttattttctgcttctgctgatgctctctcctgcaggtagacaaaaaatggtgaactgagttcatcgtataacagtaacaataacaaccgacaactaattgttcatcatattaatatatcaatgatgttctgtagacagggcatgcaatgatattatacacagtttttcagtggataaaagagcagttccacagtattgactatattttcactaggatgaaatagaccagaaacattcactcagtagatttttttttcttcaataacttggtagaaattgagaaggcacaatctcgacaaatcaaactaaccttcttctctctttcaaggatctcccttatggggcaatgtgcagcagttacacacagattctgaaaagtagttgccatcatgaacaaaaggaaaataaaatcattgttttatttcaacaaaatgaaatcaaataagaataaagagtcttcacataaagcaaaaataccttcatatcactgcctgaataaccatcagtcaagttagccagagcttccagatctacatcatcagccaaatcttctttggccagtattacgctaagaatcttttttctattggatgcatctggcaaattcaccatcaacctaaattgatatgtgatcaggcaagcaaccattagcatttcattgtaaaaataaaaggaataccacagcgatgtaaaaaaagttacctcctggggagcctcctaacaacagcttcatcaagatcaaatggtctattggtggcagcaagtactaatacgcgttctttatcttttgttctcagaccatcccaatttaccataaactcatttttcatcttgcgcatagcttcatgttcccctgggttctcccttctacccagcatgccatcaacctacaaaaacgaatggatagaaagtaagaaactcaacaggataaaccaaaatcatgctagcctgctgaatcataggcaatataaaaaagagtgattcacagctttcactttggagtttggacaaccctttaaccaatcttttcactttggactaggtaactttgcctttgttgcaatttggttagagaagagagttggggtggtcaaaagtgcaacaaatgtaaaattaccagtccaaagtgagaagattaggtatatggtggtccaaactgaaacattggtaatataaaaggtgggccaaacgacaattcattccaaaaaaaatgaccataagaattttgttgactgacctcatccacaaaaatgacactaggagcaattttgcttgcaagtgaaaacacagctttgacatatttctcaccctcgccaaaccactgtcagaatcagatatcagcaaaaggagtattcaagatgtgaacaatctggaactctgcatagctctataaagggagtacctttgaagcaatactagacattgatatgttgataaaattggcgccagcctctgttgcaacagctttagcaagcatggtcttccccgtaccaggtgggccaaaaagcaatattcccttacatggctggtgaataaatggtgatcagaactatgtttgtgaaacaagtggaaaaaagaaacaagagaccaaataaaaaaaacagaccatgataattagcatgctacatttagtttgcagggttttttttaaagggttagggggcacatgaatcaataattgatgcgtggggagcctactaggctacatgatacaaaatactcccaacatgaaagctggaataaaaattagtgctaatggaaaaaatagttgaatctcaaaagcacagaacagtagagttaatgggcaaacaatagaatcacaaggcaacagagttaatggtcaaagcatagctggacagaaggccactgctctacattaagtacccactcagcaagcccgcatggatatataagcgaagcaggagatatttacttgaaaggggtaaacagaaaaatcagaacatcaaatttctacaagtgatacggaagactgaagaaagatcacacagagtgcagaggaactgaagggtactaaataaaagttatgaagcttgagctaccttcataagttgtcctttggagaacaattcgggcctttgcaacggaagcatcactagttccttcaaagtttccttgacattttctagtgctccaatgtcctcaaaggtaacacctatctcatctggagggatcacatcaccaagaagccgtttttcgaattcattctctgtcgttacatcctaaaaataacagtgggtgtatgtaagctgtaagcacagttaacatgaatagccccaaagcccaaaaatcatgtcattactgtttgcttgcaaaactctagaacagtcaggatacaaacaagaagttgggccaggctgccagttgccagtctagtcataacatatatttggcgatctaaacggttaaagaatagaagttaccttaagtgatttttttgtgctcttctttttagggtcactttgcatgctatccaacagctcaactccatgcttaaggctgcaaatatagaaattttcagtaaagcagacatgagatagaccagaagttaatctttcttacacaacaatgtaaaatattacagggttagagagcatacctttcaccagaaagggcaagtaatccatcattttcacgagttgggattgtgctatgtttaaattgatgactcaaagcataaccaacgactttatcgacgcctgaaaacaaaacagagcaaaataagaaaataagaagagcagatcaattatgccacagaacaaaattatgcaggattacaaatgtaggactgtactcacattcatttgtaaggattcgatctttaacacatgctgatgtctctatgtcagcacattccagaccattgcgggttaagaactacatccagttgcagaaatacatacaatggaatcagaaatattaagtaagaaacagcataaggagttggcaggtgtgaaattattttcactttttcagttatcaagtgaatctcgtgtcatagatatgcaacatgcatgattcttaaaccaagggggcttgtaaccaaacaattatctggaaattgaagggtacatacatggtagcacttttgaaaagcctttacggatcaaatataatttcagtattaaacacacctggacccgtaaggccataaacataacagaataacaataactaaacagacagctaattaaatatacatatatatgtacaaagttgtctacaccatcgatacttaccgactggatctttgacgtgttagcttttgccttcagaatttcaacatcacggtctaatagctgtttccactgtgagagttccaattcatcctgtatttctcagagttaaaacttgaaagaggcagtgcctgaaagtaaatgtcgccctataataacacaaatgacacacctgcggtgtttgtattgtcactttatttgggaagagtttagtcagatgcttcgctatcttcagagcctctttgtttttatcattcacccgaccaaagctatcctgcattaattcatcagattgtaacaagtggagttcaatcacaataattcagataagaaataacctgtacttcaacaatgaaaaggaagttgagaatgctgtgttactagtaactagtgaccattgcaataaggaacatcagacatcttctgcatactgttataactattatatcctaagttaaccatggggtaaccaaagaaattcacaagaatatgagcacaactgtagaagaacaggatttggcttaatgtacacaaacatcaattgcaagatacttcagtaaaactagaaaaacacacctggaaggtgaggtcgagtattgcttggctgtatgggaattttgaaaggaaaggagagccactgtttgactgtatgaaaaaaaaattgttagctagatggaaacaagtaaaattatactagttataatgattcttacaagcagcagtaccttgtctttccgactgtcagtatggatctgggacccaacaataaaaacaccagctgggaaactttcaatcttattctttaagccatgataggagtaactgtttccacacattttctcaacatccttcaaaaatagtatcagaggaccatgctgactttcttcggaagcaaactgtagaaagaaccagtaagtaaaaagagaagaattggaacaccaacaaacatagccaaaaaggactgcacacacctcgtatattacatcaaatggatgtttagctctatcttcccatcctgggccatcgaggcaaagagaatcaactggagatacaaggaaacataaacaagtgaatttcaaatttacattatatcaaatatagtaataaatgccaaattacagaatctatgtatgatataggtataaattatttaaggcataggagcacaagagcaaacaggctcacctggacaaaagaaaccacggtcaacctcgcaattgcctccaagatcaatgccaccaggaatctttttatcaaatctgactccaactttcgaggattcattttcctcaaaaggaagcctaacttcaccttgtgagccataatctggagctctgcagatcgtatcatttggcataaaccgatcagcggatgcagatgatgacaccaaaagattgtttacaggaaaaaaggccccgaggtgattgcaagtaaaagatgcaaatggtaacattaagatggcatttgtaaacaaagggagataacagataattcagggaaaaaaacacgtagttcacccctcacacaccatcattgatcacatgccggactgatgatccgaaactaaaaccaatcagggtcgtttgttaaaaaaaaaaagagcctgcggcatatcaataccaactatataacctaagaatatacagtaagttcattataatatcacatgcaatgttcacaaaaaaaatggagctagagattattgtcatgattactacgtaagatctgcttttctgggtacgtttggaacacaaaattgccacaagaactgaaataacagtgacgtcgcttgaatacttcagaaagcttatgtttatgcaagacataacctactgggaaccatttattgtagcaccctttaaaaatgtttccagattagcactacagtagtaacttgtctatctaaactcctcactcttttggtactgtcacatgacaaaatgtactttaggtgaacacagaaatggaaactgcttcccataatgaggcaccgatttcaacagagaacattagaaagccaataatctatcttaatatgcctcacctttgtccctcaaggataatccctgttgattgtactgaaccaatgtatctcaccctatctcctgaaaaaaccatcagaagcattgacgttgtggttttattatcatcataaatattctgaaaaaaggaactacaatctcctgcaaactttactgcacggacaaatttaaggtcaccatactcaactcaatgattttctacttaaactaggcatacatagcgaccaaagcagtcactactcagtgagtctgtgcatataactaatagtacatgcatagtcttaccttttttgtacgactcagattccttcgactttgaagactgtccctgaaaagaaaaatgaaatatatccaagaaccatattaattcaagcaatagtgtatgtccctacatgcttaggcaaacattttgtctataagtatttaagcaggcacagaattatactagaaaaattatatatgcaaaatccaatttacaaatcaacatttaaaaagttatctaaaagatcaacatttaaaaagacaggccataaggaaattcagttattgcgatattagcaaaagctagaacttctggatgtatttgcatacggtagtagcaaggttgataattttgctatgaagttgtggacattatctgaagaatcaagatttgaataaaaattaagcagtgtagcacaaaatactacagcagaatgtaagaggaaatacatcagtatgacttgggtgtgtgttcttgtcagaaaactgtgatggctcatttgaataacatcagcgcacattaaacagtacgcacactttctctagagaaagagaccatggttatggttaagaagcttacactcgccagcaacgaaggatctataatgagcagcttagcaccaaagtgtttggtaagagccttcactaatgattcttggtatatctcagatcctttaaaaatgccaattattttagtcaacaatccatgcatagcattttaaaaaattagtaaatgccagcaacaattttcttttagagtgaaaaatggactctcttaaaaattactaattgagcagttaatttacattcagcgataagcttaccagctggaccagacaataatacccgttggcaaagagaagatatatgttttgtccatttgatggattccttgcaacataagtttacatacgctgaagacaggagagcatttttggtattctcactgcaaaaggttaggtcccattaaaagatagttcttaaccacatgagactaagcactcaacattaactaagaaacaggccgattagtacttcagttataaggtcttattagaacttagaactactcagtgctattgcattatgaccagctatcccattcttcttgccatcacctgtctacttactggctcaaaaatgaatccagaaaagagaggtgcaaccggtgtccatagcaaaagaatacacatataattcaatgtcaagatagagaatgtcatcactgtgaagtaaataaacaacagaaacatacatggataacactatcctagtacttgatgtcattgagagctatagtgaagacataaccagataagactaatggaatgaagtcaaccatatctggtgtcctgctacaccttatgatgttacacaattaaacaaactagggcaaattatccgcatagagatcactcagaattttcagtgataaaagtggcatatacaagagaaaaataaagggcaatataatgcacaatgccaacgatattgaacttaggagattatcctataccttaccgaggctttgcataataaaagcaaaacattggtggatcaagatttatagggactaaatgcaccttttgtgtcatcaaaaaagcaacattcatttatcttacattagcttctctaaattaagttccaaattggcattcatttgcagaccaaattactgcaactttgtaggttaagcagctagcgcatacctcagataatatggaaaactatcaaatgaatctgatatatcacttgcattaacgaccaccttcttcagatcctctttcaacagttgatgttgagcaacctgtaaattttcttcagaagcaagctggctctgttcctccattgttttacataaactgctgactatctctgtatctattgaagttgaaaacaaaataatatgaggcatgtagtttttgtcaaaagtccaagctcatttcaaagtacatgtgcatgcaattcttgtaatcagactattgaactcattcaccttccctctatatgcatttattactaaaatcatgccacggactaagaacttatgtgcaaagcatcaacataggaacattatgttcccatctgcaatttttctgattttataatccctacatccatgtgcctggtccagatatgccttacaaataaatggatggaatacatatactatgagccctcaaaaagtttacagggttaagagggggaacaaaaactgttataaaatagcctcaccatgaggaaccaacggagggcggccatttccaaagttaaagggcattactgatagcttggctcctttagatgatacatccaatgtacctttggtaactggatattgcccttgctgaaaagcacatgtggccgaaaatgttgatgtgcttgatctttcctctggaagttgctgaaatatctgcgaacatgttaaggagcttcatatacaacattaatacttttctgaacaatcaattacattagtggaacagatgccagtacaagcaacacttatgcaagggtagttggtgatgaaaggatacataagcatgtctcccaagtgaactaaaaataacttcatcgcctccaaccaatgtgaccttagcagtcttatctaataccttcccatttacat

SEQ ID NO: 11005 - DNA, 28563 bp, Oryza sativa
ccaggaaatgactctgtcagcctcaaatcataatttccaccatggccaaccgtaaaatgagtagtataaataggtactgaaggagactggaaaggacaaagatgaacacaatcatgagcaaagacaaaaggactccatggtgcaaattaacactatagaagtaaatgaggctggtgttctctcaaattctcaagaggcaggcaccctttgccaatagagagaatccacttagtgccactgagtttttcccacttctacaatctaccactgactttgtcaagttgaataatatgccatcgtgttttcccaaacatctactaagtgccatcgccatccacaggccgttaggatgcatccgtttagtgtattgatttttttcttaatgactaaaatacccttaccttagcactttgactgaagaccctagccgtgcaatccccatttgatctgcccagtgtgtggcagcgccgactcccatcgatggaaggccagccgcccgagtctccgaatggtggcgtgatttttcgggttggaatggattcaatccatgggttaaggtctggatcgatccataaatcacgaccaacccactcgctcaggtcatgtgctactagctgtgctctcctcttgcaggtcatgtgcttgctttctgcctcccccattatccatggcggcatggcatctctgctgctggcagctgccacgccggcggcagcggctatgcctactccacggaaacgagacgaggtgcccggtgccccaagggaagcccggactgctgcgtcgtcggcaagcgctacccgcggttcatgtggctcacagacggtatcggacatgcgccggcgatcccgacgctgcatatgtgcttccgccggaacatggagctggtcgtcgagctgtactccgggtctgggtggctgtgcctcgacgacggcggtggtggcgcacgctgccgccgctgcaacgggaggatccgcgtcgtcgtcgccgccgccgtgaatggacggtctgtcgttgtcagggtggtggacgagtgtgactacgtgaacgggtgctgcaacgaggacggcttcgcgcccccgtgccaggacaacgttggcggcgagtcactgactgtgtggaagaagcttggctcaaagagaacaggggcaaataggtctttttacagctctaacagatgtctaactaacggcttatggacagcgatggcactcagtagacgttcgggaaaacacgatggcatattattcaacttgacaaagtcagtggtaaattgtagaagtggggaaaactcagtggcactgagtggattctctcttgccaataaccctccatcagcatccattcaaacctttgaaataatgaaatgctgaacatacacaacctaatcccaattcccaaatgctcttgtatattttcaccccaacctatgtaaacttgttaacttttgtttcgtcttggtccaagatcagataaaatatacaaaatgtataccactaagaactaaggacagaagttatgccactcggaattgaggggtttgtacttcttttttctgcagaatgcgtgatttagtccttagtccttaaagaccacaacacaaatccaggttctacaaaaaaaccttcgaaacaaaaaattactctgtttcctgaaatctgctattactgtagcacctcattgtctatcaatggaatgatcttagtgaacacaataggaaatttcagaacatattgtttcaaccgattggaagttgatcaccgaacctcggaagattgagaaatcagtcttccccaagcctcagcacgcccgttcgccaccgcctgccttgccttccagagtgagagttcttccgctgatggaacatttatatactttgtccttttcttcttcactgaagaatcgaaacaagcccaaatcaatcagaaacatatctcccctgaactaaatcaatcctaatacaccccaaaagccggaaaacccaacctccagagttggacaccgttgacgacgccggtacggcgcccgtgggcctcgccacaccgtgcaggttttccaccgagctatcgatcacatctatcgccgccgccgccgtcgcgtctgctccccccgccttcgccgcgggagtccctaccgtcggcttccgctaccgtacacaccaaaaccaacacaaaaaaaatcagataaaacccctcaaattccaccccgcgtgaacacatgcaacggaccttcgcccgcttccccgaccgccttcgaggcgtggaactccccggcgaccccggccccggcgaagccccatccgtcgccggcgatgccggcttcttcgacgacgcccgccgcttcggcgcggcgctccgccgcgtatccaccatcgctcccccggatcggcgacgcgcgcacgcaaagggaagaggaggaaggaaggcggccgccgcgagggaccgaaccgtaatttcgcgcgccgagccgagacgataccacggagagaagaagaggcttggggttctcccctcttttccgtttaaggaacgccaggtaggtggtgcgggggaggagggaggcccgcgcttatatataggcccccgacccgcgccgaaccggcaagcggcccgacgagaaaaaaaccggtttattttaaagccgcagacattttgccgacttggttgtggtgcggtgcggtgcgttgagacacacaggcggggggacgttgacctgttgttgcggcggcgttgggtgatgcgtgcggctaccggcttgaccggtccgaccggtcgggtggtggggtttaggtgcggtgtacaaagggaggcgttaataattgggcgagattaggattcggattaggataaaacacacgcttatgggttctgggtttgatgttgctttcgggccgttcaatttgtactgtcttttctttttcctttttcccaatctttttcgttgatagactgtgtttgtctcgtttggacaaatgcccgccaagatggatatccctcgtcatgggattttctcacgatttatcgatcctgacctcgacttaccaagtacggcggacgctaccaagggtagttgccaatttttgccgacaatatcattttgtttttcagaaggtccaccttatattaaactttaaaacgtgaagaaagtgtttttttaacccctttacaaaataacaatttttagctatatgtatctggactaatattcgtccaaatgcatagttagaattgttattctgaagcgtaattataaacttgctctctatggagttaaccccgattcaaccaacgtgacgttgtggctatactcggtgctgagttattttggctttcggtggctagcgatgttgctacggatacagtttagtgatattttcaattttaaaaatggtaggtagatagcttctggacgtattcacatgtattcaacaccttgcgtcagtgtatcccttagctcatatgcaataagtaacgtgccgtatatatatactgctacaaagaaaaacattttatatatgttgagatattggtaccactttttcggtggaaagcaagaaacgtatactggatttcctacgaaggacaactgcaccttatggatgtatcacgtttgtcgacccacgatactttggaagtattaaatgtcatgtatatcatctttgttcacctattttactgtttcaatttatgatgaattgctaaaacaaggcatttattaagatatcatggcgttaatattcgccttctttttcgctataaaggaagaaacggctacgggttttcctacaacatgtagctttacactttgcgtgaatataaattcgcaatactctagaatcacgtcttagaagtaaatattccctaggtttaaagttttaatttgtgatgaaacgttaaaacttgacatttttttaagatatcatggtgttgatccgccttctttctggttggaaaggaagaaacgtataagagattcttgataacctgtagctatacacctagcacgtcacattggcaaatactacttaacacttaaattattttgtgccatatatatagtcttagataagttggttttccctagttgaacgtttcatttttgttatgaaaagtttaaacaatacaaattatattggtgtagcttctttttttaaaaaaaaaggtagaaacatctactatatttaatccagcttgcagctgaaattaatcacgtgaaacgtatgtgttgaaaaaaccttgtgctgatgcaccatgttggcatgtctgcagcacttcaagtatttcatgacagtagagcggaattttctcttcttctattgtattccttacaagaatgagagtttttttttcataggtggatccaggagtggtcccaagaccacccaaaataatcctagcccaatacatatatatatacatatgtgaaaataaacttaaaaaaaagaaaagaagctcctttattaatatattatgatgcacatttaatcaatttatacttctaattaacttggttatatttagagtatttaaaaagttataagtgttggatcacctatataaaatttcatcatacgcactgttgttgtgagagaaaaacacaaggtgttggtccgttggatgatctatctgagattataaatataaacgtggagctttttgcaaaaagcaaacctcacatagcattttccaagaagagaaaaagttccgaaaaacgctgaaaaaattgctccccaaagggttttaattgcggatgatgtatatcgtcttgaggggccggaaaagtgtgttggttggatttcgacttctataattaaccatacctttcattgcattaggatagcgctttaagtttggaagtaaattgttacatgtgacaatgtatgtgatcctacgagttatctgaacttccatttcaaactatggataggctgctgctaccgtagtattttttgaccaagttatttattaaaatataaatattttttatgagtaaattgcatattgggtcatgtatttttttaccatggtttcagactagataacttaatccaatgttttcactttcaactataatttgtttccaaaaggttgcactttgaaccagtagcccacctgtcagtgcctatctttcatctttatctctattcggtctccaccaacagcgtatgcaaaagcgacctcgagcgaagtagagtaagtgctagggcggatcttgagcttggtgagaacgaggtagagcttgagcaacccagaattagcaataggggaggttgacctcgacctcgagctaggatggtgcatctagggggtagatggcggcggatcctgagcgcagggtcaacgtcagcggagcctgagtaggtggaacccgagcttgacctctgcctacactacatcgcccccatcgcaccggtgggatcagccatgggctcgttctctgctagctttgtcttctgttggcattatcgttgtcctcttcccgtggcttgacctcgaccttgaccttgccacaatctcgaccttgactccaagcctctttgctcatgcaatccacatgctcgagctcatgcacaccgctgtgactgtgagataaaagagaaggttttccatgctttggtttttttttaaccctagcctacctgatcaatgggccacgagtttaaagtgtaactttcaaacacagcttactacttgataggctatgtttaagaagagaaataaaaaagatacacaaaacgaggtacccctccgtactcataaagaaagtcgtttaagtcaaaccttggggaatataaatcataaataactctcaagttattgagtttgaaaatgtgaaaattatatgaatagatttgtcttgaaaaatacttttataaaagtatacatatataacttttcaaaaagatatttttatagaaacaagaagtcaaagttgtgttttggagaccttgtcgatgtccaaaacgacttcctttacgagtatggagggagtaagttattagtgtgtaactaataattattttaaacctaaaaaatgaatttttaaaaagatacacaaaacaatttttctattgaaagttttttttaaaaaaagatataccgattagcagtttgaaaagagcgtgtgaaaaatgatgttgttttcttgtttttgtttaactctcgaacacagtctaaagtgaaaacactactgtgaaactaggatgaagaaaaacataacctactgtaaccctgtttagtttcaaagttttttttcatacttccaactttagtgtgaactaaacacagcatgtattttaaagtactactccctcagtcccacaatataagggatttttagtttttgcttgcaacgtttgaccactcatcttattcaatttttttttaaatataaaaaacgaaaatttgtgcttaaagtactatagataataaagtaagtcacaaataaaataattaataatttcaaaaaattttaaataagacgagtggttaaacgttagaagaaaaaatcaaaatctcttatattatgggacggggagtagtacgtacctggctaggcgagtacagtacgcacggagatgagaggtcgtcggccgaggcgtcatgatcatctgattgaaaaggtgcggcggaaacaggaacagtggagcgcaacatgcgtcatggttgtgtgtgcaaacatagcccaccaccgaacacccagctattttaacgctttttcggtgttgggaaatcgcgccgtctcccatcacggagcgttgcgttggagtagcagtatttggggcggacggtgtacgccagccgacttgaccagcccagctagctagctacaccaccacctgtagatcgcacgtgttcggcgttgttccatcgatccctgtactgctgtcaagagagaagagagtggagtagcaggttggtggggagtactgtatttatttactcgctgcgcggcgtggcgtcgaaaggcttgtcaatctgcacgtatcgtcagcggggaccgacgtacgccacgcgagtgtgcgcgatgaggtccagccccttatcgcttgtagttgtatcgcttgtgagagctaagctacgcttcctgaagtataatttggttcttctaaggacagatcgtccagctagtagtagctaactcccccgttttcaaaatactaaggacactgtataattattggttactgaaaaaataacaagccaccattttagcggcaataattgcattgaaattcgtgcaaactcttttacctatccctcttgtctacccctccgtccaaaaaaaaaaaataatactacctatgaacctggaaggctggacacaaactaagaattcgttttttgacagagtagtattccgctcttcgcatgcagtttgtcatcaccgcctcccctcccaagtcccaaccacgctagtcctcatgatcaccagctaaccaagaagcccaataacaacgtcgaggaaccgctgcaccttgcaagcctgcaattggcggattggaagctggcctacatacaatggaggaataagttcatataggtatgtcattttgtcatcgaatctgaaaggaaaaagtacgaattatgcccctaaaatatcatggtcggccgaattacccccctaaacttgaaaaccagatattattcaccctgaattttcaataccggacgaattacccccctcgaccctatccaacgcggttttgtcctacatggcgtacgcgtggcaaccagtcagcaccttatttattaaaaaaatatgggtcccacatgtcatactcatctttccatcttcctccctctcctctctcttctctcgcctcgtagagctccaccgccgaccagatgatgaggacgcctgaaccgtaaaatgatgaggacgcctgaaccggatgcccgcctcgtagagctccgccgccgaccggatgatgccgccgttggcctcctcctcgtcgtcgtcgtggcggcggtcatctctcctggcggcggcgccgccgcctctgccccggtcaccgcgtggtctatggtgctggccactgagcaaactcttgcggaacaagtcgagcgggtggagcgcccggtgttccttcgccggcggcatcttgcacgaggccagatgaacctcagcaccattttgttcacttcatactcgatgtcaccctttttcaagtaatccgttaatggtgagcttatagctagcaatggtggaagagagatcgatcaatatcaatggtgtccattaccatttctttgggcttctttgccggtctcgacggcgacgagcttctggaggaggaggagaggcaggtggttatcggtgatgagcatgtcgcggcggacgtacggcaccatgtacagcgcgccgtggcggccgaacaccgggtcgttgtgtgcgtatccgccgccgctgatcaccttcgtcgtcctcatcatctccagcagaccaccagggagcacccgttggtgaacatcaccggcaagaatctctcgccgcgccactcgccggcgaggtccacggcggcaacgaactcctccaccggcctgcgtggagatgggtgcgtggcggatgggtgctcaccgggatgcggcggaagcagctggacagacgacggcggcgcccccctgctcagctcgcgggatgaaggatcggcgcagcctgctcagcccgccgtcggcctcggctcctcgcccgctgcccgcagccgcctccgcgcccgcccgcctccagcctcggctcctatcccgccgtccgcagctatctccgccaccggccgcccgtcggcgtcgattcctcgcccgcccgctgtccgcagccatccccgccgtcggccgcccgtcggtgtctgctcctcgtccgcagccgcctccgcggccgcccgccgccgcctccgtgcccgttaacctccagcctcagctcctcacccgccgccggccgcccgtcagcgtcggctcctcgcccgcccgccgctcgcagtgtttagttgttcaccgagagagagggggaagagaaggagaggaaaaaaaggtgctgacagctgggccccacctttttatatttgtttttttcactgtatcgtcacgtgtgtgccacgtaagctgaaaaccgcttcgacttagggtggaaatttagccagttttaagtgtttgggggtgtcaaatgtccggtattgtagtttagggggtaaatcgtacaaccgtaatagttcggggagtaattcgtacttttttcaatctgaaatttatccctaaaacaaaaaaaaaggacaattgctcatttgaccctattctgaagtctaactactaatttgaccctaattttttaactttgcccatttaactctgctttttaaaatcggaactgccgtctgaccttgttttcactacaccgttaaagtttatttacgaaacagaaaataaatcattttatattctaaactgactaaaatgccccagagtacaaaatcaatcatatccccaaaattttcacccggtgccgtccactcatcccaggtcttctcagatctcaacggcgcggctagggttcggcggaggcggcgcatggagggggctgcggcggcggcgcgcggtgagggcttcggcggcggcggcaggacgtgcggtggtgacgacgcgcaggtgcagctgcgacagcgacgcgcaggtgctgctgctgcacggcggcacgtaggagctgcggcagccacaacacgtggatgtgggagatggccgtcgagcctgatccttcgggcatgccataactacatgtctacatgtgttttttcccttgtacagtttgagtttgatgctggcaaaattttatcaaatctaagacaatttgtcaaacctatatcaaacccatgtcaaaatttgtcaaatctaacatcgatttgtcaaacctagaaaaataaaaaaaatcttttaataaagtagggtcaaataagtaagagcataaatggcatttttgttatgaactaacaccgttacattgcctttacagaatagggtcaagtttgatcttcatttgtgaaaaaagggtcaaatgagcaaattttaaaaaacaaggtcaaattggaaattaggtatcaaaacagggtcaacaacacaattgccccaaaaaaaaagatataacgggttcctcaatttgtaaaactggatcacctaaagtactaggcgaatcagatgtggcaagctaataagtcagcgcgagatcattatgggcccacatgttattgactagcactttcctactactctcttcccttcccctctctcttctcctctctctccctctccctctcccttcctccctatcccctctagggcgacgaccgacagaaagaatgacgtgatgggtgacgaggagaagggcggtggctggtggccacaggagaggagggcggccaatatatcgtagagggcggcgcccaacgaagagaagggtaacttgcgaccctctctctcatgcttgaatgggccgagcttgttgctttttctacatcgccaccacggcgggtggacccttgaggtggaacaccaaggcgggcatggcgctgccctttatgatcacgttcgcaacctcctctgcaaaggaaaaacacatccaaaacccccctcccctcaacccctaagctcatgacttgaagccaggcatggaaaaccgcgaatcgacgcggtgcagcgagggttcaggatgggtgcgcttatcctttttggcgagttccataaggacgttggtggcgcgcttggcggcggtgcagtaggcatggtgccaggagaagcaccggtggagggcgccgacctgcgtgtggaccttgcttgggagtgctggcagcagatctctggcttgcccaagtcatcctcctcattgtcatcatcgcacgccgccctttcctcctcctctctctctccctttctgggacaacagctgctgcagaggctagaaggggagtggacattggtgccagacactagctacaggggttgggggaactgagcggtaagcaagcacatcggggtgggtggtgggtgggtaggtttggacaccggagaggcaaaggccagaatcccaaagtggggaggtgagagggttcgacggtggcggttggttggccgacgattgaggtggattgagtagagtggcgggggaaccaacgagagagagagggggagaaggagagaagagaggaaagagaggggtgtggtgggtcccacggcatttcttgttttgaagcgtacactcgctgacatgtgggtcccatatttttttttgataagtgccacgtaggcaccaaatcagcctaagccactgatcaaacgtctcgggaccttatttgcactggttccggagttgagggaccttaagtgaatttcactccgcaacaatttgagggacgtcaagtgaacttattcctacagtggagccctgtaaaggccactgggccagtagcttaccctactccgtgattccggggctctgggccgacaactcgatcggaccgaaaccagtggcccgttcggagtttttgaaggcaaatggagccgggtacccagccatattaatttgatccatgccactgcaaatttggctattcagaaaaatgccattacaattcgtctattcgtaactatgccattaaaatttttaaaaaactagaaccgtgccactcccgttacatttttcatctatcccctccttttccatcttctccgtcgcagcgcaccaccgccacctcagtcagccaccgcacgcggctgccgctgacagccttggtcgaggaaccccacgccctcctccaccggcctcacggcctcgtccccacgcaccaccgcttccttggctctagcgccgagaccgacgccgccggtgaggtgtggacgcgcagataggcggcgggagcaggagatgggcgtcggcagtggcggcgattaagctcggcgatggaccatgctgcgatccattctccgccggcgagttaattgcacgagttaattagtttcacaaaattgatctagcttccatgctacgatccattctccgccggcgagcagtcggcagcagcggcgacggcttcgtcgtctccgcttccgctcgcggcggcgtgagccggaccatgtgttcgccgccgtcgcgtacatgcgtacgccacctcgagcgacacaggtggtagccactactactcccgctgcctccatagctacagctgcgacgagcacagccggcgccgacgccatctctacttggtgctggatgactggaaggaggggtacagcctacacaaagctcgacttcagccatgtctccggcgacgacgccaccagttgcgccgacgtgtgaagccgcgcagacgccgtgcttgccgccgccgccgcaggttgcgacagagtcgccgatttcttcgattctccttttctctttctcttttcttcgatttcttctttcctggcttggcatggccggcggcgtgatgcggacgaagctaggcgacggtggcgcagcccgacgagggcacgacgaggttgggcggcgccacgaccttgcggtggccggcgaggtgtggatggcggtggggcgtgaccgcgcggccctgcggtggccggcgaggagcggcgcagcaagccgaggacggctcggcggcacagcccgaggccaacgtgcgacggtgcggcggagctcaaggcccaaggccgaggtgtggtggctgattgaggcggcggcggcgatccgtgctgcgcgctgtaacggagaagacggaaaaggaggggatagatggaaatcatgacgggagtggcacggttctaatttctgcaaaacttcaatggcacggttacaaatagacaaattgtaatggtatttttctgaatagccaaatttgcagtggcatggatcaaattaaccctatcagggagattggggtgtgccgtgagtgtggcttgcacggggtccagccagggtccctggtctcccttgatccagtaaacagacgacacgcggacgatcgccatcttagcaaagatacttcatcaagcaagaaggcagtacatcttctaaatgacgcagcctctgagagcgacagacagacaggagataacacaacgttttcaggacacaaatcgcggataattttatcggaactaatacgacacctgcgacgccggagcaaaacgacaccacaacagagcgctctagtagcctctacagcttaaacagactagcagtggcagtagtctagcagatacaatgggcaggaatcgccaaaggattctaagctagtagccaatagaacctgcttacctgcatcgacagcaaccgagatagcaacagaaagttcaagcctaattgcactggattagctaaaagattgggacatcaaccacagcttttatacaaaaccaggaggattaaacgtacgccacaacacaaagtaaaagagctaagtagaacatcatcatccacgaaaatgtcgtcacatgcatacatctaaaacaccatttttctgctgccataagcgccccactcttacttattcagttcaggacttcaggcgaaggctacctctcaccttcaggcgcggtgacctcacctactgggtcttcgccgactcgctcttcgacggctgggcctccggcgataactcgccgaaaaccttggcgatgcgctcggtggggatggcgggaaggtactgtgctccggtgtaacccttgtcggccgcggcggcgatcaccttgttgtacttctcggcccagtaggcggcggtgggcacggcgatctgcgccacctgcgggaacagcggcaggttgttgagcgagcgccaggtgaagacggcgaggtgctccgccgccggctcgtagcgcacgtagaggtccttggccgccggctggatcctgccgtacacgcccttggccacgggctcgaccttggcgtacgcgacgcgcgcggcgccggtgacgcccgactgctgcacctccgcggtgagctccctcgccacgtccggcacgccgcgggccaccgcgcaagccttggcggaggcggccttcagcgtcggcgggaggtgtcggtccagctcttgcaccgtgtcatccacctgcaatttatggttacacctccgttagcaagaacacataataatttctaccgtgcttccaaatacctacaagaattagcaccgaattctaccacaagcaatcctcagtatcaacttatgtattgccaagcaagaacacattgaaatcaaatcggaatcaatttaaaatgaacacgctgaactcaatttctaccgtgcctccaaattcttgcatcaattagcacccaaagctaccagaagcaatactcagtatcaaattatgtattgccaagcaagaacacagtgaaatcgaatcggaaattcggaatcaatttaaaatgaacacgctgaacccaatttctaccgtgcctccatattcttgcatcaattagcaccgaaagctaccagaagcaatactcaaaaatcaaattatttatcgacaagaaagaacactgagtggaatcagtcaaatggactataccaccacatttctaccgttcttcctaaattcctacaagcaccgaactctactgcaagccaatcctcaaagtcaaattctatattgccaactaagaacactgaaatcaaattggaatcaactttggagttcgtcggcaggttcgttgccaactgccaaactaggacctgttcatcacctcggagactccgccaagtgctagaatgcgccggaatctaataaggaatctaccatgggggccggattcgatgcaccaccacgggaatcccgtacggggacgaattctccaccacagattgcccacccctgtaggccccagctacatcacgcgcaccaagaaaatgaccacccacgccatcgtagggcccgcgtcggagcaatcatgcaccgcacccgaaaaaaatctagcggcgccagatagggcacggcgcccatcccgttctagcgtgcgccgccgcaagcgcggccacctcggccggcgagcgagcgagcgagccgcgccaccgctcgttcgtctcgcgggacaacgccaagtcggcaaccgttagcaacggcgaaagagggggctggggctaccttgcggtcgacgaaggcgaggacgtcgagggggacgccatggaagcggccgtagacggggccgacgacgcccttgacggcggactcgacggcgtcgacgccggggcggagcgggccggcgtggtccttggcaagcgcgtagagccccgcgaggcagatcgtcgcctgcgctgccgccacctgcacgaactccaagtacctcagcttcggcctcctcaccttcttcaccttcacctccctcttctgcaaaaccaaaccaaaccaaaccaaaacccccaaaatcggaaccaaatcagcaccaaattccacccccaaaaccagcatcaattcgaaaccaacaagccacaacgaatcgcgcctaccacttgcgggttgggctccgccatcgccggaatcgaggccgcgagggtttcgagaagctgctcgggaatcgggggagacgaagacgagacgagacgagacacgattttccttttttttttcttttctttctttcttactttcccttcaagcggggaggaaacggaaggatcgggaggaggtgggtatataggcgacgaggagctccgcacggccgtccgatgcgaggggtgcgggtcgatctgggccgttgggacgcggccgcgagaatgctctggagcgggtccgccacgtcgtggctcgcgtgagggacacgtggaggcggggccctgtccacgtctcctacaggcgccatcttttactcgttgatctgtgtgcgggatggttgaggatggacggccgaggtgggtcatgccggtgatttgctgatgtcgattctagcttctagaaatttctatcaatcatttgtgagtgaccatggctagcttgcttcaacattaagctgcagatttgaacgattcagttataaagcaacgagtatgcatttgatggtgttcttttctcaagacagattcttcggggttgttcaccaatgacttgacggccgcggtgccagcacaaggatatcgatggaaagaagtaggctggtgaaaacgcaggccggctagaagtagtagtacttccgtagccggcacgctgatcaagaactgacgtgcgtgatgcaaagaattctcagctgctctctttcctcaatggccattctgatggggatcctgaactcagggagaaaatggtttcacatcgctaaatacatcaaggcgctccaggcaggcaggggaagtgaggcacagccacgctagccgccaatctcctgcaggtactgtcgggcagtgccaggacaacctgccttgtgttgtcaggggaaaaaacatccatccgcgcatctagatcggatccacatccacttcaatagaagcatactccgtatacagtatgatcgaaagaaaaccatagttcgcagttcgcaccatacatttcatggctaatcaagaactattaatctcagacgttgagcgtgaggttccatccaagcgaatgcggcacataacaaagagcaccggcgttcagcatcagaccatcagttgatcgaccaaccatttttaaattaaataaaacaataatacataagaacatacacaacaatcgttctagttagacgcctttgtcgttgagcttttcctgcaaacagatacacttattgtatttgaccccctttaaataacggtgcagacacgagcacaattagctacagctgcacaacctctcgtacacaacgaatgcaatgttagccactgacagctaacgcctagcaacatcaggtaggagcatactgttgtacaggcctggagttgtttgcctgaagcaactccggcttacgagctatctagtgaaggccgccgagtcttggtctggttcaatcgttatactagggctaagaccatcttgcatctgctgctcagatccctgtttgcagtacgaatgttagatctatcaaggaaatacataaaatcaagtccatgcatcagcagtaaaattttgctaacaagtacagtttgaaagtttaaatgccctttgaaaactcttttcaaatttaattcaatttataatgaagtttattgttccgaaaagccttgcaaacaagcattccatgtatgtcaccctaaaaactgtgtacctgctattcttgccaatgttcaatagctgaggccagacaactaatcttgtccgtagtgatagtcccagagaggactctgtaatgcaattaaacataactattggtaatcaaaatacctgtaccaacttattatcgcacatttgcatatatgtgtttcgattagatctcgcaagtaattcaggtaagaataccaatacttctgatgtttactccttaaaaccaataccatcccccattatgatattctgtggctagttatatgtacatgtgtgttatctgcaatatattttgtaatcatgtgtttctttgcatgtgtatactgagtatttgtggaacatgtattctttgcatttgtgtcgaatggtgggcccaacccccattgtttatgtggtcatgtatataatttctaaaattaagaataataattattttttccatattaactcttgaacttgaagtatatttatctcgcgtttgttgtattgtgtaagcacattactaacaagattaaaaagcccagagtaagcaattatctaaccgtctccatacagtcaaatacagtaggcagtaacataggtacttcaagtacaggattatgtgccttgcaggaaatgagacataatatggtgatttttctggtgttgccagtgttatgcaagatgcagatataagcataagatgtactgcatgaaaataaatattaaacaaacatccccgttgttcttcaaatacctaatagaaaacaacttacctgtggctgcaaagatggtaactgctgctgctgctggtcttgttgcatcacatatggttgtggttgagacagcctgtagtatggctccttgagttcaagtttggctgtggatgtctgcaggatgccaccttgttctgccccctcaccccacattttagcttccagaaaataaccaaaagagcaagaaccatcagcttcaagtgcaatagagggaaaaaaactgataacaaacgaaatagaaaatgcccaacctgacatcgtcaagtatatcgtgtagctttgtgcactgtgggctaccagatgaagtcgtcctgttatttcttgtcctgccatgacatataatggctgtgaaagtatgcatcgtagttgataccagtgagtcgtaggggaggacctggagcagtggtaagccacctctggacagtgctgcagtaaaacacacagattgtagcgggtagaagcagacaagagacaatatagactcaaataaaccgatatagcactgacctcccattgaacaatacatcaaaccaacaagctagcccatgcaccctagtgccaacagaggccacaaaatttaggggaatgtcaatctcgtaaagctcctcttcctggcaaagaaagaaaagaatgcttcattttgcagggagaaacaatacagaaaaattacctgtagtttcagtctcatcaccaataaagaaatatttaccttcatggtagtgaaatcaagcgtatgaaacgtaggcggagaaaccaataatcttggatcgaatgcatccaccacaggctgcatgagaattgcaggggcgtttagatttgataactagtcagtagtcactctgatcaacaatgcagtcatgggttatatagaattacttaagtaatagccattctcggggttcaattcttggcattaaccactggaactggaatacaggtggctaattgaaagattaggtgccagtaagagtgcattgaactatttattgttgtttttgaattgaggtactttctagtcaaaagttgaaaagaaaagggatgagatacctgtgaaaaatacccctggaatgctgaaccatgcaaaggtgtaagatcaacaccaaaaaagttatgctgctgccagaagagagcctgcagagacacacaaccaaaatataatgtgtcaaactaaagaaacacttaggattgaaataacatactttcagcaaggataatatacttgctcaacaacatgagaataaataggaagtgaccacaaggtggctttaaccccccaccagcatcatcatacgaaaatatgagattttcgcatagagcaaatgatgtgctaaaaacacataaaagctaggaataagtgtgcattttcttttttcagaaaatacacagaagagctgcttatctttgtgttaagacaaggtataagtgggggaaatggacacattctcactttggtactgtgctatacagttgacagaaagcatggacaagttgagaattcatttctcaatatctcctatttaaagaaccagggaaattttgaaacagtaatatctatatataggatgtcagatgttatgggcgttgatccagagatagggtaacggtccaaagatgagaataaattgatagttaccccctctgtcccaaagtataacaacctagtactcgattagacaccacctagtactatgaagactgtctaggttcatagtactaagtggtgtctagtcgagtactaggttgctatactttgggacgaagggagtatttcattactttgtgttcaataaattgcaagttgtatagtgtgtatctgaactcatcttacgtagttgctaggtcaagcgcgtgaacataaacatatggtgttacagtttgatgttctggacatttccgctccaacaagttccaatgtcatatccatttctggcattaccattttgtattctcatttcaagaaaaaaaaagtatggtttcggacaacagttttgaatattttcgattcaattccaactgttttcacaacccacttgcacatagtaatttacaacaaggttagtatagcctcactagaagcactggatagtaagattgtgcagtaaacttaggaaaaagatttcatcggagtgtaatactgtaccttgtttgccatttcaacatagaggtattcatcggaaaatggagccatatgaatcctagtaaatatttaatatatcaggcatcagtgagtaattgtgaatgccaaaagtagcttaaaaagccatgcatctgagtttattttttggaaaacttagccaatagatctattctgacgttttagtaagcacagatgatttagtgaacaatcctaatcaaacacctaaagattttgtgaagcagaacttccaataaatatccagagtggttcagattaccttccagttgttggaaacattttaccacctggcacaaggaatctgtctctagctataacataggactccagcatcctttcattcaccaagagggttcctaaaatattatagacaaaacaagtcactacataatacatataagcagatacagaaacaagtttattgtcctataccaaatttcaaaattcaaacaacaatataacatttcaaatattagctagtttacattgggtattcaactattcaataaacaccgtggataccgcatatactatcaccatttggccaatggccagtgcttaacccatacaatccattaaaaggaacattgatgctaacaacggatagtttgtctacaaatatgacagccaatttcttgacaggattaacagatggcaatgcaacctagtacttatccgtcacctagctgcaaagtgtgaaagttatccatatgtatacaaacacaatgaatcggttattagattgtgcaacgggtataagatgtaaagcaggaacaccacaggtgactctgggaaaagaaatgctccagaaagtttatcattgaggcatacccataggctccgaaataagtatgtcagctttctctggaagttcaacttcctcaactttgcctttgatgacctagttatgatggggacactgattaattttagggcaaaaaggaagcctggaagttccaaaccaaactggcacataaacgaaccgttattctttgtccaagagatgggtttccagaaataagacgctgagcatgttcagccatttcagatgcctcaactgcatatacatgtctggcaccagcctgatattaacatataaaacatcatctgttattttgtataaaaaacaagaagttagaaaagtcatggagaatgttggagtgtacctgtgcagcaaataatgaaagaatgccactaccagctccaacatcaaccacaactcgaccctcaaaatcggatcgattttccattacagcagcatagtatgttcctggagtaaaaggttgtaaactaattacatatatacagaaaggagaccttcatgccattattttaactcttttgacaataggccagagatactgacctgtcctgacaaagtcttgcaacatattttgctgatgtaataactggccatagtagtggaaatacatctttgctgatgaggcctcaatttttgtatcaaatttgcttttagaaccaattattaatccattttccaaaggttcacctgccatgaagcagcaatatgttgaaataagaatctatggcattttacattaaaaaaaagggctaatgactctggcttcactgttggcataagttttgagattaacatgtcaatgttgtcccttagttgccactttgcttcgtcacaaataacacttttgaaaaaggaaacgaatacaaagagaagcacaaaaaggtgtgctacaatgagcatctcataaccaagttctaccaagagaaatgatgcaaagtattaatgtatgttctccaaaataacatgcattaatataatcatgcatgatgtaatttgatttcattaactacagttatccttcaagaaaactggatgtgcagatataaagcagtaaacatgctacttctacaaattcctaatagcattatttttttatcagaccaggcacgaccaaatatgcaagttaaatggcattatgcatttcattagatagtagagcactagagctagcagaatatatcaaaccaaagtgaaaaacattatctagtcttaaaaacacttggtattgaagggcagctattggcacttaaagaaaaacagacatggagagctgtaattgactatatgcatgataatctgaaatttagcattgagaacatgggccgatgactcagaaataatgcaacaaaatatgctactggaattatctgaaacaagaaatgaaaggacaaaccagcttttccactaatcactcggtgtttccattgttgaaaagctaaatagaaggctttgctctcagcttctgtcctaagaacaaccttaattgctcttgaatatgacttctgcctcaaagaattgagagttaacatgaagccatttaatatgtgctacaagaaagttccaacagaaaaggccaaacaatgatctacaaattgtcatattacctttacctctaggcaacattatcagaaagtctatgcgatgagttatttagcagatggcaacaaagaagtgtgacacagcagtcagcaggaaattcacctttataacgtaacaataggcagcagactatcaagagttctataagtcagactttcagataggcaggaaaattctagttatgtctcgcatctcacaatcatagagcatatcctttgcagtttcagaaagttgcttttagtacatataggatggtatcgagagagatcatatcacactccagcctttttctttaggtgtttcaactagtatgtgtctaagactctaagttggatttggatgaagatatgacccccaaaagaaagagtgttccgacaacaaacttgaatgcaaactgtgtcatgttattcaactagtaatatcaacatcttcgccccagatttaaaatgtcactgaatcttcttttgagccatcttttaaaagaaaaatgttggtatgcctctaccgtgcaacaattaaaccttgagatcatcttaaaattggcttgagcatgatacagccatacaggcatacagctcaaggcgtggtatatcagggaattggactggttatatactggaaggctcagtgcacatcagaaatatgaaatccaacagaggaatgtacattatgaccaaacgaaagcacataataactcaaaaaaacagcgaaattactgaagagtacctcctccacaccgtccttagcctccgactcgccgctcacgcacagccactccgtcggccccagcttaaatatctgcaaaactcaaaatctcatcctccaatcgcacggcaacagcagaggcacctctcagagccccaccatgaaatcgaatcgaaccaacgcggccacgccctacagcccaacgcacttccacttctacttcccccataaaccatcgagatcacggaggaatacctgcgcgtcagagagatcgatctcgagcgtgtgcttcgcctgggtctccccggaccagacgaggctgaggcgcggggccccggtggacgcgtccccgccgaacacggccgtggcgccgccggtgacctccgtcgacgcgcccgcgacggcgggtacggagacatggcagaaggagacgttcgggaacaggtccgccgacgccattggggccgggagcttcggatccgggatgccctagggttttgggcgcgccgaggcgggcgacgcggggtggctagggttttgggcggaggcgcgcggcgtcgcggggtgaaggagctcgctgtttgtacgcgtgggtggagtatgcgtctgccattttctaataaatatttttatttaattcgagagagaagacaaccacgccgccaaagtcacggtgacgcggtgagttcgaatgaggctttcttacctttgacggcaggtgggacccaccgcttcgttatcgatgaagggccccacgtgtcagtggcgaatgggaatggtatgatcgtacgcataacgacggaccatagttaaagccgtcgcttttttggctttttacggagaatgggtgaacctttggtactgacatgtggggtctatactccaaagtgctttggtccacagatcatgggaatgtattttgggagtactctgaacttttggtattaattgggctcttgggacttgggccacttggattcatttgttttaagcccaaaatttgctgggccatgactaccaagcccaaaattctctactgtacataagttgcatgtcctatattagtgtaaagttataatccattaatcataaatcttaacatgtaaatatatcacctcatcatccactagcataattacatataaaacttatgcaaacatgcaacatcatctataattctttaaattctacaaatcaacattcaatcatcttccttcacattatttttcacaatatttttaatatatatatccatcatttttataatccttaacatatattcatctatataaacaaagtgcataatatcatattttatctataatctcatatagagtctactaaatgtatttctccttaaacatagtttgataacctgttttatttattgttaataactaatatatattttattgttaactcgattattaaaataatattaaaagttacttagaaatttacgcagcaaagcacggggaatcacccagtgtatttatataagtgattgtgtgcacgttttacatgagcttctgcatctgtattttgttttgctaaaaaaaagattatgttacgatcaaattattatttattttgaaacatgtacaatcgtgcaaacatccatatacacacgtacatactcacccatataaacgctcgtattcatatagtatctctacgagcacaatcaaccagttgtatcaatatatcttgaaattgatgaagtaatcatatgtagggtatgatcgtatacaactgagatgaaaatatacttatttgtataagatcctcatcatacgcagtggttaacttccaggcttgatgttgagtcgatgtgccttgttttcgtattttccaactgttgcaactaactgttctgtcaaatatcatagaaacggtaaacaccgcgatccaaaaaccatcaaattctaaactccgattacagttaagctgggtgtatttatctgcgatgatgcaaattgagacaagtactcttttgtcatgtaaagatcatatgggtcttctaagatgggctggaccaaagcaaactttaggtggtgtttatttatgttgaagatgaagttaggacactaaaaaaaaaatcattagcacataattaattaagttttaattattataaagttagaaaatgaatcttcatgataattaaaagtaacatttttataaaagacatcgtttaacaatttaaaaagtatactaatggaaaccgatgtaaagccctaattgttttattattttgcgtgcgctaacttcatcatcatcttaatatatctcaaatactaattattagtgcataattattaattttaattattataacttagaaaatagatttatttgatattttaaatcaactgatgtatagacagttttttttaaaaaaacacatcgtttaaaaaagtgcttaaaaaaccgaggtaaaatctatgcatcttgatcagaaaagaacatggcacacttttgtttggtacggaaattttctacatagaagttatttttaaatatgaagtaaattcattttaaatatgaaataaatacatttttcaaaacgtaattaataatactccaatgatttcaaagtattttcatctgaatcaaacggggcccgtcgtcttctttcgtctccactctctcgtcgtcgtcggtctcggggcccgacggggtctcgacgccgccttccatccacggcggccgccggtggcgatctggctcctcctcctcttcatccaccgcgcattacgttccgtacaacgagagctctcccttccaccggcctgcgtttgcatatccatccctccgcccgccttcctcgccgcgatccaggaggatgccgccggagcaagccggagacctcgccgccgttgtgagcaaaattctgacacatttttttggaagtaacattacttaggtttatcgctagttagtcgttggattgcggctattcctcgctagttgtaaaatactccgcccgggggggataaactttatgtcatctgattgcaactgtaaatcctctgggtaggcgagttcaagccgattcaacaatgccgccatgggaggagcagcagaagcttcctcatcagagagagactccatgaaagggcgcacaaagaagctcctagtagataaggtatacctagcccaatgatcggatctgtgcaggggactccacgagcaagcgcgcgtggcttgaattcactcctgaaatcgacgtgctgtgctaactgtagcctgtaggagtgtagggggtagaggaggctggtcctgtgctctcttatctagcagggtggctggtgagggttagttcattctttgatgtcccccaccatcctaatccaaagagaagctatgctaggttattagggaggggaaacaccactgatgagatatggagggagggggcctggcctccctcctggctgtccctgttcttgatgtgaagaaaggggcaccaatctctgacttgtttctgcctcagcacagttcattcccctcacaggcatgcttgcacctccatcatgaaagtgtccctcctccctcagcctccccttctttggtcttttcccacctttatgctgtgctacaatgagaaccgccgtcgctcgcgcacccgattggcctgcgtgagaatcgactcacctccttcttaataacatcgatatgatagcctcctttcatatccagctttttttaatgctgtgctacaatttagtttaagttattgacttttttttttgctttacctttggtttagctctgatgtatttctccaaaaactttaggagacatggaaacaggagatgcttgcttgagaatttttttgagatattacgtaatcgctagctttatggtgatgctgacttgagtgaactatactagagaacatgaacgtggaaagatatgccctttttaccttgaaagaagcagattgctctgcttgcctaatgctgtgcccactaagaagctcaagaagcatggtggatgcattttagtgtttggtaaaatgtcgaagctcaagaagcatgtatgtataatagctgctgaatgtttcatttcttgcacatgtggctattcagatcatggaggatgcaggccactttgaaggggttttttttttcattagtttctgttgtggagcgagaaggttagatagatctcacaaggacaaggagaaagaaatctggggatatatgacaataatgatattacaagggatccaataactcatctttcctgattaatccttacaactttagcaaagaatatgtgcaccgtttccccttttttgtgaaggtagttaatagacgaagagcagggggcatggcaccaccacagggagtgcaccatatgcggcgagcatccgcatactgtaaatgcatgcctttaccctgaaatgactagataatatcataaagaaagtatgatgcctgggattgtcacctacgcgtttattccatcgatatcaccttttgaaaatggctaggggtacggtagaattccgctttctattgtgataatgtgatattcaattgaaaggaattggtatgtgaaataatctgcagctgccacctttgtagcaggtgtaagtcagtagagctcagctgatgtactgatattttgagcatatgcatgcgcaggctctttaccttcctgagtaacctgttctttttactattgaatcatccttggatgcttcaagttggggatgcacctagtatggaatttggtgtttgtttatagccgtatgttttgttgattcagtgaccttgggaccttgcaaactaaggctagcattgttcccttctaacgccttatgttacacgaaaccttcagatgctgttacaactttcctggaataacttttttagtgtacaaaatatgttattgtctccagtattatctactttactgatgtgtttcattgtgtgcgaccttgtaccacggcagtgtattccttagttgcattattgacaactttatcatgatctgacaaatatcattattgtgtgtgcaccttttgcctcatcatcttggtggatgttttttttttccactggaatattgtttacctgtggtctatgtgctttgatttgtcattgtcagcatctccatgcccagttccatatgaaattgcagtcaaaagagttcacatttttttttgcatgaattaaactttgttctgtttttgccagcagcttcatgcttaggtccatgggattgtgtggcaatgtaaacatgtttttttcttctgtttactccttttgaccacaatactaatattatgatttttgagcattgtag

SEQ ID NO: 11006 - DNA, 2019 bp, Oryza sativa
tttcctggaatactttttttagtgtacaaaatatgttattgtctccagtattatctactttactgatgtgtttcattgtgtgcgaccttgtaccacgcaagtgtattccttagttgcattattgacaactttatcatgatctgacaaatatcattattgtgtgtgcaccttttgcctcatcatcttggtggatgttttttttttccactggaatattgtttacctgtggtctatgtgctttgatttgtcattgtcagcatctccatgcccagttccatatgaaattgcagtcaaaagagttcacatttttttttgcatgaattaaactttgttctgtttttgccagcagcttcatgcttaggtccatgggattgtgtggcaatgtaaacatgtttttttcttctgtttactccttttgaccacaatactaatattatgatttttgagcattgtagatggtctctgcttctggagagtggagactctggttagcatcagtcacttgacccactacaaataatagaagttcctgggatgaagaaccaataactgtcagccacaaccctttgtttgcattcttattacctttgttacttagtctccgctagattatccatctcctttgattgaggttaatcatgtccttttgatccaactggtttaaaagttacaacttttcatctaggtggtgcatttgttattaatttgttaaccacaatccatggcatggtactattcaccttttcttgatacataaaacatttcattcaaaaaatggaagtggatcaggtttacacttttgtcactcacctctcctaggatcttcaactcagttctagcttttccaacctattttttctatcattaccacaaaaagattgccctttacttactggttacccaagtatagtgtcttttgcctatccctacatgcctcatgttttcttcatggctaggagtttgtagtgatatttcaagactagtgcaaatatttcatattttttcttcatgacaaaggggaccttcttaaaggtacatcgtgagaaacaggtggagttctgcgtcacacagcaaagcaaggcaatggataatggaggacagcgtcttgatataatttttaagttttcaacatattatcacatcacattacacttttcaatagaacactactagagggagttccataaattgagacactgtcgtgtccagaaagatagcaagtggatcatcttgcacaggctgcaccgtcgtattggttcagaatctttcaaataaagtcgaaatattaagaagatatgcttctcagaccatgcatcaccacactatataaggggcaaacaagctcccagtatcgttactttgagcccccgcctccccttttgaaataaggttgactgtaattctgcttttgttcgtaatatggatgatcataacttagactacaagggaagtggtgctcttgaagagcttgagatgttaacagtgaatgccaaagaagcccaagagctcatattgacgaaaatccttgagaggaatcaggctaccgagtacctgagcaaattcatgaatgggtcaacaaatatttctgccttcaagagacatgttcctgtagtaacatatgataaggtacatccatacattctcaggattgcaactggtgaggaatcttcaattttatgtggagaatatatcttggagctgcttagaaggtgcgcctctcatttcaatgcattcatcagttcacatctctttcctgtgtatggtagagatagtagcaaccaacatatattggttggcaatctggcaggccctacatgtacttgcctttgatagaagttggttttagtgcacttggtggttaatgggagaaaaataagttctcttggtacttgctaggctgctgttaatgactgtcataaatccagaggcacagaccgagcttcgcttaggaaaaattgtttatatttattttttggaatgtgctaggctagaaatgactggtcatactaagctacttgc

SEQ ID NO: 11007 - DNA, 11344 bp, Oryza sativa
aacgggcctgtagccaaaggttacagtgctcaagtagcacctctaggtcctgggttcaactccccatgggagcaaatttcaggcctagtaaaaacaagtcactcgttggccgggcagggacctcaaaccacaggttaaggaccgatccatagagggcgagtccgcgtgtgtggggccagggtttgtggcttttcttggccgctttggttgaggcttcttctaaatgaaaagccgtgagggcggtcattcccctgccggtcgaatttttttaaataacaatctgtttaagctattctgactcaggatcttctaagtgatcctctctatatggaaggaccgaagtaattagcaaagtacatacaaaatgcagaagttctattaccaaagtatgtataaatattttctcttgctcctacctttgaggatataatttttcaagaacacacagaagagatgtgcatattttgcatcaggcagaagaaagagtaagaaataattcccattaggccagacccagaatatactcatcataagcaaccacaatctatgtaaacaactagggcccgcctgcaaaagaatagacaacaagttgccaacaaaagtagatacatcagtttacaaatatatcatctgcttcttgaagaaataccctaatgtttgatccatgccctataatatatccctctttactgtcattaaagaaattactgttaatattaggccttattgtgtttaaagaatttaatacagggccttgctattcacttagtgactgtgcttttgatgctaattacataattaatttgtagctcggggacttctcgaggtgagccaagattgatgccgtccatcttaaaggatcttgaccgtcgaacctacctctatagtctgatcatgcctatcatgaacaagtaagtttatatcttcttatggaaatattgtgatgtggttatgacaacttcattattgtgtaatatctggatccagttgtatgcctaatctcctttctgcaattttctaaccttcttattcttgcaaaagtaatgagataagtagttaattattgcattaaccaaattttgtttttgtttgcctcaaacagatgatatcatttgtgaagctctgttgacactgaccctaaaattgacagatcctgagaggcgttgttttgcatgcttcctgtttgacatttttttttggattattcacattagtaacacaacctgggtccagtactccagttgcaagacgcaaagtattggacaatagttaccgcatatgccactgcttgcagctcaaaaacttaaaaataagttcatatattggttgctgctttagcaaagtatcaggcaatgccagatatacatttgctacctcataccacatcaagaaaccaactgttatacacagctgttttggtgtttctaaaatccacactattaatgcttccaaaggtaattatgtttaatatggtacctgaattttggactaaactgaatggcaccctcagatgcaacttagctcaaatgcttttgttcctgactgtattaatatccagtacataaatttgttagatagcaccatagcagtagcgcacagatatatcttccagagttccaaaggtttatcaagagtttccagacagatttgtcttggactggcaatttatgtcataatccaatctgcaggtatatatcaggccttggtgaggggaaagctatgtaccttctctttgtgaaagctgaaacactgacagattctggaattccagttcgatcagtcctcactagctactataagagccctcatttccttcaccgcaaacacgatttatacaacaactataccagtcctgatgaggtcattctttgccctgatagccagcagagcatgtactgccagctgctctgtggcctggtagaacgccagcatgttcttcgtatcggggcagtctttgcctcagcattccttcgatctatcagcttccttgagcagcattggcgtgaccttgtcaatgacatacgaattggtcagctcaactccagtatcaccagtccagcatgccgtttggccatgctgaacttccttgcattgcccaacccagagctagctgatcaggttgaggcaatatgcagctgcggttcatggaaggggattctgggaaggctatggcctaatgttaaatatatcgaagctgttcttacgggcacaatggcacaatatatccccatgctggaattctatggtggtggtgcgattcctttcgtctgcacgatgtatgcttcctcagaaagctatttcggtgtcaatctgagtccactatgtagcccagctgatgtgtcttacaccatcctcccaaacatggcttactttgagttcataccattagaggacggcctcaggttgactgatcacgaggaggtgatagagaatgacaagcttgtcagcctggtagatgtcaaggttggatgttactatgagcttgtagttaccacattttcaggtaagaacactgcagttatattacggtattttcttggactaagcatatgtagttatacttagatctacatcagcttttactccatatgatcaaaagaaattttcttgacatgaaattatctataacattaatatagactatcattttgtcaaaacttcaattttcacaatacaatatatgtgtcaactgtcaggtatttttgcttcaattttttttagtgatcagacaagtgaaacggattatttatgttcactgaagtagtgcttgtcaccataataaatatgtagatgcagtggtaagttcacatacaggaaaacaaaataaaactacaaacccctgcactgcagatatttggaaatgtagtaactcgcaaatacatgtccttcaactgacatatgtcttgcccaggtctttacaggtacagggttggtgatgtgcttcaagtgacaggcttctacaaccgagctccgcagttcaaattcatttgccggagaaatgttatcctcagcatcgattctgacaagaccaacgaggaggatctccacaacagtgtcaccactgctaagaaaatcctggagaaccaaaattacctcctcctggagtacactagctacactgatatttccactgtccctggccactacgtgctgttctgggagatcaagtccacccacgatgaaaggccggcccctcttgacgctcagctcctcgagagctgctgtgctgctgtcgaggagtcactggactacgtctaccgtcgttgcagagcccatgacaggtccatagggcctctggagatacggcttgttgaagctggtgcatttgatgctctgatggatctattggttagccatggcagctccattaaccagtacaagacacccagatgcatcgaatctagccttgcactgaagctgctgaactccaaggtcattgcctgctttttcagtccacaggatcctgaatgcggcatgtaaaactttggtaaataagcaagtatgcttctgtgcttgcttgatatgcaatcttactacaattaaccgaaattaatagtctgagatatagtggaaataataataataataatgtactactagcttaaataatgaagttcttattttagatggctgcaggctttaggagcttcatttccaatctagtcagatcagcctgctgcctagataagtgggtataaatgttgccaacttttagattttcatttgggttttaattactgaatattcaggggccaacatacccaaatgagaatgatatgtgctgttgctgctaaagaagtttgctgctcccctctgtagtctcatggatgactgaacacttaactgaatgatgtatacttttgttcctatatatgctgcagcagcaaatattccactcttggtctcttttagctactggaatactgatgctctgatctggtatttaccagtgcagtatagtactctagtgtacagtaacaactgcatcttccatttcctaaaaattaaaatccaattctctgaagccttttctgcatgctacactgcccatcagttcctgtactccctagtagtccatagtacaactatggacgcatatgcatgataggcagatactaccatgcgtgcagagcctgctgattctgctgctggaaacatgatttttgtgcttgctggttaagtgtactcaacaacttagcaggggattaggaagaagacgatgccatggcagtgtgtcatggagtgcctgtaggcccaatgtctgtgtgtttttgcatgcagacacggcttacctggctgaagccctctgccggtttgatcccctgctctttgcacccgtctgatgttaacgtcttggttaagccgtgcacgcatattctattctacgtgtcgatcgatgtcttcagtggatgattaggttgtgcacgggtgccaccactctctacttttacctaacctaatctcttctggaacccatgaattttttttaaccgaatgtttctttttctacgagcttcctacctgtaaatctttgtctaggacaagccattttcatgtgagtttcactgaaaacagttcaattcttgatgagtctgctacctcctttcccaaagataactatttttggctatatatctgagtaaacaagaaaaatgcttatatttaggatcggaggaagtattttctttagtttcaactgttgttgtatatttattagagaacagaaattgctatgtatacaatccaatcgtctgactcacgtgcaaccgatcgacggcctacaatgtacatgaacattcgctcttgaagaatagggtgtgtttggttgacctggtttacacaagggatatactagcaagttagcataaagcatgtaaagtttggttttgtgaaagcaatgagctttcaatcatgagagtgatggcattcatgctaggttaattacttctaagctaagacttgaggaatggccgatcgaaagatacatcacaacttcacaagagtgatcagtcatgacaatacatatactagtagtattgctatgtatctgaatggacccaacaatgcaatgcaaagggctccttttcagatggacctatgcctgcttgccgtcgctggtgacctaaaaagagttttgctatcacacagcctacactacacagcttcatgtcagctttgcggccccccttttttttttctcagtgtaaagtcatcaccatcaccagtgcatgcctcttctggaatttgctctcgagttgagtgctcaaatctttcaggtggtacatgctctgatcattgcactgcacatgcatgtgcaaatattcacgtagtagaaaaggcctgtaaaacaaaaagaaatgcaagagatgtttttatctccgttccaaaatataagaacctagaatcggattacaaagaatctgcacatgcaacctatccagatttgttgtacaagaaaatatcccttccggtaatagattcttatatttttggacagagggagtacttaataaaatgagaaacattaacaaaaaaaaaaagaaaacattcattatgcagatgccaaaagtattcttggtgtaattgtatcatcttgatatattttattgagatcaataaaaaagtttcaattatcttgaaagtcttgtgatcaattactttaataattgtttaaagatcacaaagaatgtgccatgagtatctgtactgaaagttcattggtgcatgcatgtatgcatccagccaaagaaatcacgggatatgctcgtatgcatgttggggagacagggatgtgtattcgtgtccagaaagtagaacaggtttggaataatacaccatttttgtcgtgacaggaacatccaattattttgtggtggattaattatttcagtccttttgctttataaaccacggagataatgataataattctggcaacatccaaagttttttttcagaaaggcaaacacacataaccttttctctgtagctgaacatttgcgtttggtactatatatataattccgatgtgatcgaattgctttatctagattatcaaaaggctgccgcattagttgggctactccattgcattttagcacagctttccatcaagcaattcaagcacatgtgagtaactcagatagtcagattcgatctgcctcaatcgtactgagaccaataacaaagcgatcaagcatgttcatcggtcaaaccgtgcttatggcaataggttgcatcatcagctgctttgtgatgcacaggaaaccagtgtcactcagctccaaaagaccatctattttgtcacaataccatttgctacatgttagatcatcgatctattttgtttcagcgttatcttgttggcatctaactgaatctcctctggtcacccgtaacatgattagcaccatttctaaacctacgcacaaggaccctcagttacatgcataaactgtggatgaaacaaagcatgtcacagaacaggatatatagtaggctgggtctaacacagaatccaattctaaaattcaaatttgtcccacaaacagtacaatactacttgtctcacgaatcatttctcatctcaccaaactatccttacacttaaaaaaaccatccctcatttaacgaggagtatctcaggcacagttgaaacatattacttcctccatcccataatataaggaattttgagtttttgtttgcactgtttgaccactcgtcttattcaaaaaatttgtgcaaatataaaaaacgaaaagttgtgcttaaagtactttggataataaagtaagtcacaaaaacaataaataataattctaaatttttttgaataagacgagtggtcaaacagtataagcaaaaactcaaaatcccttatattattagacggagggagtactattaattaagtagattgttgctgcgaattatctacttaattataacgataaagtaaatatttttataaataaacttaacaaataacttaaaaaacaagtggtcacaacaatataatagaagaatctttttttaaatgtatttttaaagcgtggggctaataacccggtcctataatctgataaatgatacgaaaagttgcaagcctaaagtcttttacctttcctactaatttaccttttgaatcctagaattatattcttggccgagttctttacaagcaaaaaaaaagtatctaatttttcgcatgctcgcttcctaaattgctaagcggtatgttttttgaaaaaaaaatctatgaaaaaattgttttaaaaaatattaatatgttttctaaatttaaaatatactcaattaatcaggtcttaatgactcatcaatcttctcccattctctcctctcaaatacactctttagttggacagaaggagtactctacagattagacggaaggaaaactagaaatggcccaacaagaaaaataaaaatactactatatactcctgtgttgaatgaagcttctcacatgtcagcttaagtgcaagggatcctgacatctcagcgttgcacatgtactcactccctcaaaaaaaaaaaaaaaaaaccaaaccctgggtttctgtgtccaactttaactgtccgtcttatataaaatttttttataattcgtatttttattgtttagatgataaaacatgattaaattttatgcgtaacttgtttttttaattttttttcataatttttcaaataagatgaacggtcaaatgttagacacggaaactagggtttgtcttttttttttttttcggggggacggagggagtatatatacgctcctagtacatgctggagttagacaccagctaggagcagaagacttttaataatttgttggaagtgctcagattcaatgagcatagtgttagcgtaccattgctactgcccccaacttttaatttgttttggttgcaaaaatgcaaaatggcatttatgcatcctgtcaaggctctggcattgccattgaatttaccccagcgagtgcatcagctctggcagggtttgtcgtcgcaatcgcaaagatgagatgcagcagagccatgacatgagtagtagtggtagtggtactgctagtcgtaacacactttgaacacgagtagatctcgcttcaattcatacatttgctgttggtgcagcagcctgagcttggagcaggagcattcagtcattcacctgcgtttctccggaagaaagaaccatacactagagaacaaaatctacacacacccaggagagatgagatgagatggccattcaagatgcacagctctgctgcctggaaccttcaattttccttcagtgctaaaataagctctttttcatccaatataaaacctaaaaagatcataatatcatcatttcatcgaatcccaatataattatttcttactttatatactctcggtacatttattccatattttcacatcaacataataattattttaaaaataaatttattttgggataaataggaaaatgaacaatacagatagctaggagagatgcacctaatagtgtagtagtaaggggtgtttggttttttcaatctccaatacgcttaaaattttttctcaaaatatattttgaggctcataattttttcttaaaaaatatttggaggtacgtctttccttctaaatctcttcttttttcttcttttttttcttttcttcttaaaatattttgaggctcataattttttcttaaaaaatatttgaaggcacgtctttccttctaaatctcttcttttttcaatgatgcggaggctcgtaatttcttcttaaaaaatatttggaggtacgtctttaatttcctagctttttttttttttttttacggagagagtagtactagtactacgcgcgtcctccctctggggttgcaacgcgaccgcgaaatctttggttggttccaacgagaaaatgggtcgattttctgtgggatttcgacggcggcggccggcgaggcgatatgcaggatgctcaagccgcggtcaaacagcgggagactttactcgcgtcggcacttggcagtagtggcaggcaggcagccgcagctagattccgctagcctcgccgtcgccgtcgccgcggctcgtctcgtgccacaatacatgcagcacagtgcacgcgcacgcacacactggcattgtcactgcctcaccgttaattttactcgctccattcctaaatacgtattttatctgtattaaaatataagtaattttaggattacttaacagaggatatttttttaagaggaaagactttgatgtcgcttagtaaatgagggatcgatgattgaggataagatactaaagaaatttgaatggtgctagcagatgattggaacttgggaagaacggtaatctgaatagattggaggtgcatatattttcatggtatgattttgaaatgttagaagtatttatattttatagtggatagaatattctctattgactattactgtttcgattttactcaccaatttcctctaatttttaataaatacaatatttttttaatagtatttgttttttttgttaaaagacaagtggttaaatttaaaatgtcaatagtttcaactgtaaagatttagcaactaagggagtagtaaatgggtgtgttcagaaggtcggcttgtagcttcagcagcagccgtatgttacactgatgcttgcaacactgttgttattggctgtgccggatatttgtagttgtttgaggaaaaccaagataaaattaacgggggctttccaccgaattaatccgttgctggtttgggggatcgacacggcatgtggacgtgcgtacccgggaactgacacgggcagtccagtcctcacaccagaccagtcctcgttgcaacgtcgtatggtcacctttcaaaaaaatgttttgcccggaaacaccgggttttacagccacatttgcgtgtcggtgccatgaatcctaccagcaattttgctctccgtcccgtggatggagatgctgccatccgttctcactgtttccatggggtgtacacaacaaattaaacctcgcatatatactccctgccttgtacgactacctactatactacagatgaacagtctctgtgctccttttggtcacaacacaactttgaccaacagctgtgttgggttgttaatgttgccgtctcttctttctctttttttttacgtccacgcttcttaaattattaaacagactttttttttgaaaatacatatataaaaaaattgttttataaaccatattaatctatttttaatcacgtattaatgagttgctcaaaaaggtgcacgagggatttgctcccaactcaaactgccaaacatatttttagtttttaattgctaccttctgtaatgaaaattatgatatattgtttgctctctagcttaattattaactgtaaccaaaatttaaattttaaaattacttttagtgttgatcttaatattattaattacttttacttacattagattttaagtgattaagaatatatgtgtgtgaaagttttatttataaattatttttcgctaataagcattagggcttataatcggctataggcgaaacaataggtctgtgcgttgtcagtcacagtttgctaacacttgccaacaaaagaaaccaaacatcctcaagattaagtgttcaaaatatttgtccagcaggtctaaaagaatatttccatatttttctaaatcattaaaacatggcggatacgagaatcttatcataagtaactgaacaactgtctcagttaaataaatttgtctaacttaactttagaagtggtaaactgtatatggctggccaacaatcgacccctaaacaaaccgagactatcgtatccctaaacactaactatatcaatcaaacaagtggcgcattggttaaacgaaatactatcaagagtaccactggtaaatgctaatttaaacaactccattcataattaagaaaaacaaacaagtccatgtccactctcatagtctcatgcccttgctgatttgtccactacccttccattatgctttccccaaaataatcaaatcaaggagcgtatcacagaacaacgcaagaatcattgcattacatgtggacaactctggccctttgtttaatttgcagagtaatcatctcataaacaaaagcctgtgagccaacaggacgccagcttaactagcctggccaaagactcttcttggcgccaaatgtgcctccacttgcctcacaattcggagtggtaggtaacatcacatcactgctcaaattcaaaatatctggtttatttggtt

SEQ ID NO: 11008 - DNA, 595 bp, Oryza sativa
  unsure (1)..(595): unsure at all n locations
ccttctcgggcacctcgccctccttcttggcggcgtcgtccttggccggcttcttcgcctcggctttcttctccttctccggcttcttctccgagctctcagtcccagcttccttcgccgcctccttcgccttcttctccgcgcccttcccgcgctccccggccggcgccggagcagcagctggtggcggcgcggcggcgacctcgtcgggcttctgcttcgccgcggcggcgaccggcggcgacggccacaccgtggcgtgcttccctgacttgtgcagccgcctgacgagcacgtcggcgccgacgctgctcgtcaccgtcaccttgtgctgcgccgcgtcgattgtcaccttgtacacgcctgcgcatcaccggaaaaccaatcaatcaccaagaaatcgatcaaatctcaatcaaacctgcgaaaactacacataccttcgatgttctggagcaccttcttgaccttcttcttgcaaccctcgcagtggatcgacactcggagcacggtggtctgcaccaacaagaacagcaagannnnnnnnnnnnnnnnnnnnnnnnnnnnnnnnnnnnnnnnnnnnnnnnnnnnnnnn

SEQ ID NO: 11009 - DNA, 1082 bp, Oryza sativa
ttcctcctccccacccaaagctcgagctcccgctagggtttcgccgccgccatggtaagtccccctcgctttctccccgccgccgcctccaacctgacctcactgcgtgcccagttcctcccgggattcaccgctgatcatctcagcacccgcgagtctttccgtttcctcgtcgttctcgctttttttttttttattttttttgagttttctcctggacgagttggctgcagccgcagggagatcacatagagcttcaccagaagcgccatggccggcgcctggactacgaggagcgcaagcgcaagcgggcggcgcgcgaggtgcacaagcgatccagggatgcccggcaggtgagagactgtttatattcccccccccccctcttctgttcaattttttttggtgcgtttctgttgctgatgcgcgcgcgtttgttctgtggcagttgcttggtgctaagggtaagaggttcgccaagaagcggtatgccgagaaggcacagatgaagaagacgtaagtacttgtcgaatgtttctgtcagattgcatgtttgatgctccatttgatatattgatatttctgttgagtgttgatttcttgttgtattggtaggggatgtgagctcaggaatgcttgctgccattatttatagtttatactagattgatgcattttgaatagatgatatgatttgatgtttgtttactgctttgttttgcatagcgatattttgattgtgagatgtgagcattataattcgcaagtgtaaaatttgcttgtttggttgcatttctgtaaagttcattcacggatgtacacttgcagcctgaaaatgcacgacgagtcaacttctcggcagaaggttgatgatgttcaagagggtgctcttcctccatatctgctggaccgtgatcagacacaacgtgccaaggtaagtactcatattttgggttgctaaaatgctatctttctataatctagatgtgatacacaagtcaacttttcactgttttgatcattcatatgctgtgaaacataggttctcagcaacacaattaagcaaaagaggatggaaaagg

SEQ ID NO: 11010 - DNA, 885 bp, Oryza sativa
aaaaaatttagtgtattaatgatatccttgttaggtaaattaagatcttggtgcagtcgacaagtgcaaactcaccaagcaaatcgaacatgtcaagctaatgtcgacacgcatagagtcaaagaggttgcatgaaattgttggtttgtcatcatcgaatacgagagaacaatccccaaagagctccatagcaccgttgttcttcttgcttcttctcaagttcatgtagaaagccatcagctcacagagccatggggattgaagtatttcaatatgcagactctgggcttgagctttgaattcctgcccttgcttcgagtaatgtatctggaaaagagaggcttttagttaatagtcttacataattattaatataaccattgaggaccgtcttaaatccaaagacaagaacaatgatagatacgttaattctaacaaaaatagtcactagaaagattaaatatataaatacaactcaatcatcctctgtgtgtgtgtgtatatatatcctcgaagataccatatgagtatatgacccattgacacctatatagactagcattttgggcttcaccaaactcacatgcttataactaaaagtgtgtgaaatttttgtgttcctctctcaaataatggaatacttatatagttatcttcccccttcgttcggtttccaaaaaaaaatattccccctttgtccttagtaagctttaaatgtttctaatgcctttaagagataaagagaggtgccaagataaagtttaagggcatgccttgcatatttctttaaaatttcctcatggccacggcatttataaatgcataagtaacccaagtctttgccttgctgatcaatgccccatggctcttgggacccttgcttgt

SEQ ID NO: 11011 - DNA, 7804 bp, Oryza sativa
  unsure (1)..(7804): unsure at all n locations
gattaggatcggctgggtctgagttgggctaggtaagccgatacagccgattccgacaatacgatctgtgtacgacgtcgggttcaagttaatttacttcaagatggttgccacgcacggatagagtcctgggaaggcaattgtatctattaattaggatattttatgtaggttccatatagataaatgtgggcaaaagtctgccgcaaagacttgtggtatcttagagtttgttagagataatagtagtatgggcatatcttgtaattctcgggtataaatagaccccgagccatatgtaattaaacacacacacgttcaatacaatttcggcgcatcgccacccttttgctttagttttgtttcgacgagttcttgctttcgggttgagctgcatcggtttcgatcttcaacaagaggtaaaacttgttatgatgacttatattctcgggattagtgcttccatctttacgacactctaatcttgtttatgtaatttatcgagttatcatatatcttacataacctctggcaatatcgctatctaatctactatcggctaacatctgttagcagagggcaaccgattaggttagattttgacgttgatctagattatataagatatctaccactctatgaaacttctagcggcttgattgtctagatatcgttcttcttttcatacttaatactatatcagttgagtttgatatattaagtcgtgtttagaatatcgatctctagcctgctttctagttaccgattagagtaacatcgaagtttcagccgattttatcagatttaactatatttgttctatatgcttcattgacatgttaaatctgccctttatatcaagatattgttgtatctaagtatattaggcctttgtttgatatattatacctgctttaatatcctgatatagagtagtatcggagtattagccgatacatgctagatctatctgatcggctatgctataaacatatatagtcttgttaattgatatatatttcgatctaagtgatttatactgtctcggcatagcgattgatctatcccaatcacttgatttaagtatatatcaatataaggagtgtatatcattaatatctacagccgatcgagtagatttagttctttcttatttattcatgactgccgatcgatacacagatgacatcggctcaaagataaatgatacgtcatcggcacctagccgattggctatcatttatagatttacccacggtttctttgcttctatttcttattgattataggatcaaatcaactggcatgctaacatacccgaaggcgagctttggacctgcactggagttaagcagatctcccaggccacgtgttttcagtcaacagcgctgctcctcccccgccgcccgcgggctgctcctcccctcgccgcctgcgcccaccacccgcggtgctccgctgcctccccttctcctgcttcgcctgtcgccggccgctgaagtcctcctccgggtctgcagcctctgcaaccactgcctccccttttcccgtattgtcgccgcctccgcggcatcgccaggaccaggcgccgccgttggcaggagctggaggggtgggaggcatggcgcggggacgggggaggatggcaggagcggcggctcattagagccgacggccaccgccgcccaactcctctccgtcggtcgtcgctcctctctcccagccaccgctcctatctgttggccgccaccgctctctcccggccaccgttcctctgcccactcgttttcgctagcgagggcctatcgtcagctgtgcgtctccccaatcatcggtcgccaagaagagagaggaagtgatgtggccgcgtcgtgctctagggcggcgcctgtgggtctaagccgacggccgccaccgttgacgcctagctcctctcttcgcaagcgagcaccgccaccgccgagagcagtcgcgcgtctctggttttccctgcccgtcgccgccatcgctctcgctccactaccagttgccaaagaagaaaggtagaaagagaagggtagtggctcacttgtgggtccacgcgggtctcatgctgactcagccgccacatcagataaaatcggggtcaaaaccaccgaaggatctaaagtgaacggttttgtaagttgagggacgcccgatatctggttttatggttgagggacgattttgaatctcgatgacaagctgagggacctactgtgtactttttcctataagggaaactggggaggcccactcccccatcatttgacggaggaacgggccatgtttgggttactggcccgctacgccggcgaaagtcatctcctcgatccgtccgacggacgaccagaccaacggctaaagtgacagtattccagcgcagatttcgctcagatatccagtgcaaaatatgctcttggatcggcgcaaaatctgttcggggaatggagtttgatactgctttggtttgttgtgtgcagaagcagaacacgaagctgatcttgagtaacgtggaagcaaagatcgtgatggtaccattaagaatttagaacagaatttttactcttgtttgcaaccggcagatctcgtagcagatcagctttgtttcgtcgtagacgcataaacaaatgacacatgtgctgcgcaagcacaccaattcaccaaaacaaaaagggtgaggtcgaggacgacggtgaacctcgtggggtcgtggatcatgcatagtaaaaaaaaaatgggatcgagcaggcggttgaaccgaaaataaccggaaccagtgaccttggttgctcggttcaacaaaacgaccgccactgtagcagaacccgtaaaaaaccggtgattcagacggtttttgcgagaaccggtgaaccggtagcggttttttaagaatcggaccgattttaaatttgtcctaacagtatgacattacgaatttactacattaccacactatttttgtttttttatgttgtgaccgtataataatagatatactattttacttatgcatattttaccagtttgtgatgattctatatttaaaataatgcaaatcaaatataatattaataaataaaaaaccggcgaacaggtgaactggtcgaacaggtgaaccgatgaccagagcagatcgacctccggtccggtttttttactatgggatcatgcggactgcaaatccacgcagattcaatattaaatcctgatccaaattcaatattaatcctgatccaatactaatgagagagaagcaagtagcaacatgacaaacaaacaaactcatctcatcacactatattttttttacaaatctgcaatcttacaataagagcagagagcaagtagtgtagtgtagaattgggccaaagttcgcttatctgaaactgaaagaaagctacgaagacttgcaggttgcaaactaagcaaaggaggatgtttcagtcattttctgtgtctcccatcctctcgctgaagctggccttcgccgtcgccttcgccgtctccttctccgtctcctgttgcgccgcgcctccctcgccgcgggccgtagccgccgacctcctcgccgtgctcgccggcccgggcgccgcggcgcgcgtgccgccggccgcggagtcggcgcgcctgcgcgcctgcctccggttcctctccccggtcctccccctccccgccgccgcagcgatctccgaggggagggccgccaggaaggttcttgtggagcgcggcggcgcggacgaggcggatgggatggtgatgtggccgccggcgccggtcatggagctcgcgcgcctcgccgtcgactccggcggcgaccccggtgccatccaccgcgcgctcgaccccaccatgctcccggtgagctctcgtttatctcgttcttcgtagctcgtagctatatctatctccgagaaattgtaaaaattctaactctgcatagttctggatgtgttacgtacaatcctgaaattaatttccataacaaaatctaccgggggaatttcgttaggtgcctgatgttcagagggcgaagaggaacaaatgccaactcacaagaacaccatatgggaggcgtttcgctaacaaggtccagatttttgccctagctgtttgcttgcacttgaaattctttttacttacaaaggttgggcattgttcaagtgacatgtttgtgttatcaacaggacatcaattcatacctggcgtttttgttcgaattgattgcggcacgaggaccatcagtggggttaaatgtatcacttagtcgatacgatttcttccacggacacctcttccttgcttctgggacaggaaggcttggaattctgtaagtgtcatcagttactctatacaatttgtgctcaacactttctaacgctggccactccgatttcttaagtatcaagtgagaagttgtatgaaaatgcacggttctgtatgtatggtaacattactaatttactattcactatctgttatattgactaggtactccaatctgaacatacaacctagaattgaatcatatgcaaatttaagttggatattagatttttctttggaaaaattgagaattgaatctaaaactatcgcgagtatgcaggaacaagcatttggtcacagatatgtggaattttttttttagtgccaacacataatctttaatacagtacatatgtgccagaaacttgtatagtatcttcatcaaatatgtaaatgcaaatgattaaggtgtgagctattcttgagacagattccatgctaaagaatatccagcatttgataaggaattgttcccttacagtttgggattttgtcaggcaggtatgattttagtcagatgcatgggaagtcttaatctgacttttttttcaccgattggattttattaaattgtttattttctctatgacaggatctaatgtagtgtacgatgattctatgaatttacgcaacatcctttggttagcaccattgccatctaatgaaacaaaagcttggctatcaccaggtatgctgcccctgagtacttaacactgttcacatttctccattgtctccaagattgtttaggttctgaattaggggctcatacgcagttcatctcacttcaactcctatttctatttctctcgaacaaacaaaaaacaaacttttcctacatatgaattgacattctgctggtaacttttacatgaaacaggtgttttagttgtcctggatgcacatcctgatgggattatctatcaggatatgatacgtgattatgttcgggatgtacggacaatatatgaaggtttgattttataatttatcaatctacctgggtgggttcactatggagatagatggataacctagttggttttctgaacacctctgcagatgattttggagaggtttccgttgatgtcaactatctgaatgttgccaactccgctcctgcgaatagagttttcatttgctgaaatttaaccagacaattagctatcttccccgggtgtgattttatcattgtgggaagtagacaccatgtatcattcttcaagtcatatagccaggaaagcaatggtttgcttagcaaatttgcctcttgacggcatttgcatcctctgtgatgtttaggtgtttatttgattttctggaggatgcttattttgagagagaacgaagcaacttatatgggccgcacgcaggccgcaatcccgtccagaccttcacgcgggccagaatcccgttccggacaacctgttttgggccgtacggaggccggagtccaagttcatgcctcgtcggctaaacctgtttctggttttgtagtttccgcaccgagtagaagtaacgtgtgtttggttatatacaatagaaaatatcaaacttatccaagttagaaacaattagccacatcttaacaagtctaaaggaatcggtttgcattttgcaggttaaaggcagaatgacgtaccattaagggtggcataatggttaaaggtaaaatggaagaaaaatgaatgagtaatggttgatagataatatgggataatcgttagatgtaatataaacactctagaagtgtttatatttcaaatgctagataattttggaacgggggaagtactagcagatacactgttagtacatacatgcagaagtctagaagcaaatgagaccagacttgtagctctcataacaggttgtaaaatgtaactagtaaagatcttttctgcaccacgacatacaatgtaaaatgtattccagatatgttaaaggcatataacagatgagccttgtgcccacagtttaaaacacgctactctgaatgatcggtcaaaaagacccactgaacgggtacatctggggtgagagtcgcaacgagaagaatgaagtgtatagcattgcgtccttacacgagtaagacagcattgatacagccatcattctctgggttgtttgtaacttgtgcatatttacctgcacgacaagaacgctgttttatggaacaagttccagggagaagttaaaaagcaaaataagcagaacattcaacagatgccttaccccaaacaacttttccagcaggggttaccagaccaagttcactaacgttcacctgaaaagataaagtctgtaagcaccaacaggtaaaagcaggatgtctaaatgaacatgacaagcatccaacaatgttaaagtggttccagcaatctgctgccactaagaagttcaccatatcccatatatgccacatcagtaagataatcaagagcacaaaaggaatttatctcataaaagctaaagttttcattatcaataattcactatcagctgtaatactaacaacttaaatgagattacttttgttttcatatacaggcagaattcttgacatacctcaatgatagttccccttgtcaaaacaccaagagtagagtacatttgaccatttgggtttttcttcacagaaattatgtcaaggttgaaagtacatttcagctcagggtgagtaacatgggcctttgtgaaacgaaggccagttggcctaataaaccgttcatactttggtggtttccttgtaaacccaggtccaacaaaggtggccttagtgaccattctcttccactgtttggctgcataagcgtcattcgttagcagaaatcagatgcctaataacacatggtagtttctcagatcactactagatgacatgtaaaactgctttggcagaaatcagatgcctaataacacatggtagtttctcaaatcactactagatgacatgtaaaactgctttggcacctagctacgaggaagtacaaatacatgaatgcaccgagcatacaagccaaatgtcaactaatattacagatttacactattggcacctaggttcacttactttttctcttgccagttcgtaaaactttgaacatttcttcttcagccacaggtctgacctgaaaggaagaaaattgtgacagtgcttagtcaaggtaggaaaaccattgattgccaggtactagaaacagtttgtgttgaaaatcacctttggcaaaggaacctcccatttgccagccttttccatcctcttttgcttaattgtgttgctgagaacctatgtttcacagcatatgaatgatcaaaacagtgaaaagttgacttgtgtatcacatctagattatagaaagatagcattttagcaacccaaaatatgagtacttaccttggnnnnnnnnnnnnnnnnnnnnnnnnnnnnnnnnnnnnnnnnnnnnnnnnnnnnnnn

SEQ ID NO: 11012 - DNA, 16549 bp, Oryza sativa
tagtgtgcgaatttgattcataatttcatctccttcacccacaatacctgatatgtttaactccccaagtattaaaaccggtgcaatttaactccctcgatggttttggaaagctatttgctgacgtggcggtgttaacctggtctttgttccacgtgatgtcgacgtggcgcttacgtggtattagaattaaaaaaaatatgtggaacccattttcacgcaaaaaatattgtggggttcatgggttaaaccttttacacaaaacgatgataaaagtgtaaaaagtgtaaatggagtgatgcatgttagtgagtccgcccgtcgaatggattggttgcacggttccagaggggggctgttacagacctgtttgggagagcttctaactgcagcagcttctctcggaatcagaatctcctcaaacattctagcctttggtccagtttctaagaatctgtagttgtataattcagaaaatgaactagaaaccaaaagctaaaagttgagcgtttgcagattctcgtaagttgactatcaaccagttacttcttataatcttaaactctcccaaacaaatgcttccccgaacagacctacaatactttgcactctaaattcaatctcgaatggagagccttaacatggtaacatgaaactagatctttcttggtcatttttttttatttttgctgggagcctgggactattggtttatacatttaaaaatggagttaacatgtacctagtacatttggtttgatgttgtctaaatcaatacttaggaggccaacaacaaaggagatcacatattaagagctgattgaagaactgccctttattgcttaaacattctttggcattttgccgaagattcaagggcccatttaagttagattgttctttggattattttacggattatcacttaactatagggatacattaaatatattaagccccacatacaacaagcggtctgaacattacagtaaaagaaagactccataaaacatcagttgataccaaaatttaaattttcaaacttaattttaaagttgattttaaaattttttattgaagtttatttttcaacagtaatatttaagtagctaagaacgtttatataaaaattttacctataaattattattattttgttaatacgccgaatgacattatccacatttagctatacgatgggttttgttattcctggagagttttagaagccacattgttcagcgccacaggaaatgaaataatatacgtgcatcgacttaatcactgcagaaaatgatctagatttaacacaacatgaaggccacgcacacgttgaaggggatgacagcaacagggacccaaaacattaaccacaaagtcaaacccccagattgaactgatcaaatataaatgaatttacagttatgcacttgaacaatgactacaaatctaccctatttacatctaagtgcacagtagtgaacaacccctgctgtttttgcatttaggatgacaaatccaacttcttacacaaagaggagcaacagagcaggatataagtgacaacaaatggcaaattccattttgtcaagaaactatacatcacatatgaagcccctctaaagaaaaaaaaaatccaccaactttagaatcacatgcccaagaatgccctgcactgtgactcccagtgttccttagccagacgaacacgttcaacccgctccatctgtattctcttctcccagtactctggacaactgtcaatagatgatccatattaaatttcaacttggtaacaatccttgtccttttgcgataaacgaaatatggtgataatctatgttcatgacataaaaaaaagtgtacatttgtacggccgtgcagatgactgatgatatgatcctgagcagttcagacttacctatagcttagtagcatgttcagctcatccaagtgtacagcattaggaaagactcctgcctgaaatgagaaatcaggtcagttgatgggacatgcacaagcatatggtcatcaaatttgaaggaatgttatctaaaacaaagatcgaattgaaggaattgtttatacctgtcggcacagtgggcactttgatttgcgctcggcagacttcagcccatcaacgatcgtaacggatgcagcagaacagctgcacaagtagcaatatatgtgaccacaggaaagagcaactggatcaaacacggtatcctgcaaaagcaagtgaatttcagaaatttacaatgcaataaggaagtgctatgaatttcgcagtaacaaggaacaaagttgatacttgagcacattataacaaggagaatataacctaagtacgaattcatacttcataacataaaaaatttagtgtattaatgatatccttgttaggtaaattaagatcttggtgcagtcgacaagtgcaaactcaccaagcaaatcgaacatgtcaagctaatgtcgacacgcatagagtcaaagaggttgcatgaaattgttggtttgtcatcatcgaatacgagagaacaatccccaaagagctccatagcaccgttgttcttcttgcttcttctcaagttcatgtagaaagccatcagctcacagagccatggggattgaagtatttcaatatgcagactctgggcttgagctttgaattcctgcccttgcttcgagtaatgtatctggaaaagagaggcttttagttaatagtcttacataattattaatataaccattgaggaccgtcttaaatccaaagacaagaacaatgatagatacgttaattctaacaaaaatagtcactagaaagattaaatatataaatacaactcaatcatcctctgtgtgtgtgtgtatatatatcctcgaagataccatatgagtatatgacccattgacacctatatagactagcattttgggcttcaccaaactcacatgcttataactaaaagtgtgtgaaatttttgtgttcctctctcaaataatggaatacttatatagttatcttcccccttcgttcggtttccaaaaaaaaatattccccctttgtccttagtaagctttaaatgtttctaatgcctttaagagataaagagaggtgcaaagattaaagtttaaggccatgccttgtcatatttctttaaaattttcctcatggccacggcatttataattgcataagtaaccaagtctttgccttgctgtatcaatgccccatggctcttgtgacccttgctggtgaaccacattgtatatttcttgaaacctgatgccaggtgcaactcgagaagcttcttggccttttcattgaagcagccaataacggctgacatctcattgagaagagatgggaaaaaactcccatcacatactgcatgttgataggaatttgtcagataaccaaccatgaaaggtaaggtagacaaaaataaccatcatggcgactctaatattcttttctaggcaaaccgcagtagttacaatatcaatatgaaagaaccaggaataatcgactcttttaggactctgaaatatttatatcaaaaccatcccaaattatagtagacaagtcgacactaactaaaataatcgaaagttattcaaaaggacagatgaataagcccctgctaatgaatacaaaattaagagtggactttgtgatggttgacatccccttttccatggttactacggcctatagtatcttggcacttgaaaaattacgtggttgtcattgacaaacaattaccaccttgacaatgacttgcactattataatggggcagtcaatgggctatctctagtagtgttcaatttgaagttatgttataaatctgccgtccacacgacagtagtatatgcagattttccaaatacccgaccgatcaacttaatttgttggtattgatgtttgaaagcaaacaaaacattatcgccattttaaaatccaatcttaaccatacaaggggcgacagagaaaatgcttcgaaagaattgtgctaagaagtcaaattgttgctttctctgcagtaaagcttctcttccatgcgaagctgtaattgtttgacactataaataaaagaagtacagcgagaacaaggtaggatacatatatctaaaggataaataagagaaaataggttggcattcccaggaagagttcaacttgccgaataccaaaaccgctgtgtacagcctacaggttcctctgttcccgcagaattatcaactagttcttctcacttctcagcacgatgaaactaaaaaaactgaaaaaaaaaacaattgcctcttgcaagttgcaacaagtcctaaattctaatccttttctaggtatgccattttgccaagggtttgtccttttttaaccaaaagaaaaaaaaagtaccaaaaggcatgagcccgcccattaatcctcgttttcattgaaaacaagaaaccaacaggtttcttttgaaaaaacagcattattttcagtgtaagagaatcaagaatagtcctacgcatcaaagagaccatataggaggaaattgaaaggtatagtagctttattcaccagagcaatggccggggcagcggccggcggaggagccgtcgttctcgtgggattggaggtcagagcggcatttcttgagcaatttcttgagccgcttcagccccacgcccgggagctcctcatccatccccttcatgtacttctcgtacttcttggcaaacttcatgaatccaaatttaaggcaaacttcttggcaaatttttggagcgcttgaatggataacttgtacgcctatggcgtctgcaaattgatggattcaaaatcttggggtatatatatgtttgtgcgatgtgagtatgcctgaatgacttgagaaacgatttacagggtgagctggaaacgaacaaaacgaatccaaatttgtatagctcgcggacgaattgggggggcacggttcagagaaggaatgcacatgcaacaagagacggcaatcggaacaatggctaaagaaggaaatggaggaaaactgatgaaattaaaccaccaagagaaggcaaagaaaaagggcagcgaagctcacggagatgaagagggggccagaaattcagttgagctcaggcgtctcacgtgagacagtaataagaacaaagaaagaaattaagcttttaggattttttttccgagcagggtgaaacgaaggcaccggctgcgacggcatcgcgccgaatatatacaagcgaggagaggggaaagggtggcgccatggtggatgtccatgtggcgcgctcgcgtcgtgaggcggccgcaacggcggggtccgcgtgagagcgcgagatgatgatgatgttccgtgcggtgcggggcgagcgtttcgttgcgtttttctctcgttttcccccggttttgtggcgcggggagcgtgcgtgcgcgtgtgcgcggacgccgtcggagcggacaatttttgtggaaacagaatttgatcggcggaattcagctaagctcccacgcaaacctttgaattttgcaggttgcagcttttttttcgtgaacgcgcaaaaacgattgtacgtcgatatattagaagaaaaaagttacagttacacaaccgcactcagccagatcggcttttgcagccttttttccttccggaaaacttgtcaaatcgtttgatttatattattgtcacgtgttatctacttaattatgagaatatattaaaatttttaaagttctagctaaaataagtggttagcaatacagtagagaaaattttagaataattgtttcctgtcgtgtataaaatcaaaaagggtttattgataaaaacttgttccaaataaggtcgtatacgttttgtgatttcataggtatggtcaagaatagtgtggcctaggagaagacgagagggaccaattgacgcatgaagaaatggaattctcgctttgcagttatgcatctatatcaaacgtgggcgaatttggatagggcgacggcgacgtaaacgaaaaagaggcgtgcagttaactaaattttagttgaatcttgtggctgcccgtgctgctgtgcctgatagaaaggcgcgtaatcggataactgtcaaggaaagggttgcgtttcgctacctgtttagtttagcctagcttccaggtctcaatcctctgcgtccgtcagatattctgcgtactagataagctagcgtctaaagccgtaaagcgggcgatatacatgcttaacggtctacgcctaagaggtaaaattagataacagttattttggtcaattggacaattgcatgcaagtaaagttttcctttcttttctaccaaatttgatacacacacaaatgcaaatgtacatatatcataggaggcaaatgtacatatatcataggaggtagactacagaacgatatactgttacaataaaataactgacatcatcatggtacagttagacatgatacctactagtatcagatctggtacgtgggtatcatgctgaggtccgtatggtatagtaggtaccggattccaataccaaacataatacccccatatcagatctattacctaggtattatgttgacattagttatttcgttcgaacggtatatcgttttatagtatttatgatatcatatttggacgggtatatctcaatattgacgaaataaccatatgtccgagagattggacgatgtatcttgaaattgatgaaatcatcatacgagccttgctagttggcatatctcaaaattgacaaagtcaacatatggttcattagcacacgtgtctcattggtcgtcatatcttaaaagatcgacaaaatctacatacgtcttgctatcgatggatatgccatatatcaataaaatatacttagttgtaaatatgagaacccatggaagcacagaatttaaactctggtgcaacttaacttcgcgcactgacgttttctactgctaattagaatctcagttgtaaagtttaatacgagcagcacctaacctgaaatcaaacctctttttcttagtgatcataattgctcacttttgacaatgctaccactttccaaacaacaaagacagaccaacaaccttcgtggtaaaagatgaattagtgaaagtaagcatgcctagagtagctgctatgcatattgagtcgtctgcttaattaaacaattctccactaaattgttccaaaagcaaagtagatctcaatctcatcgattttttccagtaccggatacaatcacggaggacaaatttatgtggcaccttttcatcctcatcttgggtcgtctcaattctcaatagacttttccacgagaaaaggatgtcacgatatgtaattaaaacatggaacgataatactactgtacctaccatatgaatattgttattcaaacgacgtgaattcggtttgcatacttgcaatcactccgttgtcgaacaggctaacgaatccttgtgctaattgcataagtagttttcaatttggcataatctacatggtcaaatgtggatgaacatgcagtttgaaactggatcgacttcatgacctggtagtagtatacataccgtgtccttatcggcaacgtactcttacccggcaccgatttctcgtgctcgatcacatgaacacaccatgacaacatccagtttctaacagcaataccttaataggctagtagcatatatttatcagcctaaacaactatgtttattgttagagaatgcttcttccagtgtagcttccagtgtagcaaacagtggttggtttcttaatgcgcaaatcaaaccataaaatcgatgtcaccttgcccacaaaactggcggctgctgtttgcttgatgtaaagcagcggctgctaagctggtggcatatatattctccacgaccatttgcctgccacttgcttttatctgtgaatcagtgaatccaagcagggtaaggccatgcaaagaaattatgaaagcttagcgtagcgaagaaccttactcttgcagtactgttctgaccactgcatcaattgtattttgtcatttggtcatttttaaatgattcagggatgaaaatatcaaaattactttgtatctacgtaaagtaggtagtaataatctattacgcaatatgatatattttgcgatatatatgtctatttggagaagcttcagttgtaacgtcttaaaatttctagctctctaaatagtccaaattgtcaagcagattctggtaatagttatataatccttaaaactggcttccctagattcacactagctgctctggaaaacactgcctcccccaaataacatcataatctagtttgctaattgaaaaggataaagagaagaacgttctggagccgtacggtttctgaatctgtactattttggcccggccatggcccatggattcacgggttatttatccctcaaaacggattcttgttttggattcctgatacacttcgatcctctgccgcacacaacacgcagatttgattgaggtcaacgagtaaagaggttgagacaacagaccttgtctagcgataatgcattagttagtggttgcttagcggtgcctctgtttagtggcatgccatctttgatggtgatattgagtaaagttttttgagatttcggacgctccaaaactacaaatagctagctggaatattgggcctcatcggttacccatattccctaataagcccggcttattaaggaataataaataatttataggaaaattttttatatatttgttcgtaccgacttaaaagccaacgctaaaaagaaataatgctaaaaatatcttaaaatgaactccaaaatcaaatcaagttcagaaattcaaattttagcttttgatttagcttattaggtgaaccgatgtggctcttggttagctagctctgtatccagatagacgttgacctttttctgtcgtggtagatcagatgcaatcagggatgaattgatggacatttggacaaaagtagcatggagatggatactagttcttggacggaagaatcagattctcttcccttttgcagtggaggctatggcctacttcttacctgtccaactccgatccaatccaatccaggcgagaacgttgctaaacaccggctgctgcgtcctggattagagagcaaagagaagggtaaatgtataagaaaaaaagggggctgatgagaatcaaagcttccatctgaactgaactgaagggtgagaggttgaggaaagaagaagaagaagctcaatttcggcccattaacatcggcccaaattgttagaagatgtgggctgcaagcatatattgatacatgcattataattatactcagaattcaacagaacacacttaacaatattttcttgaaagacttaacagtaattctacaatctagatacggtgattaaatgtttgaaacataactcaggatgacagagaacaacacgctaatagattatagtccctacacttaacaatattttcgtgaaaagaagcatatatgtgtcctttgtgttacaaaattctgaatacgttttccaactagaaaaaatgattaaaaatcacagaaatgcagtgcagtacctagtatagcatcctacactatagccttgctccctcatgatattggacaggaatgcagcagttgaacatttccccttggtcccagcaatatgaatagcctacaatcacattcattcagttttgtccaaatattaatcacattttctccattcaaagtaaaatcatgactcatatgcaagatggcagctgcctaatacttgaaagaaacaaatgtcaatgtgccatgcaccagaaaaatcatatatgtttccttccttatgattttaataggcagtttcaaggcaagttgtgagcctctggtgttaaggagagggtgaggtctcagtcactgggagtgtggagttcacaaaggcggccgaggtgatgcatgcggccaaggtcgaagccattgtcagagttggtcccggtgctgtgtggcactccagagcaatccatgtactcagagaaatccctgagatggacatcctcgaagttctattgataaagcaggaagaccagcggagtgagatagcgaagcggaggagcatacaatgaggtcgtactgccgtcgcactggcaacggcagaatttgacggagggagtggagataccaccatgtcgctggagagtagtggcagagcttggaatttttcgttgggtgtgcctacttcacacaccaaacttttataacaacacaaaccacatatatatacatgtacagatttccccttttgttaaatgtgtaatgcaaatatgcgacaatatctcacagcattgctaatcgactaaaatcacgagaaaaaaagtacaatacagatagttccaatgtaaacgatcttacataaatagaagattacagtgctgctactttgcgtgttctcttagccttgaaagtttgtagtactgtcttcctcactactatggagaaataaaaatctagcttaacaaatgagactaaacaatcattcaataattttccacacatgctgtttcacaaattgttattcacaaatcacaggatagattctctatttggattaactacatcactgatcgcgacaatttcaatcacaaagttaaaaccatactgaggaaaaaaaaacagtacaaaatgagctaaagaattacctgtcgtcggcgaatggctaaatgcctaaaatcagtcccggtcagtcactcagccggtggtagcggcgggcggtggccggccggcggggggcctccggcccgagaggatgaggatggggcggggcgactgagcgactcgagatgcgagggcggccatatgcggcggacttggcggaggcggaggaagatggccgcggcaacggcagaggctgccatggaggatttccaagccacgaaggcgtcggcggacggcggaggctgctcggcgtggaagcggcggcgctgggctcctctctacggcggcgtctgaattgatcctctccgtctgatctgtatgtgtgcaggggtaaatccgtccactcaattggggatggaaaataaaactagaaaaaaaaaagagaatggcgttaaataaacaattcttattctccgtgcaaaatgctaaaaatcatttaaattgattggcaactctttggaggctttgcacgatactttgttcgttccaaaatatagccatctttaggtctaatagagattaaggttgaaaacagatattgccgttcggttaaattatttattaaattttgaattatttatgatctgttttcaagcttttgattgattgaaaatggtttggacttttgtacattagaaatagtttcctaaaaaaaattgtgatacgaaatttaaattataaaattatgttttggaatggagttgtaagggataccttgcggtacactttctgctccttaattttatcccttctctaattttctggttttctcatctaagatccacgccaaaagccaataacggatgtaatggagctggaaagaaaacgcctctttctgagtcagctgccagcattttttttctgaaaatgagcgatatatataaccgaaacaaccatcttgtttggaacgtcatctttttccgagatcttagaacacggaatcaaaacaagcatgatattttctcaaaaagaaaataaaacaatcatgctatctactcaggaaattcctggattgcagccacaaaaccagcggtatctctgtgtttagttcgctaaaattagaagtttgattgaaattgaaacgatgtgacgaaaaagttataattttatgtgtaggaaagttttgatataatgaaaaagttaaaagttacaaaagaactaaatgcccagctccagatacctgtcgcaaccagggttcaccttaccgttttggggggggttaccgaccccccgcggtatggtggttaccgcggtaaccgtgcggttaccgcgaaaaaccgcacaaatttcgtttccaaatttttgaattcaaaatccacggtatggacacggtaaccgcacggtttagtacggtaaccgcggtaagaggacggtaaccgcgatatgttggaactgaaataaaaaaaatgaaaaaaataatagaaaaaaactaaaatgtgagtattttagtttatgttggaactgaaataagaaaaatgaaaaaaataatagaaaaaaactaaaatgtgagtattttagttaattaagatgtggttatacaacagaaaaattcggcatgacctactctatattgtagagtccacagtataatgtccatgattacaattctagttcgaatgaaaggaaataaacaaggacatgcatagctacgcattccactgattatatgccatattgtactcctctgtggacatgagcatcaagccatgtgaatgtagcaaccccgccttgtattccttccaactttgacctgtccatgatgatgttgtttgccactgagcgtacaattgagcataccactgaggctcttgccattcatacacccatgtagtagcaggataatcagaagcttggggacggttgtacacatacgttggatagccactttcaaagctagaggcactgaatgagctagagctatcctgttgtatgtcactgaattgttgctgttgtcggactcccggtgcaatggtagttcgttgagagcttggagcaccatgatcctggtcctgagtagcatgagtgaagtcgccctcacctgcaaatcaaaaaattgcaagaaaattatccagtactgaattggaagatgaaggttgaaattgcaactgaattatatcacaccagtgaattgaacggggctgtggtgatctgattgttgggtgtgacccctaggaggcacattagtagtgccttggcctccttgaccatcgtcgtcgccgtcatctgtttcagttcttgagctactatcattggactcttggtactctgggctttcttgggtctcttcatcgctatcaacactagtcgatcgtggacccttgccctttacctttttagatggacgtgcttttggcggctttcgagtcttccttttcccaatatgagtgtcacctacattcgtatcagcccactcagcaatactagaagctcccgtggtccttcgcaggtcatccaagttgactaggtcagacacaagttgactaggcaggggagcgtcactctcagctgaatcttcatctagttcggggcaagcattagagcgagcattgtccatccaggcactgatatgattgttagtttcatagaatgagaggtccgctaatctttgaaggggatcatcgtcctccaccctaatttgggcatttgcttgctgaattcgaaggcgaaggttgtagttcacgtacactagcttgttgagcttcttgtgggtaagtctattacggaccttcgtatgtacgaatgcgaatgtgctccaattcctttcacatccactggaggagcaacattgaccaaccaaacgcaacgcaagcttcttcaaattcggcgtgtctgaggcgaacatagaccaccattgtgctacaaaagccaagtaacatgtcatttcataattctgaatacatcaagatcaattagatatatcatagttccatgattagaaacataccaggtgaagttttcccatctatggccatccttcttgctagtgccctcccaaattcacccgtcttacgtcggtacatctcaacctccagcaaagcggcggcagccgtatcgatatccgtcatccactcgaatgcctgtcggaggtcttggaagacagtagcacttggagaatacgcgtagtgcgtcctagggttcaatgcggcagctacaaaacatggcacaggttaagtaagagttacataatatgccatgtggattatgttatgaccaatatttaccggcattgatgagagtctcgttggttaggtcgtgcatccttctgttcacgatttccatgtatgcttcaaacttgtccctttgattcgcaaaaagactgtcgtactccattttgagcaactgatatctcaaaagtacctcactcaaattggggttcttgtcctcgtcagcaaaccgaaggaatgagtacataggttggacaaaattcactactgcctctaagttctcccaccaagacagactagatagacatgcatgtgcatatctaccttccaaagtcccactaaatttgctttgcatgaagacagaggaagccatccattgcatgaaaagatctcgcttcctaaggaaactctggagaaacatgtagtttgttccgaaccttgtagcattccacttaaccagttcaccacctatagctaagaccatcatagcatgcaacttgttatgattgtatagccatctgcaaattttcctagcactctcaatcaccatttcgtggtctggcattttcccaacctccttaagcatcaagttaactgtgtgtgccacacaaggttgccacacaattgtcttgtattcttgccgtagtagtctgcacgccttcttgtagttagagccattgtcagtgataatttgaacaacatgctccgagcctatttcgcgtaccaccttccttatctcctgcattggtagataacataataaaaattagtccatgcccctaacactgacgataacaggtgatgaagtaatttgttgcatgaaccatacataccttcagcacaaagttagcatcctggctttgcccggtcgcatcaatggacttgtggaaaaacattattccattgtagtatatcagaaaattgatgaccgacatactcgtcggacctgtccaagaatcacacattatagtaacaccgtactcatcccaatccttcttgaacctatcaaattgcttcttcacatccttctctttagaatcaagatattttccatctatctcgttaccagttggagaaggtacactttcacctacaattgacgtatgaaataagtagtgcgcaatgagttagaaaaaaagaagttccttaatagatgcatatgtaccccacttttgtgtctcccgaacggcgctcacaaagtatggattatcggcgtttctaccaggaatgccggcggtaaagaagaaccttgcccatgactcaccaatggcttgcctagcttgcttccccttctttgtgaagaatcctatgtcaatgcgtggctgcacaggggccttggcagatgctaggttgtaatctctcacagcaggtgactccctatgagacgtagcccttcgtagcatattggtaattgggttacttctacctttccgtgcctccggctgagcggatccactcccaccgccatgctcataagtgccaccacgctcctcaacatccctcctaaagttttcgtcttgtcgtgaggctgcaatggctgcttccatttgttcctcctcgtcggcatcacctgttaggtcataatagttgacccttactgcttcaacccttcttccgctatcactcttacgctggtcacctgcatcttttatcctgtccaactcacggcagaagaactcacggacatccggaggcactgaattgcaatatgtaacccccttccctcttgcagccaagtgttgctttagtcttgttgccccaccaccgcccctctttgtatggcaatacttacaacgccatccaggtgggatattctccccgtgctcccacacagggtccctactatctgacatctccaccctgtatcaaatgcatgagaaattatcactgctaattataaacatacctcccattatacaataatacgacgtaattatatgtacactggtaagcatgcatccaaattcttccatactatgacgtatttaatttaacctatatgtacatagaccaaagcaatcaaatatacttcacatgcatggttttagccaagcacgggcaaccaaatgccgaaataaactcatattcccaatgtatttcacatgcatattggtaaaaatatgttctattgacctaaatccccaaatatgtccatgcatatcacagtaaaaaataccataccacggttcaagccacggtaaccacggtagggtggacggttaccacggttttcacacgattaccgcacatacgtatatcgtctcatagattacgaagccgacggtaaccgtacaaaaccgcacggttaccgctcctaaccgcgcgaaaaccttcaaaacggagggattacctcttgcccgtcgacccaggcggttaccatctcgtaccgcgcggttacccgccgcttaccgcgagggaaccggcctcgccggcgtggaggcggcggatcttggcgcgggcgcacgccgtcgccccttcggtcctgagcgcagctacgcgagagaggggaaaaacggtaggattcgccagagaaacgaagcagaggcttccaaagatattttcctcccattgtgggccttattgggcctcgtgaacagtgcatacttggcccattccatttaatcttttttcttttttataatt

SEQ ID NO: 11013 - DNA, 729 bp, Oryza sativa
catcaacataataattattttaaaaataaatttattttgggataaataggaaaatgaacaatacagatagctaggagagatgcacctaatagtgtagtagtaaggggtgtttggttttttcaatctccaatacgcttaaaattttttctcaaaatatattttgaggctcataattttttcttaaaaaatatttggaggtacgtctttccttctaaatctcttcttttttcttcttttttttcttttcttcttaaaatattttgaggctcataattttttcttaaaaaatatttgaaggcacgtctttccttctaaatctcttcttttttcaatgatgcggaggctcgtaatttcttcttaaaaaatatttggaggtacgtctttaatttcctagctttttttttttttttttacggagagagtagtactagtactacgcgcgtcctccctctggggttgcaacgcgaccgcgaaatctttggttggttccaacgagaaaatgggtcgattttctgtgggatttcgacggcggcggccggcgaggcgatatgcaggatgctcaagccgcggtcaaacagcgggagactttactcgcgtcggcacttggcagtagtggcaggcaggcagccgcagctagattccgctagcctcgccgtcgccgtcgccgcggctcgtctcgtgccacaatacatgcagcacagtgcacgcgcacgcacacactggcattgg

SEQ ID NO: 11014 - DNA, 616 bp, Oryza sativa
  unsure (1)..(616): unsure at all n locations
cagatatgtggaattttttttttagtgccaacacataatctttaatacagtacatatgtgccagaaacttgtatagtatcttcatcaaatatgtaaatgcaaatgattaaggtgtgagctattcttgagacagattccatgctaaagaatatccagcatttgataaggaattgttcccttacagtttgggattttgtcaggcaggtatgattttagtcagatgcatgggaagtcttaatctgacttttttttcaccgattggattttattaaaccgtttattttctctatgacaggatctaatgtagtgtacgatgattctatgaatttacgcaacatcctttggttagcaccattccatctaatgaaacaaaagcttggctatcaccaggtatgctgcccctgagtacttaacactgttcacatttcttcattgtctccaagattgtttaggttctgaattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11015 - DNA, 1244 bp, Oryza sativa
  unsure (1)..(1244): unsure at all n locations
caacagaaatatcaatatatcaaatggagcatcaaacatgcaatctgacagaaacattcgacaagctgcatgcctgcaggtcgactctatctgtgccccctcggcataccgcttcttggcgaacctcttacccttagcaccaagcaactgccacagaacaaacgcgcgcgcatcagcaacagaaacgcaccaaaaaaaattgaacagaagaggggggggggggaatataaacagtctctcacctgccgggcatccctggatcgcttgtgcacctcgcgcgccgcccgcttgcgcttgcgctcctcgtagtccaggcgccggccatggcgcttctggtgaagctctatgtgatctccctgcggctgcagccaactcgtccaggagaaaactcaaaaaaaataaaaaaaaaaaaagcgagaacgacgaggaaacggaaagactcgcgggtgctgagatgatcagcggtgaatcccgggaggaactgggcacgcagtgaggtcaggttggaggcggcggcggggagaaagcgagggggacttaccatggcggcggcgaaaccctagcgggagctcgagctttgggtgggggaggaggaaaggaggaaaaaagaggcctcgcttcgggatttataagctctcttgggcctcctgagtgttagcccatgagagctatatgggcctcaccaatgatgtcttgggctttgcaggtagtaccgctatgtgaggtgggctaagttcacattgtctcccttagctagtgtgcgaatttgattcataatttcatctccttcaaccacaatacctgatatgtttaactccccaagtattaaaaccggtgcaatttaactccctcgatggttttggaaagctatttgctgacgtggcggtgttaacctggtctttgttccacgtgatgtcgacgtggcgcttacgtggtattagaattaaaaaaaatatgtggaacccattttcacgcaaaaaatattgtggggttcatgggttaaaccttttacacaaaacgatgataaaagtgtaaaaagtgtaaatggagtgatgcatgttagtgagtccgcccgtcgaatggattggttgcacggttccagaggggggctgttacagacctgtttgggagagcttctaactgcagcagcttctctcggaatcagaatctcctcaaacattctagcctttggtccagtttctaagannnnnnnnnnnnnnnnnnnnnnnnnnnnnnnnnnnnnn

SEQ ID NO: 11016 - DNA, 1955 bp, Oryza sativa
  unsure (1)..(1955): unsure at all n locations
gaaactcgcacgtcgacgacggccggcgcctccgctgaaacagaatgctgctgcacgcccgcgtcaccgtgaaccacgcccctcctgctcatgcaccggcggcagcgtctcgttgcctctcgccgctgctccatttgtacccttcccacttgccgaatgcaagcttctgcatgcaatcacaatgttaacgacacacatgcccgatcaagaaaacacgagaaatagttgtggatagagtgcagatttgtatccgtttgttagggttgggttttgggtgatcctaactattgtccctttgttggtctagcggcggtcggtccagtgcgctttctcctagtaggattgtgtgttggagttgtcaatgcttgggtggggttatttttttcttcgttttcctggttacgaccttccaaggttgtaatcttgtattttttttctactctatcaatataaacttcgcactgtctcgtgtgaatcattaaaaaaaagactcggaagaccatatggttaaacacctatcagatcgcagtagggccgatcagacatgtactgtggtctgaccggcctttgttaaaaggctctgaatttgataattttgagctaaatcaaaactaatgtcaaatttgatcgtcaaatgtccaagtacttttttgtttttgataaagcggcatagatatgataagaatttcgagatcttaaggtttgataatatttaaacaaattagatacatggaaatcatatgcatatgtagattgtaagatcgaagaaaaaaaaacatatcaaaaactgtgtgctagccgtgatgatcatgtgcatataaataccttcttgagtatgttcaggacgatcttgccgcggaggtccatgaggtagacattgtcgctgcagctggagccgtagttgtcgacgcggtagacgatgccgccggtggagtcgtagacggtgcagccgcggccgttgagcaccagcgacttcatccacagcgtgaacaccttcctctgctcgctcgtcgtcgacggcggcggcggcgacggcggtggcggaggaaaagaggagtagacccttgccatgaatttaattacctctgccgaattgtatgtttggaagatgatgatttgaggaggaagacgatggttagtttggtgatatagcatctagggcttggtttgtggctagtaatatacagggggaaaagtgaagaaagtgcaagcgtgaggtatattgatgctgacatactgttttatttgaacctttttggaggagggcaagtcatgatgatgttcttttatatggatacaaacaatcagctgttttaacatatttatgaattatgacaaacagctggagaaggcttttttttttttgaacaactcaccggagggaagagattcctcaactgaatttcattcaaaagtgcaatagtagaaagtacatatgagagattacaattttacataggcaaagtcgtttcaatttcaggttaatttgtatgctctaggcaaagtcacgttcgttcacaggacgtaatgtaatcttaacaaccatgtttgttgaaaatattttaccttctcttaatcctaataaaattggtcagggcacttcttcgccaccgagccggcaaagaagagatgagatcaataaagataatgcaaaacccactagcttacattctttgttcttgaaagccctaacgtggcactatacattcatttggtgcatacaagattaatttgagtgagtaagaaaatgtaagaactcataacttaattccttcttgcatgtaaccgtctgaaattctgaatctatctttcgccactaggttctgcaacatttcaatgattcagttgcagagttggtcaaggaagagaattattaataaattccacactgaacggggatccaaaatgnnnnnnnnnnnnnnnnnnnnnnnnnnnnnnnnnnnnnnnnnnnnnnn

SEQ ID NO: 11017 - DNA, 627 bp, Oryza sativa
  unsure (1)..(627): unsure at all n locations
nnnnnnnnnnnnnnnnnnnnnnnnnnnnnnnnnnnnnnnntagtaatgttaccatacatacagaaccgcgcatttttatacaacttctcacttgatacttaagaaatcggagtggccagcgttagaaagtgttgagcacaaattgttagagtactgatgacacttacagaatttcaagccttcctgtcccagaagcaaggaagaggtgttcgtggaagaaatcgtatcgacttagtgatacatttaaccccactgatggtcctcgtgccgcaatcaattcgaacaaaaacgccaggtatgaattgatgtactgttgataacacaaacatgtcacttgaacaatgcccaacctttgtaagtaaaaagaatttcaagtgcagcaaacagctagggcaaaaatctggaccttgttagcgaaaccgcctccatatggtgttcttgtgaggtggcatttgttcctcttcgccctctgaacatcaggcacctaacgaaattcccccggtagaattgtgtatggaaattaatttcaggattgtacgtaacacattcagaactatgcagagttagaaattttacaatttcttcgagatagatatagctacgagctacgaagaacgagataaacga

SEQ ID NO: 11018 - DNA, 644 bp, Oryza sativa
aaatggcattatgcatcctgcaagcttctggcattgccattaatttaccccagcgagtgcatcagctctggcaggttttgtcgtcgcaatcgcaaagatgagatgcacaagagccatgacatgagtagtagtggtagtggtactgctagtcgtaacacactttgaacacgagtagatctcgcttcaattcatacatttgctgttggtccagcagcctgagcttggagcagagcattcagtcattcacctgcgtttctccggaagaaagaaccatacactagagaacaaaatctacacacacccaggagagatgagatgagatggccattcaagatgcacagctctgctgcctggaacctccaattttccttcagtgctaaaataagctctttttcatccaatataaaacctaaaaagatcataatatcatcatttcatcgaatcccaatataattatttcttactttatatactctcggtacatttattccatattttcacatcaacataataattattttaaaaataaatttattttgggataaataggaaaatgaacaatacagatagctaggagagatgcacctaatagtgtagtagtaaggggtgtttggttttttcaatctccaatacgcttaaaattt

SEQ ID NO: 11019 - DNA, 736 bp, Oryza sativa
gttccctaagaatgaacgatttcaaacatgcacatgagcaggtaatgttactgccacttctttcctttttcaggaaaagaaaatgaggaaaagggaaaaacaaaaagagactcaggctactacaagatctgatgtctcaaaactcgcaatttctaataaacgtatcgatggttttcatttccatctcaaacattacgtataattgctgcctacagccctagtggtgtgtcaggagaaaagaaagaactcatatgttcatgtctacatggtcatcagatgttttgtagtctctaaattacttatataaaaatatgatgctaacataaactactttatgtataggtatgtgcaagtataacatctgattcgagaaatatgactgagcttattcagtggaacgatctatatggagaaggcgggtccaggaagaagacttctctaagctacttcatgtagcctatcgctagcctatgtacatacaacataagcattagcgtaaagcggtccgggagatagacaagaaatagctcttcttgtgtgtgtcatgtataggtgatacccagtcacaatagtcggtgatctctctattcatgtcaactgtaagttcgtaggcccgaagtgtagcgtaaaaaaaaccggtttgaaacttgaactatcaagctggaagcctgaccatcaaatcggttgattaatgtcgacagccagtgcaattcatttaatcaattgatgctcgtat

SEQ ID NO: 11020 - DNA, 1240 bp, Oryza sativa
cctctcccacctcccaagttaacagcatgctcccccgcctccaccctcagttcaaactcctccacctacaccccaatctgctctggtagaacaagtgcacatgccagatggtactacatccgaaccgaagtctaatcctttggaacctcgtcgtataattccaaagttgatatcgacatacgacccaaagaagattgacaaggataaggagaagttcatgttttcagctttcaggaattctgagaagagaaaagaatttgctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtctcggaaggcgctttcatgagtggtcctaatgggatattttttatctctttcccagacctttacgccctctacaagctagataaaatggatgttaatctcgttgtggcgttctgtctgtaagtctgaactctttattacatgttacacgtatcattccaaacaaataaaccaaatctcatttcttctttattcattgtacagtatgcaattccacgaagctgatagaactggagcaaaggttggatacgtcgatccaacaagaatatgcaaaacacgacacaccgtagagctgagagaggactgcgagcaattggttggcaagacccctgaagaaaaggaagaatatgtgaagacattgcacaagaggaagaagctagaagtagcaacatacttggcaatagcaatgttggcgcacgccgacaaagatgtcttaatggtcccgtaccagttcacgtaagctttctcttctttttgtttaattaatttatcttcttcggaattttctgtctccaataagcctatcttatatgcagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaatggttttctttaaacagagcacacaagtactacccgcaaaagaggtggacca

SEQ ID NO: 11021 - DNA, 555 bp, Oryza sativa
tttccctttaatttcgacaagctgtaatccatctatgaattccagagtccaaattgagcgccaattcccgttgctggatgactcaatacaaagttgtctccatcagtgaataaataatgaaatgtcaaactatgacgagaggacttaagcgactctagtaacagattatgtgaagcaaggattcagcccaaagcacaattctaaacttttctgcataaaaactaaagacaccataatattgtgggaagatgataaagagggtacccacaaaacacatgattagttcaaagggaaaataaagaattaaacactcacagatgtgcaacctatgatccagaagttgaatatgaaatagcttctcataggaatgccaaaattttctagaaacctcaataaggatctaaaatgtatagaagagatcacaaaatggcatataaacaagttcaagattagagaaactaggcaagtatctgtacaacagagaaaatgcagactcagacaacataccaaaagttttgtgggctgcgtttagcagcagaaataactgctgcaaac

SEQ ID NO: 11022 - DNA, 11811 bp, Oryza sativa
  unsure (1)..(11811): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaacttgcgtcagaaaaaaaaattgccaatgtcatcagggttcctgaacttactatctacctcaaagctcaaattgattagtagagataaaaaaaactcaccgaactctggacatacttcacaacgctcccggatgacggttctgaactgtcctgcgcagcctttgcagcgacgacattgcgactcctcatcctccctgcatacgagcacattagagcacatgatactcaatggctcgtttgcaaagaaacaacaatataaaaagaagtgcaagagaaggttgagattgattgggacccttggaggaaattaaaaagaaaaacacctgaaacaaatctggtgcttggcactgcaggcagcatggggagattcccggtgatgctctcgctgccgccgcgcggaacgagagccgcaggccgagcaacggcgagagcagaggccatcgcggttagcttcccccgagaatacggtggaattgcggaggtcgcgagcggtggatattgggaagaactactgcttggccttcgtctgctgcagcggatgcgagtggaaggctcctcgtccacgaaagcaccatcggttggcagatttgcagattgccccttgccttctgcagatattctgattaatttccattctacgagtattactgtaccgcctgcctgtccgggagaccggggaagttcacgctgggatacagcttcagatttcgctaggtttatagtgactgactagtgacacacagatgtttcagtttgtatcttttttggagtatattaaaaaactaaaccgtcacaacttttttagtaaaaacattcaaatgtgttgactttctttttaattgctcgaaccgaaggtcctgagctttgttttttgcttcacacttataaagtttactcctcctctattcaatgaaattggcagcttaccgattcgttaaaaaaatataactacaatataattaaagtataactacattgcaattgtattgtaaatacgatataacttataaaactcgtattcaacttatgatttgattagctaacgttgagattttacgcgtgatatgtgtgaacatttctttctattaaatccatttttttttcctttatttatactacgagcgctacgtaactggaatctgtacgataatgacaaaccagcactgctgcaagctcccctgtaactctgcataatactgtagaaactaaacgagcagtaaacaaacatcggattccttaacttacatcggggtcgtacaatcgacggcgagctttaaccaaaattctcgcggaagagagaatctgtctgtccgagaccacctgcgactgaggctgtgatccctgtggcaccggcaggacggcagtacacgcccccccgtgaccccgcccgcgcacaggcgcagcgtggcgccgtccaagcgttcgagtctcactcacctccaccacctctcgcgcccccacgttcctcggactagccgcggtgtcgcctctgtccagctcggttgcttcgctacgcgtcgctcgctgctgccaccgcgccccgcttgatagattcgagcacgcacgccgggttggcgctcggcgccgcgccgcgccacggagggtgtcacgagaccgcctggcgcgcacaggcgcagccccccgtgtcgtcttcctccctggttccttcttgtcaccgggacgggcgaacctctttcccgcgcgtctgcacatgccattttcagcttccatcatcaccatcactactattcactacttggcctagtagcgaccgagcagtgcccactccgttgctgcctgcctgcctgtccgtcctagctagcatcctacgctcgcgtgtagagagggtgaactggcgaagggctgagcagagagatggaggtagcagaggccggcgtcgacggcgtggcggggaggcggcagcaggaggaggcgtccggcgcggcgccgttcggcaggtcctcgtcgctcatcggcgccgcgggattcgacggcgcgctgagagttgagcacttgtttggcttcttgccttcttccccgatcgtgtctcccgtgtgcgttgtgtctctgaccttgaacatttgggctggtcttgtgatccgcaggagctcaaggaccttcgctcccagctgcaccagacggcggactgctgcgagaaggcgttcctcgacaccgagaagaagaagctgtcagtgcaaagcttcagctatcacatttaattatacacttctcccgccactgttttgtttctctcgtgcctaacatgtcctctcacttgccactgttttgcttgaagaattctggagagcacgaaaggttacatctgcgacgcgattgtagcggtgattgatcatttggggaccgtctcatccaagctcgagcaacagctgcaggagaagattgagatcacacaaacagagaaaaagctcaacttcttgaagcaggtcaggacatccgtcgactgaacctattttccgtgaatttcgcatgacaataagagtcagtgtagttacagaaaatagcactagtagctcgcaacatgactagtagcttgaaccatttcaatgatgaagaagtagttgaaagaaacagagtactcactgcttaaatgcttagtactttagtatgattaggtaacttagctcattatctaaaaaaggcaagtgaagatcctgtactccttcaactttttccgttctttgattcagggataacttttccgttccaatttcaagaagttagtgtaatagattttgaaagtgaacggttcatggttactgctgatgaacatcgatcaaacgacactttagtactgccacttattttaatttttagtctcttcatgttcatggtaccagaggctcctgacatgtgaacagtatgcaattactctcaaactattgaccgtacgtggggacaatgatgccattcagtatcatcgccgttacctctcgcaatgtaaattctctaactcatttgattttgtgttgtcgccattacttcttataaaaaaaagggttgctgatatgtggtcatttggacagcttcaactctgttatcattgactaactatattattcactacagctactggaggaaccaaagaggaaaatggtgctaactccaggtttatgccaactaaaattttcctttgatcattttactattatagcatgtgacctgcatcatatcgatttataacattagtagttctgcacacaggaaagatgatgtaaaatttgtggagtacaacagcccaaccatacctggagcaattcttactttcaagccatatgatattcagtcaaccattggtaaattcggtatcttgctcatgttatgaagatatgtatgcttattattgttttcagtgtatgatatacatttctcattgattagtactccttactatcttcaatttaagaactaggaagtagtaactatgtaaatctgtttttttttacaagtaactatgtaaatcttagaagaaatgttatatgaaattctgatatgtttctgatgagatcataattgtctagtttccttgtgttatgaacttgaagaaaattgtgaagatccctaatcaacatgtattacgtaatgacacaaactaactgatagaggaatctgtacatttttttctcctaagtgtgtatgttttatgcatggaatagatttgtcatcaaccttctatagactatagtttaccacagttatagttttgttttccgtataataatagcatttgcatgttatcccgagttatgtgttaagctttctctcttgatatttgtggtagattgactgtttgtttattttcatgatgttgtttgtctttagggagagaacgttcggtggcaactacagactctgaaagcccaacaacggatgcaaagagttcattctctttcagagcagaggtattctctttaagagcaaagagctccttttttttttcaaattaaaaaatatgtttttaaacattatttactttaccaaatcaaaacgctggcgaatagtttcatactagccagttagcgtgctaccctttttgtgacaatttagcataacaagatgcccgtttgcaggacgttcccattgttctagctgaacacaggaagaaggcaaatcatggcagcaatatcttgtcatttatcaggaaaggtagacggcatgcgtaagagccaaaagcgccaccggaatagctcgagactggatatatgcacgcatactttaatgaattcagtattgattggcaacaatgtacaacctaatatcactgaatccccaatttctgtcaaaccagtgtccattgaccatcatgtatgtttagctttgcatttgtgccagcagtaaattcggcccgatcatcctgaacatgtaacaaacttgaaggatcgagcagtaatatctgcttggaaagctagtttttcttcccctctacaaactctcaatatcatgtaacaaactttaatctgtctccttattatcaatgacaaagattcaggtgaggaatctctcccctccgatgacttcgtaaaaaggaaacctgaacacgaattcagcaaattctgcatcatcaaggaaaaatacatgtacgttcagtacttcagggcatcttttcctttgtgcttgagaaatcaactcccgaatcccgatatatcatatatatacatgcagtaattctcataacggtgtgaatcaactctcgtactgtactgtggcgtgctactactagtagtagtataaaggaatttcgctttttacgcgacattcttgagggtagctggcccatcataggactaattaaaagcactcgcataactactaattaagtagtaagctcctgccacaagctatgccaattcgatgagcccgctcaacatcatatcgatcgaccggctcacgcatttcattcaagaagcaccgtccggttgcatgaacgccccgcgccgcgcgtacgtagataactaccattcaaatccctaactgcctgtctgccatttctctccatctcggtctgtaaaatgccatgtatctagtaccagtagaacagttgtactacctcctgatggtctcacgtaacttctttgttccctttctcttcaattacgccattgccgtcttgcccggtcgatcaaccctagctttctaagccctacaaaagacagcatccatctgctagtgttagcttagccttcagagttcagagagagatggggaccaaccggccgcggccacgaaccaaggacttcttcgcagctccggcgctctccctcacactggttcgtcacatcgttctatcgacggcccgatctttatgtagatcattttgtctgaaattttcacctaatcacctgtgtgcttgtttgtgtttatgtacgtgcgtaggcaggcgtgttcggccggaaaaatggacctgcggcgtcgggtggagacggggtggaggaaggcgacgaggaggtgcaagctgcaggcgaggcggcggtggagatcagcagcgagaacgcggggccggggtgtagacagtcccagtccggcggtggctccggggaagacggcggccatgacgacgacgacggagagggtagtaataagaagaggaggaggaagaactaccacaggcacaccgccgaacaaatcaggatcatggaagcgtgagaatttcctccatttctgttgcgtgaatatcagcgtcaggtgtttcctgtcccctgggccgcgggtgaaaggggtgcttcaccaggcccatggatcagatagggccaggcccagaaaggatgaacttgcatgagagggagatttttttagtttaagcaagcgttccagtagttcctcaatgatctgacatgaaaatatttttcaaaatggaattttgttctgaatcggttgaatgagcaggctattcaaagagtccccacatccggatgagaggcagcggcagcaggtcagtaagcagctcggcctctctgcacgccaggtcaagttctggtttcagaaccgacgaactcagatcaaggttaattactagcgctcagtcttaactataccagtgtgctcgtcccaccgatcaacagcaaacagcaaatgaatcatgaatgcatggggattttgatctgtgcaggcggttcaggagcgacacgagaactcgctgctcaagtccgagctggagaagctccaggacgagcaccgcgcgatgagagagctcgccaagaagccatctcgctgcctaaactgcggcgtcgtggcaacctccagcgacgccgccgccgccgccacggcggcggacacccgtgaacagcggctgcgactcgagaaagccaagctcaaagctgaggtttgtatgccgccgccgcgaagccgcgcccgtcctttccggtgcgctacactgcaagacactgactccggcgaactggcgatgttgaacttgtttcagatagagaggctgcgagggacgccaggaaagtccgccgccgatggaatcgcctcgccgccgtgctccgcgtccgcgggcgccatgcagacgaacagcaggagcccgccgttgcacgaccacgacggcggcttcttacgccacgacgacgacaagccgaggatcttggagctggccacccgtgcgctggacgagctggttgggatgtgctcctccggcgagcctgtgtgggtgcggggcgtcgagaccggcagggacattctgaactacgacgagtacgtgcgcttgttccgccgcgaccacggtggttccggcgatcagatggccggctggacggttgaggcttccagggaatgtggactagtttaccttgacacgatgcatcttgtgcacactttcatggacgtggtatgtgcatggcgatatgccgatattgtgaacacacggacactagctcatacatgcatacaccttgcatgatttttttttttgtgcaggacaagtggaaggacctattccctaccatgatctcaaaggcagcgacgctggaaatgatcagcaaccgcgaagacgatggccgagacggcgtcctgcaactggtgacccgtcttgtgtctctctgcttctgaccgacgaaattcatagtgctaaacgtgtcataccttgctcgatatggtttccagatgtatgcagagcttcagacactgacaccaatggtgcccacgagggagttatacttcgcccgctactgcaagaagctggccgcggagagatgggcgatcgtcgacgtgtccttcgacgagtctgagactggcgtccacgcgtcgtcggcggtcaggtgctggaagaacccatccggctgcctcatcgaagagcagaacaacggccggtgcaaggtatatacgtagaacacagtatggttcaagctggcgtacggccgtttcaactttcaaccaaatctctgcaccgtggtttgactagatgacctgggtggagcacaccagatgccgccggtgcacggtcgcgccgttgtaccgggcggtcaccgcgagcggcgtggcgttcggcgcgagacgctgggtggccgcgctccagctccagtgcgagaggatggtcttcgccgtggcgaccaacgttccaacgagggactcgaccggtaaaaccattactgacacgtcgcatgcagcgccgcgtgatccatcatcatccatggccgtctcacggatctctcccgtacacaggggtctccacgctcgcgggcaggaggagcgttctgaaactggcgcaccggatgacgtcgagcctctgccgcaccaccggtggatcgtgtgacatggcgtggcgcagggcgccgaaaggaggcagcggcggcggtggcgacgacgacatctggctgacgtcccgggagaacgccggcgacgaccctggcgagccgcaggggctgatcgcgtgcgccgcggcgtcgacgtggctgccggtgaatccgacggctctcctcgacttactgagggatgaatcacggcgaccagaggtgagccgccgctgcgcgcatttcaacttaccctgcatgcacattatgcacactctgactcactaatcaaattgttgtagtgggacgtgatgctacccggaaaatctgttcagagccgcgtgaatcttgcaaaggggaaggaccgtaccaactgcgtcaccgcctacgtaagctaaccttccctggcagctacatgtgcatctcgtcgacacgtacattattgctttccttcggatggatgaactgcaggccgctcgaccggaagaagaagaagagagaggcggcaagtgggtcctccaggacgtctgcaccaacccctgcgagtcgacgatcgcgtacgcggcgatcgacgccgccgcgctgcagccggtcatcgccgggcacgactcgagcggcgtgcacctcctgccgtgcggattcatctcggtgatgccggacgggctcgagtccaagccggcggtgatcacggcgtcgaggaggggaggcgaggcttcgggggccggatcgctggttaccgtggcgttccaggtcccggccagcccgtcggcggcggcggccacgctctcgccggactcggtggaggccgtgacggtcctggtctcctccactctgcgtaacatcaggaaagccttggggtgcgactcgtgcgaggaggaattctagtccacgggacgcggaaatattctactcctacttcggattcgttattcgtatgatactccacgactccacgtgaccatgtttgcaaagtaaatttgcatcgtgacttaccatgaacataagtgtacagctaaagggatactcgtactatagaactacacggtactgtaaagtcaacaattaagcgttaaaaatcccccgtcttgcagacttctttatggtcaccgcaactagcagagagccgtgccatgggcggtttcttggaactcgatcatatccgttgcaatggaacgcaacaaaacgtaaagaccagcccaagacgtaatgatatcacgtctccacaccgatgacgttgggccgctgcgtcggtgagcccgtatcatcttctacaaatccgaccaccgcgtcgctcctgctcggcacgtcgtcgccgccgcttcccaaatcccttctccctctcaacaattttgcgtgcagcgctggtagcaacagtgcacaactaggctggtcaaaggtgtgcacggtggtgaagacaggatttagtgatagggggtgctggctacgagatgtaagaactcaccagctcctcggtaaacctctcggtagacaatggtgtggatcttgatggctcagttcatgctgagtagcagattggcctcacctcacctcttgttcgctctaatatgcgtagtcgccaaaagaatcattttttaaaattaggcaactaaatagcaccaattttacaaaatacatgaatgacaagacatcatttctattcatcctttttagttttggagacttgcaaccacatcgcttagttacgttaactcaggtaatcacgtaaagctaaaatctattggtcagttatgtataggctcaacttgcaactaactaatgagttaattgtatggattagatgcctaatcacccggggggtttgcagtgcatggggatgggggtgtcaggcccaccccggcacccccggtggcttcgccactgggtgtgcacacgaaaataaaaactcaaacacaataaaaattcgtctaaaagcaggataaaaagagataaaaaaagagagagaaaagcaacggactgcagaactatagccagctgcagcatgaactccaatacgtaatgtgcgtatgacaggtgggaccaggtatctatctattatataattaaaggaatagaaaaaggagcatccacgttcgctttcatggtctagaaattctcttattaatcggagaaaaagaaaaggcagagtccatatagaaatacaatttgaaaatagttgaaatttggaattaaaaataaggaatattagaagatgagactagagtctatatagaaatacaatttagaaatagttgaaattcggaattgaaaaataaggaatattagaagaggagactagagtccatatagaaatacaattaggaaataactgaaattcggaattaaaaataaggaatattaaaagtagagtatagattccatatagaaatacgattaggaaataactgaaatttgaaattaaaaataaggaacattagaagaagtagagtatagagtctatatagaaatataactagtaaataatagaaattcggaattaaaaataaggaatattagaagtagagtatagagtccgtatagaagtacaattaggaaataacagaaatttggaattaaaaataatgaatattagaagtagagtatagagtccatataggaatacaattaagaaaataatagaaattcggaattaaaaaaataaggaatattagaagtagagtatagagtccatataggaatttaaaactaactaaaattcggaaaaaaaagaggcctccacgttcgctctcctggcctagaaattctcatattaatcggagaaaaaaaagcagagtccatatagaaatacaatttagaaataactgaaattcggaattaaaaaataaggaatattagaagaggagactagagtagttattacacattagtagtttcgtaaagttattgcaaaatttaaaattatgttgtcattgtaatatattttaataatataatgagaaaacatatatactattatatgagagaaaatataatgatgctagccgcgcaatctgcgctggccaccatgcttgttaatagtatagtaagcaactattgtatgaattgactattatattggctatggatgatttgtagttagtagttggctatactattaaacttgctctaaatgaagttctccaatttgtgtgtttagttcacgtcaaaattagaaatttggttgaaattggaacgatgtgacggaaaaattggaagtttatgtgtgtagaaaagttttgatgtgatggaaaagttggaagtttggctgtatttattccacaccataattgaaagtttgaataaattaaaacgatgggataaaaaaattggaagtttatgtgtgtagaaaaatttaatatgacggaaaagttaaaaatttatagaacaagattggaatctaaacagaacctttgtttaaagagtttggaaataaactcggcctttgtcgcaaaatttcgggccttacctcgtggaggcgtggagctggcccttgccgccacggtacgctttccctgacggatcgggccaagctgcctatataaaaagtcgtcgtgccacactgccacgggccacggcaccaccatcgaacaaagaatagcgcgcacgcattcgcctcgacgccgcatactcgcgtccacgagccccgcgagaaacagctatccacgtcatccgcggcggccgcccgccgttttcccttttccaggcgcgactcggcggccgcacccggttgcgcacgccgctcccccccc

SEQ ID NO: 11023 - DNA, 30225 bp, Oryza sativa
tccgctaacgtgcgcggggcgcagcctagcgccgaccgcaggttaagtacgctggtgcgccacgtactgccttcctccgcacgaacagcaaccaccaccagcacctcctcatccgccgccgacgccgactcctccctccaagctttccccaccatggcgtcgtcgtccgtcttcgctggcctcgcgcaggcgccgaaggaccccatcctcggggtaagatccccctctcgtctcccaatctcactcccgctccccatcgctgtcttcaccggtttcggccgtgatcgcgcggttttttgggttcgctcgacctgatcggtgctcccgttggtgttgtggtaggtgacggtcgcgtacaacaaggatcccagccccgtgaaggtcaatctcggcgtcggcgcctaccggaccgaggtaaggtgttttgggggaatttctattgattttttgctccttcgtattttggattggattggtggtggatttgacttcgattttgtggtctgatcggagtaggaagggaagcccctggtgctgaatgtggtcaggcgcgctgagcagatgctgatcaacaacccgtaagtctgatttgaaaaccagatgatccgcatgatttcggacctgggaattttttttaggctggctgagtgtacagattccgtgttcaacttgcctctagatctaacctgtagataatacggtatactccacctagcttgcaggttatgtactttttttgcgaacgcttgcaggttatgtactaataatatattagtatttggcaccattcttgctttgaatcgtccggctgacttattttattctacgaaaataattgttgacctttggtcttttagtgacctttcctgctctacctacctgtttttataatatttcaggtcatttttttgctttgcttttgttatatactagcgtgtaggattgattgatgttgttgcagcgctgggtatccaactgggtttgccttatcagtgccacactgccactagtttgtttggcccattattaccacttagatatatatttttagtgaggggcacagtatgttaatttacgagtactgcaggtctgcagctttgtgtgtgtacacagtatacatttttttttatgtatagacaatttcttggatgggtttacaggaagaaaaaaccattgactattttttacagcaaacttatgatgatattcccagttgtattttacctgtgattatttgctttgactaggtcacgtgttaaggagtatttgccgatcactggactggccgatttcaataagctgagtgctaagcttatttttggtgctgacaggtgcgttcctgctctcaagaatatatatggtcatatggtttcctcatctgttacctttgaccaattgtaacaaacagtaaaattatctcactaagataacttcttcagatcctttgctacttttggcttattcttgtattaggtaattcacaaaactgattatactatttattggaacagtcctgccattcaagagaatagggtggctacagttcagtgcttgtcaggaactggttctttaagggtgggaggtgaatttcttgcaaggcattatcatgaagtaaggaatctgccttggctccttcatagatactgatatggttctacattacaatgcaaagtatgatcgctaaattataaacgtgttctccagcgcactatatacatcccacagccaacctgggggaatcaccccaaagtgttcactttagctggcctgactgttaggagttaccgctactatgatcctgcaacccgtggactggatttccaaggtaccaatttcaattttccatggaggaacttgttcttatgaagaagattaattgcaagattgtttgcacctgtctgacttgatcaaggatgtgttttcgtgttacagggctgttagaagatctcggttcagctccttcaggtgcaattgtactgcttcatgcttgtgcccacaaccctactggagtagacccaactttggaccagtgggaacagatcaggcagttgatgagatcaaaagcattgctgccattctttgatagcgcttatcaggtaaattattggcatccttaatacttatacttctagttcttaggaagcatgacattggttaatacttatacttctagttcttatacttaatacttatactaatttttctttctgtagccgtaaattccattggtttttgtccatacgacattttatttcaaaatagactttgacttcattattgtgcctgctatgctttatttgttcagggatttgcaagtggaagtcttgaccaagatgctcaatcagtgcgcatgtttgttgctgatggtggtgaattgctcatggctcagagctacgctaagaacatgggattgtatggagagcgtgtcggtgctttaagcatagtaagatatcttcactctaatatttgtcaagttcagctttgtggcttgcccatactttgttcgtagtcttgaccgaggttgctgtcatcttcatgctgttcatagtagcaactgatgtacctgtcatgcatggaaatttgtgtgtctattttatttcatctcacactggctattttactactagtaagagatataatcactatgagccatgatggctacaattcaagtattataattgtttttttgtcttgtctccaaaaaatattggagatgtttaatgaggttgagagtctttcaaggtgggaagttctaaacgaaagtaggacagtgaatttttattctttccagctccaaatatctctttcaattttgtcaatcacatgccaccgatgctttaattgttgaaattaaattttgattctaagttgatgccgacccagataataatatcctatttagttgcatagaaaaactgaacggaatgtaactttgtatttcaggtttgtggaagtgctgatgtagctgtcagggttgaaagtcaacttaagcttgtaattaggcctatgtattcaaaccctcctattcatggtgcatctatcgtggctaccatacttaaggacaggtaacattgatgtcataataattctagtcaaccatagaaagtgagctatatgttgagaaaggcatgcctagaggcagattcagggaataaaagtgtgtgctaagttctttttgattatatttttactagtgcaatgttcaatgaatggactgtggagctgaagggcatggctgataggattattagcatgaggcaacagctttttgatgctctgaaaacgagaggtaatagtttctgtcaactcctctatatcgtccttgctggaagtacataactaatgctatgtacaaagaaatttgatcattggccttttagtctttacgtttatttcaagttctgttttgacagcaattttgactaattctgtttatgtttagtctttacgtttatttgatctggaggcgttatttcccttttttctgtgaatgctacaattgaattttgactaatgtttcttactgtcaaagcagtaatgttgttttaaactagattttctttggctatgagaaaattttatattctatttttttcgagttgattaatcaagctcctgagacaagttccctgaattccaaatagtgcactaaaccaatagtatatttttaaagcatttatatgattctacttggcttgcacttataaccttaatgatagaaggacattgttttacatggaaaagctgcaatgcgtatttggctcgttgatctgggttttatgattgctcaatatttttgttttaaaaaggagtttttcttccctttttctgaatccattctctatggctaaaagtgaggtacattgtcagaaatattaatcattgttgacatgataacatcatgcagaaactcctggagactggagtcacatcattaagcagatcggaatgttcactttcactgggctcaacagtgatcaagtggctttcatgaggcaggaataccacatttacatgacatctgatgggtaattgtctaatttagctattgtgcaacactcgcaattatgtttgtatgatctaagtctgcagttatacaaactatataatttttagttctataacagtagatgatctatcttactgtttctatggtagtttcctttgctaaatgttcctttttagctcatctttacaagccaaatatttctcttgcaggaggatcagtatggctggtttgagcgggaggaccattccgcatcttgcagatgcaatccatgccgcagtcacaaaactgaagtgaatgatggtagcatagcagctccctccaagaataacatcttaaaaccatccgcagcagtgttctgaggattcagacagtgatgtttgctggctgagcacatcctggaagtttccttgtaatagactcgtgtgacttgcttttgggagcagttttgtaccagtggattcagaaaaagtggtgatttcgaatcacctaataagctccatcggtgatgcttttaccatatgcagcgttatataatcttagaattctaggaagctagtgcttgttttatgcgaacaaatgcgtaccttccgttcccttccattggcggacagggtatacgacatacgctgatacagagcatcagtgccattcagatgcattttttttttcgcggagttggtcacatgtggatttggtggaacctggtctgtgatgcacaagtaactcagtattgattactcctatttaagtcgggttatgtagggcacgccatgttctgccctttaatatgaaatgaaacatgcgttttgccctatatcaatatacacagggcaaagctcttgcctttgtttaaaaaaaggggaaaaataaagaaagaatgagggggtgtttagtttcagggctgtaaagctgtaaagttttgacgtgtcacatttaggtattatataggatatcgaaaggggtgttcgggtactaataaaagaactgttttaacgtgtcacattaggtattatatagggtgtcgaatgtggtgttcgggtactaataaaagaactaattacaatatccgtcagtaaaccgtgagacgaatttattaagcctaattaatctatcattagcacatgtttacggtagcaccacattgtcaagtcatggagcgattaagcttaaaagatttatctcgcagagtagttgcaacctgttcaaacctttgatgtgacatggtgtaaaattttaaggtgagatctaaacaggccatgaatgaaacatgcgttttgctgtggccacacttccagtcttctataccataccgttcattgttgaagactctggatctttactattaagaggaaactaaagagctactcccttcgtcccataatataagatattttagagggatgtgacacatactaatgctataaatctggacagacgagtaataagctaccactttcgtttagagggcctgcaaaagtgcaaattacttcgttaaagaaaaagagagatgcacatgtccactcgcgacggcctagaaactacaatgttaataataaagaaaagttaaagaaccaaatcaccttcacttccacatccagaagttaatcgtcttgatcagatcatggtggctccatatatcatgtagattaatagatataattgtatataaaaatatttctagaaatgggttcaaatatataactaaaacaggttatataagtaaacatttttgcgaggatatatagcatgtactcaaacttcagttcaaacagccttacaattgcgtaggaaatttaactagttttagttttaaactctgatgaatctctacatatttttaaacccgagcgtcgcaacagaaattatagagtttctaacatattaaatcaattaataaccgaataagtctaagtaatactatggttttttcttattgaacaggtaggtgaatcaaaaatttggtggagccaatagtaaaataggggagtaatttttgaaatgtgggttaatattatagatttgtggagcccaaatgttagtggcaagggtggtgtgggaatggataccatagctactaaaacttttaactatatattgagcaaatgtggtagtcctaacttttaatcaatatatctattatcccctactctatggctgataaaccacaaaaaatattgaagaaaacaacaaaataaattattagtaaaactgaacaaacttgtcttaggaatcttcctagataaaattcaaaccgaagaaatacccagagtaagacaaagccaagtttcgaggaacttttaacagctggagaggtactcccagaatctctagctctaaaggttgcgttcgaatgtggtgttggttagctatatgtgaaatgaggcaaatcatcattatcgcatgagtaattaaatattataaacttgaaaaataatttgtttttataagaatatatatagaaaacttttatagaaaaaatatattgtttagcagtttgagaatgcatgctccaaaaaaagaacgatgaagtagctaagtcaagtatttgattcaaatgaagcctaagtatctacttatagaaacttagtacccacaaactgaatagactctcaccatatacccagtgccgtcaggaggatgttgaattggggtatatttgttcaactctatgctgattaattttttcttgttctgtccctattaactcataaataaatgagttcctcttgaaaatatgtccccttaaaatgagtggatactagcaaatgtttgttccaactttttatggcgtgatttgattaatagcggaaagagattccacattccagcatattttaaatttttttatcggatccctggaaaaggttcccggcccaataccaacccgtttacactcctaagtcctactaagtcctaataaccgagtggtttcagatctcgtttacatggaaagttggttcctcctccagccaccagctcgatcctttcttcctcgttctcgcgatctgacctccccatctctcctcactcgatttcccggcggctagcgacgcgggaggaggcgcccggccggccggcgagcacgtgctgatagcggccgaggaggcgttgcggctggacgaagagcgccgcgtgcagcgaagcggcagtccggcgagcaggaggtggatctggacggcgtcgtcttcgcctgagccagcctcaccacgcgtcggcctcccgaggcggggagttcatccgcgcgaacggccccggtagcggggcgaggcgttccgaatctggcggcatcctcggaggcacacggcaacatctcggtctgcttgttcttcacgctgcgccacaagctcaactgcaatggccgccgccgcggcgtcaagctcgtcgccggagttctcgtagtagccgaggtgccttgctccttccatttcctccatctccgtcctgtcgttctccactgctctagctactagctagcaggatatactccacgaatcgcagaaatggtattcaatgccttgtaatcgttcagaaaactaaaaaaatattccgcaatcgcccacttcaaccccaaatcccctgttttccaatccccttcaccttttcgcttacaatccctataccgaactccatgctattttctgctccacccatgttgattggcacggtaaagcgcacagctcatatcaactttttttttttgttttctttcttgccggcatctcagatcaacatatcaacgtcctgaactgttctatttgtctgcaagtacctgccgagatgttatggttatttttccttggacagtatgatgcgcttttcaatttctcattcagtttttcttttcctgtttctccgattttcactcttcctgattttctatttaaacggtaggaaggtagctgtccttgcctgaaatagaaatgtttagtactgctcaccttttggcagtttctgcatcatgaaggtcattgaaatctggcatttaagttgtaatgctcatgcgtcgtgttgatcagtaaaaagtgttgctattctcaaagttctagtttgagtttatgaaaatttattctagaagttcaaattatggagggaatcttttgtttcttctgcagatactgattttcacggggatgcattaagctacggtctaacttgtgggagctggatactgctgaaaaggggaccaaatggagcttcagcaggaaagctcggatgcggggactttgttctcggcgccatcaaggaacctatcatcctcttcatcagcatttgtttctgctaaccaatcccctttcttcacgccacgatgtctatctgcccgtgtctcagatcacgcacatcctgagaacaatagttccttgagtggtactgtgctgaaaatcagtgatattctttccagcgacactctgttaaagcgggagcaattaccatcagccactgtggggttattgccatcggatgcttctcctcctcctagtatttgcacttcaagcaattttgacactccagcaattgtctataacaatcctagcttcatttccaccttcagtgacccatgtcaaggcagttcatcagcaactagcactggtgtccgttcaactcagaaggagaagcataagagacagtggggattatatcggaaatcttcatcctctcaacctacgacatcagctacctctgtcaacagacttcggagctttgatgtgtacataggatttcatggccgtaaggcttcactactgaggttcactaattggcttcgtgcagagcttgagatccatggaatcagctgctttgcttctgacaggtctagatgccggagttctcacagccatgatactattgagaggattatgaatgcttccacatatggagttgtcatccttacaagaaaatcatttggcaatccttataccatcgaggagctgaggaacttctttggcaagaaaaatctgatccctatattctttgacttgggtgctgctgattgccttgccagagatattattgagaagagaggagaactgtgggagagacatggcggcgagctttggatgttatatggtggaatggaacaggaatggagggaatcagttgatgctctttctcgggtgtcagatgtgcaattagaagcaaatgatggcaattggagacattgcatacttcaaactatcattgttttggccacaaaattgggcaggagaagtgtggttgatcgggtgaataggtggagaggaagggtggagaaggaggaattccctttccctcgtaatgctgattttgttggtaggaaaaaagagctctcagagttggaactcattttatttggagatgtcagcggagatggggaaagagagtattttgagatcaagacaaagcagagaagaaagggcctcgtaattggacggtctgttaacaattatgagcaagtaaatactgatgatggtaaaggaaaggagccggttttgtggaaggaaaccaaggaaaacattgagatgcagagactggggagtccaccacgacatggaaggccatcgagaacaaagaatgatggcaggtatgggaggaaaagaagatgtaggaagatactctacggaaagggtattgcttgcatttcaggggaatctggaattggcaagacagacttggttttggagtatgcatacaggttctcccagagatataagatggtcttatgggtcagaggggaaagcaggtacattcgacaaaactacttagctttgcggacttttctggaagtagatttaagtgttgatagtcacttgcatgagaaaggaagtgaccgatgctttgaagagcaggaagaggaagccattgccaaaatacggcaagagctgatgcgggacataccgtttttagtaatcattgataatcttgagagtgagaaagactggtgggataagagagtcataacagaccttcttccacattttggtggagagacccacttcatcataacaacacgccttccacgtgtgatgaacttggagccaatgaagctttcttatttgtctggtgccgaggcaatgtctttgatgaagggaggcgtcaaggattatccactggtggaaattgatgcactaaaggccattgaagaaaagcttggaagactcactcttggccttggtattgtgggatctatactctcagagcttccaatcactccgagcaggcttcttgatacgttgagtcggacactgcccataagagattgttcttggaatgagagagatgctatcagtttgaaaaatcatgaaatccttgtccggctcctggatgtctgcctatcaatatttgaccatgccgatggtcctaggagtctggcaacccggatggttcaagtgtgtggttggtttgcaccttctgcggtcccaatacatatgttggcgttggctgcacataaagtcccaaagaagcatcggaggggtccaaggtggaggaagtggtggcgaacgctgacttgtggcttggctacatctaggatgaagagatctgaagctgaagcagctgcaatgctgatgaggtttggaattgccagatgcagcacaaagcctgaatatgtacagttccatgatctgatcaggctatatgctcgaaagcgaggaggcacacgaatggcacaagctgtggtccaatcgatctacctccgaggctcaattaaacattcttctgaacatctgtgggctgcctgcttcatgttttttggatttggttctgatcctttcctggtagaaccgaagccatcagagttgattttctttgtaaagcagatcgtcgtgccacttgcaatcaacacattcatcacatattcccgatgtaatgcagcactggagctgctgcgtctatgcactgaggcattggagcgggcagctgactcaatgctttctcatgctggcaaatggagagaaacaccattgtcctgtttcaggccaactcagtcagaagcccaatacacctacctttggcaggagctggctcttctgaaagcatctgtattggaaacacgggccaagctgatgcttcgaggtggacagtatgacactggagatgacctaataaggaaggccatattcatcctgacttccatttgtggcgagcaccatcctaacacggtttctgctcgagaaaccctcagtaaactcacaaggcttcttacaaatgttcagcttaattgattcatatagcttaaggacttcaccaatatattcttttcagtggggcttttcataaacactgtacaaaatgccccagatcatcaaataacaaaagaaaatttgtctacacaatttgcacaggtttgcttctttggttaaagcactctcttgttactttcacctttgtgatgtgatcctagtcttaacacgcacaaggtttcaggcatcttcctctggtgttgatcttagtaattaataactggcaaacatatacatttctctccttttcatttctcatcttattggtcattttattttgggatgtcttccccctggctcaactgttctttttattagtcattctattaaaagtatcagctcaggtagttctgaagtgacctagtcagatgcctgaattgtatatctcaattgtgtcaagatgaataaaaagaggaatattctatcaggcaaaagaaactagtcgtctccagcagccactgatccctacagttttagtctctagctagaggtgatttcttctatcatataattagagatgtttcacgatgttggatgggagtcttgcattatggtaactgccagatgaaagttggtgaacaattatttatttctgtcagctccaaagatcatagtacaaattaacaaccatgtgatgctgatacttcgatgttgaagtaaggtaatgttctacattgattcccattcaatttaattgtttgtagcgatttatttttgataaaaagatacgaggtaataggcatttgcattgagaaactaaaactgcaattttgtgcttattaaggtctgtggaagtgttgtatagctgttattggggttgaaactcaactcaagcttgtaactattctaattcttatatacacaaactctcctattcatggtgcctctcatgcctatcatagttaaggacaagcaacactcatattacagttctggttgaaatgcatgcttattggttattgcagattcacgaaatattaaagaaaaacagtgcttagttcttgctgttgattatgtctactagtgaggcattcaacgaatggaccgtggagctgtagtcatagcttttggagaatggaagtataagttctggtctcttcttgcagccttgcacagaaccatatttgtggacaccaagatctgaggcaacagctatacgcagaaaaccatggttgaagtttcaaccaactctatttcgttctttatggcaatttaattaaagttatatgtaaacttggtaaggcttgatcattgcccttttagtctatgcttttttctcaagatcttttattacaactttgagttgcttgccccattttctagaatttatacaactgctgtgaactaatggttcttcagcaactgggttgacagattttacatcaatttttttgaacgggaaaactcagagcagttctggcctattgatatgttattttatgattattaattctaccttttctattttttttccagtgctttttaatcctgccgccaatgttctgaacattaccttgttagcttcatgaagaaacacctggaattggagccacactattaagcaaattggaatgtttactttcactggactcagcagtgatcaaacgacctccatgaggcaggaatgcctcatctacatggcatctaatgggtaagtcgatctacttcaggaattttatgttgctatcataaaaaccattgggcgtgtcaagtttacggttgcacagtatataatataaagcgacctgagtgaaatatgtcagcggtccttaaaacttgtaagcaggtgccttttagatccacaaacttgtataaagcaaatctaggtccctgaatttgcttaagtatgctgtctcgatccaaaatcactatatacctttctagtgctgatgtggatgttgaggtgacacactatgcatgtgatgtggcacataaataagaaaaaagaataaaaatggtgagacgggagaggtgcgtaaggcgttaggtacatcagtgccacatagtctcctagtcctagaaggacacatggcaggcagctctggacttatatgctattggagtactgtaataagtgggatttggatctgtcttttacaagttcgtgaacctaaataattatctatttacaagtttaaagactactggtgtattttactctataatataacactctccgttccataatacttcctccatttctaaatatttgacaccgttgactttttagcacatgttttaccgttcgtcttatctaaaaacttttatgaaatatgtaaaactatatgtatacataaaaatatatttaacaatgaaccaaatgataggaaaataattaataattacttaattttttttgaataagacgaacggtcaaacatatttaaaaaagtcaacggcgtcaaatatttagaaacggagggagtacttggtaattttgacttggcattgttttagcttgaccactaatattttatagataaacctacaagagtattgaaaaatagaacatattattgaagtatgatcacagtaaatatgaacatataaatcccgttcatcgtagttaaacaatttgaaagatatcaatgctcaaactagagcaagtgccaatcaaaattgccaaatactccctccatttcaaaatatttgacaccgttgacttttaagcacatgtttgaccgttcgtcttattcaaaaacttttatgaaatatgtaaaattatatgcctacataaaaatatatttaacaatgaatcaaatgataggaaaagaatgaataagacgaacggttaaacatgtgctaaaaagtcaacggcgcgaaacatttcgaaacggaggtagtattatgaattggtgtttgtgttcgttctgtgttcttgccctcggattacgatttctgttgcatccaggaaatgttatatcttaagtttttcggttgttgacacatctggggattgtccttttcttgcacacctgcatgaacgtcagtagatgtctctgtcgtatacattggtcaacccctcaaccccttgaaatggtacagaagattctcagctctacaaacccagaagccgaaaacggcgggctactcaagcgagagcccagtttgatcaaaatatatatgtacactatgtgataatacatgcaaaatatcgtgccactttttaatggcgacctggtgggcttctatgcgccccgaacaggttgtccatgtacgtctgcttcaggttcgtcatgatgttgggcagcttcatcagccttccgtcctcctgtgcggccggctcaggcgccgtcggcgagggcctatcggcgtcaccgttccagtcatccatgaagtcgagcagcgtcctgccgttgggtgaccctgtcattttgcagggggcatccacctcgccagcctgctggtggtggtgctccgcggcgtcgttggccatagccggcgccggcggcgcctccttcttggccttctccctggcgtggtcgtcggcgttgaggacgtcctctatccgggacatgacgttgaaggccaagctctccagcaccctggagtagctctccaggatggcgaacccgacgtcctggcagcccaaaggcgaaaagtgcgtgtgtcatcaagctggacactaccccgacattggtcggacggctcacactggagtaaaatcgtgtgtgatcttaccctgttttcctgtatcttggcgatgtcgagggtggactgggggatgccggggtaccggtgcttgatgatgagcaggagcgtctgcgcgcgctcctcgaactgctccctcttctcctggctgacggccgatccccacgccgacttgccgtccttgttgtgcaccttcctgttccagatgatcaccgacgcctcgatccggtccttgaggtccaggatcttgtgctccgacgtaaggtccaccgtcgacaggaacacgtccgggtcgaactccacgtcggtgatgatccggtacagcgcgtcgccgaggctcgccctcccgttctgcagccacccacattcttgccattgtcaacagatgtcttcttgcacggtggatggatggatggatcgtgtgagctgccagttctcaccttggggagggattcgaggtaggattccgggatggccatctccatgaggcagttggcgttgatggccatggccgccttgagcacctggttcaccagctccttctggtgctggagccaccctctggacgccggcgagagcccgccaggcgggaccttcacgatcgggatccaccatttctcgtctgatctctgctcgtcgctatccgagcacgagtcgcgcttcacgtaccagaactcgttccgatccttgaagttgtccaggtaatcctgccacgcaacgcaatgggggaatatcacgctgttcgtctcggtagctttgcgagttctagcgatggtgagatcgatgtatgtcgcgcttttaccaggagcatcgtgtcgatcttgcgcaacgccggtatgttcgcctggagatctctccgctgctgcgtgcccatcacctgagacgagcagagagagaaagatagcaggttacttgatggagctgcacacctgtgacttgtgtgagctgtgatctatcctgagctacaagcggctgccgctgctgcatggctgacctccatctcaacgccgttgtccaagacttgtttcttcgcgacgaactcgacgatgtgatcggcgacggatagaagccagccgacctctttcttccacctccccttcctgtccggcgccatgggctccagcttccgttgctcaccaaacacagaagctgatgacaaaagaagttgctctcaccactgctacatttcttgcgtgtgcccccccaagatagagatggaatttgggcaggcagtcaccttacctgcaagattggtgatggcgttggacacggccagcgccgacggcacgcccttcccggaccccgacatgtcctccccgagcagcagcttggcgaacttctccttcatcagctccatctctgcacgcaagcgtctagcgtcgcttcaaaaccaaagccgttctgtccatgcgcggcggcgggccgtgttcgatcatggcgacgacttaccggaaggtcctccgccgccgtgttcgccggtgtccttggcgagccgcgacttgggcgccgcgctgtccttgtcgagcacggcgccaatcttgagcgtgccgccgccgccgagatcctcatcggccggcgtgccccggccctcctcgctcaccatactctgcgaccgtcgcaccgagcttcgtctctctagcagcgacccaccgccgctcgctgccatcaaccgatcaactccaccgtggccagcttctcggcaaccaaccaaacagcaacaacaacaacggcaacaaagaaatggatccggtgacacgacacgtcgaaaagactggaaatcccaccatgatactacccaaagtgtatatacctgtaaaggacgcagctttctgcggcctcgagcgacgtgtgcagaagcaaacgatgatgatccaggattggcgctgcagaacacccacgcagagagagccacgagaaggaacaaaaaggggagggttgaaatgattaatcccgaggtgatgatgattgttgtttgtcccggtaatccaagaaccgggtggttcgatcgatcgtccgcattgtcgcggtaagaagaagccccggggaagagggggagcataattagggagcggcacatgctttattattagaaagtgccttgcctgccatagcgccattcttagccaccctgctttcctgggagctacctagctggaggaagaagacgaacacaacacatggagaattcgtcggggtcaatttactgaacaaagtttgttgtcctacttaaatagttaaatacttcaagcatgttcggtagacttatgttccacctcttatagaactgaagtcaactaaacagttttagcttcatccttttattacgtgaaatttgtcacgacacatgaagacctgagagatctgaataaatccagtgcaggtcctatcaatcgggttcaggacgtgtcaattcgtttaatcatgcaactaacaagataaatagacagatcgtatcggatcaaggagctgatcagccaatgggctgatgtgaagtcgagtgaccagccaatatcgataaggtttagatcaacggttatgggttcgatatagattcaaatatcagataaacaatgggattcttgctatcatcggctagaactaaacttcacataattatcaataaaccattctttgtcaaatacaatcttgatagatcggatcgaaccgagacaatataagattgaagttaataaagagagatttaactagtgagtatacgagtttgagtataagccaatacatcacttagaaatagtagcaagataactcatcacctagaactccgatgaaacgttgcataaaaacctatcggtttactagaatcagacttactagcaataatctaatagatcggagctgaccgaaacagtataagattgaagataataagaaaaccctatttagccgatagatctacaaaaccgtgatggatatattgaatcaatctaaaacaacaatgtgattggagaaatattaacttaattagaatatcggacctaactgagaaagatctaactaagccaatacgactctaaacaacggtacagttaaaaataggatcgatatatcagataggcaactgtcgaggggtgaccctctctagcgggaggctgtgaggcccccctttgagagttcggccgggggcagcgggtgagattcgaggatttggtgagcgaaactgtgtgtgatcttgatctcggaggctcctccaagacgatgagacaaaagaggtttatacaggttcgggccgctatgaagcataataccctactcctgtgtgtatgattcttctgtgcttagaaagtccatgaatccctggtatgtaagctagggttagacaagctttggctcagggatcctcagtccgatcccccttccttgctaggcattgtcctccttttatactctaaggggataccacatgtgctgcgagtgctacctagggagaagggaaaatattctctaaattaattacatgtcttgtgccttagcccagaatctatctgcacgtcggttgctgcgcggggcccatcaaatcatgcagggcgcccttgtcattcgccatttaatggatgaggacttccgggttctcgttcacaccagaaaacgggaacccgggtcagttcagagtggttggaccagctctgatcggggtaagaggctgtgaagcccctcatcattatgatgggacgggacggagcacgccgctcatcgcctgacacactggcagggcaggggtacacagtcgccgtcacatcggtcattcaaccggtcacagaccggtcagatgcgcagcacgttgcattacatgtggcatggcacggttgcatagaccgctttaaatgcagttaggtgggcgttaggcgcgcccacctaaccctgtacacgtgggctgatatgtggagggggtcggggcagctcgaccccaagcgagggcggcctcctccctctagcttggaggtggcagccgccacgccaccccgggctcgacccccctcgggggaagccacgtgggtttggaggtggcccaaccccaagctgggagggggcagccgccgcaacaccccgggctcgacccccctcggggagagccacgtgagtttgagggcggcctcctccctctagctgggagggggtagccgccgcgccaccccgggctcgacccccctcggggggagccacgtgggtttgggggcggcccgacccaaagctgggagggggcagccgccgcaacaccccgggctcgacccccctcggggagagccacgtgggtttgagggcggcctcctccctctagctgggagggggtagccaccgctccacctcgggcttgatcccctctcgcggggagccacgtgggttgggggagttgcccgaccccaagctgggagggggcagccgctgcaacaccccaggctcgacccccctcggggagagccacgtgggtttgagggcggcctcctccctctagctgggagggggtaaccaccgctccaccccgggcttgatcccctctcgcggggagccacgtgggttggggggttgcccgaccccaagctaggagggggcagccgccgcaacaccccgggctcgacccccctcggggagagccacgtgggtttgagggcggcctcctccctctagctgggagggggttgccaccgctccaccccgggtttgatcccccctcgtggggagccacgtgggtttgagggtggcctcctccctctagacgtgatacccctgggcccatatcaccgacagcaacgcttgcttcaacttgaatataatattgaacttaactgggaagttctagccacaacgatacaaagcttgacaaaacttacttttcgctggagatcaaacttaaccgattcagccctgctcgaaagtaagaactcgccggaataaaaggcggcgatgcgctgaaggtaattgtattgatatgtgaagatgtcttacaaagatctcaggtgtacatatttataccctcggattgatacaagttctaattgaatacgatactaagacttcctaataaatgaaactgtcttgtcatggtcttcacaatttctctttaaattcagcttgatctggataaactttcttctaccaattggcttattttctttaaccgagtccactggtgaatcataccaaaatttaacgttaacgtctttatagtggagctggatagaatgatctgaagatgaggtggaattgttgagacgcttcacaactctactccgctccagacttggttactggatttagacctctgggttgatatcgctctcattatgtatcatgaaatctgttgcgaggtttggggttgctagtgtgtatagaacgtacaaaaaattatttagacgaacatgtgcagaaaccgaccttagctcagttggtagagcggaggactgtagtatgtgcagattaatccttaggtcgctggttcgaatccggcaggtcggaattatttttttttctttttttttctttttagtccttccaagtgaaacctaagttcccctcttctctgttgtcttcaatttgagatgtgttattattattatttttcctgagacctttatttttcctattctttttggaggaggagaacaatgacttcgatgagagttacgatttgaactcgtcctagcgcatgttgctaaaaaaagctttaaagacgcgaatttgattccagcaactccagcaattcgtataccgattctgaataaactcgagccctgttgctctcgatccaattatgtactacaagggaaaccaagtcattctagaaaaacattacacaacaccaagtggaatcgcatgtttgaccagcaattccaatcttttgcacaccctacttccaattttctactgtgctatcgtgcgagtacaattcacgctccatgtatcgtgccagccgacgccgcctcgtcgtcgtcatcaaaaaccgggagagtaaacttgtagcgcccgctggttattctgattgattattccgaatcagatgcatgttagcttctcgactcgtggatgtcgctttcagctcatctgctacgatgctgcgcctttgaagacgaggaacctgagcgcccccagcttgaagtagatgaagcttcccttgctgtgcgtgaagtagcagccgaagctggcgcccaccacgcactgccatcccggcccgtggatcatgtcaaactcctgcgcatatgcagcaaagccattcaatccaagtgttgccaggggtgaaattcaggttgattgatctacggtctcagatttcagtcttttcagatgaatgcagaaaactgaaaacaagaactttgctcttggattgaccaattaaagtagctaaggattggtgcgaatggtagtgattaccgaccttcttgatgtgagcggcgatgctccggcagtcgaggacgtcgaagcggtcgagggccttgtacgccgccgacatcgcctgcagctgcatcttcaccggcatgtcggtgtcctccaccatcgccttcccttccaacatggtggtcgtctcttgtgactccttcctgcccagccttctctgttgcaatgctcgaaatgaatgcacaaagatgagagcaaaatgctgcgtctctcgtccctttttataggacggatggatgcgtgaatgcgtccatgtcgacgtgacgtgcgaacgacccagcctggacgagttcccggaatccggatggatcgggcactagaggcacagattcaattgctgggtgctcccgtccggttgtgaaactggaaacagtgggtgtttccgtgttggatatttttccgctaccagttttttttttccatctcgtttttctcattctttttatcgtagtggggctctttgtttttttggatgagctggtcgtgtggatttcggtgtctgggtttaatatggagaacatggtatgtgattggaacttcaaatggggaactcagcagataggagaagttcgataagttaattgcttgctttttggttcctatcgtcctatccgtgttgagttctccacgtaagcgtgactgcgtgagcgtggagaagtcttccggctgatctgatctgggaagtagtattaaatagatatatgtgcttggcttaatcgtaacatgtgataattatgcgtggtaggatcctgatccatggggtacagatatgtgcaggattatttttattcatttatagttgatcttgcagttcgaattgatccatttaatcctacctggcaggagttaagtttgagcaaagattgtagtgctggtctaactgccttatcagggcatctatagtcaacctgcaatgcgtgaattgttatcttatacggataagggcaccacgctgtctttttttacttttactagctgaatacccacacattgcaacagaagtttaaaaaagaaaatcttatcatacacattttagatactctaaacaaattatctctataattttctctaatcatctaagctgcttttgccatcacttttatatgagaatttggaaggcacgtacaccctgacaacaagaacgaccccccttgtcagggagttgatggtggtggtcggtggtagattcaccgctcatcaccaccattagagcttttttaaaattgtatatattatttatattataaaatatgtagcttttttatactttaatttacacctatagttttgtgctaaatttgatatttaatttatagttttacgacataccaccttaaatagttttttgtcaaaaacttaaaaagtaagatcaaactatccctaattttacgaaaattactttttttttcttacctccgattttcctgagatccgacaggcaggccgccgtgatctcacaggactcacagcgcgtcccaaggctacaacggctgagacgatccgccaaccaacgattaatttccggcagcccaggagcggaggagccctgcccagccgctagcctgacgacacgccgaaaaccgatggctgccccggcgggacctcatgtccaggaggcagaaaccgcccgatgccaccactctcctgtccaactgggcccaacgcgtcgcgcccgcagatctatgggccgcccccacccacaccgtatcgaagaggtgcagcgccagcctgccgccgctggcgcaacaccacacgggcacgcgccgcacagcgaaagccggattctccaccacgacgtcccccacaaccgcgcaccagccttccggtgcgcttctcgtggtcaggactagtcaggcaccgcgctctctctgtgccgggcgctcgctacagggagagtgtagcggaggcgtgcgcgttccactgttcaaggacggacggcttcgttccctctccctttcacaaggtcggctctcttttgatcgaggaagcagatcatttctgcaacgggacagagtgcgcggctactttcacctcaccagcataagcacaacaaaatcaacgaatgaaataatggccaactagaagaacatctacattgcctctgctcagcattctgagttctttctgacacagacacaaacgattcgatcgcgcatcagcgacgaaatccccgtttccctcaaacttctccccgtgctggttttaagacggagggaagaagcggttgaggttgaagggcaggctgtagaactcctcgctcctggcgtcccccttgaacgaccggaacggtacccaccatggcatcccccggtccttggccgcgtttttcacctccagcgtgttgtccaggaagacggccacgatcagtccgaccgtcggaggcgatgagaagatagtgttgatgtagtcgttgaactgcattatacagcacacaaaagttagtacctgtaattcctaactacgcttcagaagaatctccactgcaactagtattattgtaagtagaaataatcttaaccgttggatttatgagttttactaccagtgaaaaaaaacattttagtagaaataatcttaaccgttgatgtccccattgaattaaaaaagataaacgatctaaatatattttactgacagttgtaaaacatctcatttatctaatatcaagttgtcaacatgttactgttgaatttagaaacgcagaacaatttgctacataggtgagccatgaggaaggtgataaagagggacaaacccatccagcttttgtgtgcgcagggccacgctgagcggccatgctgtaccggaaaaagtattcgggcacagataggccaagaaagatggagacaccgacgataaagaggttgcgcatggagttcatgttagtaaactgcaagaaggagagccccactgccgctgaaagtcaaacaaagcaaatgtgtgagacaagaacaaaaacagtggcgtatttactcgcatcagatggcgcagggtaaccaaccaactagtccaaacaagacgcagtacacggccgcaaagatggtaaatgggatggaagcaaacaatgctccaaattttcctgcgccagatggaaaaaggagaattcaggaaaactgagctaacattgggcatgatctgcacacagttaaattactgtcctatcaacaaattactcacctagcatggagaagaagatcatgaagccggcagagatctgtataactcgtcggctcccgatcctcgttgatcctaacaacccgacattctccctgcattgatcttaacgttatcaagctggaagtaactctttgataaaaaaaaattctgaagttcactcacactgacacggtggagccagtacccgttccaaatagcccatcaagaaggataccaattccctgttgtttatggagtatcaacttaattacagctctgaacaacattcaggagtaaaaaacaagaaacaataggatgacttaaatatccacctgccacccaatgcctctactgaggatatgtgctggaggtggagtagcacttgcaagccgagccgcagctttgtaagaagccgtggactgtccaagacaggctttgagttaagttcaaggctgccacgcaaagaaatggctcctgaagacgagttatgaggggcattacctctactagcgataccagaacagcagataccataccaaaggattgaccggcactgaaagttggtgcgccccattgtagtggaaaagggatcttaatcctggagcaagtccctattgttagcacacacacactaactgaagaataaaattatccaaaaggatcaactgaagaactatctttcagtaggacaactaaacttttctgtgggacccatttgtcactgtttgcgagtcctgtgacccatccaatgcaaaatgtacaaggctgttgaggccccaaaggttgagcttaggcctttagtcttttcttttttatctattgatcataactttaaagtcacgatcaagtctcacttctaggtgactgaacacctatacaatcaactaaatctggttaaactaagaaactttgacatagagcatgtagtgcaaagaagagcttagcaaccaaagtcccatactaaggatagcataaagcacattaacaccgtaaccattttagtttacttggcacattaaagatatcacaaattcgatgggaaaataagcagagacaaaccatggcgcggaagagatgagattggcacggtcagtgcggcagttgatctgagtgacctcagggctatgcttatacgcgccacctgcagtgaggatttgagcataggcccaaaccaacgcgatgcagatgaacagggagaacctctccagtattggaatatctcttatctgtacattcttcagatactgaaaaacataattgacaatgcacgagttagactcaacttcaaatatggtcactagcaaaagaattcgatcattggagttgcttgccaaacctgagaaagcacgacaaacagaattaacattggaagtccaacctcaacgcatctcccaacctgacagtaaaatcaaacaacaatgcaatgcaatgaacaatctttcctgtctgaaaaaaaatatactgcattgtatgttctgcttgcgtgtcgaaaatgtgaggcgtcaaatgaacagctcgtaccacagggaatcctctttcgaaaaggccaaacccgagcaatgcaaccactggcgccatccccaacgggctgaagaatctgaaaggcaaaagcagcaacaccgcatgagaccatgacccatcagtatgggagcgtaggcactgtcgaaactgaatctgacatgcacacgcacgtaaccagcagcatccatccatgtgttgttctaacgtagtactaggaggagttgaagggcaaacctggagaaaatgccccacagctggctgtagccgaggatgatctgaatgctggaggacacgatgagtgccccctgtatcgccctcatggtctgaaggaacctctgctcagagagagagagagagagagagatgaacagcagatgattgtgatcagacacgcctaatctaaaacagtagaggcgattggacggatggatggacagaaagaagagcgtccgcctgctctgcttacctcgtggtcgtcgggtatggcggcgagcgatgagtcctgtatgatggccattatcgggaccacgaacgcgtaggatccgccgatcaccgtgggcaggcgcgtcccgaacagcgactgcagcagcgtgttgatgccggtgacgaacagcagcgtctgcaccaccctcaccctgtccccctgcgacagcagaaagcagaaaagtgagttctcaaaccatgggtggtggcgaatggattgggggaaatcaacaagagtgcggccgcggcggcgctcacgtcgctcccgcccatcatgggcaccagcaccgccgggatcatcaccgccgtgcccagcgccaggatgtagtgctggaatcccagtatgatcgcctcccctgaaacagcaaaaatccaagacgtggattcagaatgcgaaatcccgagcaggaaaaaatgcaatgcagccgccgccgcttcggctctcacgcaccccagggagggttggagtcgatgcagtactcgaacccctgcagctgctccatgggcgggtagctgatctcttccggcttcacctcagccatcgtcgccgcaccaccaccctcttctttgcccgtcaggatcccgccgccgagcaatgaaaacacacgggaacaggaaaacacacgggttcctcgcttatgtaggcgccgctgcgtgctctctccttggcctctctctcgagaaggcttctggagccagccaggtgggggcttattcagcgtacgcgctccggcacggcacacggcagcgtcccccttccgcagggggggagatcaggacgaaatctgttggagaaaaagccgcgagagaggatggctcgtctgcgtgagagagggaggcagcgcaaagagcaaattcgcactctcgccggcgcggctactgttcactctcacactcgttcgtcagccttggtcctcacactcgctcactggggccgtttgtcgtcgtggtgctttcttcttctctcccttttgcttctccattttttcccccttttatccgtgtttcgagtgcttcttccctccttccgggaaactgaactggccgttggcttttttggtgtgaccgaattgcccctccgccactcaccagtttccccttcgtgcattaactactccctacgactagccgttcttttttttttttcctaatcctgcgagtaaaacacgctgctgtttcttcgttttgttttagtttaccgaagatgctacactttcttactctaataatcctaggacaaattgcaaatctggaacatctttctttcacctgattttttagtagaagtccaaaaatatgttcatctccacccacttgacctgtttagttaaaaaaaactttcccacaaacatcatattaaatttttgaatacatgtatgaagtattaaatatagataaaaataaaaactaattgcacaatttgcatttaaatcgcgagacgaatcttttgagcctaatgagtccctgattagccataagtgctacagtaacctgcatgtgctaatgacgtattaattagactcagaagattcgtctcgcggtttccagacgagttatgaaattagttttttctttcgtaacctaaaaccccttccaacatccggtcaaatgtttaatgtgacactttccgtttcaccaacttaaacgggcccttacttggacgctgattacacactacagtgaacgttttctaccgtaccgtaaacccgatgtgacatgacagagtccttcggaccaagggcaacatcctttcgtgatcattgaggcggcaaaggcaaatggcaaagactcaccagaaccaccagaagaccattgcgggttttgcattgcgagtagtgcaggtagcggtcggaacatgttgctggtttccgatttaacggacgggacgaatgcccaattagatacccacaccaccacctgacagtctggtccaagtacaggggatgtttgtagttttccgcttctgaaaaatggttgcctcgtcagcctgcctgccctgcctcgtgccccgcttgactcgcagtcgccataggcaacagattattgaggagagcgcaagagttgagaacttgagaagtggggggtggggggcaaggaaagttaccgttgggtgccgttctgttctgcctgcgtctgcgtgcgaggcgatgattgcatcggacggtgagagagagagagagggaagggggggggggggggggcgaggaccggcggctccggctgggccccgcgagccagtccgtaggaaagcgatcagagatgatgcccctgcgcgacccctgcacggactccgacgcggtgcatcgcgacgctgctgctgctgctcctactagctgcttgtgctacccaccggtggtactggtacgtgctactacttgcctgcagtggcaatgcggcatgggcgcacggccaccggagcgaagccgagagagggctactgctcccaatcagcgggtaatttactccattttattgcagtaactctcgcctctgctggggccgggccaacgggctccgccatcgctgcgacgatgcgtcgtcactctcctcctgccagatctctacggatggcgtgctgtggactctggtgaattcatggtcatggacatgcatgtcaggttggttagcagtggtaattaatggtagggcgacggttgccgttcccttccggccggttggtgtgttcgccccttgtctgcggtgttactactgccagttcgtagcgtggtggggccgtggggatggtgctgctgcggttattgcggtgttgatcaccgatagaccgtttgggtcgcaaagaggattactactagcgttaaactgttaaaaacggccgtaatgcgccgtgaaaactgatctcttggttggttggttgggctattcagtaaactgtactggtatattggtgtactgtaccatactgtttggagtagatccacagcactgttgatagcagggccgcccatccgtgccgtccagagtccagaccgcacggcttcggtcctgaaaggacaagcatggaagttggaaggctggctagcctagtagcactggtatattatgatgagagcaattttaacaggtacggagtacttcgcagaaaccagatactagtagtagtgtagtaggagtatttaatacagcaccttgaataccgacgggaaagcggaaatttattgagtttaaatccgcccaaaatcaagaaaatgtcctaaacatggcaagatgaggttagtatgtcacccttgagaaatgccaatacgcccaaaaagcagcttatagtaaaaatagcaacacatagggaacacattgtgtaagcatgttttttggccaattcttgaaggttttttttttcacattataaggctatgtaattgaaaacctccaaatagtacatccttaactcaaaagaaaaggagagaagcactacgatcttctgtctgacttatgatcgcttgttttcttttcttcagcttctttcctcttttgttgcctgaaagtaaaatgatcaatgttacgaacaacagagaggggtgctggaatttatcaagataaaagctgctcaaacaactaacataaaacctatgtataacaaatcttcatatagttatcctgttgttttaatggttaaaagtaagatgtttaagttacacagagtaactgacgcatcaaccatacattttatgcactgtaattgatattaccactgcatcataacagtatgaaaaacatatggatgtagttctctgagacaaaatattcatagggaaaacaatggcacag

SEQ ID NO: 11024 - DNA, 65621 bp, Oryza sativa
  unsure (1)..(65621): unsure at all n locations
caattagctttggattgcatttctgattggcactgacagcaagataatacaaaatggaattgtatgctaatagaccgtgagcatagaggcaaaccatctgttccaagttctgacagctgaaataagagaacttacgcaaaagcagcgtatccagcaccaacatttgctgaagttagaagcgcggctgctgacaaattatcaagtccacttggagccacagggttcttaatatccccatcaacctagtaataaataacagaaaagcaacagtcagtcctgatgtacactgcagtatgtaaatatattggttcaggtttaaaaaccttatcccattttgacttcttgtttggcctagcctctttctgtacgccttctcccgatatcgaaaccaatggtgcaccagcagcagctgctgctgatacagcagctgtaaaagatgcaatgagcactgaaacatccaaaatacaaaattgacagattggtatcataatttcgtttgtatgtactatacctgcaattttcggtattgccgcactaattggagcttgtactcctccagtgataaagtcaacctttccactctttttcttctccagttcctttctctcaacttcacgcttcatatcagcttctgtagaaaataggaggctcgtcatgcctaggatatattcttgcgcaagtcttagaagaaatttctcaagaaagaactaaaacattcactattgactccacaggcataatatatgtataaataactaatctccaagttcagtttatgagtgaagaaccacttcgcgaggttgtcctagatcaacaattcccatctcaacataagagcgaccattcaccaaatcatttcagaattgtccaatcatctactagtttattttgtatgcacatgttgctaacacaacaaatcaagcacattgcaagaattccaccctccccccagaatagacgcaagctgcaggtttacaagcatatcataaagaagattggaagttactttgaggtttaaaaacacatcctacattctttttttttcccaagtgaagctgtattctaatgttcaattgtttgtcaaaattgcactatataatccacaagtacagcataatggataaacctcgactataacataccgatctcatcatagtaatcgcttctatcgtacccataaggatcaaaaacatctttactgaagcaggtccctatctggtcaatttcttggtaccgcacagcatgctgcaaaaagtctggattcctgtagtcctttctattgcgcacttcagaattgaagctctttccagcccttttgtacgcaaggaacttgttgatcttttgctgtatccaaagcattggaacataaataaatgtttaatgcaatagccaaataaatagattgtatggatgtgcattctaatttctaagcagtatgcatgtcatgtgaaaggccatgctgttgcagtgtgtttacaggacttgaaaagagaagcatatgtcaaactaaaaacaacagaagggcttcaaaatatcgaccttttgttcagaaataataattacaaatgagcaagagtcattagctagataaacaaatttacaagcatgtaataaatcaaaaggagaacaacgcatacagctatggcacagccagatctcaataataccatgaaaaatgcatgaaatggtttctggggtatggcttatgtgagcaggagaacaaatttattctagacaatggagtttattaaatccaaaggatagtaatatggtcccaagggagaacaatgttctgcataaaaatgtgataatttttttacatggaagtagaacatgtaggaaatattattttattaagaaggaaacctgtagtgctgcagaacattttgcagtcacaggaggaggaaggaaacgactcagaggatcatcattctgcatgttatcagcagcttcttccacctgaacatcttccatttctgctccagttacactcattgctgcagctgcccctacttgattctgttcaggtgcatcgttctgctgagacatttctgatcgtatatttggggtcagtatgtgaacaatacctgagagagtcttttcttcataattccctataggagagggataaaatataaattagattatatctagattgcaaatttagaggttataataattcagtttcatcgaaaaggtaaaacgagaccactaactcaccaaaatgttttctagaatggccagaaacataatatataatcaccaaaggaaataaatctgtcatgatattaagagtttcgtccatggatgaacaaaagaaatgcatgcattcttgttctgcacataacattttggtactgactactaacacacgactacaaatgcaaaagatcttgaggcatgttattgtggtatatctgtaaaacaaggttcattctttgtattttggaacctacatgtttctggctgaggtaattagcaaataatgcatagcctgattatgtgaaaacaaaatatctcaaacatttattattttcaagtgtttgtctatgttttcagctctccacctttcttggatatggttgtcaactacaagtaaacaaaccatttgagcacaaacatgttttctgatatgtgctctgtcattgatgacatatcctaaatagtgctaacgttgtgataaatctctactattataaaaattgaagatgtttttgccggtactttggtacatcatccgtgtatgagtcggttttcaagttcgttcgcttttggaaatacaaatccgtatttgagtcggtttttaagtttgttcgcttttggaaatacaaaaggaattgtataggaaatctctttaaaaaactcgcatgctacttgagatggtcggattcctaattgcagctcatgattttctaataaaatatatatatccaagcgaatttaacagtgaatttcatcttaaataaaccatataacaataataagattaaaatagccttcacccgttgcaacgcacgggcattttttctagttgatactaaattacataaccgtcaataccgagtatgcgactgatcataaatccttaaaatcacaatttctgcatactagctggacatctcgatttgcactagatattagcacggtatgctgaacatagcacaatacaacaaatacagcaggctaagagcttaccctcagcaacctgagcatccaaacccgatctgtctatgccattgatctccccatcctgcaaccagaccataacaacatcaattcaggaaagttggaaactccaagcagcatcactaaacatatacgttgctagctctacctcctgctccggcgacatggccgtttcgtcatgagcgtagtccacgatagcaagcgggccacgccgaggggggcgcggcaggtcggccggcggcatggccgcggcggggcggagcggggagggggacgaaatcgcgaagggcgaggacgagcggcgcgaaggcagcggcgggagccccggcgaggggtaggggctggctagggttctgcggccggccggatcctcggcgaggggaggggatgggggcgccgaagaagcggcagcgttggggttagggtttgagccctcgccttcggtctgaggtgacggcgacgaggaggttgcggcggcgggcggcgaagggggtctgggctcgtcgccgtcatcctcttcctcgtcgtcgttgtacatggagaagagagcggctactgccttggtgtcggacgccatggcgaggcgtagagggggtgggggtcgaggcgagaggttagatttggcgatttggggagaccggagaagacgagtccgaccgtgaaggattcgcgaatgaaacagccgccgtatgggttctcttacaggagcttcaagttggtgatttgtgggttcgaacagaacgggccggttgatgacgatggatgggccttgaatcttcatggcgtcatggccttgaatctttatcttcatcttcatattcaggaaattcattgatggtacgattcaatggaacgaaccaaaacttgataaattttagaggaattttggaggacttgattcctatgagatacatttctatatagttatttgggataaaggaatgatcttctagggtttctttgaaatttctatagaatgaaccattttataggaattttggagaaaaaagtagcatgaggtttcttcccatgatataaagttcctgtccatacttttttaggttgtgttcggtagcctgtgttcccaacccatctctctcgtttttcgcgcgatgcttttcaaacttctaaatgacatgttttttttcaataaagaattatataggaaagttgcttaaaaatcatattaatctatttttcaggttagtcttagctaatactacctccgttccaaaatacttgtcgctttgaatttttgtttgtaacttttgatcatctgtcttattcaaaaaattatagaattattatttattttgtttgtgacttgctttattatcaaaagcattttgagtattacttatctatttttatatttgcaccaattttttcaaataagacaaatggttaaacgttacaaacaattcattatacgatagtacttaattaattatacgataacaagtcatttcgttttccgtgctagagagataggctccctaccagcacaaacgaacgcagattatggtatcttcacaatcctacgttccaaagcagccttaaagttttcattcagtttcatgagtagccaaataagcctccttgtttggaatttggttccaaatctatataacttggaggtaaaatgaggaccatgttattcaattaaatctaagatatctcgttaaacaccaatatgttgagaggttttatttgcacagatcttacttatgcattgtatgaacgctctatatatacatgtatattagtttggttgcgttcgaatcttctatagatgaagactaaaagtgggtacgcaaaacgaaaaatccattagcgtgtgattaattaagttttaattattaaaaacttaaaaaatggatttatatgatattttaaagcaaattctatataaaaaattttcgcataaaatataccgtttagcagtttgaaaagcgtgctaacggaaaatgaggaaaaatccgtatctttatggagttagaacagggccatggtgctatgtataattaaccatgcaaaaaaataacgactttgtaaatagcaagctgacaatcatcaacacaatggttatggcatcttccttcaaaatttagacattttaggctgtcctttgattacaattaattaaacttgagttgaaaaaccaatgtggtatgattgaaatgcatgatcttcacaggtaattgatatttaaattgtgtaataagagtttacaagtcattcctaacaaaggaatggttcacatatctaactactgaatataaacaaaaaaaaatacaaattcaatgcttatgaccagaaaatacaactttacatgttttcttttacaattggcatagctctagtacataattgttaatacgaatcattttgaaatgtggacccaacacaatttgtgtaggcatttatcttttgccacgcgcgacttaacagttttacagctcagatagagaacgttgtagcttcttccaagatgataactcgtgtaaggaaaaatagaagtagattgctaaatagcacagttgttaggatgaaaagtgaggcgagtagatggggagcttaatgcaaattaaaacaatgcggttaaacacatgattaaaggaataacactggcgttgctatgagcccacgagttaaatgagtgtctattgctatggcagcatgttctctcgacttaagtgctatacttcttgatataaataactcataaaataaagtcataaccttgcaaaaagtaacagtttgacatcttcacaaacaagggattaagagagtcgaatccacgagagtggagcataacaaccctagtatataggagatatcaattgcattactcaatactcatgcctctgattttactaaaaatatatttttttaagaaaaaaaacacattagaggatgtgaggttccatattaatagagcagaaaaggttacaagattacaactctaaaaacctataatcacggaaaaaaaacacaccaacagtcctgatgattcctacccaccaacttgaggaaaaaaactaacaccgagctgggacctcgcatcaaatagtgtaaaatgtatgtgatttttttacatgccttttgacttttcttttctaaaagggtacatcaaatataattataccaatataataggagaagctttgctacataaaattaacttggtgcactcccatagcattatcagagcaatgtgaaaaatgaacacgctataactcaacatcgatcaatttaatctaaaaattatcgagttacctgaaaaaatcaaaagaaattgttcttcctttgcgtacaagttacgaagcgagcttcgtttgataatttctttttaggttaaacagagtaaatttcataatacgacatatatcactactacaaaaatcgtttttctatacgagggggtcggtaggttccatgcgggccgcttgtggcggcgcctgcaaaaaccgcccccccccggggtgggtcgatgagccgcatgcgaagatccattatcgcatgcggctgcttaagacagccacatgcgataataggtttattttcgcatgcggctggcttaagggaccgcatgcgatgatcggccatatatgctcctccaggcccgagcttgaccatttgaaaacgaagctctctctctctcctaaagcaagcaccaattagggggggaggttttcaactcgaaatttttgcttgaactctatacgaaaggtgaagaactctctctcctccttcatttggctccatttttgttatatttcgttggtggaaagtggagttttttttaatattttgacaaggtttgttctaactagtttttgcaaaatctagcttcaaaatatatgttttgatgggtaaattttgcatgtaatcacttgtacatactagttcatgtattgttgtaatttttttgggagacaaatgcatttaaacttttgtatgaaatacctgcggtctatttttttatctgtaacttttttgcctttatataattagatggatcggtcgtcatggatgtatgagatgcggagaacgtagcctttattaaggaagcacctaaatttattgatcaggctaaggcgcatgctttgagggagaatatgacaaagatcttttgtccgtgccgtcattgcaagaatcagaaattgttggtagatcctggtgaaatattgggtcacataatggagtacggattcaccgccaactacatggtttggacctatcacggggaattcgccaatccggaagatgacgatgaagagttaagtttcgagatgaatgaggcagagaattttataatcgaagacatgtcccgtgaaagaatggatgtcgatgtttccaccgatagtgatgatttcgatggtggttttgatttagaggatatgctacgccatgttgaaccagaggtgctagcgggcaggtcacgaggattggagaattggcaggcattagagaaggcatcgaaggatcttctttacgatgaaacgaagggatgtgataaggatttcacagtcttgcgttcagtgcttgaacttctgagattgaaggctaaacatggatggtcagacacaagttttaatgatctgatgagtttgttgcgtgtgttgcttcctaagcctaactttgtaccatcaaacacgtatcaagcgaagaaactcatatgtcctttatctcttggtgtagaaaagattcatgcttgtaagaatcactgcatattataccgtaaagaatatgcggacttggaatgttgcccaacgtgtggcacaagtcggtataaaacggggaatgggcccgtagattcagagtgtaccgatccagattctgataagggtaagcgcggaaagattccctcaatggtgatgtggtacctaccaattaaggaccgcctgaagagtctgtactcaaacccgactgatgctgagttgatgagatggcatcaagagagccggaagatagatggtatgattcgacatcccgccgatgctcgcaagtggaagacatttgatgtaaaacacccagaatttgcaaaggatcccaggaatataaggtttgcgttgagcactgatggaatgaacccgtttggtgacttaagcagctcgcacagcacatggccagtccttctcacaatgtataatcttccaacatggatatgtcagaaacgaaagtacattcttctcactatcctcatacaaggtccaaaccaacctggaatcgacatagatgttttccttgagcctttgatggaggacatggaggagctttggaaagaggggttacgactatgggatgagtttaagcgggagcacttcaatctacgtgcgatcatattcgttaccatcaatgacctacctgcaaacttttcattatctgggcagattaaagggaagactggatgtctgatatgtctggagaaaacttcgtacaaatactggacatcgtctttgaagacagtgtacatgcgacatcgacggttcctaccacaaagacataggtaccgtaagatggctagattgttcgataatacagtggagaatgacactgccccagcagcaagaggtggtacatacgtgtatgagataacaaagaagattaaggttgtatatggaaagggaaagaagaagacagtaaagaggaagaaagctgatggtgacaacggtactgcgtcgcctttcaagaagcactcaattttcttcaaatagttagattactggaaggacctagagattcgacatgcaattgatgttatgcacctcgagaagaacgtgtttgatagcaccattggcacattgctggacatcccgagtaaaacgaaggatggattgaagtcacgtaacgaccttatagatttggccatacggcatgaccttcacccagtagtgctgccaaatgggaagaccgagattcctcctgcttgttactcgttgacacttgaagagaaaaaagccttttgtaaatgtttacaaggggttagtgcctactggtttcgcatcgaacatcaggaagctagtatcaatgaaggatttgaccatttcgggatacaatgtgcatgactgtcataggttgctaacagtattcctaccaattgctataagggcagtcaaaccagtccatacaaaggtggttataacaaagttgtgctactttttcaatcgaatttcgcaaaaggtatttgatcctctggaattaggtccgcttcagacatttgccgtcgagactgtatgccagcttgagatgtatttcccaccatcatttttagatatgatggagcatttgatcgttcacatcgtccctcagattattgaacttggtcccttatacttacatcagatgtgggcctatgagcgttacatgtcgatcctcaaaggctatgtacgcaatcgcgctcacccggaaggatcaatgttagagggatacacaactgaagaggcagtcgagtgttgtatagactacataaaggatgctaatgccattggcattcctgttcatcgacatgaagagagattatctggaaggggtactgttggtaggaagcagttcttcgataatgattacaaaaaggtgtccgcggcacacaacagcgttcttcaacaactcgctatcgttgagccattcattgagcgacacctagaagaaatcaaagcctgcttcccagggcggtccaatgattgggcatcaagagagcacaagcgtcgctttcctctgtggttcaaagatctaaacctgccagttggtgattctgtggaggaacttactttacaaagactggcatgtgggccttcaagtattgtcaattcatggctaggttacgacatcaatggatttaccttgagtacgactacgaaggacatgaaaagcaccgcacaaaacagtgggatccgtgtcaaagctattgacacgagtggagaaaagaggtcgtattatgggaccattcaagaaatatgggaactggactatggcctgaacatctagatccctgtgctccgttgtgaatgggttaaagacacaacaggagtttccgttgatgactacgggctaacgatagtcgatgacagtaaaacatgccacaaggatgatccatgggttttagcagagcgtgtggctcaagtgttttatgtgaaggacccttcagatgaaagaaaaactattgtcatatccagaaagcaacagatcgtcggcatcgacaacatcgaagaccccaatgattacaaccagttcgacgatgtaccattgtttactgatcttcctgtgcgaattaagaaggttgagagaacaatcgatgaagcgaatatgtcgtacgttcgagcagatggtgttgccaaggttattaagtcatagttattttgtaacctttagttctcattgtgttccaaatgtacgtgcatgaatttaagtcccccttatgttgtaatcattagcatgtaacatttggttacgagttttgagcaattttcatgagttttcttagtgccaaaaaaatttggaatgtttaattgtggcgaaatattgggaatatatatatatgtacagttatttagaggaaagaaaaaatatgagtttttttggtaaaaagatatttccatgcgggtgacttaagccagccggatggaaatatctttttcgcatgcagccggctttacggcccgcacagaaatatctttttcgcatgcggctggcttaacggcccgcatggaaagataattttcgcatgcggccggcttaagtcgcctgcatggaaagatcatttttccatgcgggctcttaagctgcccgcatgcgatgatctgcgcctatatatagggagcgcggggagccaaaattttctaagtcccggcgcccgcgaaaccctagccgccaggctgccaaaattttctaagtcgccgtcgccgtcaccgccgccaagtcgtccccgccaccgccggctcctccccgaagtcgcccctctcgccatcgccgtcgccgccgctaggacctctctaccccctcgccgtcgccgtcgccgccgccaagtcgtccccgccaccgccggctcctcccgaagtcgccccgtccctcgccaccgccgtcgctgccgccaggacctctacccccttgccgtcgccgtcgccgccgcacggacctctcccccctcgccaccgccaagtcgttgccgccggccgccaagtcgtccccgccaccgccatctcctccccgaagtcgcccccctcgtcgtcgtcgtcaccgcagccagcacctctcccccctcgcgcgtcgtcgctgccaagtccttcccgccaccgccggcaatacctcctccggtccaaggtcccccggtaacatttacttttaaaaaaaaagaaatgtgaaatgtgcaattgtggattgtttaattgtggatcgtggattgtgatatgtgcaattgtggattgtttaactttgagaatgtttaattgtggattgttaaattgggacttatgttaaatggagatttatgtttaaattgggacttatgttaaattgggacctatattaaattgtgacttatgtttaaattgagacttatgttaaattgggatttatgtataattgggacttatgttaaattgggacctatgttaaatggagatttatgtttaattgggagtgatgttaaattgggacctatgttaaattgtgacttatgtttaaattgtgacttatgttaaattgagaattatgttaagttcggacttatgtgaaatttagttaaattgggacttatgtgaaattaagttaaattgggacctatgttaaattgagatttatgtataattgggacttatgttaaattgagatttatgtataattgggacttgtgttaaattgggacttatgtcaaattgagacttatgtgaaattaagttaaattgggacttacgtaaaattgggacttatgtcaaatttttttatgtcaagttggaagatgttgagcgataaggttccatcgaacgcaccaatagcgcctcaagaaggtaacgctcctcaaaaatccggtagcaacaagcagccagacgcttctagtgaagaaatgtggcgcacaccaagtgacccgtttccaatggaaataacacaagtcgcccctcgcgatgatgatctggactacatacctatggaacaggctgtaagtgctgaaaatcgttagccatgtattatttcctaactacgatgtgacatgaacctaatggtgtatagagttacctattctgtgcagatgttagtccgacgccactcgaaacgtaaagccgggaggaacaggagagaggaagaagtttagatggacaccgttacatctgcacctgaacgtacggagacatctacaagtgcaggcgggagtgggaaaaaaagacgtggtgagagaagcaagaataaattaccaaggaaacttacaacgtgattgctctcgatcaggatgggaagcccgtcgagccaccgatagtgcggtccaagtttagcaacgcatgtggcactctagtcaggacgcgttgtcccattaatgtcaagttgtgggaaacggtggacgacaacatcaagacatttctctggaatgagttgcagaagtattttgtgttccctcctggatcagaggtcagggggagagattacgcacttaaaaagatgggagatcgatggcgacagtggaagtccgatcaaaatcgggattatgttcagaagaatctcccaccgtttacggattatggacaaatatcgcaggctgactgggatacgtttgttgcggatcatacaacagctgaagcattggctttgaggaaaaaaatgtccgagctcgcgaaaaagaacagatatccccatagattggggtcgagcggatacgctggtcacgtcgatcaatggcgggagatcgagcaaagatttgccgctgccggcaaacccctgctggtagaccccaaggttgaacgtagcaagaactgggtttgggcgcgcagcacaggtcaagtctcggataagggagacatactattcgaggctccagacatagaagaagtgactactaatttgcagcagatagtcgagaaagaaagatcagtacagttcgccccacggagggagcgagaccagcttactgcggcgttggggacggctgaacactctggacgtgtaaggggtttgtcctcaaagacgagttggaaggtagggtttccacaagacgcaccaagttataagaagagagacaaatacaaagaacaactatcagacaaaatctatgcgcaagtgaaggaacacttctactcgttggcagctgaaaacccgacagcctttccaaggttattccctaatggccagcaacccacacaatccgcacagcaaacaactaatgtacccaacagtgtaggctcagtgcagacaactcccttccctgtggatagtataactggaccaactccgtgcagtctcgtcgtaccaatcggccgcgctggaaagactaaggaggttgcaatgggtttagcgatacccggacgtcaattccacaacacggcaatccctgaggattacgcaagggtacaggtcgccaaggtccatagcgatcacgtttccttggaactagacatacctgcacctgaggggattgaacttcttggtgatgcagtgaatcagtttatcttgtggcaccgcagagacataatcctgaccgcggccgttccagcagcagaatcttcaactccatcctcatcacaggcaaggacagctgccgctcctgcaccaccgtcgcctcctgaaccaccgtcacctcgacatccgtcgtcaccaccaccgcttaggtcaccgcctcgccaacctacaccaccaccctccccttctcaacagccgcctctcccggccccgcaaccagttcaagcctctcccacctccccagctaaacagcatgctcccccggctccacccttagttcaaacctctccacctacaccccaatctgctctggtagaacaagtgcacataccggaaggtactacatccgaaccgaagtctaatcctttggaacctcgtcgtataattccaaagttgatatcgacatatgacccaaaggagattgacaaggataaggagaagttcatgtttcagctttcaggaattctgagaagagaaaagaacttgctcacgtcatgtcagactcccagaagtcagtactagcagcccaagatgaattgcaatcatggttatctgccgatgtgcctgaaacttatgagtatggcaagccattcttgccaacatatcttatgaacaatctaccctgggaaatgagggcaatgcacgaatggtatatcaaggcatataggaagggtctcggtttcataagcatcgccgtcccggaaggtgctttcatgagttgagtggtcctaatgggatattttttttatctctttccgagacctttacgccctctacaagctagataaaatggacgttaatctcgttgcggcattctgtctgtaagtctgaactctttattacatgttacacgtatcattccaaacaaagaaaccaaatctcattacttctttgttcattatacagtatgcaattcatgaagctgatagaactggatcaccggttggatacatcgatccaacaagaatatgcaaaagacgacacaccgtagagctgagagaggactacgagcaaattggttggcaagacccctgaagaaaaggaagaatatgtgaagcaattgcacaacaggaagaagctagaagtagcaacatacttggcaatagcaatgttggcgcacgccgacaaagatgtcttaatggtcccctaccagttcacgtaagctttctcttctttttgtttaattaatttatcttcttcggaattttctgtctccaataagcctatcttatatgcagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagcagctatccgtcaggactggctggccggtactatcaaatctataccaatacaactaattatcgaacagtacatatatactaaatatatttactgagatcggtccccataattatatcgcagtgctacaaacaaccaccaggaaccaacttgtgcggttattacgtgtgcgagatgctcagagtaaatgggaggtacaaaacaaccagtaaccgagtaagtcatcgaactcttctctacaaagaaacccatctcgcacacacttctcactgagtaccattttattttcctttctatgcacagatccccgaaatcccatatattgcataacgattcaatgacactactatcttgaacgtggccgctgacctctgccgattcatccgtcgcgatgtctgcaacgcaagaggtctcttctacgacaaccagagtgaattcgcaatggacgacaaatttaaacctctcagagagtgggagaaagaacatatgcaatgacatgtacactacttatacatatgatgaaaaaactgtggcacttgtattatatatttcgtatgtaaattacgattgaattaatggttatgtattatatgtttgttactgcggcacttgtcttatctcatatgcttactattccgaaatacgataataaatccctcaataatttaatattaattatgagacacatctcaccaaaaggctagaataaatattatttgagctattcggaaattgaatttcgcatgcggtctacttaagacgcccgcatgcgaaaatagattttggnatggggttttgttaggtcgaccgcatgggaaaatatatcttcgcatgcggcttcttagatggaccgcatgcgaagatctattttcgcatgcggccgtcttaagtgaccgcatgtgaagatcgatcttcgcatgcggctgggacggccgcatgcacaaatggtgatctttgcataccatttcgcgcatgtgggccggccaaccgcatgtgaagatcgatttcgcccgtatgcaaaaacgctttctgtagtagtgtattttgatcaaaatatcgcaaaattgcatatttttaaaacatcgtatcataagactacacatatagtgaagattttagagtttatattcatagcactattgaggtaacaaaagttgtagatttgtgatatgttaaatctatagttttgtcctatgattcattaaatttgtagttttgtaaaaaagcatggtgtttaatatatagttttgtgatacacgtttttaaatatgcagtttcgttatacacgtttttaaatatgtagttttatgatagattgatcaaactacctgtaattactcacaacttgtacaccacgatccacggattaccctcttgaaactattgctcttactagtacaaagcaagtcaccatatgactattacatgtcattgcctctgttggaggctaaccttgggcttcgttcttttgttgtctagcatacggtttaggaacaataacaggagacacacacacatataagtggcgtagctagaatttaaagtaaaagtgatccatctatatataatatgtcaattaaaagggtggtccactatacaatttttactatattaactaggacatatactataatttcaaatttttaggtggtcagtggaccacggtgccacctagctggctacgcccctgacacatacatatatagttttgttttccttacaaaatggacagactcccttttaaaaaaaaacctatgtgttttatgtggtcaaatcttatagagtaaatttcacaaaaactacaactatttagttaaattatcaaaaaaaactatatttttaacatgatgtatcacaaaactacagattcaacactaaatttatcatagaactatagacttaggctgcgttcgttcattggagataggggagattgtcactcgtttttcacgcgcacgcttttcaaactactaaacggtgcgttttttgtaaaaattttctatagaaaagttgctttaaaaaatcatattaatccatttttaaatttgaaaatagttaatactcaattaatcatgagctaatgactcacctcgttttgcgtatcttcccaatcttcccaattctctctccctcaaacacacccttaaggtggaatgtcgcaaaactacggattcagtaacaaaaatatcacaaaaccacatatttattattaatttaatcacaaaacatggacatatataactcaaatatagcatgaatgctaaaggtttaaaccccaaaatctgaaattttgtgataatctatctatctattatatactaaaagtccattaaactttctacaaatcgctcctaaaccgccacatggcaactctacaaacgctcttaggctgccaagtagcatttaaaacatctaatcattgattttcatttaatctggtggacccatatttttaaccgttagatctaaaaataccaaatatatttaattcatctttagaattcagaaagccacacatccacgtcgatcactcgcgtacgtgtacgttcatgtacgtacatacttcgttagtgtacgtccttccccttccttcctttctttttattttttctttttctttttactcaaatgagataaaaactaaataaataattttagccaaattaattaaatagggagtagctaatcttataagcactttacaacattattatcttaaatttattacttaggtattaaaaacttaatatgtagtatacaatatactttgtcaatcctagcctaaaatatcaattattgtatatcctcaatgatccccatatatataagttttatacataagtcactatttactaatcaccaagtcatattacttacgaggtattcgtgcacaacgcacctaacagctggatagctgatatctaatgagcatgtatgtcatcaaacaccgatgataaagggcaattataagtgtgcaacgatcaacaaattataggtaagtagaggatgcaactaatccaccgcaaacaatagttgactactggtagattgtgactatgagtaatagcatttctatactcatgcaaacgcttctaagatgtcatgtgatgctctaattagaaataatctaagaaaaactgtaaaataaaataaaagtattattcatcgatttacacacaaaatcggcgatccattatttttcaaccattaaattagatctatgataataatccctctgtctaaaaaccatctaatcactccttacgtacatacacaactcctatgtacatacctatgcaagatatataaaaaggaagaaaaaagaagagtgtgtatatgatttgtcccatatggttgttttctctttctttctagatataaggtttcttttctaaattgagcatatacgtagtgatcactccttgccacaccgctgtctcatgccacccgttgctccaccctcttcctgtcaaatttttaaggaaaaaaaagaagagtgtgtatatgatttgtcccatgtggttttttttatctttctttctagatctaaggtttcttttctaaattgagcatatacgtagtgatcactccttgccacgccattgtctcatgccacccgttgctccaccctcttcctgtcaaatttttaaaaatactttttttactaacaatttaaagggcaatcacatgagctcatataaatgtgtgcatacgcacattatgaatacaaatacgcacaccctattcctataataaacaaatatttgtccgaaaagaaaaaaaggaaaaaaacaaacgttcatacgtgagactactattcgctagaaaaaacatacatgtaacaacattgtatctcttttttatgtcgtccccagcaaaatagtattaacatttagcacaaataattttaataaatttatccaatattaatccccacaaacatgaaatggtgaattagatgtataatacaagaaaaaaaattaaaacctatattaacttgtatgttagcaaaggatcacagtttgagcaaatttttttacgtggtccacaccaccaaagctattagatttttcgaattagagtccaatgagcaaccctgctaatttttaaaagagaaaattatatatataccactaaaatttagtagtatcgattaacaccataaataaattatgtatactctatataataaatcaactcaagacataaaaaaactattttcgtcacctccattttctctcactcataccctgaagggtgccaagcatgaatctcaactggctacattatagtaactatggcaagagtatgcattattgagctgaagtcgttttacccaaactgatataccttattttaaactgttagatctatatattaaaaaaaacctaccgattgatcaggccgtcagagtgcgtatgtacaacacatgtatccagttccctcctcacggatgaaacgaacctactggctctcgtctctttgtttccttaccacaattaagttaaccactgaataaaagaagatcctaaaaattaccccgaaaaaatatccaccttatttttttaataaaactggtagactaattacttcataccattagacatctaacgactttctaccaacttaattatatttctcaacttgtataccaggtctatttacctatacaaatatgtaaagctaaatcaatctacaaaggtacaaataaatctgtctatgaatggagctcttttttattactatatatctccgtcttataatggatcctaaaattttatacccactctgttccaaaatataacaatttttagcacttacgatttgtcccaaatataacaacattaccaccaacattcccttcccaactaatcataactctaaaacttcttatattctgggacggagggagtagaaatcaaggaggaatgaaaaaaaaatactaagatacccatcattaaataaggctcattaaataaggagatggttagtgtaatgttggataaaaattaaatgaagaatggctagatggaacgagtagtattaataattccttatattttaggatataaaatttaaatccttcgatttatggatggaggtagtagaagtaaatagaagtacgtgagtatttgtttaattagataaaaatgtcatattatcatatttttaatagaaaatttcttatattaatatatcgtcaaatctacgaagacatatttagtatacaagaaaaaaaataaagtttaaattaagatgctaaatatttttaaaaataaaagcatgtagtataaaaatgatatttttatatgaaccagctccattattgtgatatatttttctcataaatttaagacgacgtgatgcaagtaattttagtttacaatttgtaacaacccgtcctttagaacaaggcagcccagcctccatccaactggcacgcttacttataaatatcacctcacttacacttttattctcgcttcgcataaaatagtcaacccaaaaataatatggttgaagggacaatgcatcacaggttagctacactcttgcttaaatagcaagatagtactactactcatgtgcacacaatgcttatagacaacacatgtcaaatcctttaaataaaaaatatagaccacatcctaattgcactaggatttctaagacaccccctcaaaggatccgacgttcctgtcggtccaacttatctccatagtcacatatgcatatagacaaatatccagaaacatgtcccctcttaacgcacatccgtacgtccagtgatcgaaacaagcttccaaaacaatcccaaaaaatattgataaacacagatttagaagagtaaaaaaatattttttttttgaaaaaaaaatcttatacataaatattcatcacaaaatttcaaacaccattaaataaggtgcccgcgcatttgcgcgggctaccttcctaatttcattagtaaatctatagttatgcgatatttagcattaaacatgtagttttgtgaaaattaattgttaaatttgtagtttcgtgatacatcactttaattgtatagttttgtgataatttagccaaagtatctgtagttttttgaaatttactcaatttcataaaatttagattcaatgaatattctaggttggaaaagtgcagtcaatcctatagtagtactgtgattttgccaaattttatagtcaaagttcctcatcactactgtcgagaaaagttcttccatggctccatgtcaatgttcagaacatcgcaccaaatgaagcatttcctagtaggccataatctgtccatcaatcatttgcataaaatggtttgattgtagtgactgcaaaatggaatctggttcaggtctccaaaagtcgaagtaccttcgcaatcaatcatgtgagttgctaaaacaacccatccaaatttcccagttagtgtcatttctgacttattatccgaatatagttgctgcactaactgcggccgctacaaatccaatgctcttgatatttctgcagagtccctgtcatgcgtggctatatactcctattaggcaggtcaattcgtagccgggaagaaaatgacgaggattcccgatactgcttgtcccgttgcagaagccacaggactgacgccgacgtccgtgccgtagttagaccgtgccaccacgtccctttcggcttatcggcccattccggtgcccgtccctgtcgctgcgtatctaccagaactccagagccgtaggtgctttgctcgagtcatgtacctaatcctaaatggtctaatggcgtgtgcttgtcttggctcgtactccagcctgcatcttcacgcgtaatttgctgctagtgtttacagtgctcctgcagcttgggttttcagataaaacggtttaacactccacgtacttgccagcgcaggatgatgctccaagtgttggcaaagtggcaacggttttgccgtgacggtgagctagtgggagaccccaggatttcaggttccgtctcctcgcgaccgcgccgcgcgtcggtgcacgccaccgaccgccttcggtcgagcgcggcgcgcgtctaccgggcgagggcgaggccacggccacgcgccgccttcactccacacttccacaggcccgggtcccccttccttcccggggatggcgccgcgccgcgcgacgccggcattttccgttttgtttatgctatctggactggagcatcaagtacggccaagtgtgtggaaaaatcgcggccaaaccttgggcacgcctcgcgcccgcgcacccagccgggacgctccacctgtccgctcggggcatcgcccgtgcaccacgtcgccaccgcgcggtctatccgattcaaaaccctcgcgtctagaaaaaggcgatatgcggggacgctgcgctttattttaagcaaagaaaatttattgtactggtgctttttattagtgctagtattactcgtactgctgtattttcttgtgtatagtacatgtaccgcaacggtagtactgctgctgctgctagtattgtactgtagttttttttttctcagagaaaagaacagaaaataagagaacggaggagaagtaaagtggctgaaacggctcaattaagcacgctttcccgagaggccgagacgtacaccatggctgacaatgcggttcaggcatgttaagtcgcgttttgtaaggtacgcccttggagaactgggtattcacataatcacgtgaagaaccatcaagcgtacaacggctctggcctggctagttaaatttccccatttatgaaggtgaatctggtactcttacacaatcatcgaaggattttacatgttcaaaaaggagcatcatttaacgttgttcggcattgttatcttgttatagacattcagcattgtactatcgtgttatagacattcaatatttgtcaaaatggacggaagaaataagtggagctcgaaacagttttgggaatttatgaggaacgccatgctttgtgtacacaataagatacaacagcggagtaatgatgtgtatacgaatacgacttgattactatatcgattggttagacgacgatgatgttagcatccattttcattactgggagaggatgatgtgtatacgaatacgacaacataggtagccgattaggtattgaaacctaaccgcctaaatacttgatcaaacaaaaaagttgtatctgcatcgcacggtatggcttgaatggaacatcacaagttatgaacttacaaaatttgactactctcgaatcaaaaccgcaacaaatgtatgaaaatcagaaagatccgcattaaagaggaaatcattatgatatttaatactagctgagtaatccctacacgacacacaatccctacactctacctggctaaccaacaaattccagtaccaaagtaatcaagccaagccagctagtattgcacctcggtgtagcgtgagccgtggccagtccctcagcaacaaatggaagccaccttggatgtttgcttataatggccactaatttactggacagctgttatacttcaatacctccccgcactttctgtttaagcttagcttgataatttgtactcacaccgagtaccagcaaagaaaaacgtaactcactggcgcgcccggagttaaaacacgaagatcactcgcaacagccggtcgagatgaggcctcatccccacaaagtattttctacacctagatgctatgcatgtaatttaaatagatatataaaaattttataaaatttaataaaatagtacatgataatataagacactatgcaaacatgcaagtctaaattcaatcgatatatgaagaaacaaaaataacaaattttgtctgtacggtacgggtactattcactgtctgattttattatttttgtttctctagttgtagatccaatttagtcctatatgtttgtgtatagacttatatcatcacaaacaatgttactaaatttttttaattttttttataactatttgagtcgtatgcaaatgataggtgccatagcacctaggtgtgaaaaaaattttccgcctcatcccaattcccaccaatacagggaacggcgagggcttgatcccataaaacaacacgataaaaaaggcgaaaaatctcccccctaaaacgcgacctgtgcggccctgggcggagaataacccggcggcggcctacggcgatataaaccgtatattgagggagcaagccgtggtacagagcagaggaggggggagagagagagagagagagagagagagagagtcgtgtgtgcgtgtgtccccggggttctagctttgggatgctgatggcgaccgtctcgccggcgcggagggagccgacgccgcaggcggtgcgggcgtccccgatgccatcggcggcggcggcgttggtgaggagaggcggtggtggtagcggggggacggtgctggggaagtacgagctggggcgcgtcctgggacagggctcgttcgcgaaggtgtaccaggcgaggcacctggagaccgacgagtgcgtggcaatcaaggtgctcgacaaggagaaggccgtgaagggcgggatggtccacctcgtcaagcgcgagatcaacgtgctccgccgggtgcgccacccgaacatcgtgcagctgttcgaggtaatggccagcaagaccaagatctacttcgtcatggagtatgtccgcggcggcgagctcttctcccgcgtctccaagggacgcctcagggaggacaccgcgcggcgctacttccagcagcttgtctccgccgtcgacttctgccacgcccgcggcgtgttccaccgtgacctcaagcccgagaacctcctcgtggatgagaacggggacttgaaggtctcggacttcggcctcgccgccggccccgaccagttcgaccccgacggtctgctccacacgttctgcggcacgccggcttacgtcgcccccgaggtgctcaggcgccgcggatacgacggcgccaaggcggacatatggtcatgcggtgtcatcctctttgcgctcatggccgggtacctccctttccatgaccacaacatcatggttctgtaccggaagatctacaatggggagttcaggtgtccaaggtggttctccaaggattttactagattgataacgcgccttcttgacgcaaaccccaaaactaggatcaccgtgccagagatcattgagagcgattggttcaagaaaggatacaagccagtcaagttttacattgaggatgacaagctctacaacctgtctgatgacgtgctgaacttggagcctgctgatcctgttcccccaccattgggtttggcacctcctgttcctccacctccacaaggggatgatcctgatggttcagggtctgagtcagattcatcagtcgtatcctgcccggccacattgtcaactggggagagccagagagtccgtgggtcactaccacgcccagcaagccttaatgcatttgatatcatatcattctcaaaaggattcaacttgtctgggctgtttgaggagagggggaacgagatcaggtttgtatctggtgagcccatgtctgacattgtaaaaaagctggaggagattgcaaaggtcaagagcttcacagtgcggaggaaggactggcgggtgagcatagagggtacacgcgaaggagttaaggggcctctaaccataggcgcggagatatttgagcttacaccctcccttgtagtagtggaagtaaaaagaaaggcaggtgataatgaagagtatgaggatttctgcaacatggagttgaagccaggaatgcagcaccttgtgcaccagatgctcccagctccaaatggaactcctgtgagtgagaaggttgaaaggtaatgattctctcctgattttacttatatgcattgtagctaaatagggaagcaaggattttgtgttgtttaacatgcgcaaccgggcagaaagttaaattgattgatgcttcagttccaataattacataacaatgtttcacttcttgactatacatcctgtatttcaaattgagcgttcaagagtttgtttgctaaaagttaattgatttttattcatgctatttgtttttgttaacgtatgtttaattcacaatcatgcctattgcctaataccagtatgtagaaggaattagatttccttgcacggacacaatttaaagtaggaaagccttgcaattgaaaacctcgaacaactggaacttttattatttctagagtggtgaaagaatgctataggttttgctgttagattttgccaaccattaactagcttgcctcctgcaatccaatttcacagcgcttggataatgcgtatgtctggaaatttgctgccacttgaccattgcaagtgtgcttcgtgaaaagaagcaaatttgaatggttctaatcatcctagtttgtggctgttaaactgattatagattgttttgtttcattctagagcatgatttggtttatctaacatctgtgctcttttaatctatgctacgaactcaatttttcgtaaaatctttcccgcaccctattcttatggactttttagcttgtgatagattgtataagataaatgtcttttctagtcatcagttaatgaaaacattttcgcttgtcttatctatcttttggagttactttaaaaagtgattatgcactgttctactgcaccttagcttgtaaacttcctgctcttatttatttttctttatgtttccattttttttggataatggaattcaatccagtattgatgatgattccatgttaccccagcatttattggtgttgaatgtttacatgtgtcataattcatattgaaaaaacttttgaaaacaaatatagaaaggaaccgccaatatcatgtccttctggtttccccattgttgttatcaccaacttccatggattggcattgtgctgcacatcagcatatgggatagaatgggagcttgaagggaatgcttggcagtacctccgagtaccgaaatgtcatttttacaaagaacatgtgcttcactagattttcagcatgctaggtaaatgttgaaagtgctgtataggtttattatctggtgtagctccctctgacatagtaataacaggttgctttatgggaaacctggtagattttatctatttaatttggtgaaaccatgaaaatgcaaacatcatggctgagacattgaaaattacaaaacagaaagggcgcatagcaacaccatatactattcatgcaaaccatttctactattttaacctgtgagtttttgatggtttctagtttctttttacattcaaatgggctctaattcctgattttaggaggttcctttcttttcagtttcattgctgttattgataaattatcttttttttcattaatgataactttatactttgatggatctttgttgaacacttaatctggtgcacatgttagccacccaccattataggagaacacatgggacacatttaccttcagaggtaaggagggttatgtgcgtaagctgtgcctcggaggtagataggtgtgtttccagaagactttttgttacatttgtcaacctaattttcctccatcggagtagtacattctgtactgcgcaatactagcatcagttaggaaagttggttcaaatatgctccatggtacgtgggtgtacctggagctgttctgtagtcttgttttgaatcttcaatttaccttgaagaattttgcttttgccagtgaactgttatagtccatttgaattgtttgaaatgctactacaaccggaaactattgctttggttctcatagttcagaactcaataggaaatagaagtctattgctgttattacatacaagtgtgataagactaacagactgacatttgattatttccttcttgtcctgcaggtcttcaagcttacaggctcccctcaccctgaagttgataggaacagaaggcagcatgagctagagacaggagcttccatgcagttgacagggagatctcttttaccggaccaaacctgaccggtctggttcccgttgatgagctcgtggttttgataactagcaagagttctctttctctggatggcctaagatcgtttttaggcaatggatcgagacagtggatgtagatactccggttgtggatggtgcccaggtgggcgtttaaagtggatgtagataccctggttgtggtggtgcccaggtgggcgtttaaagtggattgtactggccagttttctctcgacttagcggctgtgtgcatctgcggtttggtttctttggcagcatcgaataattttgtggtaaccatgattctggtcgggggacagttgattgaggtatgggagggatatgcatgagccgggcatgtgccgaccgattggattccgaatcttccattcctgatgccattagcccattattggatgcgaggtgacagatttgggcactgcagtgcggttggttggttggggcctgtggggactgggggtcgagattacttggacctgctgtgctgcagcggctttggctgaggtcaccgagcacgtgagagcatcggtgggtggcatggttggcctaccccggcagtggtggcggccggctcgggccacgagagcgccgcgccgtttgtggtggcgcacggctctgcagtcggcggcgggcccgttgttgcgcatttccgtgataaagatcaccgtggtatgtcgtattctgttatacaatgctctttttgtggattcgaacttcgaatatggagttatggacacgggtggtcatcgatggagacaacagtggcgaaccggcgatttcatatggctcagtgagatgctttaaggtacataacaatttgaggtatgcattcatttaatcatgacatggcatgattaaccttggatttgtgtgaaagctatcactataacgacctgtactcttggtgatattccccaccgtgccaatttcctggtatctacactcctcaacggatatgtcgtggaaatgcagcatttctaacccaacagatacagggatcatatttcatcctacaaagattatgtgaaagagatcagcataataatggaaatacgcttaaaaagtaaaatcatgaaaattccatgtgatagttaggatcgacaatgacaatgattataatcatatcacaatataagatatagcctattgtaatataagaatttgatgctctgttttataatgttactacctctttacttcttgtttttgaattattctgcctccacttttctttctaagagtaaattgtattttatactagctaaagcgtagcatgtttcgctttgcactgggtcgtttagcatatactttcactttacaccatgttgtattgaaataaggttcacttaacactacgatacatcatgaaaaacaatttcatgaactttacaaaatatggaagaaacgtttgtgtaacatggtttcataaattttattcatactttacagaatttcctcgtaaatatatgacgcaacctagtgtaacgaaacttgttcagatgtactctggtataaagagaaaatatgtttacccattacaaagtgaaataaggtacaatctaccaagtgcaatttattcttcttttaacagtcaggttaataaaaaaagagagcatatatcacttatatgcttggggtgaataaacataatggtcctgtcatttcattttgtcgaattttgggctcgtttggttctctgccattggtaaccttgccaattttttctgcaacggcaagaattggcatagccaaaaaaaaggtagtgaactaagccaaataatttggcaatgttaatttctttttgctacaaatcaaacagtagataatagtagtttttttttgtttggttgggtttggccacaagccaaaagagcctactactatttattatcatttagttcaaacaatactttccccctcttgtagcaacacccttgtgatttatgagggtcgtgcctcacataaaaaactctcggctcacacacacacaagaaaaaaaataacatggccttttaatgaactacactcaattttttggttcgtacttcatcacataagatttacgggttgcaaaaggctcgaaaagccaaacgagaaacactaaatattttcaataccaacggtaactccagcttaagcaattgtagtagctcaggcacttttgttaatagcatttgaaatgacttaggcatggaaggcacagtgacgccataaaatgagatggaacggaagtgaaatattcgaacattgtattttcttaccccgatacactaatctagtttgtccttctaagtcctcttctatataagagaactatcctctcaatacgctaatgcctacatgaacatggaccaaaccgtctcacgaagttatgaacctagctcacgtaccacattaatagaccaatggccctcttaatttttcatttagccataaatactactactaaatttagtgttttaaaataaggtgattttaagaaagagatacgaacctacaaagttactcccgctatgttagaaaatagaaactagctaatgccttctaaaatcaacaaagtttttgtctgttttttttcttccaaaccgttagaaaagaatccaacatcgattcatagcctcagaactcgctgaacaacattattaactttaatccaactttacaacagaaaatcagctacaaagtatacaagcctaccactaagaaagtaacaccttctgacttttaaaattagccacactactgcttgcacgacatgcttgcccgctacgccgcatgtgtttaggctagtgcgctctctctatctctctcacacatacatttatgcacgtattgcctactctgtctctctctattcctcctaattacttaatcaacaaatttcaaatctttttaaattatatttgatttgtgatgattgcaccattatatttagtgcaattgaatctttataatataataaaaatctcatatgattacatttctgatgaaaagtatatatgttttaacgatgaaattcaatgtttcatgtgtgggatacaaatgtttcaattgaaatcccactatgttgctaattttttacttgattttatgagggtttttttaatgtttcacttgttgggacttaatgtttcatgtaatagtttatcagtgttgcaaccggtattttttttgaatgttgaatctcttcaaaacatttgatcaagtgagctaaaatatttaacttggtgataaaacaattttctgtatgtgctgaagctgtcccaacgcctatctttgttcagtgttctttgtttccttcctatgcaacagcttaccatttagccaagaaccacctagcaattcaattcaattccattagtcaacaatcacatagcaatcactagttttaatttgatattcacctaagtgacttcgttaatctcaaaatatactggcacactcgttagatacacttatagggaatgcatgtatgcacatgtctatgagcgtatatgtcgatactgtgtttcgaagaaaaaaaatcatccaacaacatttgtacctctaaataaactttagtctcactttgatggatcacataggaatattttggcaatctattatataattaaaggaattgaaaaaggagcctccacgttcgctctcatggcctagaaattctcacattaatcggagaaaaagaaaaaaccagagtccatatagaaatacaatttagaaatagctgaaattcgaaattaaaaaataaggaatattagaagaggagactagagtccatatagaaatacactttagaaatagttgaaattcggaattaaaaaataaggaatattagaagaggagtatagagtccatatagaaatacaattaggaaataactgaaattcggaattaaaaaataaggaatattagaagtagagtatagagtccatatagaaatacaattaagaaaaaaatagaaatttggaattaaaaaataaggaatattagaagtagagtatagagttcatattggaatttaaaaccaactaaaattcagaataaaaaggagcctccacgttcgctctcatggcctagaaattctcacattaatcagagaaaaagaaaattcagagtccatatagaaatacaatttagaaatagctgaaattcagaattaaaaaataaggaatattagaagaggagactagagtagttattacacattagtagttttgaaaagttattgcaaaatttaaaattatgttgtcattgtaatatattttattaatataatgagaaaacatatatgctattatatgagagaaaatataatgatgctagccgcgcaatctgtgcgggccaccatgctagctagtttccctaaaagaatattgacttccaatttactatgtttattacaagcctatccactaagaactaacacatcctaaaattagccaaagacgcctcgtttccttcctctccaacaccactggccaacaatcccctagcaattcctagcctcagaacccaccgaacaaatcaaaccccaaaaccaatttgcaatggtcgatcatccaccgtctccatctgtgcacggagggattcattgtccctccggccaatttcccggccggccggaacggcggaacctcgcccatgatcacttgaaacacctcccttgctcttcatggccatggagacgacgagccaagattcgcaggtgatcatggggcggtacaagctcggccggctcctcggccgtggcacgttcgccaaggtctacaaggcctataagttggccaccggcgaggccgtcgccatcaaggtgttcgacaaggaggcggtgcagcggtccggcacggtggagcaggtgaagcgcgaggtggacgtcatgcggcgtgtgcaccaccgccacgtcatccgcctccacgaggtgatggctacgcggtccaggatctacttcgtcatggagtacgcgagcggcggcgagctcttcacccgcctctcccggagcccgcggttcccggagcccgtcgcgcgccgctacttccagcagctgatcaccgccgtggagttctgccacagccgcggcgtgtaccaccgcgacctcaagcccgagaacctcctcctcgacgcccgcggcgacctcaaggtcaccgacttcggcctcagcgcgctagacggaggcctccgcggcgacggcctcttgcacaccacgtgcggcacgccggcgtacgtcgctcccgaggtgctcctgaagcgtggctacgacggcgccaaggcggacatctggtcgtgcggcgtgatccttttcgtgctcctcgccggctacctccccttcaacgaaaccaacctcgtgatcctgtaccggaatatcacggagagcaactacaggtgcccgccgtggttctccgtcgaggcgcgcaagctccttgccaggctgctcgacccgaaccccaagacccggatcaccatctccaagatcatggacaggccatggttccagcaggcgacgtgcccgctcggcgacatgtccctcgtcgcgagcgcgccctcggtgctgcttgccagaaaggaagccagccagcagcacgacgacgaggaggacgatgggtttgcacgggagaagaagaagcggtccaatgtgatcatgtcgtcgccggtgatcgacgtgaggccctcgagcatgaacgccttcgacatcatctcgcggtcgagagggctggacctgtccaagatgttcgacgcggaggagcgcaggtcggaggcgcggttctccaccagggagaccacgacggcgatcgtctccaagctggaggagatcgcggaggcggggaggttcagcttcaagctgaaggagaaagggagggtcgagctggaggggagccaggacgggcggaagggcgcgctggccatcgaggcggagatcttcaaggtggcgccggaggtgcacgtggtggaggtgaggaagaccggcggcgactcaccggatttccgggacttctacaagcaggagcttaagccgtcgcttggcgacatggtgtgggcgtggcagggaggtgattcgccgccgctcgtgccggcggcggggaggaggccgatcacgaagcgctcttgatatgccgactcgatatcgaattttcacgttgtaattgatatgctctctgcttattgatctctcgtacgtgtttgtgaagggtgatgggtgaaccaccgtccagctgatctgtgagtttttaaaagcacgaattacatttacgttggcattccgctgtcagattaaactaatcagagtttcgtaggacgtgacattccaattcttcttctttttttaaaaaaaaacatgatattccatatcctcttttttagctgatactgatatctcgctgatcaaaactttgaagtagtgcatagaaatatttcgtagaacacagctatcgcaaatgtcatttttatttctaaaaaaagctcatctcggcaaaaataggattcttcccggctaactgttggttcattttgttgttagattctagggctccctcatgtgtggatctagaggtgatatgctcataggaataatggtggttgtattagagagcgaacaggagagagagaagagggagataggaacccatactggcgtcggtcttggagcttaatgtggccatgtcaacggtgtggcggtgtgagggcgtcgctaaggacggtattgtcggtgtgggcgacggcggcggcgagactgtgagcagtcccctcacttcagcgcggtcctaaattgaagggtattctatggggagtgtgtgtacacggcgaaccttggatcgcgtgccccggtagctcccccttttattgtgtgctacgtgagaagagcccacagccacgaaacggctagcgccccgatcacctctggagttcgcaactaatatttgtgtccttcaggaaaattatgcatccacgttaatatatcaacgtttctgttataatcacgtgaatcatttctattttagtcgaaacatggtttggccattttatcgaaaaaagatttgtgtacagaaaaatattactgaaatcaaacgtagactgaaatcctggtatattttaaggtggccgttagtgtctaaaacggtataacctgtcttttgaggttaaaagttctaaacctgcactgtcaattttttctttcccggtttcagtacgagcaatgatggattttttaaaatatattttaaaccttttaaaaatttcttttatgaataaatcctttagaaaaacttattccataaatgtgcccattttcttggcaccagggtcattggcgccgagattattgtctcagtgtttatctcctagcaccccatgataaattagttgcttatacgaaggagatcagtgtcaaaagacttattttgaacatttttagaaaaattattttacaaataggttctcggtatccttctcttaagcgtcgatcctctacatctcggcagttaggacgacgaggatgtcaagatataagtgtatcctttttgaaataagtttttcttatacaactattgatgaggacatcctctactattacccgctggcaaagacgtaaaagtcgggtggcgaccatgtgagtctctgaataatcccactttggttagattgggaggaggaaaccaccttaaaagggagagccacccttcctctattggactagttttttagggagattgtgcctttccccgagtgggtgtgactaagaactgttggggtccgggcaactttaagttattgggcctccgccgacgtcttttacttgcttagcttgggaggaggaagccaccttaaaaggtctattggactagtcttttaggcccgagtgagtgtgcctaaaaactgttggggtccggacaagcttaagttattgggcctcggctgaccccacttggactggattattatcaactatttataaaataagttttagaaaaccaaaacataaaaaatccagcgaggtaatatatgtgtgtgtgaggaaatgacttgtgcttttctctactacttaaaaattttaaagtgtttccgctgtccataataaaaataaaaaccagagaaaaaattttcgttcgagattaaaaaaaaaatgcccgtatatgattttcttatctgttgtactcgcgcaaaaaaccagttaacgcacacacgcgctcgctcagagtaggacccgtgtggcatgtatcccgatctcctctctgggccagctgggacatctacccacagccctcaactacaagtctaaaataggtcctccttcgccgacctgagccaaatgggcctgttgcccctgaccacaccacacagcttgtgcaggacgcaattatcagttcatgtgcatgcgtgaatgcggtgaaatgatattctttagatgatttcaaaaataaattattctatattctttctatttttatttttttcataatttaatataaatcttttcacccaatatctcagaccatatggaaattgactcttctttgagtatagtcccgattctccctattcatcaaggttgactctaaatcctcttcttcattcttagtaccttaataccttcttttgacaaatttctttttattcaaatttagtttaaaaacccttaccacttttatgaattatggtctaagaaattctccactattgtcctataacctaaaccaagtgattccaattttattggaattaattgtcgacccatcctttgattcgaaacctatccttaactttcttccaaatccaaattccttcatttcgatctagccactaatttaattcatgtggcttgataccctctttggcacaagaataatatttttagaataattgctcttgtgctaagaaggatatatttttattttccaaattaatctccttttagcctcaaataattttctaaatccatgtcaggtagtttgtggctaaaaatcctatttatttcctctcgctgcctctcttgggccggctaggccgatctgggtcgagagaagaaaagggagttccggcccaatttgaaaagaagatttttagaattttgcagataattaagggatggagtttgaattcaaattaatatttggaaggaatttaggtggctaacttttgaaatgaatctatttttggagataactttcaaaagagatatttcctaaatatttgagtgcaataatgtggtctaaatattaaagcactcaaatgggagggaggcgcacggcgccacagcccagatcaggatacagagcgagaggcgagagccctcgacctcgtagaagggtcgagcagctgtcgcggcgagccccgccaaccataggcacgcgcctatacctacgtgacggttcattggacagtgtcctttcccggcaaaactaggggtgtgactggaactgaactctcaagaaaatgtctctcgttgtttacagtttacatgttacttaaataattatgaaaaattttaagaaaatgtattaatatatgataaattaaataaacatgtaaattcaatttaacttctacatctcgcaactaaaaaaataaaataaattatagttaattcatgtatatttacagttgtcacgccccgaactagtcccgactggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaaggaaagcggaagccaggactaggaccaaacaacacaggcgcgacttgggaactaggccgaaaccctaaaactcatcgtagctggcttgctcctggaagaactcctcatcaacaggatccgcttcatcttcttcagcaactgagggggggggatatttatatagagcaagggtgagtacgggagtactcagcaagccatgggaattaagtgtttaatgcaggcttcaaggaaaggctgttgtttttacaattgattttatttgaacacctttctgaaaacaactaagtgagtgcttctcaaacgacacggttgagacagtgcgtctcgtccggtcggagtttgtgcaatgtatcagtctttagaattgatcaagattggcacccagccaacaactttcaaacggccacccgggccaacaactttcaaacggccacccgggcctagctgatcccgtcagctactgatttttcaaacatcgaacccctttccacaacagcaatttcacaagcagtagtcaaacaaaactacgctaggaatcacctcacatccgcccatgaccgtgggcacggctgttcgaacagtttgttaacctctgcagaggggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatattgtgccagaagcctaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccgatacgttccccggtccgcggttttggaaattcatttagttcgcaagcaccgacccaggtgtcgggttttccaagtcttttgtaaaacccaagttttacccaagttgtttttcagattttaagtttgaaggcgtccgtcgatactcgcacagggtgcacgaatatcgagacgcatctagatggttacaaggggacatgatataacaattaacaaagggaggatcaatgcaacaaattaggtatgtccgccaaactgccttgcagacgggacaacagattaagtgcgatcctatcagtgcataatatttttcaagcaacataattaaattttaaatataggatcaagatgttcaaaggtggcttgccttgctcgagatctggagcttgatcctcgaaatcctcgcactacgggtcttcgggctccgaaactacacgcgaaacggggcaactcaataaacggcgaaaataaagccctattaatgacctctaagcgtgccattagatagatctcgagatttgaggaattttggaagttgaacggagtcaaacggatttacggttgggaagatattgaatttctaagtttattggatttttggtctaaaggaaaaggatttaattaaatcctttttggaaaagaaaagaaaagaaaagaaaagagggagggaaaatagacttttctcgggcggctagggcgtggcccaagagaattggggcggtccggccgagctaaatgggccggccggcccaagacggtcgcgcgcgcgggagggaggagagagagcccgtggaccgggctcaccgcgcgcggtcccgggtgggacccgcttgtcagcggctcggctcaccgtgcggagggagtacgtggcgcacgcgcgcgggcgggggagggacgcggtgcacgcgcacggtctgcggaggaacggatgccgctggcccacgcgcagtcttacggttcgcggtggaacacgcgcacgggaggggctgaccggggtcggcccgtcccgacctcggctgggctggcgccgacgtggcgcctacgtggctgccacgtgggctggcgggaggtagacgacgacgccggccggaacggacggcggacaacagcggcgagcggcggagcgaaccacggcgataccggtgaaaacgagcacaccgggtggttgcacgagacgaggggagacgagccaacggctcggattcgccggaggaagcttgacggcggcgaatcgcggcggcggcaaccggcggtgggaaaaggggaaaacggcgacgaggtcacgaggggccgattcccggcggtgagagcatctacgcggccacgggaatccgatgctagcgtcggattgggcggagctacgccgagcgaggctggcgacgagcgggtgctacgaagctcgagcggcgacggcggcgagcacacggcgagcgacggcaacggtcggggcggcgccgactagctacggggaggctactcgtgctaccaccgaaaactaagggggggagatggagcgaggaggaagaacggagagaggcactaccgtgcgggtcggggcgctgtgacgagaggccgacggcgcgggagtaatctctccggcctcgggccggggaagaggaaggagagggcgcggccgaagtccccttccgcgtccttgctcgtgccggctcctccggcacgcgcaacgacgaacgacgacggcgaacagagcacgggggcggcggcaatggcgcggaggtgaatgggagaggaagggaaagggggaggctggggtttaaatgggcggcaatgtcggtttgggaaccgacttagggcggtcaaggcgcgagctggcgctcagcgcttgcgtccaaatcggcgacagggcggtgacgccggcgagagggaaaaaggaggaaaaagggggagagataggggggctcgcccctttcttctttgggaaaaggaggagggagcggaggcgtcgcggcagagggaggagggaggctctgcctccgtcccttggaggctagcgcgggagtggcggggccgaggcgatgacgacggcgatgacggcggggcggtttggagcggcgcgacgtcacgggcgacaggcgcgggctggcgcggcagagggtgacggcggcggcgaccaggcggtcggccactcggcacgcgcgcgcgggaaacaacgggcggcgcggctgggcacgcgcgctggctcgcggggccgagcggctgcaggcgcggcagagcagcggggccgggcgacgcggacggcgcagacgacgcggctcgggcggggaaccacgcgggcacgcgcgcgagcgacggcgcgcgggggccgtcttcgcgagcggggagctcgccagggagaggagaaggagagcgaggggaagggacactcggcgcggcgcttgcgcacgcgcgggcagagcgaggggaaagggaggggcgctcggcgcggcgctcgcgcacacgcgcgcgcggtgcgctggcggggcggaggggagcggagggagagggggagagggagcgcgccgggggaggggagagggccgggggagagagagagagagagagagagagagagggagagcgggagcgcgccgggggagaggagagggccgagggagaggggaagatgggccgagagaaattcggcccatcgaccccgggggaggcaaaatagacttttgcggaggaattgatttgggaagggtttggattcggaattgaactcgacgatagatcggggattgagatcttgagatggcacggacactagacgacaagcgaagaaacaaatttcgcaattagggtttttagagataattttcccgctaggcgccacgacggaacgggcgctacaacagtccaaattattttttctgtgaaacttgcatgtttgcgaagtgatacatcacatattaatataccttaatttttttggcatgggtctgggttccggtcatcaactcgaacggtcaatgttggctagatacctgcatcgttatacgtcacaagttggggtggttgaacaggaaaaacaacaaggcaggcgataagtttttctttctagttagtaataaagaacttttggggtgaaatccgtagatctacgaaggaacgccaaaagcgaaggcagctctctgggtccctaccgacgctggggtgcacggagaaataaagaagtgtggaggagaaacagccgagctcattcccttcgcttcctgggccttcgtgcgtggcgtgagttggaatcctagaaaagatcgattgagactctctccccggttccacgaagatctctacgtacttgtctagtccaggacaactgggatgattgagcaccagtgatttcgtatccggtcaaaatcttagcagccaaagcttcctgtcggaaaacaggtacgattcactagaataccctaattatttgagtggcataaaaacaacaagtggtactttcaagagttcaaaatccactctaggacataggaggaatcaccatggagattttttcatataaactgttcattggataagacggtcagctgccatctacgacatgaaatgataaatgaagaaagaggagggtgtgtttagttcacattaaaattggaagtttagttgaaattggaacgatgtgatggaaaagttagaaatttgtgtgtgtagaaaagttttgatgtgatggaaaagttggaagtttgaaaaaaaaagtttggaactaaataagggccaagttcaaatgggcacaaaatatccaaaatatgataaaacgtgctaatatttaagctagaaaccttaagtagcaaacagttagcgggtgatttgattttgatctatacttcaaaacgaagcatcgaatccactcgttgaagtagattgaatctatacgtacagcgcgatttatttttattttattttaacgaactcggttttatttgtcccccgattattcgcaccgactctgtttctgttgcattcgatctcccgcgggccgttgccgcgaagctaggtctctaggaagagatcgccggcgattcgcgatggttccgtggcgccgctcctcctcctcctcttccgccccttcctcgcggcccgcgcggcgtcccgcccgcaccaatgcgagggtctccccagacgtctcgtcggaattgtcgccgttggcgggggaggagggggcaggcgaggagaggtggtcggcgttggtgcccgaccttctggcagatatcctgcggtgcgtggaggccggctcagagaggtggccgccccggcgcgacgtggtggcctgcgccagcgtctgccgccggtggcgcgacgtcgccgtcgccgtcgtgcagccgccgctcgagtccgggaagatcacgttcccctcctcattgaagcaggtgacgaccgatcaataccctaacttcaacctgtattggattgccgtctcgttaaacttggtggatgcatagacaatggtccgttacttttgattcctgaactcgggaatccatgcttctcccattgaccccatccaatggatcctaaatccctaatgcattagttctactataactcaatatgagtaattggatggtattttgtctattaattctcaaataatctaagaatttttttactttgtaccttggggagcaaaaggtcagtttctctggacagcatgagtaaagcagcttccagcttgtgtgttccaatttatcagaggatcggttaaaacctcaatctttcatcattcaaatgtaaagtgcatacggtctctctttttaatatctatttatttagttgtttgctatgttcagtttgggaaactattgttgctattctgataagatgtatatttataccaatgctatcgctgcagcctggaccaagggacgcaccaatgcagtgtttcatcaagaggaacaagaaaaactctacctttttcctatatcttggattaacacaaggtaagcctgcatgcagttttgttatctcttacttaaacactatgcagaaaatattaactcttggccatgtttttgctctatctttgacaaatgatgccacaatggttataatttttgaaaagaaaatgttagtagatcttgtttcagaagaaaggatgtaatgttttattttctttactgtgatcattggcgaaggtgtcatgcatctatgctgaaggttatttgtgttcgaataagaatgacaaggaaactttctattccctgaggcttttagactgaactgaaatacagtgagggttacgaagactctgctttaacaaccttttagtgttatggaccgtttcagggaggagtttcatacctgcatgtttatgttttacaatggccatcatggtgagatagttacaaatggacattttgttctgacgcttgaataaattgacatgcattgttgtgtaaactgtattatctttttttcacgtccaatttctttatgggtggttttcctgttctagcagaactaacagatgatgagaaatttctgttggcggctcggaggtgcaggcgtgggttgcataaggaatatgccatcaccattaactctgatggtctcttccatggaagccagtcatgcgttggaaatctaaagtgaggcctagccgctagtaattcagtaacttctattctcaatttttttggtcaattttatattgcaaataaattgataacaattttcctgggaattccacgatgctaataatgacttcgcaatttttgtatttaggtctaatttcacgggaacaaagttcaccattcgtgattggcaaccaccatatgaaggtgctaaggcgttcagcagcagatccggtcgctggtttggaaacaaacacagatgcccactggtttccacgggtgatgtagaagttggagaggtatcctataaatacagtttactcagaccaagaggtccaagaagaatgagctgcagtgttcagtgtcccgtcctcaagggtactgcagtagatccacaagacggaaaacgacttagcaatagcatccctagttcattggttctgaacagtaaagtaccaagttggcatgagcatcttcagtgctggtgcttgaattttcacggccgggttatggttgcatctgtgaagaacttccagcttattgctccagtcgaaccaggggagccgtcggataagacagtagtactgcagtttggaaaaattgacgatgacgtttttacaatggactaccggcagcctctgtcggcattccaggcatttgctatctgcctctccaactttggcacaaagcttgcttaactttggcacaaagcttgcttaactttggcacaaagcttgcttgtgaataggtagctccatgcacttattattgttgtagtatgattttattgttttcgttaccagtaacagaatttatttataatactggctaggaggatgtctaaaatgaggctaacatcctacattacagtctttgttgcccattctgaccattttgttctcgtctctagccatgtcgtctaacaactccgacaagagatatagcttgtgcatggttacgggagttcatcagcactttggagctaatgcggtcaagatcgttgatgtgctgaaaagaatagtttgagtagtccagagtgaaaagatgggataaagggttttcaaagtgaaacaggccgaaagtgtaattctatatgtgaggtgttgccgtatcatgtcataatgcaacgttgtgcttgtgtgtttgggatcctattaaatctgtatatgtatccaggatgaggaagacttgtaaatctgcagtcctcagtgtagtcatgtatgactgcagaatctttaggtgcgataagactgttactacaatcttctgagtggcattctatagactgtagagtggaacatttccttttcgccaatgacagatatatagtttgtgcctaatggatatcgactcatcaagaagccatttccttttagtgccaatacacttatacacgtcatggggttcaaatagttaatcttcccaattcgcagcatagaacgttcagagaaccaaaactttctgacaaaagaaaaacgaccttcagattagcaaagctttctgaacaaaagacgactctcttccggagggaaattagctgttaaataggctactgggtccttgtacaccgatcactgatgaggacacatctccatttctgcgctttgcggaacatcctcgcagtgaatatcttcatcgcacatgccagcattgtcagaatccgtctgcatctcgtataacagaaacaaacattcagcaatgcgatatggttaacactaaacactggcgcggaagacatgtttacctgcaaagccgtggtccggccggcgctccagcccagcagccggccgacggcgtccgcgaacgcccggtgcgccatcctcctcccggcccgggcgaccgatccggcgtgctgcacgagcgccgcgcagccggcgaacctctttgcccgccctggcgccgatcccctcgcacacgaggcacaggaaccggcccttctcccgctccgcctcgtagaaccccctcaggcccgcgtccttctccagtagctcctggaagaaccgggccacattgccttcctcctcttcctcatcctcgtcgtcgccgtcgtcgtggtcgacgtgctcaccgaagaaggcgcggcaagcctccacggcggcggcctgcggggacacggccgccggcaccggcggctcccgagggggttccgccgccggcgggccccagccacagccccaggacgcggagggctcgggttccgggggcgggtcgcacacccacggcttgtccggtagcgcggcgcgggatggggaggccgcagcggcggcggggcggggcggggcgccgaggggctcccaccgctcgagatcgagggcgaggcgctcctgctgctttcgctccttgcgcttgcggcgctcctcgcgcttgaaggccgtcgacttgcccggccggaggagtggctggcggcggctagggtttggagcgagggaggcgtcgacgcggtggggctcggggtccatggccgtcgcgccgcgatgccgcctgccgcctgcggctgcgggtgtcgctgcttacgccttacgggccaagtggacaacctgggcctcggcctttttcccatgggggaccaaatcgagcgaagcgtggagagcgtggtcgagttcgggacagtgtcactgcttcgatgttgtggagctatcagatgttctgttcttgaaacgtgacagaacggatgtgtcaactcctgcgtatgcacgccctgtcacgtcatttaggatacacattttgcttggctatgcaacaactaaacgttggcacatgagctcacctaataaagaaactttactcgaaactatatagattgaacatcgaaaaacgaaaggcacgaccgtgcaacaaaagaacaacgggtaataatatggcagcactgagttccaatggtgcaatgtgtagaaaaggctagcaacagcagaaaatcaacatcattgcgtccttgacaacatgaatttaggtaaatctcaccatagatcattggatgggcgttgatacattcaccatttcaaacacttgcattatcatctattgttagttacattgaaaatgacttgtaattgtattttttttatttctttttatgtttgaactcgacaagattcacacatactgctccattgtgtctcataattcattattatttttgtccatcgtccattaatattataccaacgccatcccttgttgcacttacaccaccaactacgattttcggttcagttgcgttctctctaattatagatggaggagatgttcacgttgcttttctcttttaaaaaaaggaagttcaaagttaaagaaaaatgtcacataataggctatttcatatgttattatgccagatttgccagtataccatttcatcattaggcattcatatgttgcactatatcatttctagcaaacatgtttcaatgcacaagccataccgttgaaaattctaaccctattttctatatcccgttcgattttttattttaaaaatagcttggttcctttaatattttatcataattaacctgtttgtttgtgtcggtgatatgggcccggggtatcaggtttagagggaggaggctgccccccgatgccacgtggccctcccccgaggggagtcaggcctgaggtaggacggtggccactccttcccagagactggatggaggaggctgctctccaatgccacgtggccctcccccgaggggggtcgtgcccgaggtagggcggcggccactccctggccgagactagagggagaaggccgccccagacgccacgtggctcccacccaaggggggatcgggcccgaggtcgggcggcggccgccccctcccgtgactaggggtcgggctcccccgaccccctctctaggtcaccacgtacggtgggttaggtgtccgtcttcaggtgcccatctacccgcatttatggcgtcccgagcggttgcgccacgccgcatttaatgtggcgtgcagtgcactcaaccggtctgtgaccggtcaaatgaccgatgggactggctagtgcgcctgtgcgctgctcgtgtgtcaggcggcgtgcagcctgacatgtcccatcaaatagtgatggtgagaggttctcatcctcttatcccagccggagtcggtcctcccgctctggtcaaagcaaggctcccgtttcccggtgtaataggagcccagaagtcttcacccattaaatggtgactgacaggggcaccccccgtgtcaggcggcaagatttgatgggccccatcatcaagacgacgtgtgcttggcttcccaagttaagagacaagacatgtatttaatgcaaagattatcatacttctccactggagctaggttaggttgttgggcccatgtggtaaccccttgaggtataaaaggaggtccaggcctagtgatggaggggggaacttccgagcgaactcgcgcttggtgatggagggggggaacttccgagcgaactcgcgcttgggtctcgcaaccccaagcactggtgttctacattcaatcaatcctgcacaggagtagggtattacgcttcatagcggcccgaacctgtataaacctctttggtctgatcgtcttggaggggcctaaccccctcaagaccacacagtttcgctcaccaaatcctcgaatctcacccgctgcccccggttccctggtggaggagttcattctccgacagtttgttttttttttgttgagaattcacccctatgaacacacgcacgcaaagcacaacgccattaaatcctgaaaaattcgctcccacggagagtcgaacctaggatctaaggtgctactgagcctcttataaccactaagctacatgccctttcgcaattaacttgtttgtctgactaaacatcactctctcaaactacttcccaaaacgttttttgcagttggcggagcaagaaattatcaaagccaaaggctaagtagggctcaactaatggagtattttcctcgaaaaattacatggtgaattaagagaatttaagcatgattatggaggcaagcctagggctcaacccaagcagccctaggctttgcttgtgcccctggcggcaactactcatttctgctcactctcttctgcttcaacttcctccgtcccaaaaaatcagagattgtttggggcatatcagagattcagagctgttcgaaccgaactgaactttatatctgtttatgaaagaaaaaataagcatgcagggacattgaaattcaaattactttgatgattttacctactcctacttgtctggacatgtaaactgaagttcagaatagttcacttaatacacttaaattgtaggcttgctaatggagcatgatcttcccgaactgccaaaggccatctcacttggcaatatctcctaaaaggccagttgtacaggattgttaaatggatgataagagtatcgcaaatggcaaaacatgatgtgccattattagcgagtagaacacgttgcatccgtctactgtgcagtcaggatgaagtgcagaaaatatctatcactaactaaaatagcactagtagtgtcctaaggtgaaccgcacatattcagagcagtagatgactaccatctaatattatgcccagtgccatggctactctaatccctgaaatcagatacacaagtatgcaccctgtcaggaccaaatgagtgacgatgattagcatttgaatcactttggtgaacaggtgtgcattccacctgtagttcccccttttcaacaagagggcatcttggtccagatcgtgtgtcaagcatctaggttgcttcgttcatccgaggataccacttactacaacacctcgaaagcttgacaggttttcaagcttcctgctaaatgctaatgatatagtagtatgatcaatgcgaaagagtcacgagcaacgtggcaaatggaatagccggcattccggcaacaatgtaccaaataaaactgctgtctatcatggcatggcaatctgtacatgaaccagacaagacaaatgagagtattactggaatcacatgagaaaaagctcagggaggatatacatttgagctgacatgagaaaaaggcatggaagcctgacttcttgtgccattttattctatgatacatgcaattacatttgatgatcaactcaaccttttatggactaaagagtactacatgatgtatggactgtaaggaagcaaacagaagctatgctgtatagatatgtgatttacaacagatttaagccaacgccaacttaccttgagttcacagagtacgcaaatatggcatgcacaacgacaattacctatgtactggtatacaaaaaagctgctaatagccaagattgcgacagcaaactgaggggggcatccagggaaaatttgggcgctggcagatacatggccgtgctgtccttcaaggcattatgaacagatattggtcttgagggaagacatcatatctcagcatccaatgaattaggcctttctaccacctaaaacaagcagccaaaatgaatgttcagcaatggctctgtgacaattggaaatataagcaaaacagaagaaaaataagtattacatctgcaaatcttatctgtcgtggcctaggaggtttaacattattctcctttggctgaattgaggcccagggagtttgtttcttcgactgcaattgaattccaagaaaagatggcactggtggtttgcttgttacggatggtaaagtgcgagaaagccaagattctgaaggtgatcttgggactggtaatgggagtagagattgcaaaggcatatcccttttggaaacactactatcttccagatgaccagaagttttcccatcatccaaattcactgatcttaacttttcagaaggtgctaacaacgtgcattctgtaacttcagagaccctttctgtcaatggatcattatcttcacctttcccaatagggtttttcccgacaatctgttctccaagctgagagccacacccaccagcatccagtgatgtccttgaatccagtaacagaaccgagtggctagtttctgagtcaatatctccacggtgatccattgattctacatgcactggtctatccagccctgagctaatggagcttgacccctttaaactactgcggtctgatccaagcaatgaaccacgatcatggtctcttccaagtgagctggaaccattactactactcattttgtcttcttttacccctgttccaaaagactcatctgccttactcgatgatgacaggacaacatccctgtaatagggagacataccaccacctgcggaatgatggaatggtgaagacccattgcccgcctgcgagtcactccagaacgtcagctggtttgattcacttgtcagcttgctcctcccatcctctcctggacgaacatacttctgctctaatttgtgcttgtatacatcctcccaggactgctgcaacacaatatacagtgagatgttactcatccctagcactaataacaagtagcataaattctgaactcatgaaatggactgtgtaacatgtatctgcatcagtaccccgttggaagcacacccaagatgcttgttttgtgagctccgggcaagcggactcggcgcccctcgtcccctgcctttggatgcgaactcccggactctcccattcccccgcggcttgccacgcttcatcgcaggcattggattcagaagtaacaatgaacccttcacacagagactagggagcaagccacatcccttggaggcaaaaccccgggtgctatgcacatcatagtcatcgtcgtcgtcttcatcttcctgctcctcacgtctgggatagctgcaagacaaataattgggaggcaaatgctggtaggggagctggacgggcgtcctcctcccgggatcatcgccactgcttccactcgcgttagacccagctgcacgcgcaagctcgcggccagaattgctcgtggcgctggctgccccggccttccggaaggtgtactgcggggagcctatggccaccgctgcgcagccgggaggaatctatccatcatgatgccgcgtacgcctgcctcggcgccggcggcggcacgggaggtgggctctggcatgccgctgaggccgctgacgctgcagttcacggtgaaggactccgtcctggagagcgtgtcgagcgcgtccagaacctctcctcatcgtcgtcgtcgtcatctcccttccgcagtaccgccgccacggacaccacctgcttctccgtcacttccttcttcgcctgtaacaccgccgcctccgccacctgcgccctcttctcatcacgcgccggcgccggcgccggagcgccagtccgggaacaggcgggggacgcgtccacgccatggagtatccccacatagtgctccccgagggcgtcgtggtatgggctcccgtcgatctcatcctccacgccgtgctccagcggctgaggatgggacgcggtcgtgggcgacggcggcgcgcggcgggtgcgaacgctctttggctgcccgggccgctgctcccagacgaagggcaccgcgccggggtggcggacggggccggagttgaggtcggccttgtggtagggcagcgcgtcggcgtggcgcaccgaccggagcggcgcccccaggtcgatccgcttgcccccctccgccatcagacgatccgctcgcatcgctcacaaactacacagcgaagaggaggcgaagcagggggggacgaattcgtccgattgcttcggccgccgcggacgggagataggatctgcggcacggcgtgtggatggcggcgggcgaacactagaaaaggagaacgcactgcggtttcggtgcggtgcgagcttacttgctctactcgcggcggtcgtggggcaaacagatcagccgccagcgaagccgcctcctccactccactatagcgagtgcgagcgcgagtgcggagtgactcggcggggcgcggtgcggggggtggcggtgctcgcgcgtgaccgcgtgagtgtgcgatgttattgctacgcgtgcgacgagggacggtgacctgggggcgcgggcgggcgggtgacgactaaaaattgtagactttctgcgcgatctgcctaaaaagttgatgcgagcatggcagggggcagctacgagtatttttctactactaccatcactgtggctgccggaacatgcacggggacgggggccagggctgagctgcctcggtgcgaagcccgtggcattactgcgacggacatggacgtggccagatccgcgttcacgcttggcaggtggcggagttggcagaaactggttgccatcttggatgcctgcgtgtgaattggtcaattgggttagatctcgttttgtttggtcagttgtagcaaggaactagattcggttgggatcctgtttactataagagcaaggtcaatagtacagccagctgcttactccaattttgatccatcgcagctataggtaacattgtagccagtaaacacaataatcaagctatactactatggctcacacagtacaagaaattttattttaatctcccttctatccgcactctctctctctcctaatcccctgttctcgccggcgattgcttcttaggaactaggcatccaagctcatccatggccaaaaagatgaacaaatttatggctatatacacatccgttttgtactatacatctgctcatctacatggaaggaatcggtacaaaacaatatatacacatacgtatgctactacttcgcttaagctatctgatttttctagagaaagatgttattctattttctccatcagaaaatataaacagctcatcgtgcaggctcacgctgcccgtgtagctggggatagagcaaacgggtcaccggagccgagctcgtcgtccggcgactagcgttgagctagccttctgcacgcggaacggtggaagatagaagtgaagcaaccgggcaaaccatcaagctgattcataagcacaagacctcagaactcaatccaagctttgtgctctcttggtctctctcttctacttgctctccatggccacggtagacgagagccgcaacatcgaccgacgagggcaagggcaacgacacgatggtggcagccgtggccgaggcggacgaagttggcggcgacagctgcagtggacaaggtcggcggcagcggcatacagaggcgacgagcatggttgacaaggacgagggtagcggtggtcgtagtggacaaaggcggcagcggcggcggacgcggacgtgcgcgacgatggcggcgcggccctggacttggacgctccgacgcatgcaacggcgagtagcacgggtgcatcgcttgctacgggcgggcccacgtcctcgagccatgcgtacagccgggcgactaattagtcgcccgcttgcgccctctcccctccagctcagcagaaaatcctacatggatctcctatcgcctattattgtacgacccgataataattggtttgttggttgtggattgattcatgtttgtaattaatttagcctttaaatttcaaatcaatctagcatagaatgatgatgtgtactgctaatccgtcaggcaaacgcatagtcgttctactgctaaaatcatgccttgtttagtttcatcaatataaaaaaaacggtgtttcgtcgctgaatcaatatttctactaacatttaaaaagtttcgcaacatggacaaaccaactacattaattattaagttccaacaacttaaacattaaaaaaattataaaatcaaaacttaccatgtgcaagggagaaaacattgattttttaagataatgaaaagaatcttggtctttacatcaaagaagctacaaccgaagaaaaaaaaacagtgataggggttcataatgtcaattaccagaattactccttagcggttttctctattttctcaaaaaaaaaacactcatatccgactaaaaacgatgaaatttgaataggttttataaaaaactgaaattcaatgttatttttagtttaactgatgtaccgagtagtttgtcagttcgaacagggttgaaatctcaaaatttggcagaaaaacgaccggtttttcttcttttttttttagggaacgaccggtttttgttggttttatagtgtctggccctggacgcacatggtgatatattctatgatagtggtgatgagttaccgcgtcagtgtgaggaagaaacagtattgacatggtgagttacttggctactgcatgtaagactgttacttcaaaccataggaagacaaaactgcttgttctgtttgggattactccctccgatacaaaatagaatttaaattttgttcaaaaatgcttgttaactttgaagcattttttgtcacgtcaattatttctaatttaaatttttctcggtcatgtctctaactaccttttcactctcatccagatagtatttaataggggtccaataatcatttctcgtaaaccttaaattttacaaataacctggaacaacaataattctataacagatattgtactacttgtcaaaactcaactcgatacgccatgtaggattgtccgccgcatcagaaaatggcgtgtcatggcactgtttctaccttacagcggcataactatacgttggtaggtactgcgtcgcaacatttttcgttatcgcntagtatgagtagatacattgtcatcttggtcattttcatcagcacgtgcaggtcacttcagagcaaaacccctttcattgacagcatggagtgaggattgaggaccaagggtgacgagcgcgatgaattttgtggcgatcgatcgacgacactaccgagctaggggtggagaaattaataaagaatcagaatttagaaatgcccattagtccattacgttgtacatcaaggtgcatgtggttcgtttgaaaaatgaaaatcgcgctggacaagacgaggcgttgtggatcgatcgcttgaatcgtcgacgactccggcctaagcaaccagatgaaaagtggtgcgttcaataggctgttgactaataaccagtagttgactaaaaaaaaaagagaaaccaaatgcatctctccctcatccatcggttgcacagctggaggcttgcagcatattaataccgagactgtctatatatttaccgataaattatttttttcaaatataattatagtgtaattatattgtatatgatatttttttgaacgatacggtatatgatatataattacagtataatatacgtgtaactacgctataacgggatgtaattttgaaaaaatcgcgttagcacgcaacgataatactaacacgctgctcgcacggagcaaagtatgtgggatctgtctctcacacgttaaggtggagttattattcaatcactctgttgagaacaagcccgcaagatcgttgcctcctgaatctgccgccaaagcatgagccattggccaattgcacgttgcatctgtcgcctgcgaacgtcaaacaaacagaatcacgtatccggaggttaatccaacggttaacaaaatcgataaatttcgaggaggaaatttgtcgacacacatctatcgaaaccgatcggcaacacgcgtcacctgtgttcatgcccggcggttcactcgagcggcattgcaattgcagcaagctagcccggcaggaaaaggaccaggcacaccttgcatgagtgccccgcgggtcaccgcggtctcgcccatgtgtgacggtgtgactgtgtgagccgatcgattcggcacgtacgtacgctgtacgcccgcgcgcacgggacgggagaaggaccatgaggagatcgaccgaccgaggtatcgtgcgcttgaatcaaccggcaaccattcgttcgctcgttaaacctgtcgggccacgcggtcccggccgccgggcgccgtccaccaccacgcatgcatcccgttcccgtcccggcgtcccgcccccgccccgtgagcccacccactgtccgttccacctctcgtcgcagcgccggacgcctccgtcttctgttctactgccaggtctgggttcttcttcagcagtgtccggtagtttcggttgccccaccgtcgggtacgtacgtctgtgagttgtcatgggaataaacagctctgcgcctagtctgcctagtggtgcaccggtactactggtaccacacggagagagagagagagagagagagagaatttactctgcttttctcaaggagcacggaccgggcgaaaccgatccgtgcatgcgaagtgtgaactcctcccccgagttcaagtcaccctgtatttttatcctcaagtcaccgtgtatttcaccggggcgaaaccgatccgtcgatccgtgcgtgtgaactctcctcttttgaagtcatcgtgtacgctacatcacggtcgttgtacaaaacgtagtctttctacaaggagtttgctcgagtttcacgagagggaaaagaaattggtcgacatgcttcgttttttgccttgattatcaggtactgttcgtgttccctgatctcgaggaagaaagttttatgataccccctgtctcttaggttcgaagcaatatgaggcccggcgactgttggggctctagatctctccagcctgtgatcatgctgcaattaaaagggtcatagactcttccttgtcacgaaataagtatttcattttcctttttttttcctaacttttgtttgcagacgccgcatgtgccaacttagcaaatactacttcctcgacccaatgtagtagtctgtagtactacttcctcgacccaatgttgtttaggccctgtttagtacctaaatttttttctcaaaaacattacatcgaatctttgatacatgtatgaaacattaaatatagataaataaaaaactaattatacagttatggaggaaatcgagagacgaatcttttgagcctaattagttcatgattagccataaatgctacagtaaactacatgtactaatgatgaattaattaagcttaaaagattcgtctcatggtttacaggcgagttatgaaattagtttttttattcgtgtccaaaaagcctttccgacatccgatcaaatatctgatgtgacacctaaaaattttcttttcacgaattaaacaagccctaattgtatcagacaacaaattcattactaaatcactaaccaattttgcgttgtacaatgtcatttaaaagtgacaggaacatgcccattcagatttcttgtacttgaacctgcctattcgggtttaagtccctgactcgagacgtgtgtgtttgatattctctcagtgaaaagcgatacagtgtcgacataaaggtgttttcactatcttaagacatgccaatctatgtcttatatgaatagagcatgagtgcgtgcgtgcaaggaaacagatgacatgatccatgatgcattgtatcagcccatatggaataagtgtactatgtctccctcaatttatgccctggttgaattggatccctcaaccgcaaaattgggtatagcccgtcctccaactcataaaaccattgcaaatcaactcttcggatggtttgagagacggtttcgtccgacgtggcatccttaaccccttgactagctgaggcagcacatgggccccaatgttagtgccttgtagtacccaaagtctactttacctcccctgcattcttccttctccagccgatctcctgttcgtgcctatgcactgtagtgccgcctctccttccaaattagttgcagaaatcgattcctctcgatctcctatcctttcccccaccaagaaaaccccatcaatattcgtgttaaatcctgcgaatttggttcgttcttatcctaacaaactcaagattaagcctagtttcctatcgtcaaatcccgtttctagcctggtctccctctcctccacctatgtatagcttgcccaaggtctctcttccaattccaacaaccctagtccaagttcttcccatgccctagctgccttcctgcgcttgctctctcttcgccgaaggccaccgctccagtcgagccgcgtcgccacatccgtcgttgcctaaggtggctatcgccaccgtcgggtttgcaagacgaaggagaagcttggctgcaccttcgcttcgcttggacatcgccgaaacaccgccgtcgacatcaacccgagggcactgccttttcaagctcgctgtcggccagcggccactcttgtcgccgctcgtcatcgtaattgcgtcgataaggatcgtcgtattcccctcttctcacatgtgccctcgattttctccaccgcacccttgttcactgtcgcgccatggccaccgccgcgcaccaccaccgcctttacaaggcatttacatatggggtccacgtgctgacttagcaagtcaacggagtcacatgccacatcggacataattgtcccccaaaccgtccgacgagttgatttgcaatggttttatgagttggaggatagattatacacggttttgcggttgagggacacgacttaaacaagggcatgagttaaggtagtaaaaatagacttatttcattccttatagctaaatacacctatgtctgtcggcctcaagcccacaacgagtaatacctactgccacgtctttaaataggccaggccgtctttcattttcagcccagaatctgggtcacgaatctagtttggccctgatacttcaactcgactgaaaaggaataagttcatctgaggtcccttaacttatcagcgaatccgattttcgtccttcaactagaaaaccagatacaacaagtccctcaactgtcaaaatcggtgcagattatacccctcggcggtttggacggctgttttgactgacgtggcgcctacgtggctaatttgacttggtctttgtctgatgtggcgttgacgtggcgcttacgtggcaatttgatccggaaaaataaaaaactcttcggacgtatgtcagtttcacatagaaattaattaaaaaatattggggcccacatgggccccacctgtcatcctcagccctcatcttcttcctcctctctgcttcgctcgccgctctcctctacttctaccgcgcgctcccttgcacgccaccaaccatccatcgcttccaaaaacccaattgaattcaaccgcactgcgccaacaacgcgcgcgcgcgagagcgagcataacacgaacggaaaccagccatgaagcggtagcggtgacatactgacattagcttgggtggagcgtgcgaggagcacgaggcggtggtgagggagctgacgcgcaggcacgagctgacgacgtgattgcgggcaggggcaggggcaggtcgaggccaccgccacattcatcctcggggaggtctcccgtgccttcatcatctgcctctccatcatggccagcgcctccccgtctacctcgccgccgcggctagatgagacgccgccgccggccgactcggccgtctccgtgggcgcctcgccgccaccactaccaccacgcgcggcaagagaggacaacgtcccgcgaaagtgagttcttcgcacgtgctgtactactggaagcaaaaataaatgccgcagaatgtcacggtctcacgtctcaccgcaacagattcaagcgaggtagagagaaagagagagagttggagaagacttggagaggaggaagaagaagaagaacagagaggagagcagaaaagaacaagcagagagattggaattagattgaattgtattgtttacatgattcgatccccttttctctctaacctgccggcttatatagtaatgcactaacaagcctctctccctgacagtggcccagcctctatctactgggtccacacactcttaggaaaacggatactgggttgtgcctcacgcttggatcgcctaacaggctgggccgctgcagtttgatttgaatccagcttcagagaacttgccgccgtgacattccctccaccttgagacgaagcttgtccccaagcttcagattgaggaaaacgaagacgcagctcttgagcattctcccatgtgacaacatgaggatcatcccttgactgaatcctgggcaaagaaggatacagtgattcactgggcgccaaagctttcttgagttgggaaacatggatgacaggatgaatcagactagtggccggcaaagccaatttataagccacttctccaactttggccagaaccaggcatgttctggaacaggtaatggttgtaacattccagggtatttgacatgttctgactttgcttgctgacagatagaacaagaattcacaaactgcatcacagtagaacgtaagtgaggccaagcaaacaactgtttaacccgttgataagtgacatgtataccagaatgaccccctactggtgcagtgtgaaggttggccaaaatcttttgttgaacctgaacattgttaccaatccacattatgttcttaaagtaaagaacaccatccttcagagtgaagtctggaacagcagctggactaatacacaatgtttgaaccttactagaagcctcaggatcagacatatagccatcaaccacctcttgaatccagttaggaataactgaggatatagcagtaagttcaaacactttatcagcagatggacagcgcgataaagcatcagcagctccattttcagtgcctttcttgtaaatgattttataccgcaagccaagcagtttagttaacgctttatgttgccacggagtagtgagtcgttgatcatccaaaaaagatagactgcgatgatctgttctgataaaaaactctgcatgggcgccaatgatccacagctaacatgatagccaagctttctttctcataagtagacaacccttgatggcggggacccaaagctctactcaaaaaggcaacaggatgatttttctgcattaatactgctccaatccctttatcagaggcatctgtttctacaataaaaggttcattgaaatctggcatcgataatactggagcagtgattaaggcatgcttcagagcttgaaaagcctgttcagtttcagcagtccaaatgtacagttggcccttcctcaacagattagttaatggtttactgagaagtccataatgtcgcacaaatttctggtaataaccagctaaacccagaaaaccacgtaactccttaacagaggtaggggtaggccaattgctgacagcctgaattttatcttcatcagtcgaaactccattaggactcataatgtgacccaagtaagccaatctttgttgagcaaaggagcatttgctcttcttgactttgagctgatgtgtagtcaagatctgcaagactatctgaagatgcttgacatgctcaggaagagtcttgctataaatcaaaatatcatcaacaaaaacaagaacaaatcttctcaacaaaggagacagaatgctgttcatgcaactctgaaatgtggctggtgcactagtgagaccaaagggcatgactctgaattcaaaatggccatgatgagttttaaacgctgttttgtgttcatcaactgactgcattcgaatctgatgatacccagctcggagatcaagtttggtaaaccactgagctcgtgacaactcatcaagtaactcatcaataatggaaaagaatttttgtccttatagtaaaaccattaatatgtgggtattcgcaccaaaaaggcagtgtaccatccttttttttcactaccaaacctggtgatgaaaaagactagacctaggctaaattattccttttgttaacatctctttaacctgcatttcaatctcatccttttgggcaggtgtataccgatatggtctgacattcactggcattgctccaggaagaagaggaattgcatgatcaaacattcttgaaggaggtaatccagaaggatcctcaaatacatgggcaaattgagaaagcacttgttgaacgacagaaggaatggattcctgttctgaagtttcagagacagcacataactgaatgaggtgagagattgcttgtctgtccttcaacttctgaaactgctgagaagaaagccgtgcacattgctcaatttctgacacaattccttgtaatgtcacagattgatttttccaagaaattgtcaaagttttctttacccaatccacttgcataggactatgatgcattaaccaatccattcctaatatcatgtcatagcttcccaaattgaggaccttaaaattagtgcagaagacccatccctgagttatccattcacaattaggcacataagccaaacaagagaggattgaaccattggccactttcaccatagttttagcagttaaaggaaatacaccatcaattgcctgagccacatgagcactgataaaactagctgtaatgccagaatcaatacctcctttccttgtatatatcccaacatgcgcatacatcccacagattcagaaccatgcaaagcctgaactgatattgccattaacccttgactgtctacagcttcagtgccatcaacagaaacttgatctgacattgaatcaagctgcaatgtcgaaattaattcctgaactgcatgcaattgcactgtattagcacacttatgagtgggagaccatttctctgcacagatataacacaatccttgagctctgcgttaagcttcagaacagaaattttgtcagaactgtttccaatcttagaattattagcagctttgcgctcttctgttcgcatcatactgccaccagataacccacgattaggcggcaagggcaaggtcaaagcactcttgtaagcaggatttggtcggaactgcaacccagagtcactcttttttagatttgaagctgacaccgtagcagattccataattacttcctcttgcaaagaagcaattgccaatgttgtctccaaatctttgggctgttgaataagtactgcattcataatctcccgaagcaatccctcagtaaaacgatgagttagatatctcatattcaaatctgggtcataagctaaaagttgattcatcaactcatcaaacttttcataatactcccaaaccgagcccaattgtttaatgctgtccatttgtctaataagtgtttcatgcttgtctctatcaaacttagcagacactgctacacaaaaattctcccaaattggaaacctaacatgagccttagaggaacgcaaccaagatactgctcttcctgagaagtaaatggttgctattctaacccaaagccctgggaaagtgttattcacatcaaaataatgctcacatctcattctccaatccacaggatctgaaccatcaaacttagggaaatctaatttaggaaccctatggttatactggcgcccaaactgatccccatcacaatccccattcccgaactcaaattgctcaaaatttttcagagatgtggaaggagattcatacgtacccttgaccggagtcgggcccagggtggttgccactcccagtgcccttccccggtgttcatgaacttgtaggcggccactggccatcttgcttccgccttcagccgcagcagccgcttgagatggaatcggcggcgtaggcagcaacggcgccttcctttcctcgtctgtcaacggaactcgaggggaagacgtcgttgaagaagtttggttcaacttgttgacaagatccagttgttggtgaagttcgccgactgactccatctgtggcctccagtgactcacgccttggtnnnnnnnnnnnnnnnnnnnnnnnnnnnnnnnnnnnnnn

SEQ ID NO: 11025 - DNA, 365 bp, Oryza sativa
ttaaagttgattttggggttcttttatcaaagtttatttttaacatttgcttttacatcgctaagaacatgtatataaaagttttattcacaaattattttccggttgtaaatatgtcgttttggccgtctcggacccttttactttccgtttcgctttagtttcctgtcgctgtgggcacgcttgggacccttttaccctccgtttcgtcagccttcttttccttgggaaacgtcagtatgtattggtgaaaccattgactgactgtatattaatatacagtcgccgggccggccggcgtatgggcgctatatatacggaataaatttatcaagattctggacattacaaaggcaagttgggcc

SEQ ID NO: 11026 - DNA, 739 bp, Oryza sativa
  unsure (1)..(739): unsure at all n locations
tgaatgatgaattgtcaatccatctcatctctggtgactacgaagacttccaaaaactagtcgacaaggcgatccgcttgaaggacaagcaccgaagatggaaagcaagaagcgcaagttggttaatgcgagtcaattcgtgttgtctgatagtgtgtaggtaacttatggtcagtcttggttaatggtgaggatcgagactatgctcagggagagcagatgtccagtgcggttgggataccatgtgagaaagcgactagagttaggatttttggaggtcaacttcggtcaacgtgggatcgggactagacaagggagcagttgaggtgcaaacggtcagtgataatgggtgacgaagttggatatgagatggcacatagtggatggacaccgtgtgggagagatctttgcaacgggcttcacgaggtgtttctacattaagcgttggtgttcgtgaaggaaaacggaaggaaaactgttgaggattatatggtttctacagtgcttgatgtactgtagcgatggtactgtatcatgcagcatatgcatagaggattatctgcagctgcggtatatggaagagatatttacaatttggaaattgtagattggtttggaaattcagcaatagagtcctattgggaatatgagttgtatttctactttgagtaggatcgnnnnnnnnnnnnnnnnnnnnnnnnnnnnnnnnnnnnnnnnnnnnnnnnnnnnnnnnnnnnnn

SEQ ID NO: 11027 - DNA, 673 bp, Oryza sativa
  unsure (1)..(673): unsure at all n locations
nnnnnnnnnnnnnnnnnnnnnnnnnnnnnnnnnnnnnnnnnnnnnnnnnnnnnnnnnnnnnnnnagaaaactaattagcatatgattgattaagaattaatcattataaactcgataaattggtttatatatttttttaaacatcttctatataaaatgatttcgaaaaaaacaccatttaacaatttgaaatatgtgttaatggaaagcgagtaagttgaagtttagctgctaatctgctgaaatgaagtttagctgctgctgctgtccccacatgggtgtaacgcccccacggatatagcctgactaggtgggacagaagcaaacttaccagattaaagatttactcttttttttggatgtacacatagttggacagctagctatcatacgcatcagctattagagatttagagctatctcttgctgacatgtgggactaccttttttacagatatcagctggtgatattattaaatttgttatgttatggccctattggataaccccacgaaagtggcagctgccgagtacaaatattgagtctagcatagtttaaactacgcgagtaggaaacaaagagctaaactctcctcagttccaagcgcagccaaatcacctcgtcaattattctcgtactggatgacaagtctgcactgtgctgattgcaaaa

SEQ ID NO: 11028 - DNA, 808 bp, Oryza sativa
ctccctccgtttcacaagctaattcattttaacatttcttacattcatattgatgttaatgaatttagacatacatcaatatgaatgtgggaaatgctagaatgacttatattatgaaacggaggaagtaatatgcaacatgtcatagcaatcgtatgaaccgtacacaggtcatatataacaagatgcaatacgccatttgacttatgaaaaggtacgtagcttagtgattgtattgacctaagtagtacccaaggttctgagttcaaatctccgtatgattgaattttagattggcttatttgcggggctaagttcctaatttaaatggccgcatatatccggttggatgtagaagctaggtaaaaaatacccttctctaaacaaaatctctttgcctttttaggttggcatacgtgagatgcctcgacttcctcaatattctacatcttcctcctatttgttccgatgtatcccatgtttattcacccttcaatgctcgatctctctggtctctaaggtatttgaggatgtcctacttgacctgtcgaatctagaattaaccgatgaacgttcaccctgatagagtgatgggtccctcctagttcatcgttcagtgagatcttgccttgttatggcgtgtctccgagtgccgccactagtcacatataacataatcaaggtgtggtaatacaatttggtgccaacacggcaacatggtaaaggccatttctgcatttgaggatgttctacttaacctgtcgaatctagaattaacccatgaacgttcaccctgatggagtgatgg

SEQ ID NO: 11029 - DNA, 613 bp, Oryza sativa
gatgaatcttttcccatgatatatgttgtcctaacgaggcagacacgtttttcatatctttttttgcatcgagctggttttaggtgaccaaccacatgtaagctatatttggaatgcaaccacccatagcagacctgattaaagcatttatgtggtgcaagtgattcatattgccgatacatttttgtgtttttaatgaaagaacatacagtttgttgggacaaaatattatcttagcgaacatgggacaaaatattatcttaacaaggagagagctcatccttgaagacctgtagggagaaggcgggagcttgagtaaggaagaggatgagaatgggtccgcaccaccttttgcctacttgggagtttaggctatgaattttccattagttgaccgttaaattcttatgagaaaagcccattttgccctttgctttgaagaagcatataaattaatagagtgtattatcggagggtaaaaatttgttaaatgggactattatatttatgagttagttatgccccatattatttgcgataaatatacatttagagatgacataaaaaataatacttaattattacttattgaaagttgtgtatgttgcatata

SEQ ID NO: 11030 - DNA, 5782 bp, Oryza sativa
  unsure (1)..(5782): unsure at all n locations
nnnnnnnnnnnnnnnnnnnnnnnnnnnnnnnnnnnnnnnnnnnnnnnnnnnnnnnnnnnnnnnnnnnnnnnnnnnnnngttggaactatatacaaacacaaccaaagaaaaagatatgcagtacaaatcagaaatactgtagcattcctgattaaaaaaaaaggtagactatcatttgtaagggaataatggtgtatgaaaaagcaaagctagcgagggaactggaggcaggaaatggaagatacatgccaagcatacataagtgagtgtagaaaggaacgggttgtggcttaactcaccaaaagtgaccatgagaagcaaactacaaatggaccctgggcaaggcgacaacacatggttccaatatcaccagatctggaatcgttaaacagtggtggtgccgcacggccgacagagcatcaagctaaccagcacccacagtattgacaaacttgagcaccttctatggcagcaaccaatcctttttatacagataagacaaaatcaattatcatatttgatattcatatttataattagattgcattttttctcttttttgaaaaaagattccacttatctattgaccaacacttcaaagtatcacctagagtagaaggcaaactgaagagaaaaacatagattttaacaatctttcaccttcttgtacatagaaacacaactgtaatgtacattaatctgctttttcattagccgatgaggacggtaattttaacagagctaggaagatgcaaaataaatggctcagcaaaaaagagtaagttgtgtctcctaggcaagaagttttttggatttaaatcaacagcaactatgaaattgtaagtcccttaaatataattgcatgaaagcacataaaccatttcttgcatacttaattaaactcctactcttaaacccaatccagtctagagcatacattttcatttaataaagttttcccgaataagtaacttgagttatgtcacaaataatgttttcactattttcaagtcagggttatgtttgccaggcaaagtcaatagggacccccaacatccaaagcaacattataccagctcggaaaaaaatctgagcatgtcaggttttattggctgatgtgcactgagtaacataagaaaacttaattcaccatcatttcacataataaacatctactgaatatgccagtattttacacggcaaatataagaatgctagaaaaagaaaaataatttgattcaccatgcaactttctccgcttgaacttttacagccatggttactcaagctgtcgatccacccccaagaagggtcatcatgctggaacaaaagtagtccatgcataacaataacttttcagagaataaatcatttcataggatgaaccatagaaacacaaagcacattcaacctaaaaagagcaggtgtgtaggtgctcgacggcatggcacacaatgacgcaacctcaaactggcctaaattataaagtggttatgaacattcagattttgcatttgattctgtagagaactacaacaaatagatagatggcacctaaaaatcggatttaaatatgcaaatataaccagcttattcactacttagaatcccatgttatagctgaatctaatagttacagaggttcgcaggcagtgatcaagaaatatatgggggtatcaattttaattaaaaaacatttgcagttctacaggaaaagatttgccatctatatatgtaccaagatttcaagttctaccaagaaaaatgcagagtccctaagcagcgcatgtaggtgtatgaatcttggtagatatttgcacgggccataccattaatctctgacctccaaccattatatatatatagatatatagatggcaagcggctaagattgtggcaataagtcaaaagcagctcatgaccatggacaagcaagaatagaggaaaggtttgcactcatctgagaaaaaacatggctggcaggtggtagacacagaacgggaagcagatcagtcatgcatagatccaacatgaaggggatttcttcttctttttttcccttgcacacatcagaacgacttccccaatgggtcaaggggtgaggcaacagattgacctccttactatcgaactccatcaccgtgccgcggatctagtgccacgccgtccgctccctctgcttgctgggaggagagcggtgggggagtgccaggagatgggggagaacaggggagagctcgagggggaggctgtcgtcggcgaaactccatcaccgcacccaaatccaatcctgcaccatcgagtcccccagtccccttgctccactgggaggagagtgatggagggagccccaggagaaggggaggataggggagagcgcgaggagcaagttgtcgttggcgaggagaagccggggagggaaggcaaggcgtcggcggcgcaagagcgggtaaaggaagagaaggggtgggtgaacagtggtggctagggtttgaggggaatggagggaataggaatgttctgttttgcagaaaacacccttactttccttttttcagagcgcggtcctatatttggaatttcgtctccttcacgtaggatataccaagacattgagggcttttacaaaagaatactaaatacagaaacatacagtgagggacttaagaatgattatcaagttaatcaaggacttttttgcaagattgccagctccagcgcccagcgtggacatcacgggaagcgaacacgccagccgaaaaaccgcagaatcgctgtggtgcgagcattctatggtcctctttaatatctccgatatactgcactcttgtatattcccactggaaagagctgaaatttatatggctaatatttatgagaaattttcttctattctgctgtttctatatgtacaaaagtactatgattttattatattaattaagtattttagcacaaacagcgtcttggagtgcagatccatatcaatttatgcgattatattgtaaactgacataacatttcttattaaaaagacacaacctcataacatcaccatactgtttaagacttgagtctaaaagcatgtaacttcacttaattgcatcaaccggttttcccaggggttggagagctgctccccatgctcgaaatatatttgcatgctagcaatttacagaatatgaaataagatatgaccaggtcagaaatcaacctaagcaagcacaagacgccactagcacataggggtgaaaacggtacggaaactttccggattccggacttatttccaaaacggaatctgttggttggaattttttcggaaatggaaacgaattcggaaatattttctcagaaacagaatcgaaaatgataagggcagttttgtcggaacgtggaatcagtcggaaactttctggaaattttctcggaataccctggattttttttagcactgaatagtgaataccatggtgtttggcttttttatttaaaaaaaaatatttgttatgcaaatctaccacggtgtttggcttttatttttttaaaaaaaatatttgttatgcaaatttgaagttacataagaatatattttttctgcattgggatttatcaacaacattactctcttaaatatagataatttattccatagatttgtgttttgtgatgtactgttgagacttaacaattggacttatatgattgtgttttataataaattgttgaccgttgagacttgagaattgaatttatcagtttgatgggtttttgtattctaataaattttcgttaccgtattcgcgccggttcgttttcactctgttttcggtttcgataatattcgattccgtttttgtatccagcgtttccgattccgaaaaaaaattgaaacgaaaacgataaagatggtttccgtaccgttttcacccctactagcacacatgttgcacaatggaaccaactcctaaatccaataaagcggcggttgggttcctaatatacttgagggcaacaccttggtctccatgtgcaggaaactttttttcatgaaatggttttcccaatccgatgttataaaactgtaagagcgaataaatagtaatatattgccgccttgatatagtttctatccttgaagcccaaacatatatatcattggtagcactatgcttttgtagggttgcatttcatggtatcctctgaaagaaataaatgagacaactataattgagtagttaatacaaatatatgtatgcagttatttcatattgctactatctatagagcataacggagtaataataatttacgttaatcaatttaagctaatgcacaacaagaaaaaaaaagtttccaattgtacagcattcactattttacggggtgtacgacattgcatcctgttgagcctaatgttcaactcacaaagactagggtgacaaggtatcatgggtaatcaaaagttatcaaggtaggatataatgaaaattaggttacgctacccatcattagttcgtaaataaaataatgcatgtattcaaaacaaaacaattgataaaaatgggatcaatatgttcaaagagtgcacttgcgttgatcccagtcttgcacgacatcttctgaaacaaactgctcttctgctccaatgtctatacgatcgcaaacgaaaaacaaataaacaaaagaaaaatctaactaaagaacataaaatgaaacaacaaattaaaccaggacgtagagctcgattttagaggacttaaggtggaagaatggattgaatcagagttcgaatggaaaatttatagccttcagaagtttgaattcagagaaaatctgagggtaaaagaaaaaagtaatattccgggaatattctttggatacttaatttcggggattgaattttttctgacaagaaaatatgtgtggggcccactgacagtgttatggagtatggtggactcggtgtatgtggactcagctgatgcgtatggacatgaggtgatacagggcaatgatgtggcgctgacagggatggatctagggttaaatagatccaatggttgagattgaatcaagggtttggatggctgtgattatttggggattttttgtcgcgggacccacagatcagctacacaacggaggaggaagagcagccatggctccatgggcacgctccggcacaacggcattgacaacatcgttctgtggcgacggcgcaccgaggcactggctagctgcggtgtcggtaggaggaggcagaggcgaagtcggtggcacggcgacagtggaaatagcaggaaaaaaggggaggaaaaggggcgacgaccggcggtatctatagagggagaggttagtgttagggcgatgcataacaccaatttaaggaaggacgacaccggttctccttgcgcggcttgtggaagttcagcggcggctatgcctcagcgtagggcgtgggctgagtcggtccccatcgacggcagcgtgggccagcgacgcggatgaaaggagaggccaggctgagggtgactcgtgggctccgggattggcttcctgggcctgtgtaacgccctgaaaatcgctctaagtttaaattgtgctttaatgcatttctagaaatttaaaaagcctaaaagagcctccaacaattaaaattcaccaagatttatgtcaagttggctagtgggtatttttaataagttccccatgcttcaaaatgtgtaaccaatttttacttgaattttcagagcatcctaaataattttaaggcaacaaa

SEQ ID NO: 11031 - DNA, 8153 bp, Oryza sativa
  unsure (1)..(8153): unsure at all n locations
nnnnnnnnnnnnnnnnnnnnnnnnnnnnnnnnnnnnnnnnnnnnnnnnnnnnnnnnnnnnnnnnnncagcccagctcattccttctccctcggactaagtccatcattcctccttcgcgcgcccagtcagagacaggtgtgctccctctcgatgacaggtgggtcccacccgtcatccctaacctccagccatcctctctctctccggccgaattcctaccgacggcaacctcagattcgcctcctccactcgccgtttcatcaaattaattgaggggaattaatttccacctcatcctgtccaattcccccataatttcacactcgatcccgcattatttgcggtggattttgatggtgttcatcaatggtgagctccaccatggccggcgtcgatctccctccccggcacccttatccctcccctctggcctataaaagggaccctcgactccctcctccctcccacacaccggcgatctgtccctcctctcttcgcggccgccgcgccgctctctttttgtgccgccgccgtcacagctccggtcgcccctcgccggtggtccggacctcgtcggagcccggcgtcgccaccatccgcttcttcgcttcctcctcttccccgtccacccctccgtcgagcacgaggaccgcgggaacgacgacgacgccgacaacccgaagttcctcgtcgtttctccctcgccgccagcaacaccgtcgacctctcgccgccgtgtctgctcggtgagaaccgtcacctcctcctcttttcgtttttccctttcctgtagtccgtcgcaccgccgccgcgccgttggccgtcgccggcgagccgcctggttcggttgctgtcgtgcctgtgcgtcggtgtgccgtgagccgccctcggtgtgctcggctcacggtggatcgagcggctggcaagtgggacccgctcgtggaccggtccgcgtgcgctctctctcaataattcaagttttcctttagaaaaataattcacaaaattgtaaatttccatttaaataacaactaaacttcaaatggccatatcttgaccgtttgaactcagaatcgacccgttcaaatctctagtttccccttaaaaatgagtagaacccatttatgtgctttgtcgcttctgttcatgtggtttttattagcctttttatatttcttcgtgttggtcgtgtagatcccgctgttccggaagatcagctcttcatcgccgttgacgccgaagactttgtgagcgaaggcaagtcatatctaccttgaacatgttgaatcccatattgtgaaaattatgtggttttacttatattgcattgctttatagattataccgttcattattaatattgttttattagttattcctatgctctttgttatggccatgatgttgatttgatatccatgatcattgtgaaccctagtaaaattataacttgactagtctagtatcctacatgatggactaactagttgttttaggtaaatgcttagtcatgcttagttccaacctactccctccgtttcacaatgtatgtctttctagcattgcccacatacatatagatgttaatgaatctacacacatacatatgtctaaattcattaacatctaaataaacgtgggcaatgctagaaagtcttacattgtgaaacggaggaagtagaacttttggataaactagactatggtggttaacaactaaaactggattagttatggactattgactggtttgtcaatagatgggtgataaaatgctttgtacaactaaaacatatttttgggctgggcttggggtgcaagcaggttattttggtagtcacaccccggctaatataaggaccggtcttcgggcctctgttgcaaggcatcttcgtgcaaccacaagtctagtgggtaaggcctgactagaagtttagatcttctcaaaacaaagaccattggttggaagcgtgtggggcctggattaaggccaattttcactcggtgcaaggggggacctgtctcgtcctgggggatccggcatcctttaccttgtcggggaccggcgggcggcgaaacctcagcgggttctcctgttttgggtagacctagatggatagtcttgtcacgacctctattcgagtactgtgatagtacccggtgcgtggtaacgtgtgttgaggttgtgtcttgtgggtaaagttgtacacctctgatcagagttaaaaattattcgaatagccgcgccctcggttatgggcaagctgagcaatgtacccaaagttagttttgttttataaaaccttgggagggtgaaatcatgatggtgtagtcatgtggagattagcctgggttaagacaggttcgcaggctcatgcgaccttgatgatatgaaaatattggcttagaacaggatcgtgttttagaatgagctttaacctgattaaaatgtttaaactatggctttatgcaaaataaaccctattaggccatttccttgtttaccctatgcattattgttgcatttccggtgtgacttgctgagtacggtggtggtactcagtcttgctcacaaaaataatccagaggatggacctgaggaagatgaaggcttggatctctagttcgctccgccatcaagtgcctgttctgtagtcttccgctgttttatttgtttatctttgagtgtgagggcctaagtcgcccatgtaataaagtacttgctttacatttccgcaagtgtggcttgtaataatcaacaatgtctatgtgtacctcgccttctgggacgaggattaatgcactgagcgtttggaaatggtgtatatttccgggcgtgacaagttggtatcagagccaccttgaccgtaggatgagcaagtggtctaagccttaggatgatattttttttttagaaaatagttctttaattgtggaaactttttttattctatcttcaccctctcttgctttgcaaaattgtttactaattctttgttctgtttttttgaaaaatagatgaccagccttggcccctacaatggcgtctcacttaaggggttagttctgcagcttcgccacttgatcgttgagctgggctacaccgaagaagtccagtttgttggtaccactgtgccagacgaaggagaaaaagagttggcatccccccgatggtcagtcaaggccaccttgctctccaccaaccctagcttggaatcattggagctaacgggagggactgacaccttcatcgacgcatgccaagaagtggtgcttctgggcattggcaggctgcttcaacgacactggacacgtctgcaacacactccattccgctatcatcctactcgcagtttggcggaggactatgccaccttcagggatgccgagcacgagaacgacaccacgatcgatcacctggccaagatggtgcaggcgtatgatgatgctcgtgtcgactactacaagatggcgaagagaggttttattcaagcttctagtaggattctacggctaaggaggaagaacctgtgtgtgaagttggagatggctagcctgaagcgggaattgcgtaacctcgagctcggacatggtcaggttggagaaggaagctctgttgtggggtctaagcgttgccgtgttggaccgtccttgaagatcacgacacgcaagcgagatggccttcctccgatggtgcacgatgctcaagcgtcagccagggtgattgtccagaactacttggagcgaaggggattgactgtggctcttgccaatgaagatgactccaacgacaactcctatgacggtgatgatgagtcagagccgacagtggacgacaacgcaacaaaggacgagtagacgcgtagtcttagtacgcgtctatttttatcatttatcttctacttgagtttgttgccttgtgtgctttttggtatggactatatcgacccgttgtgatatagctgtacctttgtggtgcttaagcaacttgaactctatgtaaccaacatcacatcaataaaatttaaataagttggtttaatagctcgtgttcttgtcctaatatctcccttctttcttttcctctcatcttggttactacagatggtaaacacaaggagtattgctactaacaatgctcgtgctgggaactcagctcagaatcagaatcagaacaagaaccagaaccagaatcagaaccaaggccacgcaccaccaccgccacctccaccaatccatgatcaccccaacttagcacaagtgctcgccaatcaaaaccatctcatcgcagctttgctccaccaaatgcaaaacccgcaagcacctgctgctcaagctcccatacacgctccaccacaatcaaagctgtcggaatttctccaagtccggcctcccactatttcaaacacaaccaaccccgtcgaagcaaatgactggctgcacgcggttaacaagaagttggaccttatctagtgtactgatgaggagaaagtcgcttttgccgctcaccaactgcatggcactgcttccgagtggtgggaccacttccaggccacccaaccagctggacaagttattacttgggctcgtttctctattgcttttcgcagagctcacgtacctgctggagttttagccctgaggaagaaagaattccgtgaactcaagcaagatggcaggaccgtcactgaatttttgcacgagttcaataggttggcccgctatgctcccgaggacgttcgcaccgatgaagagaagcaagagaaatatcttgaagggttgaatgatgaattgtcaatccatctcatctctggtgactacgaagacttccaaaaactagtcgacaaggcgatccgcttggaggacaagcaccgaagatggaaagcaagaagcgcaagttggctaatgcgagtcaattcgtgttgtctgatagtgtgtaggtaacttatggtcagtcttggttaatggtgaggatcgagactatgctcagggaggagcagatgtccagtgcggttgggataccatgtgagaaagcgactagagttaggatttttggaggtcaacttcggtcaacgtgggatcgggactagacaagggagcagttgaggtgcaaacggtcagtgataatgggtgacgaagttggatatgagatggcacatagtggatggacaccgtgtgggagagatctttgcaacgggcttcacgaggtgtttctacattaagcgttggtgttcgtgaaggaaaacggaaggaaaactgttgaggattatatggtttctacagtgcttgatgtactgtagcgatggtactgtatcatgcagcatatgcatagaggattatctgcagctgcggtatatggaagagatatttacaatttggaaattgtagattggtttggaaattcagcaatagagtcctattgggaatatgagttgtatttctactttgagtaggaggttttcggtataaatagagaggaaggctatgccttgagggtaagccaagtttgagagattagatagggtttcgtgaaaacttgcgaggggtgctgtggctgcactttataaacaatacttgagcaataaagatcatatttaatcatcaaggcatcgacgatctattctagtttcgtaagttttgcgtttatgtttgattttggcattaacttgtgattgttcgttttgctacgattttgttcaatttagtccatcgaaaacctttctaatacttcattgatcagatctggaaagtttcattcgttggttcgtgcttgattcgaatttgcttaagttttatgtttagttcagatttgctgaaattccgagacagctgactttcgagggtgttttctcttaaaccgttttttagtttacatatccctccggtggagttgtttcttggtttgtctagtttattttgtcaacttttcaacttgatccaacggttggcataagagaaattgacatttgacattaagagaccggccatgcctcggttggaccgaccctaacaggtcagatagaccgccagatctatcaagattagattatttgacttccactgacttaatcgttcatccccctcttgtagccttggttacttgtgttctcttctacacattaatggttagagatgcttacattatgttgatacacaacttatttcgtgtcagataagcatcgataccaatattaaccggacattatctggatgttcttataataactaaaaaaagtatggctgctaaaatcgtattatgatgattgtaaattgtattgcaagtttgtgttaaataaaacatgcaaaatgaaaatagcatggactctttatttgtcattttccaaaaattaatatttgttgaattcaaagttaatactatgatgctgtaattatcgtcaatttttaatttagtgttgtattaatttaatttggaaagtagaatttagcaagttatgatccagggcttccttcaatctcctttttagggcagttagtctcgtatactgagaatcgatgtatattaggcaaaaacattgggtttatggttttcatttttttattgcttatgaagtttgtcaggtcaacaatcttctgtccttcagcgttgggagtttctattttctccaacggtttcttcaagctattttggacttaattacacttggaacaacatcctacaaatgcaagcaaagttgatctggttaggtataaaagtcatcttctgtccaagaactgaaggaaatgatcgcggcacggaaattcccaaatgtaattcttgtgtaaattgcaagccaactttatatgtgcttctgtgcttcctgaaatccactaacagatttgagataaaattttacgaactagtcgaggttttcatgcaatcttcgctgtaaaatagagttatactagtattcttcttatatgtttgaggcaaaccaatttactgcaatatagtgagaaaatatggacccatcgaacatagcggtgttaatctttcttgtttttctccaattgatgttgtggaggtggtagaatagtctaaattgacacaatctaaattatgcacgatcaatgatgtaaattcttttttccatcggaatattgtactgtttctctagttcttttagctgagtattgtggctttactaaaatttaattatataattgatgacctgcaataaatatgtggagattttggaccaaaggggctttaataggagcctcaaattacgtagctagcttcactgttctctccactcaactgcaataaatggataaacattccaacaaaagtagagttgataaaaatacggtttgcgagtaatctagtgttctctttcttaacaagataactatgtatgctttttaacagatgcaagctgggatggtgagcgagcatgaaggcggctcccttgtttacaagtttattagtgaagggggaaatcatccattctgtggcggatatggcccatccgatggcagctatcgtcaatccttggaactctttgaatgtagcgaaaatcatttctgtagctgtaaattgaattccttttgcgcatatgaaagaggattaactcaaacatatatgatgaactggggatgaacatatctttggtgtgaactcattatcatctagcgagtaatatctattagctattgctagctcatgcctgcaaggaaatttctaaagacggacacgattaaaggttgaagatatgctcgccagctacacattaaccgggcattttttttcaggaaagcattaacttacatttattcatttgatatttttggatttgcaaaataattcctttccacatcatggcgattgttgcaaatatgatctcccactataaacccaccatattcccctttccttgatttcacatcaatctaaccatctctcctcaatctacaggtgcattctagctagaaagtagtgaactgcgaaggccatggcttgcaagaaggtgaagcttcagcggatcgtcattgatgtgaagcaacgggtgacattcatgaagagtctcaagggcttgacgaaaaaagttagggagttcgcaacactattccttatggggtacggtgaggttgaggtgcaaacaaccaatgtttggcccgccgggtgggaggccaccaaagttttcgaacactt

SEQ ID NO: 11032 - DNA, 6245 bp, Oryza sativa
aaatagttgaaacatgaaacttagtaaaactttaattttcccacaggatcttatgccagaagatgaatcttttcccgtgatatttgttgtcctaacgaggcagacacgtttttcctatctttttttgcatcgtgctggttttaggtgaccaaccacatgtaagctatatttggaatgcaaccacccataacagacatgattaaagcatttatgtggtgcaagtgcctcatattgccgatacatttttgtgtttttaatgaaagaacatacagtttgttgggacaaaatattatctcagcgaacatggcaagtgctccctccatgggagacaaggagagagctcaaccttgatcgaagacctgtagggacgaggcgggagcttgaggaaggaaaatgtggtagtgtggagcggttgagaatgggtttgccccaccttttgcccatttgggggtttaggctttttttgaggtgctttgcagccatatagttttggggaattttagtcattgcacatgtacatttggtgtcatgttacacaatttatataattctaaaaatattacctaggaatgaaataatccccaacacacttaatccttgaattccatgctgcttgggccatattatattgattccttccaattagcattctccattgtcttctctgtttttattttttaaaaaatagatctcatataccgggcaaagttttttattttccggatgtaccatggatagtcaatatgccttggttacttgtgttctatcctacacattaatggttggagatgcttacattatgttgattcacaacttattttgtgtcagctaagtacccataccaatattaactggacattatcttgatgatcttataataactaaaaaaagtatggctgctaaaatcgtattatgatgatcgtaaattgtatttcaagtttgtgttaaataaaacatgcaaaataaaaatagcatggaccctttaattgtcatttaccaaaaattaatatttgtagaattcaaagttaatactatgatgccgtaattatcgtcaatttttaatttagtgttgtattaatttaatttggaaagtagaatttagcaagttatgatccagggctttcttcaatatcctttttagggcagttagtctcgtatactgagggcaaccgacgacatgattgccctgtagcttgctcaatcatctaagtgaaaatggtatctatatgaaaattcttggaaacattaacccacgtaacaagttcgaaatagcggactttttctgcatccgacacaaacatgttgtgcgagagttatctttccagatccacagataccatggatgccaattcataataacatttatgaacagcgggacttgggttgtcatcgtcattgatcacattttttctctgccgacgtttcatacttcatcggattacctagcgtggtggatctgcaatggaatcgatatatatagggcaaaagcatcgggtctatggttgtcatttttttattgcttatcaagtttggcaggtcaacaatcttctgtgcttcagcgttgggagtttctattttctccaactgtttcttcaagctatttttggacttaattatacttggaacaacatcctacaaatgcatgcaaagttgatctggttaggtataaaagtcaccttctgtccaagaactgaaggaaatgatcgcggcacggaaactcccaaatgtaattcttgtgcaatttgcaagccaactttatatgtgcttatgtgcttcccaaaatccatgaacagatacaagataaaattttacgaactagccgaggttttcatgcaatcttcactgtaaaatagagttatactagtatacttcttttatggttggggcagaccaatcaatatagtgagaaaatctgtacccatcgaacatagcggtgttaatctttcttgtttttctccaattgatgttatggatgtggtagaatagtctaaattgacacaatctaaattctgcacgatcaaagatgtaaattcttttttccctcggaatattgtactgtttctctagttcttttggctgagcattgtggctttactaaattttaataatataattgatgacctgcaataaatatctcgagataattttggaccaaaggggctttaataggagcctaatattacattgctagcttcaatgttctctccactcaactgcatagatggataaacaatccaataaatgtagagttgataaaaatatggtttccgagtaatctagtgttctctttcttaacaagatagccatgtgtgctttttaacagatgcaagctgtgatggcgagcggagcatgaaggcggctcccttgttcacaagtttatgagtgatgggggaaatcatccattctgtggatatggcccatccgatggcagctatcgtgacaggatcaatccttggaactctttgaatgtagcaaaaatcgtttctgtagttgtaaattgaattccaattgcacatatcaaagaggattaactcaaacatatatgatgaactgggcatgaatgtatatttggtgtgaactcattatcatctagcgagtaatatctattggctattgacaggcacgattaaaggttgacagatatgcttgccagctacacattaaccgagcatttttgtcaggaaagcattaacttgcattgattcatttgatatttttggatttgcgaaataatttctttccacaacatggcgattgttgcaatccgatctcccactataaatccaccatattcccctttccttgatttcacatcaatctaaccatctctcctcaatctacaggtgcattcttgctagaaagtagtgaactgcgtaggccatggctcgcaagaaggtgaagcttcaggggatcgtcattgatgtgaagcagcgggtgacattcatgaagagtctcaagggcttgacgaagaaggttagtgagttcgcaacactattcctcatggtgtacggtgaggttgaggtgcaagcaacgaaggtttggccgtcggtgtgggaggcgaccagagttctcgagcacttcaaggccatgccgcatctggtcagatacaagaagatgacagacctagaggacatcctcaacgagcaggtcaacaagctcaaagagcagttgcacaaggtgggacgtgatgctgatgaaagcgagaccaagctactcctcattgaagccatcaatggccaccgcccgagcctcgagggtctcaccatcgagcaaattaccagcctcggatggatggcaaatgcacacctcaagattgtcaacgaccgcctcaagaagctccgtgaggaaggcctcatacctgcatccgtgtcattgtcgagcacggaagtaccaatccagagggagggatggctggtggatgttgcaaggggcattggctcaatggggtacaatcggttcggaggtagcagcggaagcggcactgctagatccaatggtgacatggcttagcctttcaacagtgttgcaggattctcacaggccaatcaggaattttcatttgccacccaagtaatgcgagactcattatcacttgcctgcctggacaacatggcaaaggtggactttttctgagataatattttgccagagaaagcatggtcaactatcgattttggagggtgtcaatcactcctttatttacatcccaatatatcattcctttctattttgtatcccatcatcccatttccctttttaataataatttcgcttttcccttttttagatccctacaagctagtcttggttcatgtatttgttgcatctgattaccagcttaatgcttataaacgatgaaattcctatctagaaaatgagcaactagaaaaacaagatctgagtggataaattaaaaaaaagatctatgttcaacacaagaaaaatcttaagtgcgaggaaaatgatttttttgtcgattcagcctacaataccatatgaaatagttgaaatatgaaacttagtaaaactttaattttcccacaggatcttatgccagaagatgaatcttttcccatgatatttgttgtcctaacgaggcagacacgtttttcctatctttttttgcatcgtgctggttttaggtgaccaaccacatgtaagctatatttggaatgcaaccacccataacagacctgattaaagcatttatgtggtgcaagtgcttcatattgccgatacatttttgtgtttttaatgaaagaacatacagtttgttgggacaaaatattatcttagcgaacatgggacaaaatattatcttaacaaggagagagctcaaccttgaagacctgtagggaggaggcgggagcttgaggaaggaagaggatgagaatgggtccgcaccaccttttgcctacttgggagtttaggctatgaattttccattagttgaccgttaaattcttatgagaaaagcccattttgccctttgctttgaagaagcatataaattaatagagtgtattatcggagggtaaaaatttgttaaatgggactattatatttatgagttagttatgcaccatattatttgcgataaatatacatttagagatgacataaaaaataatacttaattattacttattgaaagttgtttatgttgcatataaatatatttgtcttatacaacaatctatctattgtattactatcaaaacacatatagttggattccagctatattcggttaaggaaattaatcgattaaaggaagcttatccactagtgaccgtgttcaaggaggatgcgccatggcaagttatctactaattaggaatagtttgtcagtttccttttatctttaggaaagtatgtttagtgtcctataaggactttatgttttcctttcatctttaggaaagtctctttcttatcctacaaggactagtatctacccatgggtataaatatgtacacccggggtcattgtaatatctccacgatcaatacaattcggtggatcgccaccttttaccttttctactttattttatttatcacggtggaacttgacacctgacgcggggctacatcgctattcgatctccggcgaaggggtaagtccaatgttctaccggcctagtcaattgtattggctacattggtgtcgttcaaggctgcatcagtacatttgacttcttggatttctatgggatgttgatatatttgcttggctatttatcatatgtcttagttaatctagtcttagtttctcaatttagctctatcggttgtctctcgctttagggtttctgccggtatcggctaaattattttactagattagattagctaaggcttctaccacccgaaaaatcagtcaacggcttgattatctagatattgtgtttcttttcaaacttagtgctgcatcagttaagtttgatctactaagtcatgtttagaaccataatctctagcctgcttttggactgccaataagggtttcatcagggtttcagccgatgaggtatctagatgttgcatcggtttacaaggattgcatataagttggatttagacgatgataacaaagatttcactgtttaatctaatcttctggattttatgacatcggatctccaaccgatgtattcttcaaccttcggatcagtgcttattctatcatatcaatgttagccgattggtttctactggattatattattgttatttattattatcagccgattgtctcaagtatcagaatctaaattggatatataaccgatagctccaaaccctatcactatcggctggtatcggcatcgactggaactactccatcggctcgtcagccgataggctcattgacctgctatttgtatatcttgttagtttcaggataaacctgactgacacgcctgtatttcaccaacctttggacctgcactggagctaagcagatctcccagaccgttatgttcgtcgacttagtttgcgccagcacagacccggcaccactggccgagtgcggatttttcgtcaacaatatgctacataaaaaaacattcaataactaataaataaatattaaatttttatatcaaatctaaaactaaatttgtcgcagttaatatggtgcataacaaactcataaatataatagtctcatccaacaaatttctacatccaacaatgtactccattaatttattatgtttctcgtagcaaagggaaaa

SEQ ID NO: 11033 - DNA, 19416 bp, Oryza sativa
  unsure (1)..(19416): unsure at all n locations
cagaagcaaataagagattaggtgaacttttatgggtacataggaaattttctctatgagtaatgtcctcgtcatatcattttttaccaggagtttgtaagagaggccccacagcccttagcatcatcatatatccatggctacataattaatccaataaaagtttttattttggtacaagagtttgtccatgttcctagggaacttctgacgagaaggacactaagttgtgccacatcagcactaggatggccagattagcattccctttttttctctccccgccaagaacaacgcgccttgaaaatcaaattcactgctcagtagtttttgggcccatctaatctacatcttccccttcttcttccatggttggccagtgcttgccctctcctaactaccaagcatcaaccaggctcgagctctgtacaccagctacaagtgagcgttctgttgacgtagaatcgtgctgccgccacacacgttatgtgcaacccatggcgcggcacccagagacgcgccgttatagggcgcggatagatgtcgccgaacgagcactcggagagaccccgtcggggtgaacacacgccggtttgtcctagactcaacaggccagctaggatgtccggtttaaggagaatatacttgggataggtagcaagaaaaagtgagatagaaaatatagatggtttggttattaaattgattttaacgattgattggttttgtttcaatccgccttagctcacttatatctataggagggttgaaattgcttcccaggttctttctcacgttcaattagctgtagaaaccaattagaactctcaaatatcaagccttagcaagaaaacccaagaactgataaatcaaacttgtagtcggactctaccagtctaaccgatcacatgctgccggtcagaccggcccctgctatcggtccgaccggcctcgtatgacaagtctaggttctttttaaatttagcaaaagttttcaattttatattctagagccaaatttgagtattaacacgtccaagtgctgcaaatccagctatagctgcagtcggtgccgcaacgcccctttctccactcaatcatttgtccagatccatgttacttggttctttagttcatccggtccactctctttcttttcttagcttgtgtcccaagggcaagctccggcagctagcgaacagcaaatggtcgcatcccctacacctccaatgtacacgccacagccagcaggttgcctggtaattttgatgccgaacaacacatggttgtacatatttgaacttagctcgtactgttctttagccaaacaatttcatgctaatttcaaattctttcatttgtgctcattcacgaatttatcttgactcataattgctatttgggtctgattttgaagggaaatcggcaggaagcatccgagaacaactcactgcgcacttcctccatttttgcagcaagctagtactattcagtggttttagtcctcaagaaattgggctatttgttttttcaattttgtttcgttcttgtcataggctctccggaccttccattataattgagagatgaaatgaataattcaagtcatcaaacaagcataataaaatatccgacgcctcgagagaggaatattggagacattgctgagcctttaacctgccagtcaacttcagcctgagatacgcccgtcaaaccactcgaaggcagtgaccagatgtgttacacattcaggagacttaacaaaaatggctaaagatctataacatctcaaatattcttaactcatactcatgtgaatctagttcacaggatgtgcactagattcacactttcatctcaagcatgattatacatagcaaacacaaataagatgaaagcgattataaactacatctactttagttacattggccgaccggccaaataaatatatagaacagcggaagcttgtctacccaatccacaagcacaccgactaggggtttaccccattaagttcaagtactagaagaagcagtcgattacccgcatcactcaaagactaagtctaaaacctgcaagcaaaagattaattcaatagcaagagtcagtacattattagggcaagcaccaagacaagcctaacaccctacttgcaaggcatataatcaaggaagacataatatggttctttttagcataaagcaagttttatttgcataaaacatttccaaatcaggtttactttcaaataaatttcaacaagctagtacttgtcatattgggcatcaaaataggcattaatcatgtataaatatgcacctcattgccttccatggcagcaaggagcaaggagatcattctcaaatctctttaaattgatttaaaggtaaatttcagcatttaggagaataaacacaagtctatactcaatagatatccacacgccgctcatgaccgcgagcacaacgaatcgattagttttaactctgcagagtttgtacactttacccacatgatgcgaaataataatcatgcaagagcatggcacgcgatacataagtacccgatttattacccgcaacaaagcttttccaaaattcatgatttagccttacaccagcacgatacgtgttactccatcctaagccatacacgttatatgacctagaaccgttaagtggcgggctcacgccttaaacttaacgccgtggtggcggacacaacgggaacccacccacgtggcacaataccgttgtattggacagacttagtgacctaaactaccacgtcggggtaaataggaagttcctctgagttatccgaattcatacgcaccggtctaccagaatgtaaggctaaaccataaataatttactaagcttgagctatcccatactagcacatgtggttgtactgtatacgaaatgaactgacattgagtgaagtccttaggtcggtttgggtgcactctccccctatcggtacacaactaatcaccatatgtgcaccagttgaggcccaaacctaaaatccatgttttccatcattttatttatgaaaatcacaagtattaaagttctgtccagattatttcaaaatcaatttttcatatttgtaatgaacccataatgacaaggaagaccattctaagcatggctaagcattataataacctagtgactccaaaattcatatataacgtggtatagtcatattgttcctaaggataggaatgatggatatggatatatgtggggttaaggtgataatgtaaataataggagtttgtctaacaagtttaacacaattttaatttgttaatgtacaatcgacatgcaggatttgcaaacattttcaataacctccaaaacataggttcaaacattttcaataacctccaaaacataggttcaaagtgatcaaagagagggaggtgggacttgccttgaatcaggaaaatgtcagcacctaaatcacttcttcaccgtttaagcaatcatctaaacaaagtacacgttatgcaattaaacaccgaaatatgcgaaaaatccaaaatgctctaaaatggatgatttgtgcacagtgaataggtactggtctaaaatgaatttaggtgaaagaatttatattttatctcatttcatttgagaattatgaattttagaagtttcgtcggtatagtgtaggatttacttaggtactattgtgaaatgctgttgtaaggtgattcttgttaagtttatgtttgctggggtgaagatatgtgttttctaagaccaacacatttggtttcataatttttagagttaatatgaattctttatgtattttacaagttataacgtgttataggtgtatagtgttctataggttcatagctttagaggtttaggtccagaacttgcctcatctagctagtgatgtataaaatgagtattttagttaactaatctaaccttagttcataggcttatggtctttattaccatggttcatattttataaactaggggagctctagtccatgctagcaatttattatatcaacctaaaaattattatatgagctaagtgccttaagttttggtggatggggatggaactatgcattatgcattcactggtctaacaggttttatttgtgtttcattatagctagagtgtatttctatatacatttatatatatacatattgctcaatcgatagctataacctgtacagaaggttccatattttattttactatgttgaagcccactgtttgctggttctatagatatttggttcacttcatttagactaaagatgaattttctacaaattttacaatttaaggttgctctatgatggttattacttacataagaatttagaggcttttatcatacagtaagtatataactttattttataacttggaagtatatgttttggtgattctacagaacttgggtttactcaaaaaggatctaagatgaattttatataaacttctaaagttcatcttatgcaaaactagttattttaaagataatagttttagaggcatttgatgtaaagtgtttatatgttttattttactttatttttagagaacatgttggtggatctgtagaaactaagtttgctctaaaatgagttgaaatgaattttgtatgcattttataaatttgtgcatgctttatgtgtgatttaacttggataaattttagaggctaaatttgtactgtgagtgcaagtttttattccataacatcaaagttcacaatttggtgagttcacagaaatttgaatcatcttaaaatgagctatatttaattttatatggattttacaggttttaggtacttttcttttataatttcagatttttgtttccaaggggtccactgtcagtgagagatcaatatacaaaaagatccctgcggtttctaagaatcaacccgcagacctaggctcatatgtcagtgagttgaaaagttgcacattaaaccttatagttgtttaaattctcgaaacaaggtccctgacttcttttctcacgcacagaggcagaacagccatggctgagctcgatctcgagctcaccggcgacaaacgatggctcgtttgggggtgcgaccaaaagacaaaatgaagatcatgatattgcgattccattcctctacttttcttggtcagtggacatcggagtaacgccggcggcgagtccgaaaggaggatgttttcgggtggtgatgcatgtgcttctacaatcatgtattggttaattgggtgcatgcatgtatgttctataggctgaagggtgctcaccgagatgctagacatggctggggtagctaggttgatgacggcggctcatgtaacggctcggcggcggcaagaacctccgggtgaacggcgatggctcaatcagctccaagaactatcatgtatgtgtgtccatgaggttagtgaggccccagggatggtgtatacgcgaagaatcggacaatggctcaccggaggaggcggaatcgacaatggcgacggcgaccggaggtgaagaagacggtggacgatctccacactcgtagcaccatccttcgagattcttgaggggaaatggagaggaggtcgaggcgaagacgctggcgcgacagcttggtccggcttggtccagataagcgggaacggcgatgatgtcgctgcggcggtgcacagagcgcgctctagagcgaccatgacatggcggcgttcccgctgctgtagaagatgaaatggaatgggatcaaaaccaaagttgttcggcatggcgatatgagaatggaacgagtatgagttagagatggagagggctcgacgacggttggcaatgtccctcttcttggcggccggcgacgaaagagaggtagagagggagagctggagcttcctccctcggttggatcggcactgggatggtgggtgaagagtggcgacacagctgggtggaggtgaagcctcggttcggcgctgccacgtcgaggccacgcgtcgtacacagccggcgccaatctctctctctctctctcggctgtctatggtcggctggaagatttgcacagggtgaggatgagccagagtggctgccaagtgggtccaggtcgtggcaaactaagctagggtgagagggttgggcagaaacgtgggtgaacaaaagatttgaatgattttcaggattatttctctctcccactttagtaattcaattatttaatttgtgggtaggataatttagtgtggatttttctgaaggtagatgaagatacctagattccattttctttggttgcctcaaaaattatggatagattactcacagaaattagaggaatatgggttctttggaaactagtttggatttttaggagacctaaacagagaagataaattctagaaaaattatatttagtcatgataattaacctagtattttaataaattatttcccctatacacttccatgcagttaaatgcacttttcaacaaggtatggttttagccaattaggagttataattagtctattatttgtctggtttaacttatttatttgaggtatcaaatttagttattaaattataccgaaattactgtgtgttgtatatgttaattagagcctacatgaatttttcaatgattttatcttgcacagattattttaaataattagcaagaattattttcctttcctaaatgtatgtaaatgtttttaaaacttttatatttagactcttcttaacctgaggtgatgttgatatgttagaattttagtttaccttacacatgtaataagctccttaactatttatgcataagtttactctagtatttaattaagagaatgcttataaaggtaactaaggtggaatatatcctatatgagttaatttatttgttcacttccaggttcatgactagtcttcagatggatgaccaaatagttttgtggggcttgacattggccttgttgatatattttaagatgtatggttcctattttaacttcctctagctagcactaggccctaatggttcagttgtttatctagatcttagttaatatttatgagacctattatgaaatgcaaatcgaaaatccaaatgcaatccaaatgcatatgaaggactcaagtcaaacatggctatgagaatatgcatgcttacacataaacttatatttttgtcctaggttagagatgcaaaggttttaatttgttctaaaattttatcatgcaagagttatatcaacttcacctaggttttaaaatggaaatttttggctctcaaaaatagaaaagttagcttccaactattttgacagaaaatttttaaggtctagagttcgggtatgttacagttctgtggaatgatagcctcaattaggtagcatattttgaaagtgtgagcgtgtttgtaagaagaaatgttagcccagtttaatttccagctttgttgctgtactacaaaagcatgcaaattgaagattcagttcaagttaagttttttctgttcataataaaagtaacattgttgttaattaatcatttttttccttgaacattgaggtaaatgaggataatacaacatgtataaaaaattaaaataataaaagatttcattttgtagctgaaaacctaggggaatgtactttacacgtaggatgaacatgccacatgtacaactatctgtagaatttcgaactctagggaacaaatatcttccccaaggtattcatgaaaaactccaaggaagtttgtctttccggtagaattgacccctagggtgtcttccgtaggggttaatctaggggaacctgttccctagagttatcttgataatcctagtgtatttggccctagagaagatgttcaattcaacatgtatgaggaatgtcctcttcatatcaatttctttaccagaacttagtaggggaagccccacagcacccaccatcatatatccataggtacacaattaatccaataaagtctacttgggtaaacaatccaataaaaataaagttgactaaagtgtaaattgtgttggtgatacacaaacttgtcggatgggtgtagtatagtgcacgaatttaaaatgctagttttgaagcacaaatttgtctacatgcttaatcttattgatttaaaatagtaatatcaatcgcttcttggttcaacattatgataatgttagccatacatttgaacgatgtgctttttgttatgaaatatcaaattagttagaggtgaagaaattgtcttattcaaactatgatggccatatcacatcaaacataccacaattgttgtactacctcgatctccgggcctaatcgacttgcagttatgacaaatttctacagtttcttgatgtataaatttacaacgaattgccacgctgtccatattgtactcaccccaaattggtaccggcctaaatataaatgttcagaaaagaaacctgcatctaatataaattatgggtactggttactagcaaaaactagcaccaatactttatatgccggttattaaaaaagttggcacctatagttgatccagtcgtcagtggagtacttgtgaacacacctatatgtaccagtctacttaaaaaaaccggcacctatatataattaggaagttgtaggtaccggttcttagatttgttcctaatttatatggtcgtacatgcatcctttgaaggactaatcgtaggtttatcacataatgtctccatgcacaaggaggtacatatatgatgcacttggctcggtgaggtcaagataattgtgtttttttatcgctttcatcaaagaatcataattctgacatatacagatttcttatggaatctatatacttccattgcaattgtgattgagagaaaaattgatagggtgtattatatgggtttattgctttcgctcatggtattatacttgtggctactgcgttagcaaaaacaataagataaattgcaaagtagtgtatttttttaatgaaccgtgcggtataatattaatggttggagatgctttgtgtatgttgatacacaacttatttcatgcctatattatataattggacattatcttgacgctcttattataactcaaaatggtatggctgttaaaagcgtattacgatgatcgtaaattgtattgccagtttgtgttaaataaaacatgcaagacgaaaatagcatggactctttaattttcattttccaaaaattaataattgtagaattcaaagttaatactacaatgatgtaactatcatcgatttttaatttagtgtattaatttaattttgaaagtagaatttagcaagttatgattgatttagactctactctcaattagtctaagctggtataattcaacatttttatgtactaaaaattacaataataatatcccgtgcgactagttcctctaataggggatcatcaaatctttaagcgtcatgaggcactccatgttacctggcaaggtgacctaggtcaagtgaggtgaataaataactcatcagaaaggcaggtccccaattggctgcatccacatatctcaaaagtcttgtcatatatatagctgtcctcctactgttatgcctgctagaggtgatctcttcaactttttggcagtttcagccccaatcatctctaatactccttgatcttgttcacctatctctgcaccatcaagtgagtaatacacttgatgacttggatgtcacaacacccaaagctaataatattgcatctctggttggactagttgctaggatcttgctgccagtcttatcaaccttcaatggagaaaggggtcctccacgattatagttttgtacaagaggaaacgtttttcatccaaggcttccttcagactcctttttagagcagttagactcttaaaccgagggtaactgacgacatgattgccctgtagcttgctcaatcatctaagtgaaaatggtatctatatgaaagttctagaaaacatgaatccacataacaagttccaaatagcggactttttcttcatttgacacaaacatgttgtgcgagagttatcttttcctacccacggataccatggatgccaattgcagaataatattttatgaacaccaggacttgggttgtcattatcattgaacacatttttttctctgtcggtgttccacatctcgtctgattacctagcgtggtggatctgcagtggcattattgggcgcatatatggcaaaaacatctggtctatggttgtcatttttgttattgcttatcaaatttggctggtcaaataattgattgccctgtagcttgctcaatcatctaagtgaaacttgtatctatatgaaaattcttggaaacaagaacccacataacaagttcgaaatagcggactttttctgcatccgacacaaaaatgttgtgcgagagttatcttactagatccacggataccatggatgccagttcataataacaccaggacttgggttgtcatcgtcattgagcacattttttctctaccgacattccatatttcatccgattacctagcgtggtggatctgcaacggaatggatgtatatatggcaaaacatttggtctatggttgtcattttttttcttgcttatcaagtttggcaggtcaacaatcttatgcgcttcagcgttggtagtttctattttctccaacggtttcttcaagctatttttggacataattacacttggaacaacatcctacaaatgcaagcaaagttgatctggttagataaaaagtcaacttctgtccaagaactgaaggaaatgattacggcatggaaactgccaaatgtaattcttgtgcaaattgcaagccaacttcatatgtgcttttgtgtttcctgaaaaccatgaacagatataagataaaattttacgaactagccgaggtcttcacgctatcttcgctgtaaaatagagttatactagtatatttcttacacggttgaggcagaccaatttactgcagtatagtgagaaaatctggacccatcgaacatagcggtgttaatctttcttgtttttctccaattgatgttgtggaggtggtagaatagtctaaattgatacaatctaaattctacatgatcaaagatgtaaattcttttttcccttggaatatagtactgttttgctagttctttttgctgagcattgtggctttactaaattttaataatataattgatgacttgcaacaaatatgttgagattttagaccaatggggctttaataggagcctcaaattacatagctagcttcactgttctctccactcaactgcaataaatggataaataatccaataatagtagagttgataaaaatacggtttgcgagttatctagtgttctctttcttaacaagataactatgtatgctttttaacagatgcaagctgggacagcgagcgagcatgaaggcggctcccttgttcacaagtttatgagtgatgggggaaatcatccattctgtggcagatatggcccatccgatggcagctatcgtgacaggatcaatccttggaactctttgaatgtagcgaaaatcatttctgtagttgtaaattgaattcctattgcgcatatgaaagaggattaactcaaacatatatgatgaactggggatgaacgtatctttggtgtgaactcattatcatctagcgagtaatatctattggctattgctagctcatgcctgcaaggaagtttctaaagacggacacgattaaaggttgaagatatgctcgccagctacacattaaccgatcatttttttcaggaaagcattaacttacattgattcatttgatatttttggatttgcaaaataatttctttccacatcatggcgattgttgcaatatgatctcccactataaatccaccatattcccctttctttgatttcacatcaatctaaccatctctcatcaatttacaggtgcattcttgctagaaagtggtgaactgcaaaggccatggctcgcaagaagatgaagcttctgcggatcgtcattgatgtgaagcggcgggtgacatttaggaagcatctgaagggcttgatgaagaaggttagtgagttcgcaacactgttcctcatggtgtacggtgaggttgaggtgcaagcaacgaaggtttggccgtcggtgtgggaggcgaccagagttctcgagcacttcaaggccatgccgcagctgggcagatacaagaagatgatagacctagagggcatcctcaacaagcagatcgacaagctcaaggagaagttgcacaagctgggacgcgaagctgatgaaagcgagaccaagctactcctcattgaagccatcaatggccgccacccaagcctcgatggtctcaccatcgagcagattatcagcctcggaaggatggcaaattcacgcctcaagattgtcaacgaccgcctcaagaagctccgtgagcaaggcctcatacctgcatctgtctcattgtcgagcacggaggtaccaatccagagggagggatggctgatggatgttgcaaggggcactggctcaatggggtacaatcagttcgaaggtagcagtgtaagcggcactgctggatccaatggtgacatggcttagcctttcaacagtgttgcagcattctcataggccaattaggaattttcagtcccacccaagtaatgcgagactcattatcatttgcctacttggccaacatggcaaaggtggactttttcttagatgatattttgccagagaaaccatggtcaactatcaattttggagggtgtcgctcctttatttacattccaatatatcattgctttctattttgtatcccatcatccgatttccttttttaatcatattatcccttttcccttttctagatccctacaaactagtcttggttcatgtatttgttgcatctgattaccagcttaatgctaataaacaatgaaattcctatctagaaaatgagctactagaaaaacaatatatgagtggataaattaaaaaagatctatgttcaacacaagaaaaatcttaaatgcaaggaaaattattttttttgtcaattcagcatgctgtaccatatgaaatatttgaagcaagaaacttatttaattgtcccataggttctcatgccaaaagatgaatcttttcccacaatatttgttgacctaatgaggcagacacgtttttcctatctttctttgcatcgtgctggttttaagtgaccaatcacatgtgcgctatatttggaatgcaaccacccataacggacctaattaaagcatttatgtggtacaagtgctacatattgctgatacattttgtgtttattatgaaagaacatacagtttgttgggacaaaatattttctcagcgaacatggcaagtgtccctccatgggagagaaggagagagctcaaccttgaagacctatagggaggaggcgggagcttgaggaaggaaacggtggtagtgtggagaggatgagaatgggtttgccccaccttttgcccatttgggggtttaggcttttttcgaggtggtttgcagtgatagggttttgggtcatttttgtcattgcacatgttcatttggtgtcatgttacacaatttatataattctaataataatacctaagaatgaaagaatcccccaagacacttaatccttgaattccatgcagcttgggctacattatattgattccttccgattaacattctcctttgtctgctctgtttttttttttttgaaaaaaatagatctcatataccaggcaaagttttttattttccggatgtaccatggatagtcaatatgcctttgctttttttttttctgaaatcccatagatttgaaccatcatccttggccatggtgttgtgcttccctctttactataatagcttccaggcagtaactaaaccacccatctccatttcaagacattcggttgagtgttgtcatcttgtgcatatactgcaataccaccaacataaaagtttatgttgtatttcacatagaatgcaaattattattaattgaaataatattaattctaagaaacatttccacttctatttgatttttcttgaatgtcattagcaccatgtatgaagaatgtccttatcatatcatttttataacagaacttggttcgggaggacccacagcccccatcatcatcaaatatccatggctacgcaattaatccaattatagtttttaccagaacttggtacaggagtttgtccatgttcctagggaacttctgacgaggaggatacaaaggagtgccacatcagcatcagcgtggccagattagctttccttttttttttttctctccctgccaagaattccttgccttgcaaatataaattcactgctcagtagtttttggacccattttgtctacgtcctccccttcttcttccatgggtggccagtgcttgccctctcgtaactaccaagcattagccaagctcgagctccatacaccagctaccaacgagtatttaattgacgtagaatcgtgttgctacacatgttatgtgcaacctgcggcgtggcgcctagaggcgcactgctatagggagcgggtagatactgctgaacaaacacttgggagggatcccttcaaagtgaacacacaccggtttgtcctagactcggcatgccggctaggacgtcgtctaacaccatagagatgaaagacgacaaacaattggatggtttgaggagaatagacttggcataggtaaacaaaaggagagagatataggatatagagggttgggatattaaattgattttgatgattgattggttgttgtttcaatcggtctttgctcccttatatttataggagtggtggacttgctttcccgtatatatttcatatccaattagaaatctaaaatctcatgtcttagcaagaagccccaagaaccaataaatcgaacttggaatcggactctgctagtctgactgaccacatgccgccgatcagatcagcccgatagctgtggtcagatcggcctagggtgggttctttttaaatttaactatagttttctatttcatactttaagagctaaatgtgcgtattaacatgtccaagtgctgcaaatccagcgatagcttccggagtggccgccgagctgtagacgatggagctaccgtcggtgccacaacacctttttctccacataatcatgtgtccattgtccagatccatgtttctcgtttcattagttcttccccactctctttcttttcttagcttgtgtcccaagtgcaagctccggcagctggcgaacagcaaatggtcgcatcccctacacctccaatgtatgcgccgcagcatgcatgttgtctggtaattttgatgcagaacaaacacatggttgtatatatgacagatccaggtaactgttaattgaacttagctcgtaatgttcttttagtcaaacaattgcattctaatttcaatttctttcatttgtgctcattcacgaatatatcttgattcataaatgctatttgggtctgattttgaagggaaatcggcaggaagcatcggagaacaaaaccttactgcactccccccattgttgcagcaagctagtacttttcagtggttacattactcaagaaattgtgctatttttttccaatttttgtttcgttctgtggaatgatagcctcaatttggtagcatattttggccctagagttatcttgatgatccgtggtgtatttggccctagaaagtctgttgaattcaccgtgtatatatgaggaatgtcctcttaatatcaatttttttaccggaacttagtaggggaagccccaaacctcccaccataatcatatatccatgggcacacaattaatccaataaagtctacttgggtaaacaatccaataaaagtaaagttgattcaagggtaaattgcactggtgatacacaaacttgttagatgggtgcaatatagtgcacgaatttaaaacacttgttttgaagcacaaatttgactacatgcttaatcttattgatttaggtgccaactaggatattacataagtatatatatatatcataaagatgctatttagacatacatgtgttcaatgaaaacatgagaaaaaaaaatcgaagaaatgccattaacaagcatcgagttctatgcaataccatcgtataagtaattttatctcagaagtgccattgctattagggttccgttagtagcctttcattaagtgatacaagatgaactgtgcatttgatggggtgggttggatagaaccctaacggtaatggcatttatgtgataagtcgttcgcacgatagcattttatggaactcacatttatcgatgatatttattagaatttggcgtttgttaatggcattttttagattttttttttcttcaaaagatataaatgaagcaatactgattgtacagaaagaaattaaaaaccaagctatgatgaagcaaagtagagaccatgtttgtaaatatagcatgtcctatgtgtactcactacacatgtctcatactgatcaacacaaactgtgtaaaattaaccttgccattatcgtccaagctcatatgaattaaacaaattcgtgcagcaaaaagacacgattacataaacatagattggtgctggttggaaccctgcgtaggtgccggatttcctaaccggcacctagaaggcagcatagataagagaacctttgaggtcccaagaatcaagggaaaaaaacagctcaagctgttccccttcatcccgattccatggaacatttaattcatagaattagtaggcatccaagaactcaaaaatatcaacactaacacaaaaaattcaccaccgtcgacgggcaggggagggcaccgccgccgcggagccaccactaggacaatagagagagagaagcgcacgcaggagagagagagggaggggggagcgtgaaagaatgaggaaaccggagagtccgagtcctcctctaggccttatccgtttgagactaccggtcggctcagctcggtttttacgggtgccagttttttaaaatcaattttcagatacaaatgcgtcaaacacctgactataataaacggtttttatagatagattcttaagttgattgtccaataattatagatagattcttaagttgattgtccaataaaatgagacagttgtcgtaattaagttcaccttctcttagaaattgattttcacaagtggagtacacccagtggcatccagcttgcacctgatctacagggtcgcagtgtctagttcgcgctcggctagctgccacagtatctggtgtgtcatgtgtgggtcgtatcagagacaagaccaacgccatcttcttgggcttctgggctgcgcggcccattcagcgagctgggccaccattgcagccatgtcatcgaaccatccggcccacgaacagcccgggagcactgctccgacgtactcatcgtcgtcgtcgtcgtcgtccccatcccggcgggagcacgacggcgacgtcgccgaccagccggcgtggcacgtcatcaccacgcctccgacgagaccgtccgggcttctgacgcagcaattctgtcgtggtttgtccaactccgggaacgttggcggccaaactgtcgtcagcgggaacaccctcaccggcggctggcggtcaccgccgccgccgccgccatcgttggcgtcggcgagtttcctctcgtagaccttcttcaccgtcctccactgcaggtgcacgtagatcacgacgccgacgttctccaagtccagcagcgcgaactcggcgttgtcgccgacggcgatcaccgcgacacggccggtccaccagccgtcgggaagccactcgatccgctcgcacgcctcgcgcacgcagaacgtgtcggccagccgccacccaactccggccgcgccgccgtcgtcctccgtggtcgtcgttttccggtgccagacgctgagccgcgtcccgtcgccgtggacgaggcagagccggccgcgagcgacgtcgtcgtcgtcggcggcggcggcggcgtgtgaccatgccatcctgaagttggcggaggacctcgccgcgtccgggagctcgacgacggtgaagcgcgtggtgcccagacgcaaacctagcgtgtagccggaggtcgtcacgacgtagacatcgccgttgatcggcggcagaacggtgtccacggcgtcgtcgcacgacggcgccgggagcttcgtcttcgcggtggttggcgctccccacgctccgccggagtcaagaacgtgcactcgcgcggtcactctccgctcgaccagcaacacgtacaccagcgtgataccatggtcgccgccgccgccgccgccgtcctcgggcaggaacacgcgttcgacgacgtgcttcccggcgccgcggcctggcggcggcggcagcggagggaggagttgcacggattcacgcgggtggggcggccggagcacggtgtagcggtacggcgtgttgatgccgagccgccgcggcgctctgtcgggggactcgacgaggacacggccgtcgcggcagtcggcgatggacggacggtggtagccggcgaggtggccgaacgcgccgaagaaccggtgccgcgtccggtgcgcggcggcagcggcgacgcccggatgctgcgggagtgccttgaactgcggccgccgcccagcgtcgccgccgccgccgtcgtcgacgcagaaaccgaggaggcgcggcgggtggatgacacggaagcggcggaggaagagctcgccggaggcgacgcggagccagtgcttgcagacgatcgcgacggcgacgaggtggtcgtgggactcgaggcggaggaggatctcgccgaggaggtcctcgtcggagagcacggcgctcgccggcgacgacggcggtgcgagctgcggcggccagctttcactctcttcttctccttccatatttcttgggagtttcaggctttctttgcatgcatggatgagtatttcagtgcacactgccaatacatatatataccaccctcagcatgagtagcatgtgaaataattcacatttgaatggttcttttccggtataaacatttccaaattgttgtcctactcaaatgaaacatgtacaaaaccttatatattaaggcatgaattaatggttgtatcaggataatccatggttttgaacggatttttactttggataaagccactttgtcagtgnnnnnnnnnnnnnnnnnnnnnnnnnnnnnnnnnnnnnnnnnnnnnnnnnnnnnnn

SEQ ID NO: 11034 - DNA, 15995 bp, Oryza sativa
  unsure (1)..(15995): unsure at all n locations
nnnnnnnnnnnnnnnnnnnnnnnnnnnnnnnnnnnnnnnnnnnnnnnnnnnnnnntagtctttctttgcatgcatggatgagtatttcagtgcacactgccaatacatatatataccaccctcagcatgagtagcatgtgaaataattcacatttgaatggttcttttccggtataaacatttccaaattgttgtcctactcaaatgaaacatgtacaaaaccttatatattaaggcatgaattaatggttgtatcaggataatccatggttttgaacggatttttgctttggataaagccactttgtcagtgtatctattagcaaggaattggaatggtgccatgtgaatctatgttgttttctagctgtacatggatgcatatgctttaatatggcctcttctagagtgccaaactggtgccatggatattatgtatgtaaagactgtacgatgtcgatatgcagcatgttgaccgagaatattgtattagcaaaagactgatatatacactacttgctagtagtatgaagtccggttagttgtccatgtactttttattagtttactaacacaaattagcatatttgccacgttggctgatcatccctgacattctcgacggttggcatatgcaccaatgatgctactgaaattctgtccggactaccggctgacgcgtgcaacgacctagtcaaatgatgtaatcagtacagtagcaacgcaagacgacctactgcaagcagcggtagctagctggtgactgcctaatcatgtgaggaagggcttttaggattgttagattgatttcatttcaaactatactattttttttagtaaaattgctaaatacatacatctatttagttttttttaccaaaactctggtaaaaacataaaaaatcttgtcaatctcgtccaaactttgataaggttattttggctacaatctgaacatgacatttataaccttcaatgaaatgaaaacccatgaaaacatgaattaaaaaattacaaattctgaaaaaagcgtagattttaggtgaaaagtacaggctgtcactttagttccttctaaaattgaatttgattttaggcttaagattggatggaaatatatttcatggctatacagtggcggatctagaaaattgattcgttggtgtcataacgtgtctatcggtgtcatagtatactaattatggttagatcatggtgttataacttatggataagcagttttgctatacgttttgtcgaaagtcgtcggtgtcacctgacaccggccctattactatagctccgcccctgtggctataccaaactctagtgtattttttcattaatttatatataaaccttttaaatatgattttcacaaatttttacttactcgacggtgtttaccacatatatttccccccttttatacatttatacgattctttgcttgctggagaacttgattttccaaaccattggggattaattagtgaatcactttacttatttcaaccgtcctcaaaacaagagttccacgggttcagaaacctctggttgtccgaaattccccactgctgccacccgtatcatttaaggtgtcattttatcaaaggtagtcaccctagcaacagataatgccaatactttatcatcatgaacacataagaaagttcaggcaaccgttcgtatccacgtgcttagtagtacatataccagccttgatgtatgtttatgattagcagcttgcccaagctgacttgcatgaacaactagatagtttcgtatcacctttcttcatagtcaaatgactcatgcttacctgctgcgcctcgcggtatgagctacgtacgtagatgtaggtggcgagacgctttgcacaatgctcctgaactcatctcaaatctgttctttggatctccaaagctcgcagtaatgccctgcttacttgcatatttgttccctgttgcctaccaaacctaaaaataaacaaacaatcggtttgcatgtagttctgacaaatgggaaactggatgtgacccattcaacagtatttcttacacagcaatgcgatccttttctattcgatccttttctattcaaaccaaaggatattggtttgatctgaactttcttttgtacaagctggatacaacgattggcaaggccgtgtatcagatggtattggctggttgaaccgatcaccacttggttcccttttgtagccaagagttggtacatacacaacatatagatgtatacccatgtactcacatagtatatatatatatattatggctggcaggatttcttttgtttttatgatggacctgttggattcattctgtggctgagacttctcaagtcgtacatttgtgacaacgagcagatgaaaattgatgataataaataattatttttttagcaaagggcaaaatccctccatttccattaagagaaatgacagggattacaagataaagaacacagggagtacgttcttgcactccaagttcatagtataacaaaagacatcttgccgcaaaacacatctaaagagtggcagttaacaaaaaataaaaataaaaaacatccatcggctacttccaggaagaaaaggcgccattccattttcagttgccaggggagtcttctgatacttgctcgccatccatattgtgacttgaacatctcacttgtgacttgctttagcggctggattccccaccgtagtcgttcttgtttttccaccggtttctgcaaaacagcctagtcattcatccatgagcgagccctatataagatgtcagtaggatcctgtggtagaatctgttcaaagcacaccttgtttcttgctttccaagtggaccacagaactgctgccaccgccactagcaatagttgttttgtaactttatcacaattctgagtccaagcacccaaggtgtgttgtacattcttcataggtttcagatcaaaagcacaggacaccacattccaagtaaatcttgtcatgggccaatcaaagaacaaatgttgtattgcctcttttttgtcacaaaactgacaagtttcatttccttttctccaccctcttttcttcaggtaatttttagttagcacgctgttccttatcagtaaccacaaaaaaatcctgattgttagaggtactttgatgtgccagatttttttatgtatctcccctatcattgaacttgcctcctgcattttcatagctgtgtagaaagatttgatactaaaaactccatttttggtcaagccccaaattatttcatcctttatattgtcataatattttttttatgttattccagtccaacaacttgttacctgacaaaattctcctgaaagttatgctcccccatccttcctcatccttttcgttttacctggccagtgttatctgctgtgtgtgtctgtgattctatataagtgtggacatttttgtgacaaaggttccccccccccccctcctccccccaacaaatacaactgtcttcccaaaataatatgtttgccccatttactggctttttccagcaataggtagacatctatgagcccatgagcccaggttcatgatagtacagattccaccactgccacataaagacatataagatgggtcatctgtaatagctcataaaggagcccatgaatatgtagatgcagggaatgacccataaatatgaggtactccctccgtttcacaagctaattcattttaacatttcttacattcatattgatgttaatgaatttagacatacatcaatatgaatgtgggaaatgctagaatgacttatattatgaaacggaggaagtaatatgcaacatgtcatagcaatcgtatgaaccgtacacaggtcatatataacaagatgcaatacgccatttgacttatgaaaaggtacgtagcttagtgattgtattgacctaagtagtacccaaggttctgagttcaaatctccgtatgattgaattttagattggcttatttgcggggctaagttcctaatttaaatggccgcatatatccggttggatgtagaagctaggtaaaaaatacccttctctaaacaaaatctctttgcctttttaggttggcatacgtgagatgcctcgacttcctcaatattctacatcttcctcctatttgttccgatgtatcccatgtttattcacccttcaatgctcgatctctctggtctctaaggtatttgaggatgtcctacttgacctgtcgaatctagaattaaccgatgaacgttcaccctgatagagtgatgggtccctcctagttcatcgttcagtgagatcttgccttgttatggcgtgtctccgagtgccgccactagtcacatataacataatcaaggtgtggtaatacaatttggtgccaacacggcaacatggtaaaggccatttctgcatttgaggatgttctacttaacctgtcgaatctagaattaaccgatgaacgttcaccctgatggagtgatgggtccctcctaggtcatcgttcagtgagatcttgtcttgttacggcgtgtctccgagtgccgccactggtcacatataacataatcaaggtgtggtaatacaatttggtgccaacatagcaacatggtaaaggccatttctcgagctaccagtgacagttgcatcgtgtccaatggtactgaacggttgtaactggcatcacttcagttttctctcttacacagtttgatgcatttcttaagagaaaatcatcagatgatgtattgtttcgggtgaatagctaatatggtccctgaagtttcgttgcgggcttagtttagtccttgaggttttaaatcgtccaaacaagtcctccaaattaatcatttgggctaatatagtctttggacccacaaaaaataccacgtaaacatgccaaagtcgtctcgcatgcagcggtatgaataaaatgatcattctacccttatataccatatagaaaagaaaatacaaaaaaaaagaccaacccaggctcaacattgttgtgaagggtggccgacaaaggaatttatgcgatcagtgcttggctgcagcaatcgtaagtgacaattctaaaacgatcatacatgtgtgaaacatttgttttctttttatacggtatataagggtatattgacccaaagtattaatttggaggacttatttgaacgatttgaaatctcaagaactaaactgagcccgaagtgaaacttcagggaccatattagctattcaccctttaaatttccactcgatccagtaaaagttccacgatgcgttttcaatttcagcaaatatcacggcaacgacaagaaaattcaaaaatatttcaatccattttgaaatttcaaacgtctttttttttctgaaatattgggttgctaggaaataatggaagtgcagacaaacaaggtattgaaaatattgcaagcagaaaactcatcgccgcatatgggcaatggagcaaaggcaattcaagattgcaggaaacgttggtgtctaatcctaaatacacacgcacacgatttcatggaaactcagagcgcaggaacacaaacaacaagtttggtgctgccctaacttctgcagcttttgggttttctcttctcattatatagcagaaataaacacgcagattctacacacacgggcatgatcgatcctacctccaacaatgccaacctacgtggactgaacacgtcttagagtatacgatgcaaaaacgaaagaatcgcagaggatataacaaagtccgctactaattaagagataaaatgcacatgcacttcacaacagaaatatgctaacaggaaacatattcgacttgacattgaaagtgtgatctatgaagaatgacacaaatgttcgacgctgatagcatcctcttcagatacgtagattcacatgtgttctgtatacatcaattaggacatcagctccttctacacttcacacaagaacatatgctgactctgtacttgaaagctacggagtaattgacagataatcaccatcttttgccagtacctatgcaaatgtgcccatctaggactacaaatattaccctagtatgcattatctgctatgtagggctagatctcctgagacatcccaatccaaaactataaggttagacaactttgatacatgtatacttcacagtaggatgtactgatgaaacaaacacctcaagtgcaagaaccgtggaagccacacatttgatcacatttaataggcatggttgtacacaacattgtggttcgattttgaatatggttgcattaaaacatgtccatcccatacatccagcaggttgtttgtttgtttgcctttttttttctttgcttcagtctatcctaggtagaatttttctttcaacttttcacctcaactgttattcgtacgttgtagataggtattgaactcaaactgaatatcagctattcatggtgttaatttgaaattgagtttcaaggacacaaactatatgaagcaatttgctcctaattacagttggaaacaaggaaaaacagaggaaacagaggagtgtctttttttttttatgtgtgcactttgttatgcagagatcgggagtgttctcagattttcgagttcaataaaacttccatcttctattatatactaaaagtccattaaactttctacaaacgctctcaagccgccacgtggcgctcctacaaacgctcctagatcggcacgtggcgctttaacatccaaccatcggttttcatttaatctggtggacccattatttttaaccactagatctttattttaagaaaaaaacaaatcaatctatctaaaaaaatcccacgttactcggccgtgtcccctggacctgtacgtccttatgtccgatgtacgtacatatcccctctatgtccttttcttttttccttcttatatacttagattagatgaaaaactaaaaagttaatgttaaccatatgttttaagttgtaaaaatatatgttattttaagttttattctaaatagcgcatctcattgaaacatccataaaaaaatattaataattaacattatagactatatgattgtatatcacaattaaattggacttataattaaaaaacaatttaaattttgagtagcattttaaaaatttactcactccctatcgtgtaatactgatatatccaaatgacattattaaatttatcaagaatgtattttcatatattccatgtttctgtattcatatattttttttggaaaattaacaaccatatatatatttttacaccatgtggatgcccttttatctcttaagcttcattcggtctatctcattggatgagcttatctaggacacgcgaaacaaagcatgccatcagcgtaagattaattaagtatcaaatattgcatatcccgtgcttatctaacaaaaaatatatagaaaaatggttctatacacccaggagtacatgctgtatatatataagggtcatcctatatataaaaaacaaaatctagcaacttatttatacataacccatggatttattattttcaaccattattttatatctatatctacgcaagagatgtcataaaggaaaaaaaaaagaagaatgtgtacaagatcagctccatcgagtagttttttctttctttctttgtggctctgagattttcctcaaattgtgcatatgtgtagcaaccacccttggcgagtttgtcaaagaattcacgcggccgcagcaccgcttcacgccatctcgctaaattttttaaaagtatttttttactaatgatgtataaggcaatcacgtttccttaaaaaaagcaatcacgagcgcatatataaacgtgtgctcacccatcatataaatacacatacacacacctgccctaagagaaaaaatatttgtctccaaaaaaaggaaaaaatatgtgcttagtatttgctagaaaaaacatatacacatatcatcgaaaatgccgcatagaaccacattatatctttttaattatgtcattctcatctatataatgttaataattaggacaaataattttgacaatatagattattccatcctatattacccatgaacatacatatctaaatcagatgtataataaaagaaaaaacaaaacaaaaaatatattagcttatgtgtttgcgaaagatggtgagagatcagattatatataaccaggacaattcgtaccattcttattgtttaagggtgtaattcagactttttccttaaaagtcttccacataaggatttataataaaaaattaatcaacactaaacttcctacaaacgctcctaagcctccacgtggcatcctataaatgctcctaagccaccacgtggcactctaataaattagagaaattcttaaaatgacacaacatataactgttgatttttattaaattttatggaccattatttgtaaccattagatttattagaaaaaaacatatccttatctgtaggcccacctcggcctgttgttggcaattgcatgtacatacgtacttgcgtctgctcaatccccccctaattctttcaccccttttatcacctattttttctcctattttcattcttttagaaaagcaaaaattgtatgccaaacaattaagcaaatgcagcatctaaattataatgctaatatttgatttgcttatgtctttagatattttacattttaaaactcatgtcctctttaattcacctgtaaagagagaaatgtcacattaattggggctacattttctgacttttgcgtgtcatttaagcaattttaaaactataaaaattaatgatatatatttttgtcatcgtatataacttgataatagttaaattatatctaataaaagtaaaatgaacagaactatgagtaatattaaaaaaatagccccaccccaacattgtaacacagtaaaaagtgcgcatcttataaatgcttctaagatattatgtcgttctcttaaatcggagaaaatacgctcttaagatattacgtcgttctcttaaataagagaaaatcgtaaaaattctgacaagaaaacaaaatattcgaccatcagcttcgacttgaacatctgacacataattttagtttgttagattaatcatttagaaaaagaacatccgaaatctcccttcctccctgctcgcgtacagcgtacgccattcttttctctctattttttatctccttatcaactgaaattaaaattatctatatgtaaaaaaagacacaaatggacctccatctattacttatatcctgtcaggcttctaacgactttctactaacttaattaatttctcttaacatgcctatgaaggctatgtacctatacaaattgatcttgatacttttaaaacgatcttattaggagataaataaatattcataagaaagatgatcatagcatcccaattacacatatgatctatgaagtcactaatcataataggtattcatctagcaatatagacaataggttaaaaataaatgtgtggccagttgaacatcataccaataagcatgtgggttgcacctaggaatcttaacagtgaaataaccttgaggcggcttttacaattggaaattgagcaaatgttgctagatttaaaacccactgtaaatagaaaaattcaaacattttacgagttctatttgaatgaaaaaatatataaaaaataaaatacaatcaatcaaaaaattgatattatatagttcttaaaaagaggctatgttaagctccgatcatatacaacgtaaaagaggctagctattcctatttcctactaatgttgattagttaatgtcatggataaaaaaatatgcaaattctaaacacgtaactcatgagatatctatctatctacctattatctatctatctattattatatactaaaagttcattaaaccttctataaacactcctaggtcgccatgtggtatcctacaaatgctctcaagtcaccatatgtcactctaataaaatagaaaaaatctaaccatcaatttttatttaaattggtgaacccattaaatttgatagttagatttatcttcacgagaaaacaaaatctccctccatccacgtacgcctccacaatgtacgactatccatttttagagcaacgtacgtatgatccatccgtttccctttttcctttttttaatatccataataataataaggattaaaaaaatacgggtctaaaacgcccatcaacctactagctagcgtctcctaataagtacattaaacatcatataaatatttctaaacatatcgcactctaaagttagagaaaatataaaaatactaaaacatttgaccatctttttacattattttaggttattagatatttctttttcttacggaaaaaaaatcccaaacttcctctacgctcccatatggcgttaaaacccattaactatccttataaatacttctaaaccactatgtgacacttctaaattagagaaaatcataaaaatttaagaacaatacatttaaccattggtttcgacttaaattgatggacataccatttagattgttattagactttttaaaaaaaagctaccaaacctcctttcctcccgccccgcctttacaatgttaaagacttaaagtacattaaacatcctataaatatttctaagccactacatgtctctcttaagttaaaaaaatcgtataaaattatgaaaaagaacaaaacatctgaccgtcggtttcgacttaaaaacatccaacacattattttaggtcattatatcaatcattttttaagaaaaagatcccgccctcctttgtctagctagctctcccactgtcccttttcttctctttcttctcttactagcacttcttaaaatctatattcaacttatgttctgtttgaactattatattttttaaatgaaatcaatactttaatatccatattgactatatataaatgctatcataaaaattacattctggatccacatccatcttgaggcctccattaaatataaaaaataaaattcgtcattataaatcaaaatatcgtatcttaatttttaataataccggtagacccattacttatatcccattagacacctaacaactttctatgaacttaattaatttatctcaacatgtatatgggggctatttacctatgcaatttgatttcggtacttttatcaataaatgatcttttaggagataaaattatatatatgatctatgaattcactaagaaattcgagaaaaatctttaaatgatatctatttttatgtcataatgtgtacccctctagtgttaatttttcatagacaacatttttaaactataaacgtgctcggttgaagatcatactgattgtaccaaacatgtgggctgcagaaagaaatcttagcagtgaaacaaccatgaggtttcattaccaatatattaagtcaatttcatataagaattaaggaccatgttcacttattctttttggtaaaacttgctatgctacatggtaaattcctaagatttagcgtagaataatctagaaatgtgtagttattatatgacctctattttaatattcttactcaattgaagatatttagatcaaatcatttcaaatatgcttgatagagtggagttttccaattttttaaaaaaatggacatgaaaaggattaaaaaatttatgtaaaatttttaaataattgttgggttcaaaacccattctaaatagaaatattcaaatatttttgcaggactaatagaatgagaaatctcattctaaaatttcaaatagagtgtaacaattttttgactttttgggaaaatgttcgggctaagatatccccgtggggatttgaaataccctaaattttctcataggaactgcatatattatttcgacataatattttctcataaattgaaaattatacggtttcgagtaattttagtttagaacaaaatcataactaattttaaaagcacattaaataagttcaattataatttagatataatattttaatactaggtcacccatacatggacattcataataaaatttcacacatattaaattaggtgcacgttcatgtgcacgggttacctttctagtttcttctaataataccaaataattcatttttttagaaaaaaaacaatagcaatgtatacgtcgataatttaatatgagcgaatgggttattcgataaaaatgacacacttgtctgatagaagagcaatccatggtgaaagacaaaaaagataaataaaatctgatagctaggcagttctctggcttacttgtgggctttttcattttgtacagaattgaaacactactttccaatgaaaagttgtttatttgcatgagtagttgtattctttaaataacttccaagcagccatataaaagttacaatgcttgcacatcagatagaggtcgagtcatcctaagagcaggtaaagcaggataggctagccgctgatgatattgccacatcagttctaaggtggtgtttggatccagagactaaactttagtccgtgtcatatcggatgaatttggagtattaaacataacctacttgtaaaactaattacataaatacgatgtaattcgcgtgacaaattttttaagcctaattaatccttaattagtgtagtttcctgtagcatcacataggctaatcatggattaattaggctcaatagattcgtctcgcgaattagtccagagttatagaatgggttttattaatagtctacgtttaatatttataattagtgtccaaacatccgatgtgatagggactaaaaagttttagtcacatctaaatagggtctaaggatggctggagaggaaagagagtcttagccgcagacttcaaagagacattctccacgcatgtaaactagaaaactaattagcatatgattgattaagaattaatcattataaactcgataaattggtttatatatttttttaaacatcttctatataaaatgatttcgaaaaaaacaccatttaacaatttgaaatatgtgttaatggaaagcgagtaagttgaagtttagctgctaatctgctgaaatgaagtttagctgctgctgctgtccccacatggttgtaacgcccccacggatatagcctgactaggtgggacagaagcaaacttaccagattaaagatttactcttttttttggatgtacacatagttggacagctagctatcatacgcatcagctattagagatttagagctatctcttgctgacatgtgggactaccttttttacagatatcagctggtgatattattaaatttgttatgttatggccctattggataaccccacgaaagtggcagctgccgagtacaaatattgagtctagcatagtttaaactaggcgagtaggaaacaaagagctaaactctcctcagttccaagcgcagccaaatcacctcgtcaattattctcgtactgaatgacaagtctgcactgtgctgattgcaaaaaacttagaaggaattcggagagttgaagccaacgcagttcctggtgcctccaaaacccaaactaaaggctttcaggagattaaatttgaaatgtgaaccattgcaagttcaactctttccctgtctctccaaacactgcttgagacgaccagaaatgaagaggtatactagctagtatttatagtggggtttggccttataaaataatggcctgaatgtcaaggaggatataatttggccaggaatgctgccaaatgcatgggttctgtctcaaggctttaccagagaggagaaagaactctagtagtacttgacttacattactctttgccctttcgtggatatataagacgtcgatccacgttgctgccactgcttggctgcatccgtcagcagaagacatattgcaaaattctcaactaatttgtaattaagtgccagactcaatgaattcattgaagttcataagaatcctaaaaaaaaatcaatgttacatttttttcaattttcgaaaataccagaacaacaacaaagattttcaaaaatacgtattataattcacaaaattcagatattcttttgaaacgatacatttccaaaaaaaaaaaacaatgaagggcaaagcaaacagcaaaacacctttgacgaaaacagaagtaagaaaacaaataacatgaacatggctggtattaattgttgaccagaacatttcttgttacaattaattggatttattgcttgctttctacacaaacaatgcttgcgagtctgtgcttgcacggaacagacacaacacatgtactacctccatgtcgtttataataatatttaagtcaaacattgaaaatataaatcatgaataactcccaagttgttgagtttgaaaatgtaaagattataggaatagatgtcttgaaaaatacttttataaaattatacatatatcacttttcaataaatatttttatagtaacaagaagttaaaattatgttttggagaccgtgtcgctgtccaaaacgacttctacatagggagtatctgtatatagtctgaaacatgtacattctagaacaaccatttctatcattatcatattgtccaattttgaattattaataattaaacaggtaattaaccttttctgggtgcaagagaaagaaatgatgagaacttaagaggggcgtatcaacaatggtgcaagtgtcaagttcatagaagttgcgtacggaacgaaaactcaagcggatgcataggcaatcttccgtatgtatcgaccacctaaccggagataactggtacaaacatctagaacggaatataaatatgagactggtacaaagcagctaatacgcagctagggttagagctcttgatcaagacctctcctcccaaaaccataaagttattacttttctggtacatgtgtagataggatcgatgtagtaaacagtgggaaccttttatatctagtgccttgcagcataggggctagctactccctccatcctaaaatataagtatttttagctataaatctagataactgtgtgtccaaatttatagtcaaaagttgttatatattgggacaaaggtagtagtatttatgctcaacctttacttggcatttgccaattcatagaaagaattaaacttgtataatataatatagttcttcaaattaagatagagtggtattggggctttgcttagacagtatgtatggtatgaaagaggctaagtttccattattaacaacgaaagaagaaatttattcctaaacgtttatgacatatttagccctttagaaatcagacacatctcatattaaagaaaaaacaatgaacactacttgttcttacgataagctaatgttcctcttcttggtctcccccctccatttcgtagtgttcttcgttgtgaacaatataataatagttgttttcacccgttagtgatggtggtttctctagtagcgttggccgcatacgcattggcagtatacaatgtaaacaagttattatatgatcaatataatctacacaaaatagtattcaacagagatcgaaatatagatgctgtcaagaatagaaacaaaaaagcctccaaatccttactgattaaagaactgtattttaaccaagcatttttttagaacaggcttaatgtctaatgaactaatcagcacttaatgggttacaattcttgactaacaaatactacctccgttttttaatagatgacgccgttgactttttctcaaatgtttgaccattcgtcttattcaaaaaatttacgtaattataatttattttgttatgagttgttttatcactcatagtactttaagtgtgatttatatcttatacatttacat

SEQ ID NO: 11035 - DNA, 7960 bp, Oryza sativa
  unsure (1)..(7960): unsure at all n locations
tcatctattaaaaaacggagggagtaaggtgtaactgaaagcctggttgagcactctttgcttgtgaggtagtctttacctaagctatgtgccaccttgttcgtagaccgatagacccgaacaactttaacttcctggaaagcactgcacttgtttatgatcacctggataattgacccatacaccgacttgttataattgtgatccctcatcatattagccacctctagacaatcgatcatgataattagtatagaaaactcaaagatatagtcgtattggctttgctagcttagagagcatgtacaatctgaaagaggctaagtttctaatattaacaatgcaagtagaaattgattcttaaaaacttatgagatatttagcccatcagagatagacacatctcatatcaagaaaacaataaacaatacttgttttcatgataagctaatgttcctctaaaagttaatatggtggtttctaagtgttggccgcattggtagcaaacgttataaacaagttattatattatcaatataatatagccaaaagagtactgaacagacatcaaatcatacatgttgttgagaatagaaataaaaagtacattccaaagcctccgatgccttactaattaaagaactgtataatatataaccaagttgagatattaacaagtggcattttctgaaggccaaacttttgcactgttataataacaaacgattcttaatttcattgaaatacatactaaaagaaatcgaggccatgtatatatataaatgctcacaaacgggattcccttcattcacggttcatgaacttctctctgacccttttgaagcatctaccaaaggtttactacgaacgatacgaagtacgtacagtagtttaccaagggatttgctttaattctcttctagcaggatcacttgtacacaggatcactcctagcagtgcagtggttggcctgtagacgtgcgcatctcaaactagttttcttccagcaacaacccgcgatgttgttgggaatagtccaacattgctaatctagggggagttgaaccaacttaaaagtaaaagtgggggaagcccttcacctcttgagctagcttttggggtgtagcgaggctttctaccagttggttttgggccaacaaaagatagtgttgttgtggagaaattgtttagtgcagttcccgacaagtttcttcacattgttggcaccatcgagcaatggggtgatgtgtcgaagatgtccgtggcggaggcaatcgggcgcttgagggcgttcgaggaatccttgaagggtcggcgccgcgaaccggaggttgagtatttgttgctcacacgtgcacaatgggagaatctctatatcaaggagaagaaaggagaagacggcagcgactccaacagtagcgagcgcaaggttgataggaagaaggtaaagtgctacaactatggcatacatggtcattatgctaacgaatgtcgcaaaccgaagaaagaagaagcgctgctcgctaccgcggacgacgagccaacgctcctgtgaagattgtttactaggtattccaaaataaagacaacaagattaggggggcaattgttagcactaatcttgttgcatatgattcttttattgttcgtcaccaagtaatcacgtctaacacatgacgtgatcactctagacaaaactaattaacaataaaagaatcatatgcaacaagattagtgctaacagatgtagcaccagaaatcctgacacctcccaatccaaagcgattagttttatagtgttgcatagataaacggtgtatataattcactaataattcagtatgcctcaacaacatgtagatgaagttcttccaactgctgtgccatgtatatatataacatgtagatgaaggcacatgctagtgtttaagaactagtatatatatgcatgatgctctgtatgctactattatacaaatttgcacatgcctgcagattgctggttttttatattttagcccttttcaaaaacttattcggtagatagacccatataaaagcttattactggaatatacccttttctggatgctaaggttcatggcgcctacgtccaatgtctcggtgccaataccctcgacactgtagcagccaatatgtggaggagtcgacaaccaaggaccaatttgtaaaagtaattctaaaaagggttgaaatgtaaatatcttttcatacaaataggtcctcaacacatgctggtgtcaagggcctatttgatagaaagcatttacgtttgacctttttaagaaattaatttacaattatgttatctacgccagtctctttaataatgaccccgttacaccagtgcctaagctataaacatgggcaagggctgtcaacgttagtatcgttggctctgagacattgaacctttgtgccaataacttggctctgagaaaaaaaaaggttcattcttataatatatttgtaaataaatgtttaaaactaactaaaatgtaaaaatttcagctgcagattgcatgtctgtttgtagacttaaggttgtaaaacactgaacttttggtaaacagaatacgcacatgagtctagacgaccgtctccttttttgctcatcaccaatggttgactgattttgaaatggaaaattggtttagatgtcagaaaaacacaatgtactacgctgtacaagctataaaaaacactatatacaatgttaataatagtattctctgcaccataaaccactataataaaacaaattttacagacacccccaattcgatcacggatgagcgtaaagaacatccatttgtaaaaaatatatttggatggtgtttagtacagatccactaacgcaaatcaattttcgcacgcggatctcttaataagcttaccctcctctccttatcccctcaactcctccgcttcacatcctcatcctctttcccatttactccctctccctctctcttccagtctcatttattcactttcctctctcttactctctcatgcgctcctcatcccctttacttctctctcacttgtaggccggtagaggtgcatgaggaggttggtgcactgcggcgacggttagtctagcggcgctcgaggaggctagcagaggaggctcgcgttgacgctggtaacagcatcacctcctcaggagctgccagccacctcgcagatccggcgatgctggccttctccctcgcagacccgatggcaacggccttcttccatgcaaaccagcacagccagccttctccctcgcagatctggtggcggcggcctcaggagcggtggatccaccgccactggcctctcttgtagatctggctatgacaatgatgggtggccctggccctaggaggggcggattcacatgcgttagcgtcaagtgtggcagtggcgttgacgacgatggcggcaagcttagcagtggtggatctagtggccacagccccgggaaaggcggattcgccgttgttggccttgggtgcggccagtggcggagccacgttgagtttgggtggtgcacaggaaccccctaaacttacaatgtctcacttaaaaacactagaatatgcagctttgcatcgaaatttttatagattttcaatggttagtgcaccacccttactttgatgttagctctgcccgtgggagtggcggggtctcaacaaagatgatagtggtagcggactgcatagacgatggtggcggcaagggcggatttgagctagggttttgcctatttgaatttttatttttgttgtgattttcgttcttgcaaacggatggcataactgaccttatgtgaaaattaccatctgcatggggttttgctactcgtatgggaaaatgttgatttttacatttttatagataaactcggggggcaagcgcttgcattgcccgcttgcaaaaatccgttgtagccttttgcagaaatgtaggctgtagcatcatttggtttaggcaaagaaagtacaaggaatagaactctataacttttcccaaggatcctccatctgaatttctttccctgcttgggtaccccaggaggcgcaggcagccctttcaaaaaaatcaaagaggccaagccggctcggcaatcatgtggacagtgttgcagttatggtctaccgtgatcggccataacgtcgatagaatttgcaaaactaaacttgaaccagttcctggcacctccgattcccaaaactcatcatcaactgatggctggtaggagatgaaagttgagagctgaaccaatagaagttggagccttccactgtttctatccaagataaccgactcagagttggaacaaacagaggttgagcaagtatttatataggcatccatgtacgtatatagctttgacatgtctgtataagttgatatcttctgcaacaatttgggatacatatagtacggtacggtacagcaacatcagtatatattaatttatatgcaaacataaataagagttgcgtacatcaatttatatgcaaacatagatataagttgcgtattactgcttattgggcatagtgtaggtctggcatgaagtgaattaagtgatatatggtgaggtacgaagtaaattaagtggcactttattcagggtgttagaatatacaccaacagaccaaatttggtttgctgcagaccgggatacagctaccttgtttgaggcttagagcctatttatgaggcccaattcaagaggagaacttgtgggccaatggccttaattttcatgaaattgatttaactagcaattttggagaataaccccaaaaaagattgggctccctagagattgaaaaactattcgcagtttctgctattgataatgcattaatatttctttcttgatgtgtttatagcctttaattcgtcaaaactccagatcccttcttttcaggacacggtgaccattgtgaagctcgtagcgctaagaaatcatcttgatactagcacatatcagctcaccacagctagcttcgcccatttcgagctgtgtccacttcgatacagggacatggttatttgaatctaccctacgggatcatctctagatgatcaccctaataaggtattactactctttgatcagtgcttgctgttaacctgtaaacatgcccatctcgaactaacgagtgctacaggagagcaagaaatcgtatcactacaactcctgagtcctcccaagccaaaaccgtaaggctatggatatatgcagtgcaggacacaccggcctaaaaaactatatatagaagttcatctatcagttgtgtctcctagcatgaatggacaaaacagcagctctgattgctattttatgctatagcaacgacatttgttatgatcctccatgggatggtatatgtaaacaatagtgtgtagtagtcatgccagcttgtaatttcctcctcctgtccacaaataccaaataatattgtttgtcttttattgagatatatagtgaggatatatgaccgtaattttaaatattaaacgaggagtggttagggagtgcaagcgtggtcgttgaaattaagattacgtaaaactaaattacagatggttgctgggagatctatactctcttttatttaagtatacgacgttggttaaaaatggagggagtagtactttggaagtaaccactgtagttttggtacagcattgttcaagttgatttccgttatgatatttattttatatagtcggaccatataaaaaaatatcttcataattatgctcaaaatattaaagaaagttttctacgaattttaaaattttcgccattctaaaagaaggaaggcaaagaaacttttccacatacagacttctaaaaaaccgcatacacttttacaatgaactaggaagatagcccgcacatttgcgggggcatgcgcattagtatgtttcaaaaatagttctaacaaaacaaattaaaattaaagtaacttattttcaattttgaattgagtgttctttatatctctctttcgtgaagaaatctcaacaaactttcattggtttttttaccatcctgcaagccctctctttaattacttctcatatatgtgcaattagttatgcatgtgaatcaatatagatagaaacaatattttaaaaaatatttattgtagtacttataattattgggttcacctatttgaaggaaaacgaatgggttgtttttttatcataatttttaggatttttaatttatttgagcgctatatagcatctaggagtgtttgtagcacaccacgcatacgacaggttgagagtgtttgtagggagttatttgatttttactatataatagatagttaatatagcattgcttattgtttatgtactgagttgctagctagaaaatttggatataaaagtgagccggtgagataataggagataaaatgatgggtccaccatattaagtgaaaatcaatgatatgatgttttccttttttttctcagaattttttagatttctctaatttattaaagggccacgtgacggcttagtagtgtttgtaggagttacgtggcggtttaatagcgtttctagaaagtttagagtaattttatatataatatggtttttttggctttatcctttaggagttacgtacgttacgttcgtacaaaggtaacatgtaatttttttttgttttttaggtagtacatacgaacattgctctccatccatatgcatagcataggaaggatctttttggtttttttttctgtttacgaatagtcattgtaccttcctctccatccatattagaaggaatgattttaatagatttaatctaatagcctgaaatatcaggatcactaatttaagtaaaaatcaagagctagatgttttgctttttctcagaatttgtaggattttctctaatttattagagtgccacgtagcggcttgagagcgtttttaggaagctaagtggctgcttgagagcttttgtaggatgattaatggacttttaatatataatatatttttttagagaaccgcttcactaattcctagattagaacaagtttaatatgtaaattacatgaaaaactgcttgtacgtagattaattttgtataatccctatcgagaagatcgagatttttactcgcgaaggattgattgcctttgaaatggaaaaaacatccggtttggacgatacacaatgttttactatgtgctgccacatggtaggattcccagcaccataaacagcttaattagtagtaaagcctggagcagcatttgctctaggcaagtatgtaaaccatgaatggaactccatcctttccaagaggccaaagcggcttaactggcaatcatgtggacactgttgctcttatgatctaccgcgatcgcgctccacctagatagagtttgcgaaactaaactcgcagctgttcctggtgcctcccattcctagaactcgtcatcaagtgaaggcttgtattggagatgaattaaatttgagagctgacccaatagtacgtagttggagtcttccactgtttctctccacatatatggcctagacttcgaacaaacagaggtttttgtgctagtatttatacagagctttgctttctactgtccatgtcaaaacaagttcactattctacacttatgctgtatatagcacgtcacgtgtctgcacaagttgatcttttctgcaacaagatagctggtacggcacagtacaacaacataagtacattagtttatatgcaaaggtaaatagatgttgtgcattgcttattggacttagtgtatgacaggcacggagtaaattaagtggtatatgttcaggcacaaagtaaannnnnnnnnnnnnnnnnnnnnnnnnnnnnnnnnnnnnnnnnnnnnnnnnnnnnnnnnnnnnnnn

SEQ ID NO: 11036 - DNA, 16556 bp, Oryza sativa
tgcattgcttattggacttagtgtatgacaggcacggagtaaattaagtggtatatgttcaggcacaaagtaaaattaagtggtacattattctggtgttcgatagtgtcaaatagacacaatacaatttccgatgcttcccacccaaaacatgacttgctgaggtgagaatatataatgaagggcttctggacatatagactatgagcgtgatccggccatccattgctccctaagttaattatatggtctgagctggtatagaagcacatgcaagagcatgtactgcaggtgaaaactactgtaagaaacatcaaattgcaacctaattaactatgctatcacctgcagcacaagccaaaataaacgactgtacatgatttcagagtgtatgttcgagttcatcacgtgtaaaaatgaatgtcaagacatcatgaaagtaagattgagatttttacgaaggcaacgaaactgtgtgaaggcacctcacacaggttgattatttgtcaacgagatggtagagaatttgttgcgcgtgtcgaccttaaggtgacatgagatggcgtagaatttctcaatgagcttggctggctttcggtcagggaaaaaagcaggaaattcatcaattatatccaagattatgtgaagggttttacaaggatttgcaatttccccgatcaagtgtcggggagttcaccccatagggtgtcggaggtggggacatggttatagacccacgtggttaggagatatggtaaccacttaaaatatactccaattacaagtatcactcggtggaggcaattacacatcaatatataaactaatcctagtccgcagccccacagcaatatgtcgacgcacacacgatatgacagccggtgctcatcgatgctgcatgtactgctcctccttgtcggcgtatccttgtcagccccaatagccacgacgctgcatgttgcattgccccactagctatgccgatgaagctggaatcccttaccatagttggcctcggagaacttgctcgggtgacggagtccaagaagcgcaagagctggagactggttcagccccgttcttcacacaggggcctggaccgggttaacacgcaagatagcaggagtgagcagtttcgttcctgtccgcactgcacccttgcaaaccctagattttacaaacattggttttttcttggtgtatgtggagctaggacaaatactgcacaacaagcgtactagtattcctaaagcttcccactcctgaatggcggtgagaaatctaaggtgactacagtgcatgatatggcctcttgtcttgggagcttcacattttctttttgcgtgctgcagcaaaaactgaaacaggactgcctttttatagtgatcatgtatgcatgaggtatataattatactgtaagtaaagcagggctgccttttttttatagttatgtatatctcatctttttatttataactaattattataagtaaaacatcttattaatgacaaaaaataatttaatagaaaataatttgcatgtaaaacttttatatgtgtgtcctttagtaatttttttaaaaaaatatgggaaaacaaactacaacgatgaaaacctgaaatcaactccaaaattatgtttcaaaactcgaattatcacttatccttataagctgaaggctaagtgaagaaaacctgaaatcaactctaaaaattatgttttaaaactcgaattttcagttatccttataagctgaaggttacacgttgcgagccgcatatgaaaactacactgtacagatttcactgttgcaactttaagctacgacacaagataaaataaaaccattgtggctacacatatgcaaggacttgccgttagtaaagtcttgaagggaaaacccttatgtgggagctgatgatctttggtatgaatggcaacgaaaactgatgcccacaatgttcacaatcatatgctccgtatgccggaatgtttgttagttgaaatacaaatttgttcattgttataaggagatgtgtcacattcatcatacgagcaatcctataaaataaatcatttccataactaatatttagcatatattcctccaaaatacagaccaggcataatcattagcctttccaaaacttgttttctcgcttttcactagaagtctagaaacttttatacaccaaaatgtctacgaatagaattctgtgcaataaatttggacttgtaaacaaaccttcaatgctccacacatgccatgcgtacaagaaaaacgggtgatgcaagtctttcagttatcaaaaaaccaaactatggaggatgcaacagttgatacattgttataatgaatcataatgaacggactaactcacaggcccttggagagtagaacacagctcgttctacagaaaactatcctacatacaagaatcgtaaagaagcaaacatcataagttgtgattcacagtcacagcatgcacagacgaacagattagctaagagttggcttgcttttttttttcagggtaagagttagcttgctaactcagggcctgtttagatccatttgaaatggcaaatggcaaatggcaaaagttttggtggcaaaagttttggtattgaaaaagtactagttggtgtttagatgcatcctaaacttttgccattctagcactaaagtgagagagagaaagagagagggagtggtcccaaagcactttttggcacaatttgctactatggactagcaaatgtcaaatgccaaattgccaaattttgctactagtgtttagatccaaaatggcaaaaagtgcttcagaatgacaaaacttttgccattttggaggatctaaacagggcctcagactacattgtaaacaatcgtaacaactaacgctaccctaatcgcccatgttatagtctccaccagctaaaccagcaaaatcgcttgtgtcccatagcggaataaactattcggtatctctaagattcccaatgtctcccaatcctgaacagaatctagtgcaattatctataagtatcacgaagtatttctttccccattcattttgcacatatcgaaatgaataagttctagcgttgccaaatttcttgcctcaaatgtgttgtgagccttgcgacattgtttcgtttgaacacaagcatgacacttaaaacctttgatgaaagtgaatttcgacataaaacttatgtcagctaagcgcatcgtacaaccaaaattcaccactctctcatcccaaagacccgaaatggcatggctatcctcctgtcttaatttcagccccgaggtgttgcggtttggctaaacctataacaacattttgaaactaaactcattgcagttcctagtgcctcaaattcccgaaattcttgaaattacatatagcgtaatcaacgatagttgaggtcatattttatctccatatgctgatcgactcagagaaaccaaaatgtaggggtaattctactacaaagatttgtatttatagcagtttgctatactcgggagtagtttcgacatatctcaagttcagttatagctctctactacataaatggggtcttttgtctggccactccccctctcattttccatacgtgaaaacctctcccaacttataaaaaccgtccaactaaaaaaacaatttcccaaaaaaaaaatctacgactgtatagagtaaaccaaataacctacttcgcccaaatctttcgcatccacgaaactacagaattaaaaaaaaagaaaaaaataaatccttcccgtctataaaaatactgttgcaatacacgggtcaataactatttaaaaataaaaatataagttatttagtgctaattgggattaaacggtaaggtaacaaaatcaaacccttgtaccacattactttacactgggaagcaacacctcggaatccatttggggagccaaatctcccacgcaacacttctataaaaacgatttcgcaggtcgtgaaagatctattggagttcttgaaaagctcttaaatgaaatgaaagtgcactgaggaccatggatatggcccataggatgatgaacaggcgtttcctgcaattacataaacatgcaatggaaattagaacaaccggacaatccggtaccactgcagacagtccaacaacacacagaagcggacaacccggcagctactggacaatccgatcaacacagagaaaaacatgaactcgcctagtggaaatataggctcgtactgtccacctcggtgctggacagtccgacaacactaagtgtttgacactctaacaatgataggacaatccgaccctgcatagaaaaaataaaacctatagatagagtactttgcacactacttatatactagagctagaaggtgatcaacaagatataagcatgtacaaatagatcaccaagttactcaatatgacagcatcaatgcaaagtacaaaaagcaagagaggaggcactgatttagagcgctaaatatgaaatttgtagttaatgacgtttttatttgatgtcatttagagcaccaaatatgtatgtagagatgaagtcaaaagaatagcatgcgtgccaaagtaatgaagtatttcatagataagatgccaagaagaccacgcatggagtaacaatattagggtcccaatcctatataccgcttgcatacatatttcgcatgacttgtgattatcagaaacaaattaacactggaattcattttgacaagtatttccttaagagagatgtctgtgaaaatgtgattgtcacatgcggttccttctaaacgcataagaaaattgttgattaatttttacaggcctaggtcacaggtggttcactaaagacgtctataaattggtaatcatcagtctacaaaattatagtaatgtattaaaaaaccattgctgctatcatagtaatttgtcatatgttctgtgcatgacaaggttgcctctgttgtttgagtgtatcgccctcaactattttacacaggctgttgtatatatgatcaacaaaatgaagtaaatacacttttcagaccgagtccagtaacattagtatatagatgcctcagtacgcgttgggataattcaaagccagagatggttggtggttctcccacatatataacattgtggtatttgaaatgggaatttttgcatgtcaaatgaaaatatataaggaagagtattcatatataaccgttaattacaggtcctttgcgtcacaaatttcagaaaaaaaaatgagaatatatagttgaaggtggcaaattaatactcaagtgaatataaaaaaagctttaaaattttaacacatacctacaaaataaaaaaatggaaataaaaataaggcaaaagtaagaattacgattccaatcaagtttaatacatgccttgatgttagtttatggtcatgattagaagctgatagcctcagctggctagaataactagtttcatcatgctcatgtctcttttagcagatcatcacctttcttcatattcttacatagggatctcgggctcccactcctgcctcatagagatgatactgatctagatggggccgtcgatatgccctatctcattctaggtggcagattttgaagagtgctactaagttcaccccaaatctgtactatgcatctctagagctcgcaataatcctctgctatcttacatttctgcttcctgcgtagcgagcagatgttcctgatgcctatcaaacctatgataaataataaaaccttatatatatatatatatatatatacacacacagacacacacatattatgtacagcagagctaccattttctattcaataactcagacaagtctgaccaaatggtggcaagggtggcatattcaagttttttgggacagcagagctaccgttttctattgaattggaagaaaaaatattggtactgtaactgttgaagtatagtctgaatattttaatttgttcaacctagctagacagaacgctggaactcacccctgcagatcgatgtgttggactggtggtatatatactggtataaggctttgatatgctagacatgtgtcagatgttggtattgggtactgcaaccgactacaactatcggtatatgcaccaatgtagtcacactcacacatattcattgtcatgctatttagtgttgtatactccctctttccacaaatataacggattttcatttcttttaagagcttaaggctagaaaaaacatgatgtccctgatgaatgatatataattgaggatagggagatatatatgatttgatgaaaactaaagttatatattcacggtatactactcaaaagggcgtacgatctatctagagtcaaagacaataaaaggttacatttatcatttagcactaggtgaaaccccgcacattgctgcgggagtttagcatgataacaataagtaaaaataatatgtaatacagctagacaacataagattatgtaaagttaacgtggtttatgataatttaaatttaaatagtatatagaatgatgattcaaatgtaaaagtaaggtgatatgactttatgaaagaagaaaagtatcgagatagtttggaccgtagattaatcatctaaaggttaaaaataattgaggtgatatggattaattagagaagaaaaggagagagataatttggaccatagattaatcatttaagcactaaaatattgatgtgatatgtcttaacgagagaagtgagaaatagcattaactagctaagactactaagtgaggatgaactaggtacatagcatattataaaaataatgaagatatatattgaaatattttgtgaattatgtgggatgatgatttaacatgcttgcattttaaaagctctaaaatttaataaattataaaattatagataatatagcatgtttacatgatgtttaaatttaatggttgttagtggatgatgatggtgcatcttgttaatacatgatgatgggacatcttgttagtacatgatgatttggcatgtttgcatgttaagccttagtaacataggatttgacacagacaactgcggattgctaaagaaatttgtttatcataattaattctctcttgctataaagttatagcccactaattcctaaagcttaacaagcaatggtgttccatcattatcatctaacaattattacatttaagcatcatgcaagcatgctatattatatataatttaataatttattaaattttagagatttaaaatgtaagcatgttaaatcatcccaccattcacataatatttcaatgtatctctctatcaatttttataatatcatatatacgtttatagttcatcttcatttagttcaatttttttcttttttctcattaagttatatcacatcaattgtttttagttcttagatgattaatgtatggtgcaaattatctctcttatattggaacagtcaagccatccaaacgtccgttgcatttctctttatgtagtatgtgactctaaggtgctagcatgtaaaaaccatctacccatgaataaaggcatgtacctggtcctgcaaagctagtgtttggaagcttaaatgcctacactaatgtgcttaaccatataattaaataattaattggaggtcctaacaggaaatgcatcattgttggatagtgcttaacctggtcatacacgcaattttgttagcttcgtaaaaatgttactcttttcgtttcattcgtttcatattataaggctaagacacttttatcaatgaatagaagacatatcagcaaatccactccgttgtcgagtctaggttatctgtaagtggtgaaatgatgtatgctattttagctgaaggtagaaaagtttagagaggttcaaatgatggacatctccagaataatttaattatgaaagtaaaaaacctagataagatgaatgtaccttaatttgttactcgaccgtgggcatgcaccagccccaaatcatatacagtagctatttcagcttgtcctggtggtagcttagggttagtttgagaagagggggattgagaagatacgcaaaacgaggtgaaccattagcgcatgattaattgagtattaactattttaaattttaaaaatagattaatatgattttttaaagcaatttttttatagaaaatttttgtaaaaaatacaccgtttagtagtttgggaagcgtgcacgtggaatacgatgtccttttctcacccaacctcccagaactcatcacaacgaacgcagccttaattaattaattaggatactatttcaagtttctgacaatagtcacgttgtcacatgcagtatatgctcttgcatttgctttcttatgcacgctatgtgtctaaacccactcataccatatcattcacagagcaatggccagaagctcggcactattctcaccacagccgtcgcgtttagggttggaaagcattgggaattttattttgtccatttctgaagattggactcgaattctaagctaattttgatcacaacccgaaccacatagtatgggggagaaattattttttctaccttcggtgcggtgaacttcggagctaatttggaaaacaagagataaatgcaaaaagttttctgctcctgaagtagcttcaacgtacgctcttcttccaaagaaccaaagacagaatgttgacctacatattagcagaagcatcttctataatccatattgtaatacttggaatcttaagacaagccaaaaaaaaaatttgtgtcaggggcttacggccatttttattttattttatttgtctatcctcatgctaatacagaaatcacatcgacaaataatatatcggttcaaattgaacatcacttatataaatattttttctgacatctcttctctcttataattaattaactaaccacttagaacacggtaaagaaagaaaataataaatataattaacacacatatttttttctgacatctcttctctcttataattaattaacttaccacctagtacacggtgaagatagaaaataaatataacttactatcgaatcaactccacggcgcaaacaaagccaatcgttttcgccacgcgtttctcttctcataatgtagctgcagaggagatgcaaaacacgccaacatgaagaattttatatattaactagatgctattataaagactaaataaagcacgtaagatggctacttggtaagttgttttaatattctaatattgttctgccatccaatgagtcatagaatgttaaccgttactatcatttacgaccctgagagtattatccttacatgacagaaggtgtaaaaacatgacggatatttctcgcccgcctgcccgaccgtattaatctgggataaattcggatacccgagtccttacacggatattggatacaaatacggatattttctggcagatatgagatcgggtttggaaggatggtatccgacggatatagagtgtccggtaaattatacgggtattacccggtaaactacccgtacattacccagattgctgccaccaccactccatcatgtcaacaaccaaaggcagccagggagggggcaagcagtcaccgtctcatcgagggtgccgcacgccggcacgccgcgcgcgtgcacaaccactcgccactcacgagcgccgcccagcaccggccgtgacggtacgatgccgatggcgccgcacatatgctagccgctagtggctacgctgccgcgcacccgcgtccgccggccactgtctcgcacatcgccgcgtggatgcgcgacggccgtcgtaccgccgccgaccaccgtcgtactactttgatactgctgtaatagcactgttacttatggtgatgtacagtagtagttttactactgatatgcagctatggtgaacaacagtctacagcattgagtctctaagagcccactactagctccaattcatctatagccgatctaatagctaatttatataatagttgcttactatactattaatatatactcccacatatcatacacacgttgtgtcttagagtccgtgcttgaccgttgctcttctctctcatattttatctcattaaaatatatttatagctggctaatagtcttctattgtacgtgctcaaatatattcatattatacatatatggaatggttgaacggctattatctatatgatatatatggtcgttgctttgatttgatgtccgaataaatattcgcaatcgatagagttcgtatccgtattggtgcgtattcgttccgtatttattcccgagattattcgggtctgtatttgtacccgataatattcatgtctgatccgatcccgattataaaatatgggttaggaatgggaaggatgagaaccaaccgaaccagacccgttttcacccttgcatgacagcaacacctcgtggatgatccgatcaaggttggtgtccccgggcccacttggcatcgttactcgtacggccttctccttccactctttgagcctcgccagcagcgcgaggaggtggccgaggcagttcgtcatggtagactggcacagcgcggggatgtcctgcgtggcgtcctcgtcctcggcaccgggcgtcgccaacgggaaaattaaacttgtacaagttgcaacaaaaagagcaaattaaactgaaaatagttatcgtatattcgcagctatatttgttatttttgttacaacatgtagaagttgaatttaaacttacatgtttgtggagtgatatatttcatattaatctatgttgctaattttttttaaaatattttgatgaatatttaggtgacatgcacgaaacgaggggatatcccctcaagggatgaaatcaccttcccgctttaatggtgctgttagctagaatctgttgctgctgctgttgctggaatgatattgctactgctgaagattggtgctgttgcttctggaaattctgtggcatctggaaattatgttgctgctccaggaatttgtgctgctgcttctgaagctcatataatgcaagaatttgtgctgatgctgatgctggaacgatggaatgatgctgctgttgctgctattttttttttgtgctgctgaaactgcagtgctgctgctgctaaactgcactgaaattgctgctaattaatgctgctgagatagcttctgttgctgtgctagctgctccttctgctgaaactgctgcttggactgctgaaaatataagcagtttcagctgaaaattagctgctgattctggaatatatgaaaattagctgctgcaggaggaattttgctgctgttgctggaatgtaactgctgctgctggaaaatgctctgttcttgctggaaatgctgctgctattcttgctggaatgttgctcctactgatgcataaactgctgctgataaaattgttgttgctggcttgctgctgtgagtgctgattgtgcttctgctgctgaaaattgatcacgaaaatgcagacatgtgtgttgattgtgctgtgtggtagcagctgtgtgtgctgctgctgtgtggcagggatggtataggagatcggcgacgagcagcagggcgcgcgccgagagatcggccagcggcgtaggggcagggagcacgcagtggagggatctgccggcggcgttggggaagtgaaaaaacggaaatatctgttggtaagagaagagcccacttttagttttggggattaaatcttgattatctgttggagggaggagttttttcacttcctattttcagtttaggaaacccaaaaatatttttttgggagattataggaggactgctggtgaggctccaagggagagcgagtggattagctggtttatttctaaacataatagatcaaacaaattaattagtgggtccacatgttaatagaaatcaacggttgagattttttcagaatatttaggatttttctaatttattaaagtgccatgtgatggcttatgaacgtttacataaatttctcgtggcagcttaagagcgtttataggaaatataatagatatttagtatataatatataaaatataaatagattagggattgacagctattggaaaactatccaatcaactacgtggcgcaaataaaaccaatcgtttgcgccatgcatctctttccataatgtagctgcagaggagatgcaaaacgcaagactacataaagcacataacatagctgcttgattagttggtggaatattataatactccctccgtttcaaaatgtttgacaccgttgacttttttagtacgtatttgaccattcgtcttattcaaaaaaatttaagtaattatttattcttttcatatcatttgattcattattaaatatattttcatgtacacatatagttttacatatttcataatttttttaataagacgaatggttaaatacgtgctaaaaagttaaggccgttaaacattttgaaatgaagggagtattgatctgcgatctaacaagtcatacaatgttaagcactctcaccattcacgctgagagttttatccttacatgacagcagcacctcgtggatgactcggtcaaggttggtgtcccagggcccacctagcagcgtcacttgtacagccttctgcttccactcttctgcacgctgccgcatctcacgccccttctccccttccatggcctccagtgtcatggccgccacctctcctcgccacgcctcgccgccgatctccatcgcgacgccccactctgtctgcttgtaccggcagttcgtctgctgctccgcgaagaacagccagctcagcatcagcacgccggaggcggggctctccagcgtcgagttccacccggagtgcgtcaggaacacacccacagcgtcgtgctcgaggaccttatcctgcgggcaccacgcccggaggacgccactgcccacgacgcatattttgcatgctgcttttcttcactattttgcatacatagatccaccacaaaaagaggggtttaaaatcataaaaaaatacatagcaagagtggaaaggcatgtatctaaccaatgtagaaaaatctcccgaagatttcgagttcaaaacctttccccctatattttgttgttttcggagagaaacttcggttgaaatgaacagttctcagggaggaagaagactataagaaaatgtttttgcaggcggaccatataaggtttcgcccgtgaaacaatctttgcaggcagaccatatattacgtccacctgcaaagatcctaattatcgcaggcagacgtattatacggttcgcctgcgaagatagttttcgtaggtggcaccttatgtggtctgcctgcaataagtttttttttaggtggacggctagcatgatcttggttgctattatcgtaggcggccctttttctccgagggcaatgcccgcttgggaaaaaaatccccacgttgggaagaacgatttttctagtagtgctggtggtagcttaactgattaggctgcaatttctagtttataatagtcacgttgtcacatgtagcatatgctcttgcaagtgctttcatatgctgtgcgtctgtaccctctcatatcgtatatgtcattcacagacatggccagaagccctgtactattgtcacctcacccatcgcgcttaggggtgggaagcattggaaatattattgtgtccgtttcggaccatttgattcgaatccttagatcattttgatcataacccagaccagtcgaacttaggggtgagaagcatctggaatattattgtgtctgtttcggaccatttgattcgaatcctaagataatttttccagaccacatagtatgggggagaaattgttttttcatccttcggtatggtgaaattcgaagatttggcaaacacgttttcttctgtttatatacgctcttcttcaacaaaagcaaagacggaatgtggacctacatattagcataagcatcttttatagtcgcagcttaagacacaagccaaataaattgtgccaggggattacgaccatttagtttttattttatttgtctatcctcacgcaaataaagaaaccacttcgacaaataatatatcggttcaaattgaacatcactaagataaataatttttctgacatctcttctctattatgagtaattgatttaccacctagtcctcgttataaagataaaaaataaatataattatcaaatatgtttttaataatcaggggttgacagcaattagaaaactatccaatcaactccatggggcaaacaaaaccaaacgtattcaccatgcatttctcttccgataatgtagccgctgaggaaatgcaaaacagaaaaaggcatcccgtgaagacgggataagtggataaccttccattcttatccgttctctttctgtgtctctctctctccccgatcctcgcttcatcgtcatccaccgccccaccctccctctgtaacttctcttttcgttcctagcagggggttgggacatgattcccatggcaagccctttaacaagattggaattgtccagcgctcgctatgctaatgtcacgtcgccggtggtggccatggggctctcgtatgctagggtccgggaagagatgcaacgagttcaaggtgggaggtgagttgaggtgtgtcgcaaacgatgtctgcgaccatcacacttgtgtgggtgtcgaggatcagggcagcgacgctccgaatcaaggatggcaacgagaatgaatggcatccctccacctctaaggaagtagccatctcattttcgcgcttgctttttccttatttcctttctcctcatggctctcatcggtgtgaagacatggtactcacagtatttaatgtctgggtatcatgttcttgatacctaggtatcaagtaactggtacccagattatccggattagtaccatatgtaacaggcctgatacctcaggtatcaggtaccaggtacctagatcagtctaacacccataggtaccagacctagtactggtatcgggtacctaggtatcaagtacttggtatctagatcggtctgatacctgtaggtaccaggtacctagatcggtctgatacccataggtaccagacttagtacttgtaacatcctgaaaatttccaacaataaaaatcactaaaatttcaaactttttaaaacttttgcatcatgctggttgttatgattcctattgcttgccaaaccgtaaatgatcaccaagaaggtaaagaaaagaactacatttaagcaatagatatgatttatgagaatataatattgttaaccctacaaataattacgcacaagaaaataaagccagacaaacggaaggttaattactaatttaaattagggattaaatactaaatacgtgaaccatgtgttgcgtgctatgacgtctaaatacacatgaaatgatgaccatttataatggaactctatctataacatagtttcactaggagtaattaatgggatattactaaactctaatggtctatataaaggtaaaccaattcacatgaaataatggtcatgtaaacaaattaagctttatacataaataagaatgcgttggtgtttaactaaacaattagattaatagtgtaccgagtctaaatttgctatttgtagaataaatagattaaaaatatccgtgtaaaatataatgctacacaaagaaactcgaccaatatgccattgaattaataaggacacatcgttatattaattccgatattacccgaaagtcttcaaaaatatataagttcactttagggcgaataatctagattaatctaaaaaggactcatttgtgcgataaataaataaatatgggtaatattaatctagggtgaatacattggttagaataacacaaatattgagtaaacttcatttgtgtaaaaattaggatttatagaataaaatttatataggaaataggcttaaatagggttaaatagccggctagcactgttcattagcccctaggtgttcgacgtggtcccctagccctagcccctcctttgccacgctgcctcgcgccccacgcgccgcgcgccgctccgcctcccctttgctgcgccgctgccttgcgccccgcgccgccgcgcgccgtcttgtcgccgccgtcgccctgccgcgtcgccgcgtcatgtcgccgttgccgcgccgtctccatcccgccgcgcgccgacgccgtcgtcggtcgcatcctctcgagccccactcctccgcgcgtgccgtcgtcgtcgccgtcgcatcgacatcatcgcctcgccgcgcgctgtcgccatcgccgtcgcgtcggcttcactgccgcgtcgcgcgccgtcttgtcgcgcctcgcgccccgcgccgccaagccatgtgccgctgatgcgccgtcgtccgtcgcgtcgcaccacgccgagccccgtgtcgcgtcccatcgccgcttcg

SEQ ID NO: 11037 - DNA, 19873 bp, Oryza sativa
  unsure (1)..(19873): unsure at all n locations
ccatccccacccattcccctcttcctctcctccttcccctcttcgtcccctccaccgcgccgcgccgccgcattcgtgccgccgcgccgtgcgctgtcgtcgcgccgccctcgcgccgccgcaccgccgccttcgtgccgccgcgccgtgcgccgacgtcgtgccgccgtcgccatcgccggtaagccgccgtcccttccctcgttccgtcgccgtcgccgcccgggtggaaaggagccgagagagagagggaggaaggagccgggagtaggatgagagaaaagaaaagaaaagagagagaaagaaaggaagaggaaaagagaggccgacagagagagaaagagagaagaaaggaaaaagggagagaaagaaaaagaaaggaaaagggaaaagagaaaagaaaagaaaagaaagagagggagagaaaagagagaaaaagaaggaaaggagaaaatagaagggaaattgggggagaaattaggaggatttaggaaataaaaatggtcggggttaataatagattatttttggaaattcctcgagcgtaatggtatttcgatcgaaattccgagttaattataaatatatgtttcttgatcagattagattaaaattggtagtaatttagatataattaataaccaaacaattagatgaattcttatagattattatagattatttttggtaatctctataagtcatcggttcatggtagaaattcggattcaattactaggaatcttagccgtgtattatatttaatcgtttagtcatagactaaattaaattgtataatatttctaagatttcgtccgatatttagctcgtaatagaaatttctaacctgttatatggatataatgctcgggatgagtaaattaaaaacttatgacaacaaaatatttatacccgcaaaatagtttaaatcgaaattgggtttgccgtagttcgcagatagtaaagttaataaaaagtaatcgactttcgcattcgacttttactcggatttaagtgaaacttgaacctaaattcatctaaattcataagctttccaatgatatataattcactatttaacaaaatatatttataattataaattaattaatatcaaatgattagataatagttaacctaaatagtgtgccaatgaataaaaatggatattgtacagtagcataattatctttaacatgtattgtatagcttacagtaaaaagcaactactcaaatatatgatccaataataagatattgttgcttacacatatactatacatcccattatagtggtacggtatagtattaatttgcgtgttgcataaattaaattaagagggagagtatgacaaacatgtatattagataaatactagttataaatcttgacctcatataattataattatagttcaactgtaaattaggattattcattgtaaaattatgtgatgggataatctgtacccataatatgattaacctgaacaactctaacatacaaagcatggataattattaaccttttataatttattgtgacaagtaaaatatgttcataattaaagtaaagcttccatcaataaaataataatacaaatgattcactataactatttgattgatcctaaatccatctaacaacagaacctctagtaaataaccgtcctatgtagatagatgcatgcttagccataatccttccatagccacttgatagactaaaccactgattagccaaatatatatgtatcccataaatgctatgtaggttaactcctaaataggccacgatgacaatagaaagattaagaaactttagccttagcatgattgggatccattagcaaacacgaatagtacattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaaggcaagtcatcactattctttgaacatgttgatcccaattgcgaaattattttgtttaccaataaaattgcatgcaatgatgaacatcctacttgtgattataccatgccttgattattgttcacctttaaatctttgtaaccatagatacgtacgagtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggctggaggacttgggtggtgtccggaaaaggctagtgccgtccctggtcaattaaggaccgagccatgaagttaagcatgaaacgaccctcgtacaaccgtacttctcgaatgggtatagacctagcggattagatagctgagcggaggcagtatccatgcatagtggtttcttgatgtgtgaggcaggggctctacggtggggcagccattggtagaaccgcgaggcgggtgtctacagtggtgtcgtcattggtaggactgccatgtgagaatctaaaacataactataacttaatgcatgtgtgagtcttcccttcccgggtgcgccagaactcctctcactgctagaaaccgtgtacgcctagagtgcatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgatggagccacttcccgagaggagggaaggtggacatcctcagaaaaccatgacgattcaatggcgggaagctatccttgggatcacaatggatggtggacagaatcgtcgttgtttaaagtgaacactggtactaaaatttgatcagtctatgctaggttttaggcttgtgaaaagaattgtaaaattagctttatgcaaaagaacctgaagccattctttgaaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgtcttccgctgttgttctctgatagttgttggcctacctgtccctaatgtaagtatttaactcttttagcctaaattcattcgtgatatgttgtgatccaactatgtatgtgtgtaccaactgctgatccagggattggtacggataaacacagaagatttccgatttccaaaatcgggggtctacagtactggtatcgagtacctaggtatcaagtacttggtatctagatcggtctgatacctgtaggtaccaggtacctagatcggtgtgatacccataggtaccagacttagtactggtatcgggtacctaggtatcaagtacttggtatctagatcggtctgatatccatatgtatcaggccttgtactaggtatcgggtacctgatacctagaccaatctagtactcaaattggccctggtgttagcatcataacaatcgaaacaggtgcgttgtgtctctagtgagaaaatgtgcactgacgtgtggtcccttgtgaggacacgaagagacgtgggctgacaaatgaaccctcacatggggtgaagttgataaaataataggagagagtagttagtccgaaaatacttgtatccggtcgaccggcgcggggggagcctgatcgggcgctccccgggcgcactcctccccacgtgcgtacctggtccgcccacttcccctcctattttcccataaaaaatgtttcacctagtatacttataatgtttcactatttataggtctaatgttgcagtgaattaaaatattcttttgcaagaaaaaacccacatattttggaaactctctattaagaggatttggtttattttttgttccatcaaaaatgtttcacataatgtattcacaatatttcactatgtataaatttaatgttgtagtgaacaaaatattctattgcaacaaaaaaacccacatattttgaaaatcccctattaagagaatttggtttatttttttgttccaccgaaaaatgtttcacctagtgtgcacataatgtttcactatgtataaatcagatgttgcagtgaactgaaacattcttttgctatttgctgaaacattgtttttatataaggtgaaacaacgcccgatttaaacgagtgaaacattttcgatctacttagtgaaacaattccgatatacctagtgaaatatcgtgcaacatttaaaaaaaattcaataataagctaaattttttttcgtcggaatatatccatgtgtactcaatgcaaaacgcaagaagaattttatattcgaattagatgctcttattaagactaaataaaccacatgacatggctacttggttagtaggttgaatattataatattgatctgcgatctaacaagtcatacactctcaccattcaccctgctaattttatccttacacgacagcaacacgtcgtggatgactcggtcaaggttggtgtccccgggcccacctggcagcgtcactcgtacagccttctctttccactcttgtgcacgccgccgtatctcacgccccttcttcccctccatggcctcccgtatcatcgccgccacctcccctcgccgcgcgttaccgccgatctccatcccgatgccccactccgtcctcttgtaccggcagttcgtctgctgctccgcgaagaagggccagctcagcatcggcacgccggcggctaggctctccagtgtcgagttccacccggagtgcgtcaggaacacgcccacggcgtcgtgctcgaggaccttctcctgcgggcaccacgccgggaggacgccacggccctcgacggcggcgtggaactccggcggcagcgcggcggcgtcgccctctccccccttgacgaggtctgggcggacgacccacacgaaggcgtagccgctgtcggcgagcccccacgcgaactccagcagctgctcgctcgtcatcaccgcgatgctgccgtagctcacgtacacgacggagctgggccggtggccgtcgagccactcgaggaggccgtcctgctccttccagaggttggaacccacgccgtgcagcgggcttccggtggggacggcgcggcggacgtggaggtggagcgggccgacggcgtagaccggcggcgggaggacggcgcgcatggcgtccagcgccggccgctcgaggtcgtcgaaggtgttgaggatgacggcgtcggggagggacagccgctcggcctcgcgcatgatgaagttgagcatcacgtcgccgaggtccgtggtgcggatgaagctggggtagtcgcgcagctggacgccgtcgcacatgccgcgggcggcggcgccgtcgaccaccgtgtcgaggtacccgtcggtgagctgcgccgcgtcccggagcggcaccaggccacggtcgatgagctcgcggtagaggcgacaccccacgaagccgcaggcgctggccgtccacagcgcggcgcacggcacgccgatcaccctgtcggcgtagtacgcgaacgacatgaggccgtcggcgacgaggcaggtgaccggcggcgaccccgacgccggctcattgagcctcgacagcagcgcaaggaggtggccgaggcagttcgtcatggtggactggctcagcgcggggatgtcctgagtggcgtcctcgtcctcgccagacatcgccggtagcccgtcggggatggcggcgaagaagaagcccggcacgccgtcgagcgcggcggcgccacgggaggcgagaaggcggcggtggttgaactcggtgttgacgaaggtcacgtgaaagccccgggcgtggagcagcttggcgaggtgcagcgtcggcgtgatgtcaccctgcgacgggtacggcacgcacacggcgtgcggcggcttgtcgccggtggcgcccatcgccgatgccattctatgcccgttaattagtttgcagcagagaaagagagatcgctagctgttcgtctggtaatggggagattacattggagtctgttttatagtcaactgagacgtgttaaagttggggtgtggctaaggagagatggatcgcttggagcgatcaccccttgtccccctatacgctcatcccctttcttctccgcttcttctcttcctactgcaccataaattttaaaaaaaataaaaataaaattgaaaaaaattatgtatagaaatactatatgtaaaaaatatttgaattcaaattcaaatttaaaacgaatatgtaaacttttaacttataaacattgggtctataaattaatatttgaattcaaattaaaatttgaatcgggcatgtaaacttttgacttataaactttgggtctataaactttaggtttataaacattagtacagaaatactatattaaaaaatatttgaattcaaattcaaagttgaatcggatatataaacttgttgacttataaactttgggtctctaaactttatatgtgtaaacttgagctgcataaatctatctatctatcaatctatctattattatatatactaaaagtccattaaacttcctacaaacgttactaagccgccacatggcatttctataaatgtttctaggccgccaagtggcgctctaataaaagtccaagaaaaaataaaaatattccattttcatttaatctggtgaacctatattttttaaccgttagatctaactaaaaaaataccaaatagaattatatttagaaagcaccacgttctacgtcgatccatcccatacgtgtacgtgcatgtacgtgcatacttcgtacgtggccccttcccttcctttcttttttttctttttttttcactctcatgagataaaaaccaaattaataatttcagccaatagttgtaaaaatatatgttattccgagttgtattctatcacaagttcattaaacttcctacgaacacacttaagtcatcatgtgacaccctatatactctcctgaaccatcgcgtggcactctaataaattagaaaaatcttaaaaattatgagaaaaaagaaaaaaatatctgaccatccattataacttataaaccggtgaacctattatttctaaccattagatatatcttaattatctgtttccaataaaagaaatctcctctctctatatatgtactcctccctcagtggtatgtacgtgaatttcctattttatagctagcaaccccatataaaaacttaagtgaccataattgttagtaagttatataacaaaccacaacgatgcagagaaatcaaaatattgaataggttttcaacgtgcgtgctgcttgctttaatttggttatccaaataggctaacctattcttgctaggattatcaatgcaatgagcattaggtctacaaatgagggtgtgcatgcacgtgttttcatcctcctaagctctactagttttatcttttactggctaaacaacaagcaccctaaataatcagcaaatttgcgaacacatctaaatttagatccatggtgcctttaaaaaaattaatgattcaaccgtggtaaacttctacggaaaaaaataatttctagggcacgtcatcctaattaccatttaaatatatatatatttagatgttcattaaacttcatacaaacacacctatactaccacatgctacgcatataaacattactaaactgccacgtggtattatagtaaatcagtgaaccatatattttcaactattagatttatcttttttttttcttaaaaaaaccaatatccacatccctcggctctatcccaccagcacaactctcctctccccactggcccacccttcccaccaccccatgcacgtacgtatacatacatacactttttccgtctccaataattctttctctcatcttcctattttataaataataattttaattataaaaatattatgaagaaaacaaatctaaccatcaatttttaattaaattggcagacttataatttcatcaattttcattcaaatcagtcgagttataagtttaacaattagatttaaagacataaatatttcaaactgatgaacgcattaaatatacctcaataaaaacaaagtatccttgccaaataacaatgaaacattgaaaaacatgaaaacatatattatatattcttgaatcgttttacatagtaaagatcgattaaacgtgctctatagcactctcaagtcaccacgtatgatattttaaaaatttgaaattcaaagagaaaataaattatatatctatccatcggttttcacttaatttgatgtcccattatttttaactattagattgcttttctctttataaaaaaaactttaagccaccacatgtcatgtcttaaagatccttagaatgagaaaacaacaaatcataggttcgcacttagattgtttacaaagattttctttttaaaaaaacaatgtaccgtccacttcccctccctgtccaatcatatgcacataacactattgcattgtgaaccctttctaatatctgatttgagttctacgctattcgtttctctccagtctcctccctattttcagctacaaaactaaagagagaaacaaatattaaaaagagcataattttaagctacactgataattttattttatatatcatgtaatcgattttagatgatggtttcttttttacataaagtcgccacctattaccccataaatcctcctaggccttttaaaccgataagcccattatttccaaccattagttctatctcatcttaaaagacaagtgtgtattcataatacatcatcttccaaaataatatattgcacaaccatatttcttcatccaatattatttgcgctaggttgcatggagtctcacacactctctacatggaacgttcgcatatggattctttctcaaattaaacaataatataaacccatgcatttagtggagcctcatatcccacccaattcatccatcaataaacaatgacaacctatattcaattaaaaaatatcttacttttgattttacacataattttctatacatgttttctaacacaaaatatgtctacctacttagtagatgatgaagaatattataaatatttgcttgtagggattaattaaatatgatatgttataaagataactaatagtttggttagacaattataaaagcaatgctaatgaaaacaatttatggagaaatcatatattgtagatgttcaaacatagcgtacgacacatgcccgcgcgaatacgtggtctatcttcttagtttattaaaataggaaagtaatgcgatgccaaaaaaagaaaccacgtggaggagggggtttgatcgctccaggcgatcgatcgcctgttagccttttcattaaagttgtgcgcgtcaatatttttccctgtgcctgacaatttgagaggggaagtttagtgaagattaagaagatatacaaaacgagataaattattaacgtatgattaattttttaaaaatttaacactcgatcaatataaatttttaagcaactctgatataatttttttaaaaaacgcaccgtttagtagatcggaaaacgtgcgcgtgaaaaacgagcgattttttctatcaatcttctagggccaaacacattggaaacaaaaaaagccttaaaattcgagcttcattaatagcttgaaacaaaagttatctaaatggcactgtttgagctcaagtttgagccacaagagtgcaacacaacaaacgcccaaaacaccttacgctatcgaagaacaactcatagttacataacaaactcatactgcaactgggggataataacaaagaaattgatggccaagcagttgttgcatatgcagctctaatttctcatctggatttttccggtcacttcatgctccgcagtaattgcagcttgacaatgagcaactgaacaagtcattgaaagcatccacctcctccgtgtcaccttcagtatggccaacgcctctcactgccgacacagtaattttacactgagtagagccgcacccgttattggtacgtgggtgaaatagttagagaaaaaattactgtaaaacaatttggtaacatcatctaggataacatatattaatctatattcaaaagtccaacactaaattaagtgtgaaaaataatgtctgccctcattgtggcaagctcaaagtagaccacccatatatatcttattaaacagaacacagtagagaagacctccgcggttaacaagtgttgcaattggaaagaaaattacgaatacgtgatccaatcttttacaatatctgtctctatcattgaaaggacagtaccttacaaggacgttgtacaacattacaaagcatcatacttgtggacggaaatgcttaaatttatagataaacttaaaatatgcttcacatacttatatatattttttctggacggagagaatactgatgtacttccgtttgggtgagcataaaagaaattcttcatggcacggttcctaggactaaattgcagagcgtgatcgagcctgcatgtggctaaacgaacaaaagaaaaacaaactttaaaaatgagagagagagagagagatcaggaaggcaaaggaaagcgagttgggggagaggttgttttagtatctcaacaactatgcacgactacgtcactgatgtttaaagaactaggaaggtagcgcatcagcgcgggcatcttatttagtggtgtttgaaattttgttacgaatgtttatgtatatgattttttttaaaaaaatattttttctcttctaaatatgtgtatatcaataatttgtttgggattgttttgaaagttagtttcgatcactggacgtacagacgtgcaaagaggggatatgtttctgggcatttaatttatctatacatatgttggaccgatgggtacgtcaggtcttttgagggggtgtctgtgacatcctagttcgattagatatggcctatgttttatttaaaggatgtgatttgtgttgtgtgcacttcagtagtactatcttgctagttaagcaagagtgcaactaacttgtaaggcattgtccctctaaccatatcattttcgtgttgactattttacatgaagcgacaacgaaagtgtaagtggggtgatatctgtaagtgagtgccggttaaataggctgtgatgtgttgttctagagaacggattgttacaaattgtaaactaaaattacatgaatcatgtcatcttaaatttatgagaaaaaaatgtcgcaacagtggatatggttcatatgaaactatcatttatactatatatgtttcttttttgaaaaaaattagcatcttaatttaaacttttaagtaatactttttcttgtatactaaagatgcatttatagattttaggatatattaatttaagaaatttcctattaagaatatggtaatatggcttctttatctaattaaagacataatcacatacttctatttgcttgtactacctccatccataaattaaaggattcaaattttatacattttaatactactcatcccatcgaaccatccattattcattttttatccaataatactctaaccatcttctaactctgcacataccacatatttaatgagccttatttagagaggggaatcttagtatatttttacattctttcttaattcctataaaattgtaggattcattataggacagacatagtaattaaaaagagcttcattcatagatggatttacagatttatttgtacgtttgtagattgatttagctttacatatttatataggtaaatagacctcatatacatgttgagagatataattaagttagtagaagttgttagatgtctaatggtataaagtaatgtgcctaccatttttgttaaattctttttaggattttcttttattcagttgttaacttaattgtcgtaaggaagaaaaaagaggcgaaagctagtgggttcgtctcatccgtgaggagggaagtggatatgtgaattgtacatatggattttgacagcctgatcgatcggtaggttttatttttaagatatagatctaacattttaaaataaggtccaccggtttgggtaagattttttttctcaaaattttttatataaagatatattagagcgtcatgtggtgatttaggaacgtttatgggaagccacgtggtagcttgagagaatttgtaggatatctaacggatctttagtatataataatagataattcatgtcatattaattaacatatcactcagtaattaaataatttgtatgtgtagtgtccctgataatatccaagtgatgtcccgattttttttctgagttcacccctgaaaattaagggtatatacatccaagtgacgtattataatttttatatagaaatatatgtaccaagagattatttagctatctaattaatttttatactacacgtatttggtgttagccaaaaaaataggaaatatggaaggggagggttagagggggagagagggagtacgtacatacatgtgcacattttttttcgttttaaaacgtattaagtgaacttgtgattggagtgggggaacgtacagattttttttttggaagataagatttagtggtgaaaattaataatctaatgatttaaaatgttgggtccaccggtttataggaaagtgccacgtggcggtataggagcatttgtaggaataccatatggcggtttaggagcatttataggaaatttattagacttttagtatataatgataatgatgctcaaatttctaagaatttttttctaatttttaaatgtgataagttcgatgaatctttattgcgtagaatgatttaagatgacactaatattttaatgtttcgtggttgtttggttgttgccagtatgttcaaatgatgtatttaaatttttatagagcaaaatagtaatatagatgttgatttacttaattaattacaaataaaattactgtttaaataaattaaaaaccggattctgttttgatgcgatatgatcaaataatgtattttagtttttgtacatagtaaaatatgggtgatatggattttaaattattagttatttttctattgaaaaaattagttaaaaaaagagttgggagaaggagtaagacgtaagtacatactatatacgcacgtacggctggaggggtgggaggatagtttgtttgttttgatagatttaattagttttgtgttatctataacagatctaatggcataaataataagcccactgatttaagtgaaaatcaatggtgggttatttttagaaatttttgatattttttaatttattaaaataccacatgccacatggcggcttgagagcatttataggatgtccatgtggtagcttgagagtatttgtaggaagttttatgaactggtgagcaacaagcctgatgggagaaaaaaccaagcaaattggattggcatactctgtttattgcgttcttcacttgctcgcaactgttacaattatgcgttcggcagcagctgactcattctccacatgcatactttttgaactactaaacgatgaatttaaataaaaccagctgcccctcctctcccctttattggcaccagctgccagataaaataaaaaacaactttttttttctccccgacctcctctctgccacccaggctgcctcaccgccacaccgtcctcctgcagggcaccgccgcggccaaagctgaacctgctctctagccgactggcgcacaactccaccctggcctcgacccttctggtaaagctcgcctttttttcttttctgttgggcttttgtcactagttgtgcgacttgatttcttgttagagtgagcatgctgtttttttttttaaagtgtaccactcataggtaccggcatccatgttaccatgtcatcagtgttgtctaacgggcgcttgttttaaatttggcacctaaggatggtttctaaccggtaccaaagtcgatttctgtagtagtggtccgagccacagacatgctaaatagcgtccacgacttatcagctagtactttcattttctggtttctccaggaacgtacctgacctcatcaagatgatcacatatccacgagatccgaagacagaccccctcctatgttattactcttactgtttctggggttagaatgcatatgtgatcatctttagctagaacttcacgagaacaactgatgccgtatgtagggcgactgctcttggatcctcccagtccaaatccttatggtcgagtatagttgtctgatacatgtatatatctctgaaaattgtaataacatactacctccgtttcaggtaataagatattttaactttgacatactacctccttttgatatattatcatatttatttataaaattagtcaaatttaaagtagtttaactttaatcaaagtcgaaacgtcttgtaacctgtgcaaaccactcaagtacaagaacagtagtctatagaagttccagtatctgctgtgcctcgtagcatactttgtgataagagagatcgcagtccaacatatcaccttgctgatatttcaaagagcacacaacatataaatatagaggaaaaagtgtgcccgattgcccatccaattacgatattctctccgatcagactgttttgctcacaggataacattcttttaaacattacctgaaatactcgtccataggttttgagaaattactgacttactcgttctttataatatattttaacttgcttgtaaggtttgtgtcgttcctgcaacagcgaagggcgttgccgctgctgaagctgacagaggggactgatgctttcatcgacatgtccctgtaaaactgcaacgattaagaagccgtacgtgacttgaaatatgataaatgcagatgaggaatctggaaagaactgcttccttcgctatattttctagtttccggccgtgtttagttttcctctatttttaactttccatcacattatatcacatcaaaaacttttatatatacataaacttctaactttttttccaaactcccaactttctttaaatttttaacttttttcaggaactaaacacacccggagtatgtgagtctgaattagttctctgaaagtggtcggtgttttggcatgttctgttctgtcactaaaaaatgtaagctctaatggcgccttttacgccaactttggtttcttattagttcctttcaatctagttgcccagcatagacccaatcaaagccgggcatcattttcactaaaaatgtcgaagggagacaatcgtgggatcgaagatcaactagaatgtactcaaccaagtagcgatgttatttatttaatcttcattagtgatccctttgagttttccacgagagcatgtagttgagatataaaatatcttcatcttggggacttgcatatcctctgcggctacatgattgcaagagaaatccatggccaacatatggagaaaacgctgtgtaatagatactataaaaaccaatattaattttatcttagctttattaattgttatctctgttgcgatgtaactaatttcagtaacacaaaagagaaagggaaaagagaaacatcgttggtacgtatgatatcagctcagcgtcaactcttagtatctatcttatataagtccattaaacttcctacaaacgctctcaagccgccacgtgggattcctataaacactcctaaatcgccacgtggctctctaataaattataaggaaaaaatccaaacaataatttccacttaatcacggtggacccatgcattattttttaccattagatttatctaacaatataaaaacataaaaagcccactttccatcccttcacgtgacgtacgtgtatcaacctccacgtgtagatacgtacgtatctttcctcccccctcacatcctctccttttccccccctaaaactgacaacgttatatattataaaaaaattacatagcttaacaattataatttttaaagttcttttagttgttcttttatttataattcaataaataattcaagtttcatattatctatattttattttactatataaaattgaaatacatcatttggacattatatggaaaccaaacaagaataagacattataaaaagaatttgatgatatgcttcattttatcttaagtcaatccagatgatcaaaattgatcaaacttcctatagagcgctttttaagtaaccatatatcacgtctacggggaaaaaataatttggtggttcaattagctttaaccattagatttatctaaaaaacttaccaattaaatttatctgtaaatagctccacatctataatgtgtacgtgcaggtaagtagttacatacgtactaaaaatagtactacgtacatgcatacttacgcacaccaagccccacatctttatttctttttccctttctcacttaaattagatgaaaaaccaaactaataattcaatgagcacgtgtgtcatcaagcacctaagataagaaataatactaaataggcaatcatcaacaaatgataagtagaggttgccaccaagccacaacaaataatagttgactacaaatagattgcgagtatgactaatagggttcctacaatcctaagaagccacgtaacgctttgataaataacacaaaatctaagaataaaagtaaaacaccttgccatcaatttacacttaaaccggtggatccattatattcaaccattatattagatctatcgaagtaatgccttgctcctaaaaacaattaatccctccctatatacgtacatacacgagagatgtaaaaagaaaaaaaagagagtgtatataccatttcgcatgtatggtagattttttttcagcgttaactcctagcgatgttgtcgaggaagcaatgtcgtcttggcaccacttgtatttttttataatgatgtaaaaaacagttgggcgctcatataaacacatgcatacccatcctgtgaatacacatacacacattatcccctacaaggggaaaatatttgtaaaaaaccaagaaaaaatatatagatccgagagactactattcaccatgaaaaacatacctacttacgtaggtacgtgcgtgcgttcgtacgtacgtacatacatacatgttacatacatgcgtacgatcgaaaatggcacgtggaaccacattatatctctttatatttagggaatcatcttaatagtgttaataattagcataataaattttgacaatataaattattctttcgtatattacccatgaaaatgcataagtgaattagatgtatagtaaaagaaaaaaaaaaccaaaacacatattaactagtatgttcatatgtttgtgaaggatggtgataataaagtgatttttgtttgaatataataggcattatcatatagtatatcaaagtttatggtctatattacagaataaatatttttttattataaggtaatgattctcatagtgaatatggcgagatatcttttagtactctttttataaacaataagtgaattgcccgcacatctgcgtgggcttccttcctagtttattaaaaaaaatactacatgggatgaaaaaaaagaaaaaaatatgatgaaagaatatttgggggaattaatagctaagagaacatatgtgtcgacatctttctagcaaacctgaaaatattttaccttagttttattgatggttatctttgttgccgcgtaagcaattttaatgtaaaagaaaaaggaaaaagagaaacattattattgatacgtatgacatcggctcaatgtcaactcttagtatttattaaaaaaaaattactacatggggtgaaaaaaaagaaggatggattaatacatataagagaacataaataaatgtgtcgacatctttgtgttacatccgaaaatattttacccttgctgtattcatggttatctctgttctgttgccgtgtaagcaattttggtaacataagatagaaaggggagaaaaaaaagaaacatcattcatacgcacgatatattagctcaacatcaactcttagcattttaaaaggaaaatttactgcattggatggataaaattaagaaaagaacgataataaaatattattttggtaaattaatagctaacagttcttgtcttatattgtaaaagggtagttttcttagtgacaaccatttactaagggctccaacgagattctagtaaagcttaggttttgttcgtttaaaactaattagctcgtaattaattaaatattaattattgtaacttaaaaatagatttatttgaactttttataaaacaacttctatataaattatatttaaaatatgcaccgtttagctgggaagcgtactaatggaaatggaaaccaaggaagatttgtggaagtgatttctgtaacttagggcatccacaatgtagtctaagggtgtgtttgaggagaaggggattgaggagattgggaagatacgcaaaacgaggtgagctattagtgcatgattaattgagtattaactattttaaattttaaaaatagattaatatgattttttaaaacaactttcctatagaaaatttttgcaaaaaacgtaccgtttagtagtttgggaaacgtgcgcgcggaaaacgaaacaaacaaactcactctctcaccctctcgaacgctgcctaaaactagtcaataagcaataaaatattccattcagccacctaaccacattgtgtaactagtccatagcaagaaaatagcaaaagccacccataagcatatgggctgcccatatagaataaaatatattatttgtctctattttctctctcctcctaatactagttgctatccatatacattgtgaagataacattagttatagtctatatatgtgggtcccatctatatggattacttttgttatatacattggtgttacccttagccggaaagctgccattaattaattattacaggagagaaggcttagcatgtgggtagaccaaaaaaacaaaaagtgaattgagattctttatttgggttgtctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11038 - DNA, 709 bp, Oryza sativa
  unsure (1)..(709): unsure at all n locations
nnnnnnnnnnnnnnnnnnnnnnnnnnnnnnnnnnnnnnnnnnnnnnnnnnnnnnnnnnnnnnnncagacgtattatacggttcgcctgcgaagatagttttcgtaggtggcaccttatgtggtctgcctgcaataagtttttttttaggtggacggctagcatgatcttggttgctattatcgtaggcggccctttttctccgagggcaatgcccgcttgggaaaaaaatccccacgttgggaagaacgatttttctagtagtgctggtggtagcttaactgattaggctgcaatttctagtttataatagtcacgttgtcacatgtagcatatgctcttgcaagtgctttcatatgctgtgcgtctgtaccctctcatatcgtatatgtcattcacagacatggccagaagccctgtactattgtcacctcacccatcgcgcttagggttgggaagcattggaaatattattgtgttcgtttcggaccatttgattcgaatccttagatcattttgatcataacccagaccagtcgaacttaggggtgagaagcatctggaatattattgtgtctgtttcggaccatttgattcgaatcctaaaataatttttccagaacacatagtatgggggagaaaatgttttttcatcctttcgtatggtgaaaatccaagattggcaaacaacgtttcttctgttatatacgc

SEQ ID NO: 11039 - DNA, 732 bp, Oryza sativa
agtcattcacacaataaaaaagtgtggagcccactattatcctctctatctccatccttcttcctcctcccgctctcgcttctctctttctctctcccattttctcttcaccttggccggacttctggagcaacgacgacacgtcctgtgggtggtgcggctgaagaggtcttcgccctctcggcgtctcgcctctgcagctggaggaggagcttgtccttggcgtcgacggtgaggttggctcgccccttcgccttccggactccctcatggaggccgacacttgcccatctcctctctcttttagctcttctcgctgccgacgaaagacgcgccgaggtgccaccgctcgcacagcaagaccagacgacgatcctaaaataccaggaggcgcgcggcgggaggtttgagaagaaagaggcggtggtggtggagaggcgtgcgcgggctacgcctatgcggcggatcagtcggagatcggtgaggtgagtggctccgtgaggaggatcacccgcggcgagttcttggccgccgagttttcacgaggttgtcgccgccgcctcatccgccgccgttctcatttcggagatgccacgcacgtgtctctaccgctcgccgcggtctccgcctcgtcaaccgcgtctctgatgctttcttcgccatcgccgctacggtcgccgccctcgcttgcctgccacggccgtagaggaataagaagaggagaggaaagaa

SEQ ID NO: 11040 - DNA, 32768 bp, Oryza sativa
  unsure (1)..(32768): unsure at all n locations
cggttttaatagttgggggggtcaagatatctagtatcgtggtttaaggatatgaatcagattcaagtactacctaatggagtcgaagtgaacttattcctgcccaaaaccaatctcaatcctcattttttcgggggttttggtagacagtggcatagtgccagcatctccaagagaagattaaaaattagttcccaaaaatcttggactaaaaccgtcccaaaaattattatgctaataaaaagttgagaatttcttatataccactgaaaattagttggttcccttgtatgccactcaaaattggctcttccctttatgccactagatcttcactatttatcatactattgaatatatgaatgtttgcagtcacatgattttgaaccaaaggttattttggtcatttatgcaagaaaaaaaaagacatgtgacttgaccctagtcagtcaacacgcagtcaacagtcgagagtgagagggtgcacaaatttaagccaatcgcatatagaggaagagccaattttaagtggcatataagataacagaccgattttcagtgatatataatttcagtgatatataaaaaataaaaatcctaatattatatgattgttggccacgtaggcatgtgggcctagttcagttgatcgatctttttttcttgccgtggatacgttgccgctacagtacctcgacgcctcgccgatcgctgctgcctctgattttcttttttgccgctatagttcatcgacgtcttgttgcacatgtggagaaacggaaggtcgagacgatccccagccatacgacctcctacctatggcgctgctacgatgcagtagtgcttgataacctggaagatttagaaaaaaaaaatacaacatcttgacagtagtgtattatgtaagggtttacagataattcataccattttatacttcacagtacaaatcatgaacaaaacaatatttctctgcattcagaatacatatcgaacatactcctttcattccacaatgtaagtcattctagcattttccacatttatatcgatgttaatgaatctagacatatatatatatatatatatatatatatatatatatatatatatatatctagattcattaacattaatgtgaatgtggaaaattctagaatgacttacattatgaaacggaggaaatagattttctagggtttccatggaaaaacaggatactggagatggacggcagagggagccaggctggcgttggacgcgaacccaaggcggcgacgtcacctggagtcgaaaggtgaggggagtcgctagcgaggagcacctctgagctctctttctctacctttctatctcgcttgctcctgaagaagacggcggcgctaacgggagtgaggagaggggacgatgaacggatgaaggccgagacggcgtcggcgcgctgcacgttccgaggatgaacgatttatcctgcgtatgcaccgaatttgggagcgcggagagcttcgaaacagtactccctctgtttctcttaatataaggaattttgacattttacttataccgtttgaccattggtcttattaaaaacaatttagaattattatttattttatttgtaacttgctttattatctaaagtactttaagcacaatttttcgtttttatatttgcacaaattttctggataagataagtagtcaaacattataagaaaataatgaatatcccttatattagagggagagaggtactatctattaagcgattggtcgcactgcacgtggtcggattctaattttcagcttttagttcggttcaggttgtcgggtcttttctctttccttttgggactgatgttttgtgggctcacggtttgtatttttgtcccgtgtggataacgcttgatggggctaggtttcctcttctttttgcctaggaataagttcaatgtgggtcccacaatttatcgtccagtttggaatttatccatgaaccgaagcacatcgtcaaacttaaaataccggattaatcgaggtcccaagcagtattaggtccggtttaaactgatgtggccagctgagtcaaacgtgggacccacgcggggcccacgtgtcagcgaaccatttttactttcttctctccccaactcttcagggcgacgtgtagcgggttggaggcgtggagaggggcgtcggccgccggcaggacgctgcgccgtgggatggcagtcggaccagagtcgcgcggctgtcttgcggcgacctggagtcgttgacggcggagcacctgtacgtgcgtagcgacgtagcaggtccgggaagcgggagctcgtcttggaggatgtggagcttgccaaggtagttgagatggagaccgtgttcgctttagtttgagcgtggatttgtgatttcttttttttttctcttcatgatttgctcgctgtagatgagcatggtgctctgatttgctcgctgcagtacgagtaggaactctgattttctgatttgatattttcatttgctcaatattgatattgaaggatttagtctaaaaaaattaaaatgtccagtgaagaaagagcatgatttatgatttacttacagattgcaatcctatccaatcttctgcacatgttatgcttgtcgacacaccgtatggcgaggtcctcgactttgttggagaggatgagagagcacaggtactcaacacgctcgcgcatgacgtggatgatggcgaggagctcgagacgcctgagctgacgaacgccgtcagcatctccagccctagatagggagctgctgtggagagcttcaacaagctacgccgtggaggaagaggaaggcggaggagctcgaggaaggaggagggaaggtcggcgatgaagaagatggtttttttcctcttctgccagccaccggttgcatcaagggagagagaggagaagggaaggaggccggcaaccacccctctccgccggcggccatttgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttataaccttgccccccaacctatataaggagggcagggagcccctctaggggcatgagacaacctgatcgtcagatctatactacacccggcggattcaaatccccaaacaggagtagggtattacctctcatcgagagggcctgaacctgtctaaatcctttgtctccacatccatccacttttaggtctcgtgcgctaccccgttttattattgccgaattcatgtttcgacagttggcgcgccaggtaggggttgcgtcgagtttcctatcaacaagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcttccgtcgccgcccgaccggtgtcatncgcctatacgngttggtcggtcacaccaccgctgttgggcgtccacatcttcaccgttggctcaccttcgctaccgtcgactggtgtttccgcctacacggctggcctattatgccgccgctgttgggcgtctacgacttcaccgccggcctgcctccgtcgccgccgactggtgtttccgcctacacggctggcctattatgccgccgctgttgggcgtctacgacttcaccgccggcctgcctccgtcgccgccgagtggtgcctccgcctacacggctggcctattatgccgccgctgttgggcgtctatgacttcaccgccggcccgcctccgtcgccgccgagtggtgcctccgcctacacggctggcctattatgccgccgctgttgggtgtctacgacttcaccgccggcctgcctccgtcgccgccgagtggtgcctccgcctacacggctggcctattatgccgccgctgttgggcgtctacatcctcaccgttggctcaccttcgctgccgtcgactggtgtttccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcttgccttcgtcgccgccgactggtgtcctcgcctgcacggctggcctatcatgccgccgttgttgggcgtccacgtcttcgccgaccggctggccttcgccgctgccgactggtgtttttgcctatacggttgacggacttcgccgctgttaatgggcttcatcatctacaccactggcttggttccactggcgccgactggtgtttttgtcaccattgatggactgcttcgttcccacattggctacttctgccatcaccaaggggaatattacaaagctaagtcgtcatttattttattctttatatgatatttttccttttcctctgcctcactacaccaattggtcttccattgagtagtgagtcgggggctacagatgttatatcatattttttataatattcatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccgccgccgactggtgttctcgcctgcacggttggcctattatgccgccgctgttgggcgcctacgtcttcaccgaccggctcgcctttgccgccgccgactggtgtcctcgcctgcacggctggcctattatgccgccgttgttgggcgcctacgtcttcaccgaccggctcgcctacttcgccgccgactggtgtccacgcctgcacggctggcctattatgccgccgctgttgggcgcctacgtcttcaccgaccggctcgccttcgtcgccgccgactggtgtccacgcctgcacggctggcctattatgccgccgctgttgggcgcctacgtcttcaccgaccggctcgcctttgccgccgccgactggtgtcctcgcctgcacggctggcctttatgccgccgttgttgggcgtctacgtcttcaccgaccggcttgccttcgccgctgccgattggtgcttccgcctgcacagctggcctattatgccgccgctgttgggcgcctacgtcttcaccgaccggctcgccttcgccgccgccgactggtgtttccgcctgcacggctggggcgcgtcttcaccgaccggcttgccttcgccgctaccgattggtgcttccgcctgcacggcagacttattatgctgccgttgttgggcgtctacgtcttcaccgaccggccgccgcatccgcagctgactggtgtcaccgcctgcacggctggcctgttataacgccaactgatgctaccttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgctgactagtgctctcacctctacgtctggtttatacagttaccactactgatggacatcatcgtcttccgttgccgactggttatgccgccggcgactagtgcttttatcttcacaactgcgcgtcttcgctacaagtttgctcctgttgccgccgactcgtgttcacttcatcacgccgatgcaactttgtcatcatggtggagcaacttcatctttattatcttcggcactggcaaactctattgctgctacttcgcaagttttactacttcaccaacaacgacgtctttgtgagcctcgacatctcggcatgcgatgccatgttattttactacaacaagaggctctccaatattcaggatttctacttggacatcttcaacacatatcttcaatcaagcaatgactactcgacgacaagaagctataattctcgactctatgttcagttgtttcccaactaatcaaagagtcgggggctacacaaatacaaggctcaaaatttgataaattttatgtcaagctgaagaaatcaattaatcagccaatgagtcaactccaggagtcattatcttcatcttcgcttcggaacagacattctacttcaacaacttcgaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcttcaacatagcctactctgctgccgttgatgggaaacttcgtcatcatagtcggctatctctattgccgctaatcatcattaccgtcggatgcgtttgtcgccgccgattattttcttcatcttcatgattggtggatttcgctgtcaccgttgatgcgcgtctacgtcttcatcgtcggtttgcttttgtcaccaccgactgttctttcgttgttgttgggcgcctacaccttcactgctagctgacctgactgttgccgactggtttcttcgcctccatggttatgcaacttcattacctttgattggtgtcactgtttttactatcactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgggggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatgttttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctgacttttttatatagtcaaggtgctgtttgggtttatcaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatgtttccaggtgtggtgaaaccatgtgtcttttagggattaaagcacgtctgttaaagcagtgtgcgcatggcgtatgtccaatactttggaaatttatttattcacaacatacaagcttctttatagctgttttgctatgtgaattttcaataatgtagccaactttaggttacactcatcatattttacaaagcagtcggtgtatcacttggatcatattattcagggattcacaccgcatatgctacatattaatattaagtcgcttggttgactacaattatcgaaaccactcggttggttagattatttattccttgattatatgtttggtttgttcaattaaccacatagtcgggggttacacctattaggtgcatctagtcgatgcatctgactttattttttcagccctccacagtcttctgatttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttataaccttgccccccaacctatataaggagggcagggagcccctctaggggcatgagacaacctgatcgtcagatctatactacacccggcggattcaaatccccaaacaggagtagggtattacctctcatcgagagggcctgaacctgtctaaatcctttgtctccacatccatccacttttaggtctcgtgcgctaccccgttttattattgccgaattcatgtttcgacaccattgccatgtgaaggatacgagaggagagagaaaggagacagaagaattggaacggacatgtggggcccacttgctacgtcagttcaaaccggccacaatacttctagactgaaagttgacatggtattgcaagttggaacatagggtatacatggtatgtcgatttaggtatagatttcagattcagcgacaaattaatggacctagagtgaatttattcctttttcctatgaagagtgttgttttcgttttttttttggcaaaaatgagtccaatctttcattggcttggcccgtttatcgtatgggtctctcatcccacatatatgttatgttatttctctaatctttttccaatttgtttcaaatatatatcaacaaaatttatatgtctaaagtttatatacacaaagtttgtgccaaggtggagtttgttggagtttgtgtcgaatatgtgtatgttgtcggttgcagtataggacttggagttgtattagatgttaggaatagagtaagagtctgtctctatcctagtatctctcttaaatagaggggtggacctgctatgaccacatggcgatttagcatagcgagaaggagcggttgccggcggcgtccagtcatgagtcattgtaactttgatatgctgtaatatgctggatcatggaggagcgtctgtagtcagtgcaccagagatgtaggcctcggctgaactccgttagcaaatatagtacccggtatcatcatcatgttggcatcacctacgacgtttctttcgtgtttagctaccgatgtcgattttggggctgcttttataacagccgctttgcgcaaggatgggcgccgattgtttgcagcggagttgggagggacggagtcaccgtgtacccgtccccgtgttcatggaagaagggaagagcgatagtcgatggcggacggtaggcaagagcgatacggcgaccatccttctggtttgtgagctaaggattgaacgatattgggctaggcggctggcaagcatcaacctatcatagaaccataactacttaattatccttccaccttaattaaataaatgactcaaatggccaccaaaatcaacggtgggtttattcttgctatactagtacaccacgagtgtgagcgattcggcagtgacgcgcccttgctgctgcttgttgagcttgggggatgggagggcaggaggaggtgccagatcaggaggaagcgtcggctttgctgccccctccattatccaacaaggagaagaggcggcgccatgaccaccatgagctcattgcagctgcggcttctccgcttcttggtgaaaagattgggggaaattcgtcttcatggtgaagaaaagtgagtggagtgggtggcacattaaagtagtactagtagtagtacaagtactcgtgtgatttatttttaccgtgctctgcagctcccacttgagagttggtggcatagtagagtttgcactattaataaagtatgcaattcaaacatgatgtgaaaaacatgtatgttttgttttgagttgtatcttgcttccctttatggaaagataccatatatatgggagaattcctaatttcactatgtttcgaagcctaaattaactactaatctgacccttttttttgtttgcttatttaaccctgcttttcaaaaagaaatgaaatataaaaacttttcataatgatcagaatgcctcaaagcaaccctatccgcatctaattctatccattcagattaaccatatccattcatctctcgtatcccgtctctctctctctcggcaagtggcggcggcggcgccagcacgttgtaactctgatacgctgtaaaatgctggatcggggtggaacgcctgtaatcagtgccctggagatgtaggcctcgactgaactccggtatcaaatatcgtgcctcagtgatatcttcatgtttggatctcctatgacgtttcttctgcgctcagctatcgacgttgatttcggggttggttttataacagtcgcttcgcacaaggatcggcgtcggttgttgggagcgctattgggaggggcggagtcgccatgtgccagtccccgtgctcatgtgaagaaaagaagtgcgacggtcgatggcagacgatggccaggagcgatacgacgaccatccttctgcttcgtcagctaagggttgaacgctatttggctaggcggctggcaagcatcagcctatcatacaaatataattacttaattgtccttccaccttaataccgaaatcaatggtgggatttattcttactacgctagtacatccaccggtgggaggtacaacaaaaacaccgttccattggctatatagtacgttcaaaaagaaaaccagattatttcttcatgcgattgttgcaatcctaggtgacggtgtattatatgtgattgctagttaaactgcattttccttgtgatctgaaggaggaagaaaaggtggctgccatcaccatcgcagggtgtagagaaataacttgatgcacgttggaaaagctcatggattccagctccagtgacaaaaacaaggagacattatgcctccccaccaccaccgtcgggggtgatgcttcctccaggctcaggtgtagcatgcggtgataccaccatcgtgttgatcaggtccaccaggtgctgctccgcgatccaacaatcgacgcacaccatcgtcgttagtagggcagtgctgttgtaggcgtgcattgtcatacctctcttgagcttctggactttgtccgcaagagcgtctcttctattgaagttgctggcaagggtggcaaaaagatcgcaggtatccggcagagtgctgcgatgcgtgttggtgtggctggccatggcccttagaatcctgagctcgccggccctagaccacaagcgctcgaatgctgtcacccgctttctcttgttgttgcgcttctgagatggggttgaggttggcttcttcttaggctcaccgtcgccaagctggaattgctccttcaccttgggcgccttgggcgtggccttttggggtgaaggacgattattgcagggtgcgagctatggctacgattgcgagggtttggcttgggattcggcttcggccggctatccctcctgaggcttcggcttcaacggtgaggtgcccctgctgcttcttgttgagcatgagggacaggagggaggaggaggtgccggatccagatgaagcgtcagcattgctgcctcctccgttgcccaaggaggagaagatgctgtgccaagaccaccatgagctcatcaccgctgcggcatctcagcttcttggggaaaagattgggggaaattcgtctttagggtgaagaaaagtgagtggagtgggtggcacagtgaagtagcagtagtacttgtgtgatttttttcaccgtgctctacagctcccacatgagagttggtggcacagtagagtttgcactatcaataaagtatgcaattcaaacatgatttgaaaacatgcatgttctatatcttgccgtcctttgtgaaaagataccatctatatgggagaatttcttatttgactctgttacgatgcctaacctaactactaatctgaccctacctttttagtttgcttatttgaccctgcttttaaaaaagaaataaaatataataacttttccaaatgatcagaataccctcgaagaaaccctatccacatctaatcctatcctttcagattaaccctatccattcatctctcatatcccgtctatctctctctccctctctctcggctagtggcagcggcacggctcattgtaactttctgatacactgtaatatgctggatggtggaagagcacctgtaatcagtaccccagagatgtaggcctcggctgaactccgttatcaaatatcgtgccttggtgacgtcatcgtgtttggatctcctatgatgtttcttccgcgtttaactaccgatgttgattgcagggctggttttataacagtcgctctgcgcaaggatgggtgctagttgttggcagcacagttgggaggggcggagccgccgtgtgcccatccccgtgttcatgcgaagaagggaagtgcaacgatcgatggcggacgctggctaggtgcgatacagtggccatgcttctgcttcatgagctaagtattgatctattttgggctaggcagctggcaagcatcagcgtatcatagaagtataattacttaattatccttccaccttaataccaaaatcaacggtgggatttattcttactacactagtacacccactagtgggaggtatagtaaaaacacccttccaatggctatatagtacattcaaaaagaaaactagattatttcttcatgcgattgttgcaatgctgggagacagtggattatataagattgctagctaaactgcattttcctcgtgttctgaaggaggaagaaaaggtggctgccatcgccatggcagggtgtagagaaataacttgattcacgttgcagaagctccaccgccacccccggtggcgacgctgcctccaggctcatgtgcaaccacttttgtgccgatcaggtgcacctagtgctgctccatgatctaacaatcgatgcatatcattgtcgtcagtcgagctgcattgctgcaggcgtgcagtgtcatatcatctcttgaacttgtggactttgtcagtgagcttggcctggtcggcatctcttttgtcgaggctgttggcaaaggcggcaaagagatcgctggtatccggcagagcgccgcgatgggtgttggcatggttggccatgtcctctagaatcctgatcccgttagccctggaccatgaccgctcgaatctcgccacccgctttctcttgttattgtgcttctaagacggggtcggggctagcttttctttggctcgacgtcgccgaggtgcagctgcgccttcgccttggacgccttgggcatggcctttcggggtgaaggacgattcttgcggggcgcgggctgtggctgcgattgcgagggtttggcttgggcttcggccggcccttcctcccaaggcttcatcgtgcaattgcttcgccagcgaggcgcccctgctgctgcttgttgaggataagggaccgggggtgggggggaggaggtgccggatccggaggaagcatcggcattgctgccccctccattgcccaatgaggagaagaggctgcgccaagaccaccatgaggtcatcgctgctgcggcttcttcgtttcttggggaaaagattgggggaaaattcgtcttcagggtgaagaaaagtgagtggagtgggtagcacagtgaagtagtactagtactggtactagtactggtacaagtacttgtgtgatttttttttaccgtgctctgcaactcccacgtgagagttggtggcacagtagagtttgcactgttaataaagtatgcaattcaaacatgatctgaaaagcatgcatgcgttgtgttgagttgtatcttgtcgccttatatggaaagataccacatatatgagacaattccttatttgactctgtttcgaagcctaactactaatttaccctactttttttaccttacttttcaaaaaaagaaatataataacttttcataacgattagaataccctcgaagcaaccctatcctcatctaatcctatccattcatattaaccctatccattcatctcttgcatcctgcctctctctctcttgcggtggcactagctcgtggagggagggagcagcggcggctcatggtgggaaggagcggcagggggcaaagggagggatctgcctggccagctcccacagcgtcaccttcaggagccgtgccagagctagacacagagcatgaggcatctgtcgtctatggcgaatagcccgatcacgccggccatctctatggctttgaagctccgttctttgttgtacacctttgacgcccgcagatacttacctcggtagctcaacgagggatcacgagggatcgttccatcatcttcgtgtcgagcgccactaggctgcaggtagtgcgaggacagggtgtagaactacgtcaccagcatgtacctggtggcgttggtgtcgcggctgcaccacctgcgcaggtggtgtagccttccgtacgactatgatgtactcaccgcccgtacgtcgagcaggtagctgaccatatagttctggaacacctcgtacacccgagcgtcatgtagtagacgagaacagcagcatgtacgttgtatgggcgtggcacccgcggcctgtgtccatatgtcatatacagcagttcgattcagtgagtaacataatatttttctatagcagttaagaaatgtttgacaatatatacaagatgaaaataatctaaaataccttgtatggatatatattccattatatatatatatgagaaaaggccgcaatgatattccattatctaaaaaattagatatagctatacatatatattaatgaatggtgttatatattttttctatttattgtttctgtcagttgtactgattcagtttaatcaaatactttaatcgtcgtgcaggtcttcccatatataattcatctaaaacacaattcatatccgcgaaattcaatgatctgtaagaatgaaaatgtattcctatggagttaaatattccaagctgcagtacagttttatgaaatcttacccctgctaggaacacgtgcatcaactgatcactgtacagaaacaacgtatgggaatcagtatcaaatttggaacgggaaaattatgcagaatacaatgttcgaaacactgttgtagcatggcaccttctgtagaatgcctggaactttatggaatcataacctttccagtatctagaaaatattgaacttcaggctttgagcgaaatttatgattgtaatccttgtggcggtaatactgctatgtgagaaaaaaattaatttcatgtaacatatgaacaacaaaataaatttagtatatgtataatttagaaataaccaacatgcattttctttcttttttctttggttggaaggggatatgggagggaaaaactcaatatatcccaatactgcatcacgtgtatgaccctagttagccacccaaaggtgcaaggattcacagtatacaggctttgatccaaattaatttttgatatgttctcgcaattcattgttagaactgataagttagattaatgaattagcaagaagatatattatttatatgcaacatactgtgttctaatagtgattatatttgaaaaataaaagtcaaatatattttctgaatgccatttgtactaaaggtagctatcataaaatagtttggttttgtacatattactttgactgcacacaaattatcatgttatataaacaagaatatgtttttaaaaaggaatgtaactttacaaaccactccaatcctgccatatgtcattactagataaagaactatgcattccaatggttccatgttacatattggccagatgtgacatatcccaccagatatattctaagaatgcaaattgttttattaccattatttaattgtagcatgagaagtatttttgctagacgatatgagacttaatattcagatttaatgaatgactaaatgtgggtagtactcccaaccaacagtactgtttaaacactaaatctgtttgttggatttcaattgttccatgtgtcaggttttatactgtagttatacaaagtataaattttaaaagagtaacacatgtttgggtttacacaaagaaataaatgatagatatatagctcatttttcgatcatgcatcattcttttagggttaacatataacacatctttatgtcaaaaacatttgtgcatttaacattttcagccaatctccaagattactatttcatgtgtacaatcaccggtactttcagaaacgttgaacctgctaagattaaaaatccctacatattattgttatattgatgacagggctggttatctttccccaaaactatctaccctaacgaagtaaaacaaaacatttaaaaaaaaaacttcgtttgtgatacactcataaatttgagaaagaacacatttaactcttttaattaatcatgaaaatttatgaaacaaatataactgatcaacatataatattaattcactaaccttatctttggtcttctgatcatttcgaagatgattctcgatgtcccatccagttggatcaacctcatcttttcttggatgaaccttccatgattcaggaatatccttattgtttttcacttgtgtttttctttttcacttgtgtttttcctgaggaccacagaaacaacccagagtctgcatcttgtcgttgaccactctagacaagattgtcaccgcttagaatcctctgaaagtatataaccatggtgagaatcttgaacagtacgacaatacaaggtctcgtgaacgatttaaactaattcgatcatgtgataggaaacacacaaacacacacacacacacacatatggctcaaaaatcactgtgctgctcaccggattgcatacatttttctagaaactataagaattgtatctttattcaaatttgcatctataataaagaataccaatttcagaaaagatgttggaatatatgttgtattgcaggactgtttaacagaaataacaagggaagtaaaaaatcccatggagcgcaatcatattgtgttagttatagagaaaaagtgaagtcgaaattaatatattacagttgttgtttttccaggtgattgtgttccagtacttcaaaatctgttgaaatttgttatatatgttacagcactatttatcgtaatcaggaacataaacctacgcaaaacaatcagattgagctggatttaaaagttaactgagatgaagcaccgtttgtgatattctcatcaaaactaatggattgcgatatctgatatttttgatgaaccataaaaagatcatggagacaaaaaaaatcaggatatgatagaaattcatgaacctcaggttgaaacactacatttttctacctttttcctgggtgcaactcagagtccacataggagagaaatggagagaattactaaaactatttgcgatcatcccaaagctagcagccttcagttctctcgctatcggtttctgaatctgcctcgtggttattagccttacgagaatccacctcctgatcaccataaccaccaggatgcacacaaatattctgaaatcagcggtaactgttctctcgctgtcactaatgctgttgcttccatcagagtcatcacccgaataccatggattagctcctgttattgccacacccttgcctttgccatcaccagaagatggaagaccagatggtccatgggtaccccttctgatggtgccctgggtctagaagtaggaaacctgcaagaagagaaggagagacaaaagagaggatttggagatgaaaagaggattggagtaggggtagatccgggagaaacgaggtagatgttcatatctgtgctggaaacaggttgctccagaaaggctgtaaactttaattaggagatattcatattagctgtaaacttcccttctaactagaaaaaagttaaatgccaaacaaaaatgttgccagcacaagaaaacacatttcttactgttgctgccaaaaatgtgttttgggacgcgttcacacacaatatactctgcttaaaatagcttttttttattgccgtgcaatatgggatggtgtttacacaatactacatatatagcacttaatttaattatacacaatccgtctaacaaaaaccacttctgattagataaaatttggcattttaaggacagagggatcggagtatgtattttgttaaaccagtgtcgagggtatcatcaaccgccaatggttctccaaaacccctacgtaccccgcaatagtggagtttaaacttgtccttggaaattatgtattgtgctgagtgcacagctaatgcaattaggagatagcaaactcataccaaagtacggttacatagttgcatgtgaggctcctagctaatttgggattaatcctattgaggcacatatatggatttgagtatcagaggagagatggagatatttctgcatgcgttagcttgaagggcaccaaataaacttttatgagatatgctttgactaatttcaaatcatctccaaaattataaatctgtgccacacacaccgcttccattcaagcgtacatgcaacgatttttttctatacagagggcatcaggctaaaaaagacaaatgtcgaggacaatcccaaaataattaaacaaacaatagaataatatatcaataagtggattcacattttgcttcaaaaggactgaaggttaaaggtagtgctggttattgtgcacgtgcaatacacatcacagtcagatgcgtgccgtgggagtaggagggagcttatcagtagataatagaggaatatagtccctccgttccaaaataaatcaacttatagaattcaaactttgtcctaaaataaatcaacttctatcttcttattcactgttgattcgcaaatcaaaaaaatttattccttcaataccccttgcctacatatctaccaatactagctattaatatatgcaggtagttttcagggcaacacattgactccggtcttgggcacaactacaaaagtatgaggaagatagtgagcttttaaaggctgcatgccgtattcttgagacaacagttatgcaactttttgtcaaacataattcaataattgtgtactctttatcttgggttggcagtctttagcttgtttcttcttgatggttggtttcatcctttaagtttctttgaacttcactcattttgagtgtgagattgtaataattggctgtagctctttgagtaaaggccgggatgctctattccattatctaaaaaaaagctattaataattgtattttggtcctttatcctcttcattaatttcgcattgggaagctaggagttatctctttatggcacagagggagtatgcactattagataaaagtacaaatgtgtgccggtgcccataattgccaattacattgtctccgccacaaaagtgaagcagcaatgatagttagtacattcatatataccaccggtatatataacggtttatctatggcgtcggttctaaatttttcacccagcggttttatgtgagcacttttgtagagacattttgcaaattacttttaagatcagaagttttatagtgtagagatattttatagaggcattttaaaaattgcctacaaacttttactctagagacgttttctgctctacttattagattttatcttgtagaggcattctttcggcactgtaaaatagcctgatatgtaaaggcattttcttgagacactttaaactatgtacagacacttgttacaatgataatgtgtactaaaggactatatataattaactaaaggcacaaacatacaagtaatgacatggagttgagttagttagtgcattgaagataaaaatgatttgtccaagtgatctcaagtttaagacttgttaaaagcaaagaaactattttattctcctttttggactggtttcatatatttgtgatataatttaatgtctctagaaaatgcctctaccatattatagatattttataaaatgtctcttcatttgaattcaccataagacacttattagacatttttaaaaatgtctctatagtattgtaaaggcatttgaaaagtgcctctacagcactagaaaaatgtctctacaaagcatttgtttttagtggtaggaagatttatggcaccaacagttgtaaactggcaatgtaccactgactgcagaagagagaggtttagtgtggaccaagtccagcgaggtggtacacggtaatcgatggtctacatcgatagaaactgatcggccgggcgagatggcataccatctcgcacgccactggccacacgggacgccatagaggacaggaatgtgtaggtggcgcttacatcacaatgcaatggcagccatgtcaacagataacctggtcatttatgtggcgacacacagcgtggtggcggacaacaagaatgggacaagtggaatgagtactactccgtcccagaaaaaagcaaatcctagctacgaacctatgtctaggttcgtagctagaattggattctttttgggacggagggggtagatatgaggacctcacctatctcaacaatgatggccggtgaagacagaaggcacgttcgtgagaatgaagaagtgctgaaaatggatagcatttactgtggtgagcagcaaacaggttcttctagaaaagctgtaaactttaagtaaagagtaaattgcatatttgcatcggtgatacacaatcttgtaaggtgaatgcaatttagtatataaaattgtaaaatattcgtttcagtacacgaacttgtctagtttatgcgaatgagaccaaaacagtttggcaatgttaattttatgaagttgttaacatcgaaatttcgtaagcccctaagagaatcaccacgtcgccaatagttggattcctgctatattcggttaaggaaagtaatctgttaaaggaagcttatccagaaatgactgatttcaaagaggatgcggcatggcagtttatctattaattaggtagtatatgttagtttccttttaaatttaggaaagtgtgtttagtgtcctataagtactttatgttttctttttatcttttggaaagtttctttcttgtcctataaggactagtatctccccatgggtataaatatgcacacccgatgtcaatgtaaactatctccacgatcaatacaattcagcgcatcaccaccttttaccttttctactttatttcatcgtccggcgggacttggcacttgacgcggggctgcatcactttccaatctccggcgaaggggtaagtccaatatgttccgccggcccagacaattgtatcgtctacatcggcgtcattcaaggctgcatcagtacattcgacctcttggattgctctggtttggttgatatatttgcctggctatttatcatatttcttagttaatctagtcttactatttcaatttagctctattggttgtctctcgctttagggtttctgccggtatcggctaaattattttactagattagattagctaagacttctaccaccataaaaatcagtcaacggcttgattatctagacattgtgtttttttcatacttagtgctgcatcagttaagtttgatctactaagtcatgtttacaaccataatccctagcctactttttgatggccaataagggtttcatcggggtttcagccgatgaggtatctggatattgcatcggcttacaaggattacatataagttggatttagccaatcgcaagaaaggtttcactgtttatgtaatattgtggattttatgatatcggacctccagccgatatatgctttaaactttggatcatgtcattgttagccgattgatttctactggattatattgttgttgctttcctgcattatcgtcagccgattgcctttagattgttatttacatcaagcatcagaatctacatcagatatatagccgatagttcaaaacactatcgctattggtcggcatcgactagaattaatccatcggcttgtcagccgattggctcattgatatgctatttgtatatcttgtcagttgcagggtcaaactgactggcacgcccgcatctcatcaacctttgaacctgcactggagctaagcagatctcctataccagtgtgtgttttttcgcatcaacagaagttgatgttgattagcgatgtgacgtgcatacgtgtagtgagtatgcataatacatgcaatatttataaatttggtctctactttatcctttatcatggaaatgatgaatttcctatatttttaactctgatatcactgctcgtttttttatatttttctagatcactatatcatattctattttttattgatgaggtgtacctctcagatatatgtttacatagtatcctaatctacccaaacaagttcatgtaccacaacgccatatagtgtcctttttgcctttctccgcacgcaccaaacaagttcatgtaccacaacaagcattatataagttcgtgcactagattgtacccacctagttcgtgtaccagtgatgcaatttactctaaactttaattgggagatatgcatacactactggagaagtaatctttagtcccgggttacaaaccgggacgccgaatccatagtcttagtcccggttaccaaccgggagtaaagttttttttcttttttttccattgtgttttggtacttgcatcaccaatgccgtcaccccaaatccaaacaaatcatccacaattcacaggcccatccacaaaatcatccacaatccacaaatcattcacaaatcgcatgcccatccaaaaaatatctacaatctataaatcatccacaaatctaaaaaaaatctacaacaaattctaaaaacaaatcaggagggcccgcacagccgccgctgcttctggcctgttgccgccgcttccactgggcacccgcctagcactgctcgcctcgttgtgtgcctgccgccacctgccgcatcccctcccactggatccggcggaggggagggcaccgctgcccgccgcggagatgggagaggtagaggggaaggggaggagggaattggaggagagaggggaggggaaggaggggtggaggaggaggagaagaagaagttggcgtgaagaggggaggaggaggaggggataaggcgtgcgagcggctaccaatgccgagataaggaagatagagagagancgatgtgggagaaagatatttatacctggttggtataccaatcgggattaaagatacaatctttagtcccggctagtattattaaccaggattaaaattgatctttgccaaaatttgctataggacactcaaaaaatatgtaattagctataggacaccataaagacgtgaatttatctgaagatactccaaaagtgtggtaatttgctgtaggacaccagacgcattaaaatataatatccaccctaatgatggaagagaaaccacacaaaatgacaattttgcccttattatcttcttctcccttctcccagctttctttcgatgctcactcctagcaaggtccatcggtttgcccatggcggacagcaggctagcgtcgagccgccacgcggctagccgatcacgccgccgatgatgatggtgccacccgtgccagttgtgcaaggcgttgtcgtgctgtccatctagccggggcccgttggcttgcatcgttgtgccatctatctggccggcgctcgctgacttcctgtcatgctacagctacaacccggcaacccggtgtacaagtagtcctcatactacggcaacggttgcggctactgctacggcggcggcggcgcgtgccgctgcggctcgtgcgcgggtggcaacaagccgatggccggtgggtactacggagtggcctcggtgatggcgtcgtacgaccaccagggatggtactacggcaattggcagccgggctaccaacagaagcaatgctacgaggtccccaacgccggatgcagcatgtgatgtgtggcggcaggcgcgatcgccatagatgggagcaatccgtgcgtgtggtcattctcgctcatactcactcatcactagctcatggccagtgttaaaaaaatctttctttttttttgccaatgccccttttttgtttatttagggtttttagttgtgtatgtggacagttgagttgtgatcttaagccgagtggctgtccgccatgggtaagccggtggagctcactccaagtgagccagaagaagacttggaggaggaacgagaaggggaaaactgtcattttatatggtttctcactcatcaactaggtggatattatattttaatacgcgcagtgttctgcagcaaattaccacatttttgaagtgtcctcgagcaaattcacatctttgtggtgtctcagctaaatacatattttgagtgttgtatatcaaattttgccttgatcggcagtcccttggtgttatcagccaggactaaagatcaaaaagtaccgttgggcttttgaacctggattaaagatattctttagtgccggttcatattcaaattgggactaatgtgagttttgccatgcggacaaagatcaattcttcagcggtgatatttgctgtaaacttccgttatattaggaaagagccaaatctcaaatgtataaagttgtaacctctttatacttgatgttgtatccagcagaagaaaacagttttctttattgctgctaccaaaaatatattataatacgagttcacacaatatatacagcctaaaacaagtttctttattgccgctaccaaaaatgcaatatgtcccatatatgtacagatacatagataaattgctaccaaaaatgcaatatgtcccatatatgtacagatacatagataaattttggttttttaagaatggatggagtacatattttgttaaaccggcaagcacatcatcaaccgccaacagtttctgcaaaaccactatccgctacagtacagtttaaacttgtcagtggaaattatatattgtgctgagtgcacacaaaaatgcaattaggagatagcaaactcatactaacgattacctagttgcatgtgtcccctagcattttttttgggattaatcctattaagtcccatataaggatttgggtatgagaggtgatggagatatttttctatgcattagcttgcttatagcttgaagggcaccaaacaaacttttctgtgatatgctttgactaatttcaaattatccccaaaattataaatatgagtactctagcactacagacgcttcgatccattcaagtataaatgcaaagattttttttatatagaggacgtcaagctcaaaaaaaaaaaggaaaatcccaaaacgagtaaacaaaacaatagaataatttctcaacatgcaacgagtggattaacattttcattcaaaagttactggaagttaatactactactagttactgtgtatatgcagtagtacacatgttagtagaggagttgtgtgtctagagagtaggagggagcacaggagtaggtaacagaggaatatatgcacaaatctgtgccggtatcatcatcacaagctaagtggatatttgagtgaaataaggataacatattttttgcagaattaaaaacagggaaaaaataacagaaatgagaaaaaatcacgaagaagccaaagaagaacaacatcatcagaaaaaggtgtggtacgttgggtggtgcagtctccagtctccagattcccgctccttgagttgatgctcgccttaggcattattcattttgtaagggatcggatagaattagaggggataggtaacactactatagatataaaataaatccccaccaatccctccgtcatatattaaccactagaccttgtcagtagtgtcttgcctgactacaacacctgtcaatgcatagctggcttgcatattgtcgctaggtagccatctcgccgcttttactcgccatgaactgccagtcacctcatgccatgggactgttggagcttcctatagttcctctattcttctaattaacctttatttaatgtaaattaaaacaaactatagcaattataactgttaagttcaacagcaagttaaaaagaaaaataagaacatatggcatcaacaaaaaaattatatatgcctaaactgtgttaattaatctctgggtaaacaattaaaccaagagtcgcttcttttatcaaaatagattgttgaataagcataatgtagtggcaagcaggtagcaccttcaacggccatatctgttgtgtccacgagataattgcaatgctgggagacggtggattagatgagatcgctagctagttaagctgcattttcctcgtgatctggaggaggaagaaaaggttggcgccatcgccatggcagggtgtagagaaataactttatgcacgttggacaaactcatgtattccagctccagtgacccgaacttaaggagacgttttgcctccctccccaccacaccaccgccgggagcatggtgcagcgtgctgcaaccaccttcgtgccactcaggtgcacctggtgcgcagctcggtgatttgccttgccattattgccaatgttgggatacgcgtaggctacgatagtataaatcaaaattttctattgcataaactaggaaccatgcaagtattagatcatagatcgttaccactcgacgcgctgcgtagcggaagaagacgctgagaagtcgaaggaactctcgcgaagtagcgcactcgatgtagaggaagtagtcgatcgcaccggctcgaccttctcctcctcgtgcattctcctcgccgtaatcccacgccgatcagcaccgcaaaccagcggcgcctctaccggtatccacacgtacagggacggaacgccacgcgcaggtgcgctagcacccgcacgcggctagggttttgctcggggagggaagtgacggctagggtttctcacgtgatgcaatgcctccgccgatcacacccctcatgaacttataggatccatcactcaggcctccaaagcctgtaggactcctattcggatccctatccgaattaagctcatattcgatctccatccaatccccttattccggcccattaaacgtgcaaccctgtaggttcatatatactcggctgtaacacgaactccttttcggtccatgcgtcaacagtggcccctagcagaacgtattgacccaccgggcatacataaagatcatatcggctgaacctctagtgtatacttgtatgaacccatttgcctcacgatatcgattaagctcaaggctagatatgtgctatcctctaatagctcaatcattcactcgaacctattgatagattatataacttgtgattgactcctcaatcacctttggcatggacatgcacttccataatctacaacaacgaggggcccagagatatctctccatatgaggggcaaatcctatcttgattattcatatcccactacatgttttatagcatacctgaaaactacttttataactacccaattacggagtagcgtttagcagtccctaagtaagctactacacatgttgggaaccatgataatctcaggtctaaggattcaacaccaacactaaatgagatcactgatgacacaacacatatagctcttgcagtgtctcatgttgggtctatccaacaacatgttcactaacatgtgtccacattattaatttggtatctctataccatgatccatgagacatgatcatcaattaatacatgtgctgatcatctaagcatatttattccacatatgatatttgatcaaggatcctttagaaatagcaacacacaacataaagagtctgatgaaagaatcacatattcattaaccaataatgagtttatctattttaaggaacaaagtcggataaatatgtaaacatagtgtgtgtgatacaatcatccctatgattgcctctagggcatatcactaacagtctcccacctgcactagagtcaatcatgaacgtatcttatacccattgccctactatgtgcctcatgcttaggctgagggagtggctttgtcaacggatctgcaacattcaaatccatatgtattttgcatatcttcacatctcctctacacactatctcgtaaatgaggtgataccgccgtaaaatgtgtttggacttttgatgcgatctaggccccttggcttgtgcaatggcaccactattatcgcaatagagatccatagggctagaagcactagtcatcacacctagttgagaaacaaatttctttatccaaacagcctcctttgctacttcagaagcggcaatgtattcagcttctgttgtagaatcagccactgtatcttgcttggaactcttccaactcacagcgcctccattcaggcagaacacaaatccagtctgcgatctaaaatcatctttatcggtttggaagcttgcgtcagtgtaaccatttacaacgagctcttcctgtcctccatagactacgaacatatccttagttcttctcaagtacttcaggatattctttacagctatccagtgactctcacctggatctgattggtatcggcttgttgcactaagtgcatatgaaacatctggacgtgtatatagcatagcatacataatggatccgattgccgaggcatatggaatcacactcatcttgttttgctcatcagtcgtttgaggacgctgattcttgccaagattaatgccatgtgacatcggtaagaaaccattcttagaatcttgcatgttgaacctcttcaacaccttgtcaatgtatgtactctggcttaatccaattagcctgtttgatctatctctatagatccttatgcctagaatatatgctgcttcccctaactccatcattgaaaaaccatttttcaacgatgtcttgacggattcaagcataggaatatcattcccaatcaataatatgtcatctacatataggattagaaacaccagtgcgctcccactaatcttcttgtatacacaagactcttcttcgtttttgacaaagcccaacgccttgactacttcgtcaaaacgaatatttcaactccgagatgcttgcttcaacccataaatggatttctgcaatttgcatatccttttagctgattgtggatcaacaaatcccttgggttgtgtcatgtacacatcctcatcgagatttccattgaggaacgctgttttgacatccatttgccatatctcacaatcgaaataggcagcaattgctaaaacaattcgaatagattttagcatggcgattggcgagaaagtttcatcataatcaacaccttgaatttgtctaaaacctttcgccaccaatcgtgccttgtagatgtgaacatttccatctacatctgtctttttcttaaagacctatttgcactcaatggcttttacaccatcaggtggatcaaccaagttctaaacttgattgacatgcatggattctatttcggatttcatggctccaagccatttctcagagtctggtaccaccattgcttcctcataggtagtaggttcatcgttgtctaacaacaatatatcatgttgtctaacaacaatatctcatcagagtttagctttctcttttgaccactcttcttgtagttgggcttgcgcttatgcataaccatcacatggttggagtttttcttaatgctttcctcggcagtctttagcatcccatgcaattctgccaaggtcctgttcaggttgttcatgttgaaattcattgtgaacagctcaaagctgggagggagcgactggagaatcaaatcagtagccaactctcggctaaggggaaaaccaagcttatccagactctcggtgtaaccaatcagtttgatcacatgtgggctcactggattaccttctgcaagcctgcacgcaaaaaaggactttaaggtattaaacctctcagctcttgcttggtcctcaagcatgttacatagtcccgtaattatcgtatgaacatccaatgcctcatattgcctttgaagctcaagggacatagtagcaagcatgagacagcttatatcaagataatcattgcatcgcttttcatgctccctatgttgagcagcaggagcattgttgggcaagtcagctcgaaaaggctgtgtaagcacaaactctttgtgctcttgcctgagaacaattctcaggttgcgataccaatctatgaagtttgttccagtcaacttctctttctcaagaatagaccgcaagttaaaactggatggtgcaggagctgccatgatctacaatagaaatatatgtatgcaaaatccgcaccatgtttacatttaacctttcattaaacaatttaacaaaagatactcccactatgtattgtgaaacaaaattccctctagtaacatagtgagtcaagatcctcattttgttagtgtctagtgagctttggcatcacagctagacaactatcaaaataggtaagcaacaccttgctaatcacattatatgtgactcttgtgctattggggtgacatctccatgtccaacccaacctatgccccaaggtccaaaactgttttgataaccttgtcaagtaaaccaataatctctgcatatagatgtgcaacatctatcctattttatcatgataaaaagtgacagtttgctatggcaaacccatcacttattatcacaaccgtaatagatgcaattattggaagagcataaattacacttaatttttctgagggaatctatcctaccatgtcatataaaatatataacaacaataaagtaagacagatataaaaccccaagcgaaatctaaggggcaatgcacacagcggtcccgctagccggttagcgggcagagggtcgagggggggagcatagatctgatctacgattctccatgtgaaaaccttaacggcgtaatcaaattatgtcgaaaccgagtcaatctcattggctcgtttttctcattggcgtgcggttccagtggacatcggactatccgatgaacacaatcgcgctcggccttggtgagtactagacattccagtgaagtcaccaacacacgtaccgattgatctcatcaacccatgcggctatcggtttatctcatgttcggatcacctaagaactcatatacaacataatagatctcatctactacacccgcatatcaattatatgcaatgatctagatcataaactatacaaggcggctctgataccactgttgggatacgcgtaggctacgatagtataaatcaaaattttatatcgcataaaccagtaaccatgcaagtattagatcatatatcgttaccactcgacgcgctgcgcagcggaagaagacgctaagaagtcgaaggaactcttgcgaagtagcgcgcatcgatgtagaggaagtagtcgatcgcaccggctcgaccttctcctcctcgtgtgt

SEQ ID NO: 11041 - DNA, 23832 bp, Oryza sativa
  unsure (1)..(23832): unsure at all n locations
nnnnnnnnnnnnnnnnnnnnnnnnnnnnnnnnnnnnnnnnnntctcctcctcgtgtgttctcctcgccgtacacccacgctgatcagcaccgcaaaccagcggcgcctctaccattatccacacgtatagggacggaacgccacgcgcagatgtgctagcacccgcgcgcggctagggttttgctcgaggagggaagtgacagctagggtttctcacgtgatgcaatgtctccgccggtcacacccctcacgaatatataggatccatcactcgggccgatccatcactcgggcctccaaggcccgtaggactcctattccgatccctatccgaattaagctcatattggatctccatccaatccccttattccagcccattaagcgtgcaaccctgtaggttcatatatactcggctgtaacccgaaaactccttttcggtaacatgtgtcttatgttggctcttgcagtgtctcatgttgggtctatccaacaacatgttcactaacatgtgtccatgattgaaccattgatcttaaattctacttgagcctaattaaatgtaggctcagatcagatttcaaattcttcatccaatttgaaacagaaggctgaattccttcgaagatgagtccatttctttctttccaaatattccaagttgctaagaggaaaatctccatgaaacactgatacgtgaaagccaaacgctgagactgaatcatttgatgtaactccaatgaagtgtcccagacccaaccaattttgatccaacatgccttactgaaatcacaatgaaagaaaatatgttcccttgtttctcttgcatcaatcaaacatgttgaacaaaagaccgaagtatttggaggagcacagtgctttctgtccagtaggtctctagtgtttacccgatccaagagcagaagccatccaaagaccttaatcttcatattaactttacattgccagatccattggagtgtcagtgggggtgtcagtgaccaaaagccaatcttatagaggtgttgcgaagtatacattgcagacccccaaatatatgtccagccatcatttacatctaaaagggcagtagtttggacatcagccaagagaacattgtactcatccaaagcctgttgagacaatggcaagaagaattgatcttgaggttctctcgccaagtgctgagaaacagagtcttccttgtgtcttgcaaacgagaacagccttgggaatttgacagatcttaccataccattccatagatcatcctaagattggtttagcaattcctttgaacaaaacatcaaactggaacacgtccttccaccaaaaagacccacagcttctagctgttttaggaaccgagttgggataataagttgtccagattaaatttacccatgggacctgagctctattataaaatttgtgcaagtgcttcatcagaagagctctattttgaattttgagatcaataactccaagacctcctttatctttttggtggaattaagatcatttcctctccatagacaatgtcttctggctctatcaattgattcaatcactgagactgggagtgataaatagcacatatagtaggttggcagagatgataacactaaattaaccagtgtaagtctatcaccatatgaaaggaaagctgagcttactgttaaccttctctcaatcctgtcagttagaggggaaaaatccaccacctttggcttagtcgttccaagaggcagacccagataagtgaatggtaaggagcccaatttgcagccaaaagtagaggcaagatgattggccttttcttcagtcaaattcagggatcatacatgacttggagtaatttaccttaagccctgaggagagtgcagacgaattaagcatggcctttagggcaaaaagttggggagcagaagcttccaagaagataagagtgtcatcagcatactgaattattggaatgttctcatcaccaattacaggtataggaaacttcaggattcccctaatatgcgctttattaatcaaagactgaagtagatctgctcccagggcaaataaaagaggggataaggggtcaccctgtcttacatctctcttgcatttgaaaaactttcttagtactccattcaatagtataggagtagaagccgaagaaaagattttagtcatccactcattccattgagaagggaaccccatagcagtcatcacctttaaaattgtatcatgctcaattgtatcaaatgctttctcaaaatctaatttcaagagaactatttccctctttgaatgtttgaactgatgaatgtactcaaaatcccaagctaagcaatcttgaattgatttcccctttataaacccatactaattttggtgcaccaacttggtcatcaaaatttggagtctgtcagcaaaaattttacaaagaatcttcacagacaagttcatcaaagaaataggcctgaagtcattaggggtttgaggactagtcttctttgtatccatattattaatttggtatctctataccatgatccatgagacatgatcatcaattaatacatgtgctgatcatctaaacatatttgttccacatatgatatttgatcagggatcctttagaaatagtaatacacaacataaagagtctcatgaatgaatcacatattcattaaccaataatgagtttatctatttcaaggaacaaaatcggataaatatgtaaacatagtgtgtgatacaatcatctctatcattgcctctagggcatatcactaacagccagctccctcagcttcacttcctgtgcagcgtccactcctcggcgtgctggagccagaaacggaagatgaggcgtctgtcgtctacggcgaacagcccgattccgccggaatcgcgcgccatctccatgactgttaagctccattctttgttgtacacttcagctgacacccgcacatacctgggtagctccaccagcgatcactccatcgtcttgtgtcgagcatcggtgattaactaatcattcattttcatttagtttccaataaaatggcctagcattgatctgaattggctcttatctttatacattagatgctcaattatcatgtcttcatgcttacgaggtttgttttgcttagcatagtgttgcaaaagaaaaaaatgattttctttcacatagaatatctacactcggtatgccatcattggtgagatttttttagttttattttcccatgcacattggtgggatggaagttcagcactactggtaataactgtttaatgctttttttgatgaaatgtaatctacaggtttatcacattccatatatgtctagattgacaccgtgttatgttaattagattcagtaaagaaaaaacctactgggtaaactaaattgatttgcacggatttcagttcatgtaccaaggttctttaaatgaaattctgtgttaaatttggatatgggatgtggtaccttttctcccagagaatacttcagtataatagctctttttcaaatgaggtaatgattatcagaatagttttttgctttcctaaaaaacttatcagttatagataacacatgtatggagttgcaagttgcagtgagcaattgtctgaaactgaaaccaaggcataatgaagaattcaaatttcaaactgcgctaagccctattcaccaaaaataagatatgctacaaatcaatatgtaccgaccgtccattcctcatgttcaacagcgaaaggaaaacaaggtttaactgttgcttttgtttatatattagtattgtagcttccatttatatatttagatcatgaaactcagtgtatgttgactacccaaatttgatttggttccatcaatccactcaacataactaggataagagtactatgcttcctgctctacaacatataatatggcccttctagcatactccctccgtcctataaaaaatgaatatagggccggatgtgacatattctagtacgatgaatctggacagatgtatgtccagattcgtagtactaggatgtaacacatctggtactaggttggttttttatcggatggagggagcatgtactattccctccacgctaaaatataagtatttttagcataatatcaagtcaaacatttataactttgactattaatagcaaaaaaaataaaaagatcaatcatgtaaaattgatgttactggatttaccattgaacaaactatcaaaatatgcaactatttttatttaaaatatcttatttgtatagatattgttggtcaaaatagcatctcaaaggttgtgttcaagtaaaacaaatgcttatatatttcgatggagggagtagaatatacaagctatagtgttacttttctttatgtgcagatttgtacggcaattattctatacatctagaaattgataaaaatggaaggaatatgtcatatatttcataaatctaggcttagaattcattttcttttttccaatatgtgcacattttgtgctgccttcaattggacgacttaggtttatttctcaaataatcattatttgtaaaaaaaagattttttaaatttatttagttttttaaccttgttttatttgttttggtgtgtcatgaatttcaagtgcctagatactaattaagtgtcaaaacttctcattgttagatttcttgtgtttataatgaattgcaagtttatgtaaaagcttgcaacatggagtaaatatatcttggccatgagaattttttcacttgcattgttgatggttttaataaagatattctctaatctttattatttcttattggtactacatatctgcaacacattctttgtagcgcatatttttgtgtccttgaagtaccgttatgcagctctctgactaaacgtgttacaaacgtgtcctggtatagcacatatcatgtactgtgctatctatcgttacacagttcttaacgtgttacagatatctgttacaataggcctgtcttgtggtagtacagtagaacaaattaaagaaaatacacaacatataaataacggaccacacattgcaggccagagatttagtcactctgagtgctcttcaaaagtcagttataatatatatactttgcgtccagcaatggctaccattactaacaaatttgggacatacaaaaaactatcgaaaccctaagcttgccatagtgacaagtttaagttggtgtttgcagcaagaaattctaactaaacaatttgtttgttttgacaaaacctaactttttgtataggtcggctacaaagcgttttcccaggcggtcaatcggatttttgcgtgcacagcttcggcccgtctggaacaaatcgtctgggaaaatcatgattttcgtgtgcgggtggcgcacccgcatgcgaaaaacagattttcgcgtgcggttgcttatgacgtccgcacggaaaaacaaaaaaccaaaaaaaataaaatttcaaaaaaaaaagaaaaccctagatcgggtcatcgccgcggctcccacctcgttgtcgtcggcggcggcgtcgctgctcccgcctcgtcgccgtcggcggtggcggcgacatcgcctcccgccggcctcccacgtcggatccgtcacggggggagggcggccagcagccggatccgtgcggggacggccgcgggccgcccgtcgtcaccagcccgcccgccggatccgccgcccgcacgctctcgtcgctgccagggaggggaggggaggagctgtggccgcccgtcgtcaaccgcccgccggccggatccgccgcccgtgcgctcccgtcaccgccggggaggggaggagccgcgaccaccagtcatcggccgcccacccgccggatccgcagcccgtgcgctcccgtcgccgctggggaggggaggagccacgcccgcctgtcgtcaccccccccgcctgtcggatccgccgcccgcgcgctcccgtcgccgccggggaggggagaggaggggagggcacccggttcccgccctggatccgtggcggggggaggcggcccgccccccggacccatgcggagaggcccgccgccgccggatccgtgcgggaacggccgacgccagccggatcccccgcctcccccgccgcgccatcgtcgctggtgccgtgccgccaccgccgctgccacggatgccgccgcctccgcctcgcttaccgagggcgcgggcttcgccgaggagggagaggggatggggaggaggatagagagagggagagggagagggagatggatggagaggtggttgggagggcgagcgcggggggagagaataaggcgagcgcgtggggagaggataagggtgagcgtgtggggtgggctatatttgtgtgcgggccacttaacaggcccgcaggcgaaaataggcttactttcacgtgcgggcctgttatgtggcatgcacacgaaagtagattttcctgtgcgggcgacgttctgatgcccctttttcatttttctgtgcggttgcacttatgggccgcctagaaacacactagtctagtgtccatgaaaatttttagtgtagtagtgttagatgttaattaattattataactaaaagcatatgtgtcactagttagcacatgcatcaatcccatagaatcaacactattaattatgtcgaaatactgaactccataattttcataagagaaattaaaaaaaaagtatttcttccacgaagtaccaaacttgtcacagaagcaaatgactgaaatgtccagggaaatcttaacttcttaacttcttaagaataccatggatactttgtgattatgaattagtttttaaagcaaaaatatagagcccaaacatatgatctagggagcacatcaatgccttttctaaagatgcatcttcgagtagtcacattgactacacaaaaccatgcggaagctgtaagggggattctggacctttccctccagaggcagacgtaccagaacctgtgtaaaaatgaaacaagcatatttaattaattagtgaacaagaatgtatatcttttctgaaacaaactatatagatctgcaatattttcaaatgaaacagtgcaacaatcaaatatatagcaatatatatagatctaataaattgtagtttgccaacagaatgttctttatcgcaaacattaataattaaagaagcacacatgtctcaaagatagaacactgatcttttcagaattagttgccagtgcaaccactcacaggtggaccaaacacaagcttaaacgagattagacatagctcaacacaggaaaataaaagccatcctagtgatgtgagatctcactggtggagaaaccatctttcgtcggtcggcctaattccacaatagtcccgattgcaaccaaaaccgggactaaagatgatctttagtcccgattaaaaagggtaacgggcatatttgatattttgtcccggttggtaacaccaaccgggactaaagatcatcttttgtcccggttcaaatgctgtcaggtcttggcaggccccctcgggatctttagtcccagttggtaactgcaaccgagactaaagatcgtaactttagtcccggttggtgatcccggcgatctttagctccggttcataacaccaaccgggactaaagtcccacccctatatatatatcttcttcctcctccagcccgagcaagcttcaaaatttcttcaaaaaggaggggaggtcatgccaaaatttatagtgaatttttttttgtgattatatacaaatcggaggtgcctaaaaggttagcaacttcatcctccaatgtttttttgtcgtatgacatttggagctatgttttgcacacttttttgtctccaaaattttgttgttagttgatgagagagaaaattagtgtggggaagaaaaaatatatagaaatttagtttatttgctaaagaaggttttataaaatagttgagaaggaaaatatagtgaaagttaatcttgaataatagaaaacaaactaaaatgaaaaattaaaataattacaacacattaatattagtttaaaactttataaatagtaaataagaattatttggtgtaatatttcataatttttgtatgaataatgatatgtcattattgtgtgactgttgaaagagtatgtaattattttataattattgtatgactgtcattattgtacaaataattatttatgtacgattttttttcatgtcatgtagatggatcggcaatggatgtacgctgaccggcggtccaaagagtttattgacggcgtgcattattttttgagagtggccaaagctaacaggcaaaacggttttatttgttgtccatgcaataagtgtaagaattagaaggagtattctgcatccaggactattcatttccacttgtttgagtcgaggttcatgtcaagctataattgttggacatcccacggagagcaaggggttgaaatggaagaagatgaagtggaagacgacaatattccggactttgctcagtacgctggatttgaaggaaatcaaacgggcgaggcggaaagggatgctgatggtaacgacgttgcggatgatcttggtcagatgttgcaggacgccaaggaggactgcgaaagtgaaaagggggcccataaattagacaagatgttagaagaccacagaacatcgttgtacccaggttgcgagcaggggcacaaaaagttggataccactctggagttcttgcaatggaaggcaaaaaatggtgttagtgacaaggcatttggcgatttattgaaactcgtcaagaacattcttccggagggaaacaaattgcccgagacaacgtatgaggctaagaagatagtctgccctctaggactggaagttcaaaagattcacgcatgtccgaatgattgtatcctatatcgcggtgactagtacgagaacctagaagcatgccctgtttgcaaagcactacgatacaagattagacgagatgatccaggagaagttgacgggcagctaacgaagaagtgaattcctgctaaggtgatgtggtatttccctataataccacggctaaggtgtttgttcaggaacaagggaaatgctagaatgatgcgatggcacactgaaaagcgttaacaggacgggatgctgagacaccccgccgatggttcgcagtggcgaaacatcgacagaaaatttaaagactttggaaaggatgcacgaaacatacggtttggtttaagtacggatggcatgaatccttttggagagatgagcagtggccatagcacttggcccgttacgatgtgtatctacaacctccccccgtggttatgcatgaagaggaagtacataatgataccgattataattcaaggccccaagcaacctgttaacgacatcgatgtgtacctaagaccactggtcgaagatcttaaactgttgtggaagaaggaaggtgtccccgtgtgggacgaggacaaacaagaggagtttaacctacgagcgctgctgttcgtaaccatcaacgattggcctgcacttagcaacctatccgggcagtccaacaaggggtacaaggcttgcactcactgtatggatgaaacagaaagtacatatcttaagcactgtaggaaggttgtgtacatgggtcatcgtcgattccttacagcaaaccacccggtacggaagaaaggcaagcactttgaacataaggcggaccaccgtacgaagcctaaacatcgcagcgggaaaacagtgtttgctatggttaaagatcttaaagtagtgtttagaaaggggcctggcaaccagcctatagagagcgaagatggtcacgcggcgatgtggaaaaagaactctatattttggtagttaccctattaggaattcttggacgtccgccacgcaatggacgtgatgcacctcactaagaacctttgcgtaaaccttcttggcttcctaggtgtatatggaaagtcgaaagatacactggaagcatgtaatgatctgaagcatatggaacaatgcggtgaccttcatccggaaccaaaggagaaaggaagccattacttgagtctagccagctacactcttagcaaggcagagaaggaaagtatgtttgcatgcttggagagcttcaaggtaccgtctggatactccatgaatataaaacgaataataagcatgaaggagaagaagttcacaaatctaaagtctcttgactgtcacgtgttgatgacacaactgctaccagttctaataaggggtatcctcccagacaatgtccgggcaacaataacaaagctatgtgctttcatgaacgcaatttcacagaaggtcatcgatcctgatagattagaagccctgcagaatgatgtagtgcaatgtcttgtcagctttgagttgatatttccaccttcatttttcaatataatgacgcatctgctttgtcaccttgtcaaagagatcggtattctcggtcctgtgtacctacacaacatgtttcctttcgagaggtacataggcattctgaagaagtatattcgtaactgttctcgtccaaaggcaagcatcgccaaggggtatggaacagaggaggtcattgaattctgcgtagaatttatcgaagaccttcgcctaatcggggtacctgaatcacgccatgaagggagactacggagaaaggggactctcggaaggaaagcaataatgatggtagacaacaatttattccgtaaagcccatttcacggttctgcaacaatcttcattggtggctccctacatcgaggagcactaggctctagttcgtgccagaaacatcggtgagtgcgatgcatggattacacggcatcacattgatactttctccacgtggcggagacaacatctcatgggtaacgagacgattaaccaacaactggtcttactggcgaggggaccatgtggcccccacaccgggtccccacgccgccgacgggccaagccacggctccccgacgccagctgcgcgcccgcacgccactggcgngtgcgcccaacattgccaaacgtgaacgaatgtgattgaaacgtgaccgaacgtgaacgaacttgaacgatacgtggacacccttgaacgaacgcttaacgaacgtgaacgaaaagttaacgaacgcgaacgaaacgttaacgaacacgggtaatataatgccatctattccaaagtcgcggggaatctattgctattatgttgatctcaggtaataattaattaatcatagcttgcaactgcaaatgtagggcttgggatctgttccgtcaattggtctgcgggacttggaaagaaaaacttggacggaggtttcattttccagtgagtacatgcatgatccaaaattatattgaattgaatctctaattatagttaatataaagagtatattaaatctctcatcgtttctcatgtagtgtgcaaagcaggatcagggaactaactgatgcggctagtacgtatgcgagtatgcccactgcctatcaaaccaaatatgcacaacacgagagctcgatgtacgtatacataaaccattcaaaatttcattgcgtatcgatttgttaagttgtttattaattttatatactgatacgtcattatttttcgaatgatagcgtattcacatgagtgataatctcccacaaaaggattttatcacggctgttcaagaacaactgatgggattcatcaacgaagaagttcttaatctcgatggtgaattctactacgacggatcgacaattcataacgtcggtccttcctcttctgatataacgccgccgtcgaagtcatagctataactactgagcaaatgaattgtactatatatgcatgtatatatatatttatatatgtacacatttactttagtgttaatatatattttggtaacatatatgcacataaaatgttaagtgctttaaattatacatatgtgtgtgtaattatacatatgtattgttacatatgtatgtatatatatatacatatatatgtatatatacatatatatatatatgtatatatacatatatatgtatatatagatatatatatatacgtatatacacatatatatatatatacgtatatatacatatatatatatatatagagtatatatacgtatatatacgtacgtatatatatatatatatatatatatatatatatatatatatatatatatatatatatatatatatatatgcaacaaacaggtacatgcaaataaaaaaaatggtgcaccgatctttagtcccggttggtaacacaaaccgggactaaagatggttgtggccgcccacgtggatgaccgatttttagtcccggttggtaacatgaaccgggactaaaaatcgatctttagtccaccggaactaaagatagctatctttagtcccggattcgtagtcctggattcgtagtcccggttggacaaccgggactacaaacgatttctccaccagtgtctgcggcggacccacatactctttcaaccacttgcagctggttaaaaaaagtttcatcttgtatttgtttaaagagtgaaatttcactttggggcacattttatattacccaagtttcatggaataaaatgaaaatatatatagcatatatatcattctgattcatcatccagagctaacaatgagtagtaaatatttttaaaaaaaacaacaatgcgattctgttatgaaaagcacattaattacctgaatttagagccatcgtccttgttgtacgaggtctaccacgaccgcgacctgtgtgcgcatgtcatagcagtccgattcagtgagtaacgtttccccatagcatgcagttacgaaattttagaaaatatatacaagctagcaagatgagcataatctaaaatatcatgattgttacaaatgtagatatatataaataaatattgttatatatattttttctatttattgtttctgtcagtattactgattcagttcaatcaaatatatattttaatcatactgcaggtctacccgtatataattcatctaaaacaaaattcatatttgccaaagtcaattattagtaaaaatgaaatggtattcctatggagttattaattccaagctgcacagattgatgatatcttacccctgctaggaacacttgcatcagcagatctctgtacagacacaatgtatgagaatcagtatcaaatttggaaagagaaattatgtagaatacaatatttgaaatcaactctgttgtagtagggcaccttctgtagaatacatggaactttacggattataaccttcccagtatctagaaaagatttaacttcaggctttgagcgaaatttatgattgtaatccttgtggcggtaatactgcgaagtaagaaaaagttcaatttcacttaacatacgaacaacaaaataaatttagtataagcaagtatatttcagcaatatccaatctgcattttgttttcttttttctttgattggaaggggatgggagggaaaaacttatattgccattgcatcacatgtatgaccctagctaggcacccaaagctaggtgcaattaatgattcacagtatagaggttttgatccaaattaaatttgtgatgttctcgcttttcatattgatagaactgataagtgagattaatgaattagcaagaagatatattattgatgggcaacatactttgttttgatagtgattatatgaaaaataaataaagtcaaatatattatctgtatgccaattatactaaaggtagctatcataaaatagtttggttttgtacagattacttttcctaaaatgagtcctatgttttcattgagcattataacacagattgtgaacactccataagtgatataacacttttttcactccacacaaattatcatgtcatataaacaagaatatgttttaaaaaggaatgaaattttacaaaccactcaatcctgccacaagttattactaggtaaagaactatgcattcccatggttcaatgtaatatattggccatatgtgatcatatggcaccagatatatgctatcaatgcaagttgttaattaccatgattcaactgtagcataagaagtgtttttgctagacaagataaaacttaaccttcagatttaatgaactactgaatgtgggtaatactcacaaccaagaggtgtttaaacactaaacctgtttggatttgaactattccaagtttcatgttttatattctagatatacaaagtataaatgttttagaagagtacacatgtttggtttaacacaaagaaataaataatatatatatagcttatttttcgattattattcgtttagggtaaacatataacacccaacggagacttttatgtcaaaatctcttgtacattttatcattttcagccgatctctaagatttctatttcatgtgtacaatcacaagtacttacagaaatgttgatgctggtaagatatagaatcatatgtattacttgttatatttatgatagggctggttatctttccctaaaataatgatatccaccctaacgaagcacatattaaaaaaaactgctttcatgatatactcataaaattgggaaagaatacatgtaactctttaatttaatcaattatgaaaattcatggaacaaatataatcgatcaacatataacatgaattcacaaaccttgtccttggttttttgatcatttcgaagatggatctcgacgacccagccatctggatcaacctcatgttttctgggatgaaccttccatgattcaggaatatccttatttgttttcgcttgtgttttctctgaggacaacaaaaacatcccagagtttgcatctcgctggtgaccactatttgctccataactattgccaccacttagaatcctctgaaagtatataaccattgagaatcatcaaccgtccttcattacaaggtttcgtgaatgatttaaattaattcatgtcataggaaatatatggctcaaacatcactgtgctggtctacacttgagtgcatatgattctctagaaatttcaacgattgtatcttttttatatttacatatgtaataaagatgttgaaatacatgtcagattgcaggacaatttaacataaataatcagggaagtaaaaaaaagccatggagcataatcatgtcgtgttagttttagagaaaaagtgagatcaaaattaatagattagagttgcttatttcgcaggagatcacattgagctggatggagagaataacttagataaagcaccatttgtttgttattctcatcaaaactaatggattgcaattattttagtttgatgaactataaaaagatcatggacacacacaaaaaaaataaggatatgataggaattcacgaacctcaggttgaaaccttgcacttttctgtctttttccttctgggctcaacccagaatctacatctgagaaatggtgagaattgccagcactatttgcgatcttccctaagccagcacttccagttctctcgctatcggtttctgaatgatctgcttcatggcgattagccttacgagaatccacctcctgatcaccatgaccaggatgcacaaatattccgaaataatcatcggtgacagttctctcactctcactgctactcttgcttccatcagagccatcatctgaataccacgcgttagctcctactactgcaacacccttgcctttgccaccagtagaagatggaagacctgatcgtttcccctccatggctgccctagctaggtctatagaagcaggaaacaagaagagaaggggagagagaagagatgatttggagaagaagagaagattcaactaggggtagatccaggagaatatatatatatatatatatatatatatatatatatatatatctatatatctgagcacgttcatatatatctatatctgagcagcaaatggcaagcatttactgtggtgaagacagaatgtgcccgttggtgacattgaagtagtgctgctgaaaatggctagcatttactgtggtgagcactgaacaggttgttccagaaagactgtaaaagctttaattagaaaatagctaaatgtcaaataataaagtgggaaactctttacacgtgtgggtgtatccagcacaagaaaacaagagtttattgttgttgccaaaaaagtattatgggacgcgttcacactatatatataccgtttaaagctactttcttcattgccgctaccaaaaatgcaatatgggatgcgttcgcacaatatatatataccacttaatttgtacaccctttgtcccgaaaaaccacttctgataaatagtctatatccagatagatagataaaatttggtttttttaaaggatggaggaagtatttaggccatcgtcttgacgatctagacaagatcaagacgttataccatgggttatcgtccagtttagggcctaaactggtgaattagaccgtttgatcatctaatcggtcaaatattggtttaaatcgtgtaagcctggcaattagacaacataaaaacaagtgttgaccataaaattgttatctagatcatagtctaggtaatgaaccaatgcactgttggtatgtcaggagaaacctggtggccctcccaaggactatatagctaagggttttaaccccagctaaaacccttctccactattcttagacatgtcgttctcacgaagtcacgccgtctctcctcagctagttgtcatcgtggactttcctcccacctccctctggcccatgactacaccagtagcttccctcatcctagcgtcgctagttctccatcctccctcaggcccatgactacgccggttgtttctcttataccagcatcgctacttctccgatattttatgaaagatgttaagtctacctatataatcgtcaaaaaaatatgcctgttgtatgttgtacaatatatcgtacagaccgtctagacttgcgcctagactgtctagactctagaccatgggttattgcccgtctagcgtcagtattttgttaaactagtggcgagacactagtacaaaagtaatttgtccagacgggccaaaagtcgttttcgcgtgcggacctccggctcgtctacccggaagggtctacgaaaatctaatttttccatgcgggtggtgcacccgcacaagaaaatcggttttttgcgtgcaggtgcttagttcgtccgcacgcgaaaacaaaaatccagaaaaaaataaaaccacaaaaatcgccaccgcggttgtgctcctcacgccaccactgccggatatgcatggattcgggcaggggacggccgccatcgcgtggtctgggtgggggatggccacctccactggatctgcgcagggcacggccgtcgccactcgcccaccgccgccgccgtgctcatcctgccaccgtgctggatccacgcggatccgggcgggggatggccgccgctgccgctgtcgcccctcatcgccttcgccgcattcctgctggcctctgccaccgtcaccccttgtcagctcgccacgcttccatcggtcaccaccactcgcccatgccgaaagagagtttgagagagagagagaggagtatgaggaggaaagggaggagataagaatgaggtaaggagagagagagaggggacgagttgaaaattttgaagcgttaaaacaatgaaagaggaggcttgacttctgggcggacctttaagaggcccgcctgggaaaatatattttttcgtgcggctgcttaagagggccatctgcaaaaaaaaattttgcgtgcaggtctcttaaggagacatatgtgaaaataggggggaccatctttctagacgcggatacttatgatccgtatgcaacctattgaggtgctcagtagtgagaacagccactggtttctccaaaaccactacccgctacagtggaatttaaacttgtccgtgaaaattatatattatgctgagtgcacggcaaatgcaattaggagatagcaaactcatactccctccgtttcacaatgtaagtcattttagcatttcccatattcatattgatgttaatgaatcttcaatataaatataggaaatgctagaatgacttacattgtgaaatagaggaaccttcacacactctttcattgacacacaatcggccacaccattgctgatttgcgcagacctcgacatagatccaatctatgctaattgaattagggtcttgcctcacttgagagcttaaaccggtataaatctgtgtcaccatctctccttgatcttttgcaccccataaattacattgccgatcataaaaatcgacaatgtgtctagccatacaaacggcttccattcaagtgtgcatgcaaagattttatttatatagagggcgtcaggcgaaaaaaattaaatttagaggaaacccccaaaaagattaaacaaaataacataataatatctcaatgagtggattcacattttcctttagagagtactggaagttaatggtagtactagtaattgtacacttgcaatacgcatcgcagttgaggagttgtgtgccataggagtagagggagcgcaggagtagataatagaggaatatatgcactggtaaataaaaagtgcaaatctatgccggtgctcatcattgccaattactgtgtcagtacctcaaaagcggagtggcagtgatagctagtccattcttatatagcaccggcataattaatggtatattcgtgccagttctaatttttttcacctcgaagctctctgggtgggcgggaagatttatggcattagcagtggtaatgcaccactgactgataaagagaggttaagtgtggatgaactccactgaggaaaccaattgtctagatcaaaggaaatagatcggtcggcggagttgacatcccatcttgcacgccgcacgagacaccacagaggacaagaatgtgtgcatggcgcttagatcacaatgctatgtggcagccaagtcagatggctcgcaatagtcaacaggtaacctggtcatctgtgcgacaacactgcatggtagcagacagcaagaagaggaccagaggaatgagcgagcaacgaggacctttcaactactagctcacgaatgatggctggtgtctgtcagtgacaacgaagcagtgttgctcctcaggttcgcaacgagatgagtagcttccgctggggctccggcttaatggaggtgacaaccaaaacttctggtgtatgtgaaaaccggtgttggggttgatgatgaccggaagcgctccaatcaacggcggccggcagcgtgaggcagccgacgtgatggtggctttgggttcttgctgaaggcaacactctggagtctggaaccattcggcttcaatcaattatcagccaggtttccttgttattcttcggtgactaaggtggtagcgatgcggcccaatgaagcttcaatcaacgaaggattcttggctggatttagctcaggtgccaatgttagggttgtagggtgaggactgggttctaggcccgggatctccatgagaagagttgcggggaaggggaggggggaggggacaatagagagaggcacgaagaagctttctattaacctggaggagatgaggcagcgacaaagtggggctgtgcaactaagtgtgcaagcggctacccgcgaaagctcacttataggctaaactaacccgcgagctcgcttattttgacctataagtctgttcgcgggtgacccacttacacccctattgcagacatgatagaagcacggtcttcgtgaggatagtgggggtgattcattgccgatttccgcctgatgatagaggggagatgttgagaagacggcggcgaatgaatctacaatatttgaaagcaaggaagggatcggagcaagcggcacggatgcagcaacacaatgggatcaacagttggcaggtctcccagccagagttttggagacaaaccttaacatgtgatggttccacatatcggcaagaggggaaacaatgaccaagctttggcagcttcgctgcaaatgtgccaaaacagcccacctctgttgcagatgggttgaagcagagacaggtctgctcggagagatggagaggctgagcgggacatgggccagatacggtcgatcagaaggatggacaggaaacaagagagtaagttcattctagctccctcaatttgtcgcccagtctgattcttacccttacctcaaaaaccagacacaacccatccttcaacttacaagaccagtgcaaatgagatctctcgacagtattattctaggttttagctgacatggtgcttacatagcttctttgactaggtcttcgtaccacgttccatcaatgtagcgcctacatgacactttgatccagaaaaaaaataaaggagcaaaatggaaaactaaagaaataaacaaaatttatggggcccacatgtcagtcaaaataaaaaaaaattaaaaatagtgggacccacttcctccacctaaccctccctccaaaaccgcgtagccagcccttccgacgggctggccacttaaacataccacttcacttacactttcatcatcgcttcgtgtaagggggttaactcgggagtgacatggttggaggaaagagatcttataagttggtttcacttgtgctaaactagcaaggtggtactaaacctacacacacagatcacatgggccacacatgcctcatcctaattgggccaagatgtcagactacctctatctcgtcaacacttcaccgaatggcacagagggagtggtggggaggccggtgaggcaacaggtaggaacatgaggaaacggggttgtcgagggaggcggagaggtcgacgagcttggtggatctagagtcgaggggactgggatctggaagggaaaggatagcgacaggtcctttcccccgctgttgcgccgcgccctgctcctctttcccgttggctgccacgtggcctcctctcccccacaacgtgccgctgctcactctccgccgccgcgctgcatgccgctcctctcccccaccgggcggtgagcttggtgaagctagaggcaaggggcaggtatctaagagggaaaggagagtagccgttcctctcccctgccatggtgccgcgcgtcgctcctctccctctcgtcagccgccacgcgccgctccactcccacgtggtgcgccgctcctgtctcgctgccacgccacgctctgctcctctcccaccagccactgcgcgctgctcctctcccccaccaggcaacaaacttcgtgcagccaaagccgagggggtgtcgatctgggagggaaaggattgtggccgctcctctctcctctccccgccgctacgccactcctctcttccgtcaccacgccattcctttcccgcatgggcaccccgcgccgctcctcttcgccgcattccggcgagcttggtagagcctgacccgaggtggtaggaatctaggagggaaaggagacagctcgcagcgacgacatggatgatgaatacaccagacgcgcgaggaagatatacagttcaagaggctaccccgggcggtgccaacaccgcgtctctgccggcgacaaccccgaggtcctctccctctagccgccgtgcaccgctcctctctctcgtggccgcctcgcgccgtctaagatgtacctttgcaatggatacggtcctcataagatgacgatacgcgtaaattgatttttgcaagcgaaccttgacccatcccgcagaaccgattattgcatgcgaacgccattacggctctcctagagcttacagggggcctcgtccgcaaaaaaataattttgtagtagtgagggtgggctttgcagggagggaaagagaggcagagagatttgagtaaactaacttggaagatgttttttcaactcggctcgagtggacttttgtaccggtttattaaaaaaccggcactgatatgtgggacatcggtgtcatttttttaactaccactaatgattcactagtaaaaatcctttattggtgccggttccaatttagcggttctaatcaggtagttattggtaccagttctaaaccagctccgaatcggcacatacagttgtgcacccattttttttatttttgtaggcattttttttatttttgtaggtgtgacaaaaccccaaaaaaatattctccattttattaggaacctatcataaccataggtcacttcccaaaaatcacatgattttttcagcccgtattcatagaatgcgcaaagcaaggttcgaacccaagacttctctctatatccataggcctcctcaccttctcacctagaaacattttttgtcataaaattaaatgctgttgttttaagactgctaccgtctgaacttataatctatatttaacactatagatgagctgaaattaaaattttgtcaactacttcctccatttcatattataagactttctagcattgctcacattcatatatatgctaatgaatctagatatacatatgtgcctagatttattaacatctatatgaatgtgggtaatgctagaaagccttataacttaaaacggaggtagtacaaaattgtagatctcaactttcatataggctttgtcttcatccaagatagtttagaaattttaaaatttcgcaaatccaaatagatccgagaccttataaatacaattcggatatccaaacaacctcaaatcaaatagtcattaactaaaagttgtaagttgtagatctcatcgaactgtacaaatttcatatacagtttattttcatgtgagttcgtatgaaaaagttaggtaaatcggtagcaatgagtgcttatacgtgtccggtcttaattttatcctaacaaaaggttgaaaacgcttcataagtgaaggttttaggctgaccggtacatatatggctggtctctatgtggtgttttacaaggtggatgtggtgttttacagttgtgtttgttagagatggttttttcagaaccgatactgataatgtgttatatatgtgcccgttctaaatttgtatatatgtgccgaggacttggccgtaatctaaccatgctatgtttgaataaatttcaatgtttcgttcgacaaggtcgagccctgcaggctgaatatattgcacatatgttatattatcgtgaatttcgggatcaagctttctcttgcgtcccgcctgcgctgtggccatcagaccatctacggcccggctccatttgcacaagctgggcccaaacaagacaaccaaagttttgccgctctctgatataactcttggctagtgttgcagtttttaaagcaaaacgtacacccaaggtccctcaacttgtaattgagatacaaaatcgtcctccaatcgcaaaaccagataccgtgcgtctctcaattaacaaaaccgttcgctttaggtccctcggtggttttgaccccggttttgtccgaggtggcagctaagtcagcgtgggacccacgtgggccccacatgtcaggctgccacatcatctccctccccccccgcgccccctccctttttcttttctcctcgctcatggctcacttgcagcagggcggctggcgggcgcgtgcggccgccggggggcgacggcgaggtggggggcggcggtggccgccgggggga

SEQ ID NO: 11042 - DNA, 35128 bp, Oryza sativa
  unsure (1)..(35128): unsure at all n locations
ccgcatcggtggcaaggtgacgaaggggtcaggcggaaaagaagggcgacgtcggcccccacacctgcaaccacccagcacgtgccgccgatgccaggcggtccctcgcgtgccgccgttgcggacgacaacgccaagctctcgcgcctcgtctcctaggccgaggccgacctcgacgctggccacgtccgcgctgcacgcaagcacgcccgccaggccacctgccttgacccggactccccgcgcgcctcgctcctcctcaccgccgtctctatcctcgtcgccgaccactcctcccaccgcgccaccctcctcgccatcgccagcggtgtcggcctggacgaatgtggtggggaacagggtggtgtcaatggtgcgcgggacgacgggcctcggggaaggtgggagggtgggttgggatgacgacggctgcaagcggtaggaggacggtgaagaggaggcagcggtgggaggacggcggcggtggcggcgatgacgacgacgtgggcggcagatcgaccatggacaacgtggctgtgtcctcgcgctccccgtccccgttgctcgtcgtcgctgctccccttctcccgcgtcaccgcgcgcgccgcgttgcctgcttgccggccttagcaagcgctcggttgacttcacctcgccgccgccggcttcctctgggccctcttcccctcatgcctccctcctaccctccccggcggcggcgcggtgtggcagagctcgaggacggcgagggcggcgcggcgtcatgggcaggcgctgggtgacacaactggagaacggcgagggcgacgcggagatgctgccggggtcgtggattgcgaccccgacacggcggcttgctcacgcatcacagccgccgtcgctgcctcgtcgcccgccgccctcagccccgtcgcaccactcgtggccgacctcttcgaacggtcaccggaggagtaggccgcgaccatcgcacttgcgcagagaaaagaagagaagagtgagagacagaagaggaagggagaaagaagactcagcctgacatgtggggcccatgtgggtcccatgctgactcagctgccacgtcggatataaccggggtcaaaaccaccgatggacctaaaacaaacggttttgttagttgaggaacacccggtatctagttttgtgattgggggacgattatgtatctcgatgacaagttgagggaccttgggtgtactttttccttttataaatgccaacacctaatagttctgaattcaccttatttaaaaagatagtaaagagatttcattgaagtgctactcctttctactttttggttattttttttcttttcacgatgggcttggttcaattgatattttctaatatttttttatatttttagggaacagtatgttttacccggtctctatatccaactagatatatgcaatcatttaaattgagaacttagccccctcaaacaacccaatctaaaatttgctcttacgaatatatttaaattgagaacttagccccctcaaacaatccaacactacaaaagtgatttttctgtacgaggcccattgatttttgcaaacggaccataactagtggcctataaaaatcgatggttatttttgcatgcggccccttaagtggtccgtatggaaaaatcgattttcacatacgagcctcttaatagggccgcacttaagtaaatatcgaaaagacatgtgctctactgctggctacagtgacctaaattgatatgaaattcgcacctataattctatttaggtcactgcagctagtagtagactacatgtcttttcgatatttacttattggcattctggctttggatttacatatgtgcggaggactggaatttcttctcatcttgcattttcttaattaaatattcacggctccagtttaatagttttatatgtaagccggttgttctgaagcattaacttaacttaaatagtggagtcgtatcttcacttagcataagaaaaaaactattgcaacctagctttgtcttgatagtataataccttaaaaaaaggccaaatgaaaagtttcttgtttgtttacgttacaataaaattagccatgaacttgctaacagtgctcgcttagaaaataggtcagttttttggtttggccataagtgagaaactgtttctctgcactcattctggtcgaatgtaattgctcttatattaattattgataaatccccccccaaaataaataaataaataaataaagtatgcacctaggcttttttccttgtaaataaatttagtacctgtattatctcaaattggagcaaactctattccaaaatcatagcaaaccagggaaaaagcaaagaccaccagtagcagtcatcccagggtagcgtcaccaccagaccatcttttcataaagtcccaatgactttgtataagtgaaggaattaataggaattgaaattcgacactcatgactcaattgattaatgaacacatttatacagctttgaaatttctgagcaaaacttggtccaggtttcatgagtcatgacatcgcggttaccagctgtttagcacgtgtagttgtggtttctgtactattaaatttttgtgcttacacttaactatcaagtaacagttgtacgacaccacaaatggaactagcagtctaacaaacagataactgaaagtagtaaccagcagacaagggtgcaattgtcctgttgatactacagtttactcccttacaatttgtttaatcaactacacattaactgtacggtagatcaaaatgcatgcatgagttggggagcagataaattatagtactattaatctaaatatttggctcattaatataggaattctatgtacttagactatcaatttaattcgagaagtttttcgatccactgtttcctcattatatatatatgttgatcctttcgatgatcagtactagtatatagttggtgccagatgagctagggcacagctggtaacggccatgcagccaccggcggctcaatttcttgtagaaacacgtacactataaacagtttatagacgctcataacacacacttacgctgaatatacataagaacatcagaaagaccgggccaacatatgttaagattgatcaagttatcacgagcaccttactatcgatgggaatatttcttaccattgaaagaataactagccgtaaatctaagcacccatattaattctaggatttcaacctgggtggattgatttcaccacaaggaatctaaccagttgaactatgcttatttcacacagccaccaacttcacgtttataatatgtaatatgtatatatcctattttaaatcacaaacgttctactttccttcccatcccaaatccatgtatataaaaaagctcattttccaccctaatcttgcatacgaaataaccagtccctttccacaccctaagggcatcctcaatgtttgtggtgtagtgtaaccttaaggtgggccctatgaatagtaagccattgttaaagccatacccacaatgctatggttagaatttagccataagatgggcccacatagaatggaaaaataattgtttgatctcttgttcatgaagtgaatgagagagaaaaaatattttctttttgcttatggtagaccttaagcataaggtgcactctaaactaatgctactttccacaatgtatatagctcactttacaagtgcaatcattaccttaaggtcacctttttcatacattgtggttgccctaatccccctaataaataagcgctcaaagaaagttttgtttcaaaaaaaaaacaaccaagagaaaaatttcggagaaaagaaaaagttgaaccacgttcactagataccatcccgctgaaagttcatccccactatgtataattaatgctatttctctcttctctcattaaagtacattagcttaattgtttgtagccattggatgcttgatctatgattcaagttatatccctcatatcaccttagttttatctttgaatgattactctatattatctccgtttttttttctttttctcactgagccacttcactttgtttttacttttaacagatcaatatatatgatttatatttatttcagtagtccaccacaaggaagaaaaaatatataaagtatataatgctatattaatcttgtagctatcttatatgttatttctactattatcatacaaaactcccaccacaacatgtgcggtttcatacagttaacagaagaggagttggctcaagcagctgcaagccccgtcaatgttaaaagagagtatccattatatgccattgagtttgtcacagatttacgatttgccactgacttcatcatgttctacaatatgccattgacttttgcttaacttctaagatttaccatcgtcacctggttagtcttcgttagtacagtacaaatttttccaaatgaccaaaatacccctgggacaaaacattcaaaatttggataaaaattctgaaatatcagattttatgtttttggccaaattttggatgtttacaatcttatgtttatagtatgatatttttggaatttttgtacaattttggaagtttttgtccttcgggtattttggtcatttcgacaaaattgtatagtgctgacagaggctaatcggacagcgatgataaattgtaaaagttaagcaaaagttgatggcatattgtagaacgtgataaagttagtggcatataagggattcacccatgttaaaatagtccattaaccaactctttttccaataatcgtatgttgtcacataccgtaattttctaattaattaaaacaggccctattatctagtgttgacatttaatgtagagtgaaatgcaccccgttagtggctaaacttatcgcaatgtgtcacctaggtcaagttactttgaaaatgcagacttattacttgaaacttttaaaaatgtgtcatcaagatccaaaaatgtcaggtggcgttgacgttgctgctgcctcccttatgctctctccaccatctttctctttctttctcctcccctccctctcttttcctcaccacttctctgtttgaatggagcaagagaccctgctactttcgaatactcttctgcttaggccattattgcctaggccccacaaagcatctccatcgggtcaccactccacccccttcggatctcctgatcccatgttgactggtctctgaccggcctccgatgtggccctgctcctccgtaaacctcgacgttgctgacctaccctaagctccctcgtcattttgcttatgcttctgcttctggtggcgccatttcgctattgttgcttctgcggtggaccacatgctagagagagaggagggaggtgggcaggtggcaacaatatcaacagtgccaaataggatctctgaggggatgtatgtatgcgtgacagggtatttgacagtttttggacctgtaagaaaattcagcaagtattaggaggttgatctacaatttcaatgtatatgttacatagcgtgataagtttagggacgcggggagcatttcacactttaatatcataggtcagtccatatgatttaggatgcgcaaggacagtacacatttatgccttttcacttgtgttccttatattgatggggactgcatgccagcaagttcagccaagaaaaatagtaattatgtgttgcaaatgaacatgatactaccgtgttgaataattcaactgaattaagtgttgcaaatgaatatggtagtactccttttgaacaattcaaatgactaacagaccactttgttgatgatttacttgataagaattttcaaattaattttttcaatgaagttgttattttgacaagcaagcatagtttaggtaattgaagatgaggcattgcatctggaccgtgcaatgaagtgcttgatatttggatgtagaagtaccaagtgaataaatttttacgtgctacccctaatatgcgtgcatggtagtcatctatataggattggtaatgagttagagaagtcataagagatggatgaaccatccttaatgtaaaaggtagcctcaatcccaccacgtgagcatcaagaagcagatagaaagcaagatttgagtcaaaacaaaccaataaaataaaatcattctatgttgacagggttttttttatcagaggtaatatattaacatgttaccgttttaattgatcagtacttttatttgatttgcagatgacttgaataaaattaaatgtaatagccacctccattagtaaactccctctaggaaataggatgtcaatacgccaagattaattatattcattagttagactacataggaacaatatactggaccacttaatgttttgtatctttattagttacgggacgaaccgtggattaatatggttaaataaaatcttaataaatgttttaatgcacgtagtttaacagatcacatcaagatatgcattaatgcatttgtgtgtgtgtgtgtatatatatataggtatagctcaatccaatccacaaaaaacagtagtcaattgtgcacactgactctttctaatttcaacaccttgtgcctacaattaggggaaatgtgatgcagacctgtgacaacaagttggttgactcggccagcctaattaacttgactctcaaacatactgtcccggccggtaaccttcattaattctcctatagtttcgcatctgagatatgcatgcatagtagcgacctttttctccctataaatatatgctcaagttcaagcaggcacgcaataaacatactaaaaccatacaagcaaccatatccacatagcttgagttaattagttcgtcgatatatctagcctagctatctcaattgatcaacatggggttttctcatgcgattgcgatcttgttcatcttcctcgtggcctcaccaccatcaccttcacatgctaggatggtgccaaacgatgatacccagcatgtaagcagcaggagtactactcctcgatgttcagatgagttgatccatgttcaggtgcctccaacgccggcgaagggcggcgctgggcgcagtagagcgctgtggtcagcaccaagcgatggcgttggtcattagttacaagcatgtatcgatctgctacccatggtttctgaaataattcttgctttgttagatttactggcaataatgatgcaagtctaaaactgtcagattttacaaagcatgcagctgatagatatattatttatttgtttctgatgttttataagtactattagatttctaaacatgaaaagcagctgtgtactagcttaaattgtaattttgataaattatatatatgtctcttgtagctattatatatttatatttatgtgtattggagagcttgaatattctgtgtcctcctccaaatgtttggcgctggttattttaattttaagctaaccaacataaaaaaaaaggagggagtatatatactccctctggttccatattaattgacgatttagacaaggtttaggtcaaacttttataactttgaccatcaataactttaaaaatatttagtttaaaggaactagaacaatatatagaacaatatatagatttgtcttttaaagcactataataaaagtaaacatgtatttatttattatatatattataatagaaaaataaggtcaaagatatatctcgtagaccgtgtcattgtccaaaacgtcatttaaaatggaaccggagggagtatgtgtttccaacgttgtcttaatatatgattgtgatccattttgtgtatttaaacattgcgaaattcacaatctatgtggcaaaccaatagaattcttatcacaactgcgtatcaataacacacatacatatatatgcccacgtatatactatgtgagaatttgtatataatgttagattgtcacgtgtgaaagtgacatttaacctcgatcggaactatagagctctgaatgagaaataaaacactgacaggatgaagtatgaacgcagcataggcggaggtgtgctggtgtccatcccccactgcttttacactttttataaattagtcaccgatattttctgatattttggaatagatatttgtttgaatcaagttaaaaccatatattcaaatgagaaaacatctaatagtaacatatttgataaaaatatattttgtctgtaatattattacatatttttttgcttgtttccataaaaaaggtaagaactgcaaaatggttcgccattgtaaaagtcttggagacatgaacaaagaagtacttctataaataaaaaggcaccaatctgaaagcgatatgggtgctgtagaaaaagaaatttcgaacctttgttttgcacaaagtagtatctatcgagcgttgaaaaataatctgagtaagacctttccatttgctgatggtgacgactcacaaaccaagctgaagctgggctttgaattcagaaccaccaaacaaatttaacactgcagcactttttgatagttagcaatgctgataaggaggtaactttgaaagggactggttcatgaatttcctgaactaaagtagctcagcggtacatttcgatgcgtctacgttagtcaaaacaatgaaaaaacagctgttgatcatgaaaccccagttttttgggccattatttcatttttgcataaaattaattcaggttttgcattttagttaaggcatgcaaaacatttttgcaatttaaaaggaataaatttcagaaaacactacattccagggctttcataacacaaaaccctaggttttgctattcgtttcatgaaacactaggttttaggacaaaatatttcataaaacgttgggctcaagcttatatagtccatataactaatatatttgtctataataattgtgaacaaatttatgagatagtttttagtacatatatatccaggtaagtcgttttcaacaatcgttgatcaccacggtttgattactcatgtcattgtcagttaggatttttcaaatttttagcgcaaaattgagaataaaaataaagtaaacgagagggatatgtaatttgactcaactaatatgaatttatgttgaaacaatcataaatgataatgaaatatgagtgttttatatatatgggtttcttgatacattttgccccaaaatatgggattccttgaaataaattacaataattaaggtttcgtgttactggtgccccagtggtttgtgttttgtgaaatttactcttaaaagaatattaacttatcgtcgacatgatgctttgtagttaatatactaaaataaagtgaagtgttcttacatatcatgaaaagctcctgctgaaatagttttattttagaacaaattacactttgcaccagttaggttagaccctttttaattttatactaggtttagcaaatactttacactagggtgcattgaaataagtttcacttaaccccaagatatatcatcatatctgtagaaattcatgattgacttcaattttcaattcttttgatggtaagcaactattttgcgaattcgatttcactgcccttcctctaggctgcaaacactatcatatgctggccaccgcctcacggggctacgcagctctgcctctagcatcctgccctcaccgagctcccgaaccttgtcgcccgtgtatcttactatctttcagcttgtgcagcgcatgctgactgacaattagtgaatcagcccccccccccaccaacacacacacgtccgaagaaaaacattgaaaagtggttgaatacaatctcaaatcccaacaattgagcaatacatagagctagaaagtaataaataatgccactatatttgattgatgataaagatatatttactcattttagtttgttttatagtggaacccaaagcaataaatgccaatctaaatagaggaattaaatagaaaacacaaaactggcgaatcagatatggtaacattaaacatcacaataaaatatagagcattaaattgacgagaccaacatgtatctatatctatctatatatcttatccctgcgattttgttttgcttctatataaacaacaacaaagttgttgccagtttaagtcccaccaaattaaacagaagtggtgcagagatactatacagttagcaccactgtcatcacggcaccattgaaaagcaatatgtcgaggccactatactcgatagctgttgctgtttgcatagtttttgtggttatgtcgaccatcccatcatgctatggaggtatatatatagcgcagatacttcaattttaatactgactagttagttttgatcgattaacccgccaatttctgtttgattcaatcaattcatgcgttaattaatattgcactgtgcattgcatattgaatgtatctctagatgaggagacattcaccgatgaagtaccacactgcaagattgtagcatgcaccaacaaatgcagaacccatcaccatccgaaatacactgcgcggtgtattcacaacaccaaccccgagcagtgttgctgcaaaaaggatgacgcccgcgtgaccaaataatttcatgcatggtattaatttctcggcctgcgcagtgtatgcgtctatatatttctcttcgatgcagataaaataaacaagtatttatttgcattattatatgatatcgacccaatatctttctgcctatatctatctatctatctatctatctaatcttgttgagcacgaccaatgttatcagaaatcgattagctgttaaatggtgaacacaagtgaacagacagtctagggactaccaaataattgacataaaaaattatcgatatctacatctacactatttttagttaaaaaaacaagtcgcattctctggttttttgctttttccactcccaaatctcgatatatgatatacagctagggatggatgtcgagctggctcagctcggctcggtctacctcgttaggataacgagctggctcggctcggctcgttatcctaactaggaaggtagcccgcatatacgtgcgggcatattgtttaatcttgtttgaactttcattacaaatgtttatgtgtagattatatttttgaaatattttttgactatattttaaacttatcttcgttaataactggtttgggtgtattacttgaaactgtatgtcctcaaatttattagaaaaaatatgtcataataatgaagttagttcatatctatttgtattatgtgtgattcttttttaaaattttttgagtttccaatctttatataacattttttaattttgtatgctatagatgactttaagtaacattttaactttagtaatgaaagatattttgtattaaaaatatagccaacgatactacttcatctaatcaaagatagacttatattacttatattccctccgtcgcataaatcgaaggagttaaattttatccctaaataatagaagaatttatatgtaactgagacaaagtgattttttttaaatactatcacgataatctccaaagtaccgtatcatattttgataaaaatctatagtgtagtgcatgttagtttagtatccggtttgttttcaacacctattttttctaatctcatgagacacctttggtaatttggagaataaatatgtacatttacattagcgttgtattttcatcaactgtttttacacctaaaatctgatttgaaattattatcataacataaatattacatgtcggctccatatttgtgatgtatttaggctatagataatagtagtttatttattttgaaggaatacaaccggatcgcaaattggatatataatttcaaaataatttaaaagatagaacgcttaaaagcattggttggatattttatatttacatttgtgtaaacttgaagattttatccctaaattgtagaattgccgattttttgactttatgataagtatgttttatgttcttccggcaaacgatatgtaagtattattgttttctcaatcatatgtacgtacggagtactttttccgatgtaacagttatatatttctcatgtatccatgtatggagaaatgtattatttttaaggcaaaatttgctacaggacactcaaatattgtggcctttactgtaggacacccgaagatcgtgaatcttttcgtggacactgtaaaaatgtggtaattagctgctggacactcctccgattattttattatttctggccgaatcagagagagaaagggtggtgaaagtaccaaaaagcccctgcgccatttttcttgtaaacgttggtcgaaccagacccgatcccctctcgtgtgagcccgagcttgacataaccaatcccctctcctttgaaccctagctttgagcctcagcggcggcggcggcggtgaggtgcgtcgtgagcgagggggttcgggggtcagcagcggattgaagcgaccgatggatctttgagctcggggttgctgcgatgacggaatcaatgtcgtgcctagaggggagggggtcacccaggaagaagaaggcagcggtgaagaaatgctcggtgcgttttacgagcagtcaatctcctttgaagccgattgatttgtcatgggtccctgactggtaagcattaatgggcattgatttgttattttctttcttgaaatgaaatttgttggggttatgtttgaagtggtttttaatcgatttcattgcgttttgtgttcacttgtgttcacgtaggatggattgcagctcggcatgtagagtttgcattcgggttggtccttatgtcgagtttactaagaacggagacccaaatatcatgtgagtaagaacattaagtggattgtagacaaggatacagtgtgttggattgatctaatgagcgatttggatgatgaggtcatacatagtcctcagcaagagctaaatgtgaaattttgggacaaaaatgcaaaccaatatgcgcaggtagcctctgatagatctttacttgatgctttcgatatgtacagggagatgaggaggctccctttatttgttgatgtgagtgatgacgcacagaataggacagagccttgtgtggagcagggcaacactgagccgcaagatgtttgcactgacattgtgttgttcacacaacaaagtcaagtaggacagtcctctatgccttctactaaaccaaagaagtgtagcacttacaaaccggttgatgcttggggagagaatgatgaggtagagtatgtcggtgtagatgatgagaaggataagtacaaggatttggtttcagatgatgaagagcatgatctagattatgaacctgggtctgatgaagatgtcgacgacttagctgcagatgatgagcagggttgtgaatctgtagtgcatataactgatcttgacaatcctaagatagctgttgatgtaacatttgaagacggtgaaacatttaaaagatgcattaggcagtatgcagtactaaaagaggttgaacttgcaattccatatagcgaatcgacgaggtacagagcatactgcaaggccaagaggtgcaaatggaggattcatgcatctagattacaagacaaattatgcctaaaacttacatgctcaagctttggacacttcacgaaccgcttgtttgggttagcaggggtcctcgatgtctttgcttccaactgcgtaccgcataacggacacttaccgacgtgcaactcgcctgtgactgggttacgcattgacgacgagcccgtgtacaaggattggtccatctcgccggccacctcaatctgccgcagatcgccgccgcacttctctgctcgaatctgctagcggcagagcgtcctagctcgccgccgcagtcaccggagcttgtcgacgtcgccgccgcagtcaccgaagcttgccgaccggagctcgccaacatcgcagtcaccggagctcgccgacgtcgccgccgcagatcgctgccgtcgccgcagatcgccaccgcacctaaccctagggtttggaggagaggggattgtgacactaaatggggaatgggtctgattcgacccatctccatcgggttaaacactgacccaagggcaaagttgccatttactaaagtttctttctccgattcggccggaaataataatataatcggaggagtgtctagcagcaaattaccatatttttacagtgtccacgaaaaaattcacgatcttcgggtgtcccacaacaaaggccacaatctttgagtgtcctgtagcaaattttgcctatttttaaataataaacctaatctaatggtataaattgaaacaactaaattgtgttttttatttttacaaatgtaaatttaaattagcgtcgtatattcatcaagtaatatttgacaccctaaaatatgatgtgaaataaaaaattataatagcataattattgtatatatcagcctcgtatggtaagttataacgaatagaggtcattgatgggatgtttcatatttataatacaaatttagtttaactatgtatatttaagtaaatttgtagtgtaatatatttatctttaaatagtagataataatatttaaaaaccatcgatctttttaatgatacacatttttttattgtttttattgtaagggattttgaaaatactattttgaaagaccaccgtgtatagattctttttcccgatggacagtaggtaaagtttcatttctttttccaagtcggatgtatgtacgaactacttatgttttttttccttttcaagccttatagttctcccgtatacgtatacagagtaataaggtattagtttttaaaataaaatacatctaatctattattaccactattttaaaagttgagtatctattaatagatggaactgtatatgtcttacttatttccaaatccatatataaatattctaaaaataccacttctaccgattaataggatacaccattaaaattaaaccattaaagttaaacaggaatgcccatttagtgggtgaagtcagtcataatcgtcaagactttcttactctactgccttgaatgataggtctctcattgggatagttgtcctcctccagaacttggagcacaatttaatgtctaatttactatcacacccctatgtagtattgcattggtatactgggatcgccttaactcagcctatatatgtctctgttatacttaggatagcatagcaaactctgttggttatgcttggtgcccctcggggaaggagaaagaaaagataaacgtgaccaagatagtagttttttttaatttttgagtagatttgtgctatagagtagacacaatatgtttaagatattaatcattactactcatatttttatagtacagctagaatactctcattcgaaaaaaagcaaggtccatcaccagatggtacttgaaagaaaattgccaaagagagacataacaccacgataatctccagagcactatattattgttcatattttgacaaatacctatagtttagcacctggtttggtttgaacacctactattgacaacaacacatgttatacctttactaatttaaagaatgtatttattcttccaaacttatttatcaattacgtagtatatttatcaagtgatatttgacatcctaaaatatgatatgaaattatttaaaaattatcattacaataattattatatattagcccaagatgtgatgtatatagaaccgcacgataaattttataagacacaaatattttatttaattaaaggaatataatgggatcacagattggatatataactaaaaataatttaaaagataactgtctatattttatatttatattatagacctagtttatatttgcacatatttgtggagtaatatatattttatatggtaaagtattatattttaaagaccatcgattctgttccatgcacatttgttttttattacatatatttcttattggctttatcattttctacggtaggtacgtgcattttttttctttgtaataatagttatacataagctttctaatacagatatactatttctgtctccttttatcagggaagtggttaagtacctcagaagatagaggagagcgtcaggcgcatatttccggaatgcttctacggggaatgctcattgaatgtgcattctccgtattataccttgaagaggactcgaacctccacgcttattagcacgagattctgagtctcgcgtgtctaccattttaccatcaaggcatcttgaaagtgaatcatattccataaatatgatatctatctaatgtgatatcttgaaagtaaatcgtattccatgaatatgatatctatctaatgtgatatgtagaatatatgacaaaggtggagtcttggagtatttcgatcgatcggtcatataggcctgagtcagacatttggttttcatctttatcgtacgtacgtacgcatgtgttcttccttcctgtaaacagtatatatagcagaaaggtattatatatagatctaatttattggtaaaaaaacgggtccaccaatttaaatataaatcaacagtatagatctaatctaacggtataaaataacgggtccaccaatttaaataaaaatcgacggtgagattagattgtgccacgtggcggcctaatagcaattgtaggagcgccatatggcggcttttgagcgtttgtaggaagtttaatggacttttagtatataatagatagatagatagatagatagatagatagatagataatagatgagctagaaacccagctcggctcgactcgttacccagctcgagctagctcgtttggctcatgagccaacgaaagaagggcaagcacgaggatgaggaagcatgaccacaagggcgtcagacggcggccatgcggttgacttggagatttgcgaggtaggagggttgggggcttggggcggtctgaggtaggcaggggagaaggcgtcgatcttgccggcggccagcagacgaaggggatgtggcgccgtgggctgtgactcctgggcggcgacgacgatttttgacaggatgagacttgagagcgattgtgggcttccagcgctacgggagacggcgagcgattgcggcgctacgggagaaggaagaaagtgagcgagcgattgtggcgctacgggagaagggaagtgagtgattggaggaggcatggagagattttagggttagaatagtgggcttattgggccttgttgggcatcgatctctactgatgggcttgtgatcttttttcgttggccttgttggacttttggtgcttgccttgccttggcctgctgtttgttttgggccttagctcgtttggctcgcaagcagctcgcgagctggctcgttatagctaacgagctcaaagcctagctcagctcgttaacaaatccaaatgagccgagccgagccaggcacgagccgagtgagttaacgagtcacgagtttttttccagccctatatacagccaaactccagaatttggtgatactaagtaatatgtacaatgaagttatgctagggattgaaatttcggaatccccctctcaatttttttttaaattttggttaaaatatagtcaaattcaaccaaaattcataaaaattttaaataattttgtggaaaaaaaatctaaaaattcacgaaattcatgaatttttttggtcgtagagaaattatgaaaaattcggtggtttctgagaaagtcatccaacatcggttatgatctctgatataaaatttaattatttgctaaaacttctggacttctttacttttgttctgatcatcaagagcccaagacccaagcttgttcatcacttcgggcatgttcacattttagctgaaatgaatcttaccaaattttagcaatgacaaaattttgataatttggcaatattgccaacttttgataggatttcttatatatttactagagtttggtaaaataaaaataaatagatgcacatatttgataactttgctaaaatttgataatgtttattttggctacaatctgaatagacccttcatctgaattgagtatatttttgcttaactcgagttagctagaagacgtagtcgcctgagcatgtcgaaaagaatcaaagaaacattggacagctcccgggctgttctattcgacatgtacaagttagaaacacaatcgtctgtatccttgtttcgtcacaagtgagtagcagttacagaattaacttcttgagttgttgcctagcaaaatagaagacagttttctacagctagagcatcctagaaacatggggtgtgccatgcatctcgttcgagaataggacaggatgtacagaaaattgccacatgattgaaactagcatcgttgtacttcgagcgctctgagctcatagaaaatgaaaagccaaaatatgaattaaacggccgaagagatttagttttctgttgccactcatttccttggaaaaacaatagtatcactagcagccttcaatattatattaatttccgtatgggacattaaaaagtcggtttgacatgcccaactagagttgggaggattaatggtttagtttcgtgagggctagaactttgggcggaggtatatatataggtcggaatgatatatgacttgaacaagctagaattgaatttttaccttgacgagtaggtagcatgtaaagacatgaatgattccttcatactgcatatctcttaatttattgggttgctacgcctacgataattaataaattatgtctttcatatatgagtgtcacggatgctcagtgcaaataagaggaagaatttagaggatagttgggcggttttgggaagaacaggggaaggaagtagttggtattttgtattttcattttacaatattcacttgagagtgtggcgacaggatatttatataactcagattcatgcacagctagaccgccgctaacctgacacggagacctgacacacttgcacaaggcaggactcagccgagcaatacaacaacgcggcactagaaatactcacccaacgatgcctcacaactccccatgcttaagcaacagcgtgacccccgctaaacctcgatttcagttgtcgcatgttttcccatagtgttagctcatcaggcacacctatacacgagaataatctagatggaacaacagtcttgtcagttgtcgcgtttagtcaggttgcggtgaagaattgcttcaggcttggcatcaagtttaatttcagctgtctgtagtggtagctcaggactcgccacagtgtcaggtttgatggcaactttcaacaatgacacatgaaccacaggacggataagaagaatggccacatcaatcttactatgtccagtgttaagaaatacattataaagacattattaataaatatgtggttatagtgacctgagtagcaccttaaggttctgagttcaaatcttcatagcagcgaatttcagattgggttatttgagggctcattttcctgtttgatatgctaaggtcctaattaaaatatgacgtatatgtccggttggatgtagagggcgggtaaaaaatacccttgtctaaaagaaaatcaataaatatatgggattataggatcacatcgaaactacattagccaaatgatattcactaatgcaaaacgcatggtgagcggcggttagatttcttcaattgtttggctctagcaaactttgatagctcttttatccttgttgatctccaggcctgccatttaccatggctgtttacattgcaggcatgaaaccatattgccatacctctgcttaatttctcgtttggcaagatggccatccattggtccaaacaaagaagctatgagtcccctgcatctgctaagcacctccattctgtgtatccaactggcataccataatcatactaggcagttcattcatgatgcctcctattcctaattgtatctttgtatctcccagcatcctctctgcttctctttggttcctctcttgtgatatccattgctaccagcttgcagctgactagtagatggaataatgtggttttgtacatatgaaactgtgtggagtaactaatatcagtttttcacttctgggtacagtgctggacacctaagcctgctgggtacttggttctgcgataagttgtgaaaaatatcaaatgaacctatacaaattgaaatatatatctggctgcgaagtttgtggtttagtgaacctatacaattctagcctaattgtaaaagaaactagtatgaacttttactttgttgggatgcaaagtacaaatatgttcaatacttttacacgatgtggatcagcaatacatacgcctgttggaacattttttttcttactaacaagaaattaaagtgatgtttcgtgcataattgaggacatttgtttttttacttcaaactactttctaaatattgccaaatcagcattgaaaatacaatggttgtagcaaaaataccattaagtctctacaattatatgatgatgcaaggatattttgccaattctgaaggcttgggatcgcttcattattgcatatttcctcgatttgtgctctcagttagttgttggagtactcccacaattaatacttgtgaagtatttgactagttctatttcttcttagttgcaaatctaccaaactgccaaatttctcatcaacgataaatcccctgaatagacaaatagattagaaactaaaagaatattatgaccacccacattcctaatgaagcagtgtataggcagcacacaagcagacaaacatctctcacttacatgtcgccatctcccattaggctggggttgctgtcatccccatatcatcgttcctactcgcaggcgttgcaccgccttcgtagacacaacccggaaagaaacaattcacaatatatgttgactcactcgatttactttaacctctaccatgcaagtgttgacgttgtcgcaatcctaaaactttggatacccggaaaggtatcatcatactgaccttcagcgcagatgagcacatgaatagtttcccgttgcctctaactcttatagaacaccgggactaaacaatcaaaatgacagtagaatatcataggccatagttaaatttcttacgggcaattaattttatggtcactaactatacgtaacttctataccaaaatatacaagcagaaacaacgataacagtaggagcagcagcagcaacatcaataaaacatttattactaatcatatataactgcattcggtaagacaaaatacacgttatttggacagagtgatcaatttacatactttagcacatataaatggccaaactagaagaataaattaatgtttttagtgctataataaaaacagataatgtagcggcacattttacatactaataaacatatatgtgagtttactctacttagcttgttttatgactttgactaacatgtagcatttgcaacgacaacaagagagcattgatagtaatcagtatctcattgaatttcaaaacaaacaaaaccccatgtagagctagccccagtaagtatacacaagcaaccatcaaacatagtaatatttcctttaatcagtaacactcatgtgtaagagtagttttaatagtctcatagtctcatattaagtgcttgaagaaagctcacgatggtactgaacttcttccattgatccttctcatgctcatttgacctgcattattcatcaacatcatctagtacatgcttggtgacagcccagcacttcacaacatcacttcaattactgtcagaactcatgataataccaagtgtggtttttactatagtaggcatcgagagttcattccccaacacttcctaataggctttgcaacagtggtcccatctcttatagcttgaaacataacttattggtgataccgagaatcccccaaacacttcacacagtaggccttaaaatagtgccatgtgaaatgattaaagagaactcaagataatagcaaacatggctgtcatctcgatcttgtggtttaaacaccatatattaattgtttggtgataccgagagttccctcaaacacagtaagcattgaattagtgccacatgacgtcaagtgcttgaagggaactcacaacaataccaaacgtgtctctcatctcaatcatatggttcaaacaccggttacaaatgtatgatgacacagagagttccgccaaatacttcacaacaacccttgaaataattgtgtcgtatgaagtgcttaaagagaattcatggtgataacaaacgtttatccttgtatagtttgagcactgtttacttacatgctggcgacactgagatttcccccaaacgcttcacaacaactctcaaaatattgtttcatgaattgcttgaagggaattcctggcagtgtcgtcgatggccatgtgccaactggcctaccgcatagggccccccaaaattctcatatttcaatacaagacactaatttccaatatggttttatcctattcattttattttttcaaaagttccgctcatcttgatgtattgatttggctataacatatttattttctttggatcaaatagatgttcaataataatcatggcaaccttaaagaaatatagtttatagcggtgacatgaacgtgcgttctaggtactaaacattccatttttctgcttgataaagaaaatcaaataattacattaagactcacttatttttcttacttaaggaggttaccgccaccatttacgtaatatttttttctgaataatttagtatccttttattgatatttctaaatataagatttcgttttatgtttcgcactggggcctaaggtgctgggtacggcccttattccttggggctccaaacctccatcatttaaaaattgaatatcatatatatggccatcacatgtaattcctgaagtacaaacacttacataccaaacttgaaaatgctggttgccaaccggagtttccccaaacacttcactataagcagctaacttttggccccatgctcatagttatgcaacagtggtgcaatgcaatgaggcctagctagctatctgctgaagtggtttgaggagaactccagtggataaccaaccaaattatgactcctagatcgacctaatttcctcgtttttgatgtggaccacttcacttgtttaatttgccttgctgatgagcacagagccggtggctactctctccgtttcataatgtaagtcattctagcattgcctacattcatatagatgttaatgaatctagattcatatatatgtctagattcactaacatctatataaatatgggtaatgctagaatgacttacattatgaaacggaggaagtagtaagctagctagtaatctgcctcctgtggactgtgcaatgcatatatggtccttgctacgcagttggcatgtattaattggatgaacttggcaacggatgcatctagccgtgatatagcctaggttaggacatggaatgtggcgaagagaatatatacaatgtgacctttgggctgcactgagctccgatcgaatcgtagaaagatagctgcaaaattccttatattaccaccggcagagcactctgtcgttgcccggtttctgtccacgtacattcctttcattgcatgcacagccggttcaggaagttgatgacatacatgttacatatactgtattctgccactctgttgaactaagctattttatgggttgattatctagtgtgatgatgaaattatcctgtgaaccacagatcatcatatattttcagttgtcttttgcctgtcagcgaccggtgagtgtcacaggcttgctagtgatcatagagggcagcaatcatacacgacctaatctgacataatttactataaaatttgtccaaatcgaatgtgctagttgtgtcattatgcgtatatgactgtataggcaggcagcacaacgagaagaagaaaaaaggttgggacatatacacaaacagaaggatggatgcattttctctgccaccaggtaatcgatgagtcatattcccaaaacccaaaactatatgctcaaagaggagaaagaaaaaggtgatgaaggtgtccaggttcaatgtatgcaatccttgtcagcagaagaatatatgtagagccccccagctgaccactttcaaagcatgtccaaacagcagtctagtttcagctttagaaggagaggagaggagagatatttgcagtacaagtagcttattaggagaatgaacattcctaaacccaagatacatcaagaactatccttcttcaagctgtagctgcctgtaggaggaggagattgtgtcagatggagttccccctttcacttcttggttcttgtttgcttctacaggtagagcggattttgtttctgatgattttcatgttcatgattcatggatggatttgtttctcagtatgctcgtttatgctgtagctggattgtatcaaggaaaataaatcgacgatgagtaaagcaattttatctgtattgtttcttgatctttttaattagctatagttacttgtctttgtctatttgtgtgctcggatgtgatggcctcattgaaatgagtcataactcataaccgtattagcgcaggtggtcttgttgggccggtcgatcttctgaactagtgtgctaagcccaggaatttttttcatttttagaattttttttaatatttacagaaataatctatcggccaaaaaaattgcaaaaatagaccatgccgccccagtggtgggcggcaagctgacgtgatagacggcgggtcgaccgcgccgtctgccgccgtcggccaaaattgcaattacccccttgccgcccatacagagggcggcaaggggctaattgcaatttttgccgcctataaagaggttgcgctcgtactttttgcatttgggccccttgccgccccagtagagggcagcaagggacccagatgcaaaaagtacggccaaacgatttttctatgttatgttaataataaataaagaagtatttattggtaaaacttattaatattgttataaaaatgtattgaagttggttgtttcgcaatttcatatgttaagtaaggtattattttgtaacttattcgacgtattagtactcggataattaataggcctatcgcagtctcggtcgtagaaacattatatggacttaaacaaggagaattatttaacatgaagaaatagtagtacaatttgaacatgatacaactatttccattgcggttacatagatgatattagattcgaactaggagggaggtagtgcaatagttgaacacaacgacgatgtagtaatgggacaaggaaacatgacagtagaaatttcaatatgcccctacgtgaggatccctttcctctctcaaaacacgctttagtaaccttgtattgctctggtagttcaagctgcacaacacggctaggtggagttagaacccttctggtatctatccattctctgtattgacatctccttggtggttcctaggaggaaagaatagatgtaaagcgaacaaagttagtaaatgttgtgagaaaataaggattcatgtaatcaaaatattcttaccatgaaatcgtcgtcaagaatatttggacaaacaaagaaccttcgatccaatgttgtaggctttatggaacgaagaacctgacaacgatcatcacacctgcatcttggacgggcttcccatggagggagtgccgtagttagcacccgccagtcgctctgttgttcacgacattgtcgttcataagccgcttttctctgtaagtattgctcagtactttcggatgcacaataccagcgaccttcttgtaaacaagtggttaggtcgagaacgggattttctgtatcgacccactcgattatgtgcaagccgtagtacgggtctgccgaatagagtagtgttacgaagaataaagcgattgcccatacggaatgaataagcatatgaagataataaaatatctcacggtcatagttagggcacctaaaaaagcgccttcctcaaatatcaggattcctcgaagccattagttggcatcgataaccgcataggcagagaggacgctggcaccaaggtggtagtaggtatacacaaggatcgctagccagttcagatcctcaacaccccggcgtctagctattgacgaaagccggtaggatttgtaatgaagcatgtagggaagagagtactgaatttgactgagttctgaaagattgtgaggcctcactcgttaaggcgacttatataggcgcaaaaaatcgagtgatatccctgacatgtgaacgtggaagggcatggtggatacgcctgattggcaccgaaagttacatgcctgatcggcgccgaaagttacattggtcgtatgcagcaaatggcgggcaaatactcgtatcgcacgcaaataaaggaggctgcatcggtgcagcagaaagtagtcgtgcatgtgtcgaaaggtatcgtgcatgcgccgaaaggtatcgtgcacatataacaacaacgtagttattacacaagtatacagtactggaaagtgaagcaaataaacaaaaagaagactgctctactggccctgccccgcgccgcgaccacgcttggtcctccaggcctgtgctcgcacgtggtcatgggagtaggtgaaacgatccggtggcacaacacgggtagcacgagtgtctggcggtggagtggccagcgcctggtcctgcgtctgcaccggcggtgcgcctcccagctgtgaggggccgatgacatcctctgtcaagcctgaagcgaagtcgaagtcagtgatatcgaagagcaaggtggaaggcagcaagcgatccaacgaggtcccagcatggtccagtggtggaccctgactcgacgtgccggctgcgtgtgacgaagtcccggtgtactgccagaactgcgctgagtgtgaggtcgacgcagctgcctgagacgctgaccctgcaacctgggagaagtgggcggcctgcgtcatagcgaacagggcgaaacctacacatcgacaacgggacccttgtaagctaagacataaaatgcatgtaaattgattgtcgaagtaatgttgtttttttaggtacctgtggggggcacaacagaaggcctagccgaggaaggcggggtgctgaacggtgcacgaaaccctgaagcaatcggcaagtgaaacggctcacatatatgtgcgaggcatgtacagaaaaatccttaaaaatacttacctccgtgcggagggggagtcggcctaggaacgtgcgcagctggacggggaccagttggtacgggtggccgctgtacagctgcgtctgcccgagcaacgtcgtctgcacgacaggtgagcactcggagaatcgagcgcatcgattccaccatccgcgtgtacgtcgtcaggtgctcctctacgggtaccggaatccccgcgcctaaacgttggatcatcgttgaaccgtcaacgatgacccggttgatgtcgtcaacctgcatggttaattttttcatacatattcgtaaaatttgacgaagagaaagacatgaaaacataaaggaatggtgcgatgcatggtactcacagcacgagcgaagtcctggtcgcggtgcctggcgtagaggtctctagtgctcgcaacgtggggctgcttctccaaggacttcgcgaaggtgaccctagtatgggtgcatggctggtactagcataggtaggccaggtacgcctcctcagtgtgtggctctccctcgtggtccacgacctcctcggttgcgagcaaccagtcctcaacaaaagtcgccaacttggcgggccagtcgccagctgactgctgacccttgcgcgagtaactgcgaattaatctgtcatattagtgtgaatcgacagatgttgcaaattattgcggactggtagattttaatgcaacaactcaaagcgtagtgaaagatcttaccggtgaacagcagctaggacggtcgtcgaaaacggtactggaaagggctgacggaagccgaactgccgcatcacgcggaaaggggcgtgaggctcaacgcagatgtcgaagaccatcggaaccatagtcatctagtacgcctggtccctggtgcagagtgtggacagacccaacggcgcccgagcctgggtagccgcggcactgtagggctcccacaggacgtcagtcggcagaaggcggtcgaactccataacaaactcaggatacgaccacctaacctggacgtgagcccatcggcgctgcaatacgagacgatcgatgtgatgtacaatgaacttagcaattaacttaacaatacgagaagatcgatgcaacgtacctgacgatggcaccacagagtacacatcgtagggtagtcgacctctggtcgctctgcgtacagtgactcctcgtacgcgtgctggtccacctcagggcggccgatcgcaatcctctcagctgcccagatagaaagaaagagagggcacccaccaaaggtcacgctgggatccgtcttcgtgcaagcctcacaaaggccacggtacagagccgccaacaacgcggaaccccagctccactgaggcacctcgcctaccgcggcatcggcgatgctcctggcgtagtgcacgagtcccttgtcgaccgcgtgcccgtgaccgccacagaacatcacccagccaaaaagccagagcaagtacacctccaaacaacggctgtaggtgtactcgtcggcctccgcctgtagctgctcgacctgcaagcgttcgataaaatgttaggcaccttaactgtggactaaatatgtagtatgcttgtcatttcggtacaaaaacacccacggtgaactgaagcagccacctcttcgtaggtccggtgttgcggtggtgtgccaacggctcgagcgggagacgcgatgcgcgctgtactagtgcgaaatgtgtcgtcagatcgtcctgccagtccacacccgtggtcactagcccaacagcgtctcccgcgagcggtagccccaacaagtacgatacgtcctgtagggtaggggctacctcaccgcacggcaagtgaaaagtgtgcgtctctggcctccatcggtcgaccaaagctgctaggagggaccgatccacagtccatcgtctggccgggtcagcgtcgccggcggcaacctccaccagccgacacatcggtaggaggccggcctcacgcagcctgcaataacaaactaatatgtcaatataaaaattattacagcgcaactaatttatagcaatacacttttcgtacccctcgacaaaggagtcgtgaaccataagtagctcaccgcacgtccgttcccggaacgtcccaagctgagccccctgcactgcagtaaggtgagaccggtgttggtgatctatcaccgggtccaacaactgagttgtatcctgacgtgccatctctgaaaaatatagtgtttcgtgttagaacaattcaaaaagtagtaatgtcaaacaaaaagataacttgtaaaattatgtacaacaagagtacatgctatttaaatataggaaacgttactaagggtacataacgatgacgtgcaatttaacatatatgtagagttcgataatataacataacataacataacattacgtgtcgaaatccgacattacatcagcatacctaaagacactaggtgccttagtctaacgttacatcacgagacctaaagacatgacatgccgaagtctgacattacacgacgaaacataaacacatcgataagttcgaataaaattacaagcaaagccacatgctaacatagaacataagaactacaccacgtaaccagacgtggcacgacgacgcctaggacgttgtcgatccttcacccgtagggcgagctccatctgttgttgatcctgatagtcctgcctccgccgcacttggtttctccttatctttaggacaatgcttgtaggtgtgcccacgttcatcgcatttgctgcaacgcttcaccctgccagcctccgactcgtccatatcgttgcggatgcgatgagtcttcctccttccagccttgcctcggagctgcgatgggtcaggaatattgagtccttcatcgttagtctctatgaactccccagctatgccgaacccataaatctcgccgctccatgtatgatatattgcttgcttactgaagtactgtgaaacatatactgcatctggtatgccacactccgctacggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagttccaaacaaaatgttgttgttcggcatagagggatgaactgcctggaaccgatccctaaaatacctgcatgtcccatgtaaaatgaactccactatgccaactagtggcagtccacggacaccgcgcatcacccagttctaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccagagtttgaggagggtcagcatcggcggtcaatggagctgctgcacgctgatcactgcatttggctgtcaactcatctaatctcttccaaagctcattgaattttttctcttggttctgattgcatagcctcttaaacatgttcatgagctccttgttcttgaattgcttgaagaaattagctcccatatgacgcatgcaccacctgctctgtacatcttcccactcaccagggtatcctcgttccatactcccaaactgcaactcttctatcgctcgcagaatgccagcgtgcctatcatgtatcaggcacacatttggcctcataccaacaacttttgttttaaccaatttcaggaaccaataccagctgtcggtattctcactctcaacaaaagcaaatgccaagggcaatacctggttgttcccacccctattgttgttagtatctagccccgattctttcctgtcatgaatgtcccatcaatgcagagaataggacgacagttcacgaatgccatcttgcatgcatgtagagctaagaacgccctttgcagcacactcttgccaggatgttcaattgaggggaatttcttcacttcataagagctcccagggtttctttccttgataacaccaaagcaggcgtggcaaattgtcatacgaggcttcgtaagttcaaaagctcatctctataattttctatttggccctccaggccttggcatagctaatagtatacttgcatgtctcttcgatgtgtcggattattgaccttagttcatatgtgagattatcgatgacatgcgcatacatctcagatgcaacaaatgcacatgtaatattcctgtggtatttctgaacaccaggtagataacatgtatgcttggtaacgactgaaactgtccaataatctttccatttccccttatacgcgtgcactttccagggacaaccatctttttccttaacacaccgaacttcatattgggaccggttggacttggcaacccaaaactctctatgaagtgacactgcaaaatgttttactacctccttcatatcttctgctctactataaatcgctccttgaataaccgcattttcattgtactcccatctcacactatcctcttctgaaacgaccagcgcagaaaaatcctcactagcccattctgctggattaatatccgtctcatcatctgacgaatcaccttcctctacacgctcattgtcagaatcctccctctccatttcatccacaatggcaccgacagtctccccctcgttggccactccacctggttgaatgcccactggagctactacacccccatcctctcgtgcgttgacctcctccacagaagtctcatttacttcagcacttggtccctcgccatcatccatgttcatctgcacacatggatccttcgggtgaacaaacggaaccatagctagaggctacccgcgttgcaatgcattttccacattccatctncacactcgagagtttgaactggcattagttcccaataaaaaccctcagttgcccgacttactataacattgattgttatgtcacttatctggggatcaactctcaagcccctcattaaccatccttttatagaaggtacactcctctcagccagtctatcaattcccctttctgatacaataaaatctgacagatctaccccagttggcccgtaacggacgtttcctgggccatggtaaacttggaatatttgtttgttcgacatatctatcaacgaaataactagatcatattaatctttcatgcaataaacatctacaacgtaatatcttcttgtgtatgccaatgcaacggtaaagtattgattccaaactagtagatctacgtagttaccgatatctaaaatacgcacttctagattagtacaactaaaaccctaaaaatataatgcatttattcaaacaaagttttaaaaaatacacactatttaactcaatagtcacatataggatctatgaatattacctgaaatcggcgtctgaatccgacagggcttcgccccttcttctcttctcctcccctttcttcttttttttttcactggatttgagggggaggaatgagggctgggggctgggcgacaggccttttataggcaggccttttataggcagcgaggcctgccgcccggccagagggcggcaaggggccgcctgcaaaatggccggccccaactggcttttttgtattcgggccccttgccgccccaacagagggcggcaagggctttactgaaaaaaaccctccctccgtcaccgcccgccccaacagagggcggcaagggatttgtaagctctatataagatacgcatatgtaccgtccctgcttgttgggcatcaaatgacaaaataaaaaacagaaatccccacctatctcgtcttcttcctctgaactctcgatccccgattccaacagcttctcaatcctcactgatagaacattatgcgtgtcgctggtggctgtcacgacttcgtggtagtttggtatcagacacaagtcgatctgccactacggagaaagcatttttgctcccggtttataactccctataattatggttttgtaaccagaagtacgaatccgggactaaagatgggtatctttcatctttagtcccgggtgaaatgaaacgggattaaaaatccatctttagtgccagcgccaatcccggttagtcaccatttttttttcttttttcatcattgtttcttttttctttcccaaatcgagttggtccttcccaaatagagttgctccctacatatccccaatcatatctcccatccgcccgttgacgcgatccctgccgccctccacacggcaaggtcgccgcctgccgccctccgcccggcacaccacgctagccgcagccgctacaggcccggcccaggcttggccgcctggagtggtagaagaagaagaaggcggggaggggaaagagagtggaatggggaggaaggggagagaagagggaatggaggctaagatcaggattatgttaatttaataagaggggagagagaggaagggcaaggggataagattgactattgagatgatgaggcgcgcggctcggggtgaattttggtcccggttggtataaacaatcgggactaaagaaccatttttagccccggttgttcataccaatcgggattaaagataattggggcttaactcgtccgacaacttcttgaaccgggactaaaaatgatatttagttccggttgataacaccaaccggaactaaaaatcaaaaagttttgtcccggttcctattcgaaccggcactattgtggtttttgggtaacggaccattgatggttagtgtgcgcacatcctagcgacgaataaatcgcagacaacactcacggagaggatagtgtgatggaacgagatattggagcgcaccatcgagctcacctccaatatcaacggtattctcggctcgctccaaggcacaggttaaacaaaactaactttccgaagtttgacgaggtcaatcccaaactctggaaaacaaatagtgagaagtattttagtatgttcaggtagagaagatttatttccgatgattttcgtattcatgattcatggggagatggatttgtttctcagtatcctcttgtagtagtatgctgtaactggattgtatcaaggaaaataaatccatgatgacgagtaaagagaattatctgtactatctcttgatctttttagttagctacttgtctttgtctatttgtgtgctcggatgtcatggaaagtgtcatgactcatgagccagccttatgtgttgccgtattagcgcgggtgggctgtttgggcgggtagatcttctgaacttgtgggctaagcccagcgcagtgtggttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11043 - DNA, 3049 bp, Oryza sativa
atagttatatccgagctaggtgtgtccttatcatcctccccttcttgattagaaaccgtcctcagtttacctttgtcatggagagtattgcactaatctttggctatcacaatatcatgtgctgaacattttcttgatgtccatatgattggatcctaaaattctttgtagtcgaaaaactacaacactcccttttttgcaaaccaacctgtaactcatttaaataactagaggaactagatagttaattacttatatgcatgcggtcctctagacaagacatttcatcatgaaaaggaagtatagttaaattcgaacaaatatataattgatgcacattatattctcctttactatcataattgccaataatatgaaaaatcacatcagaagggcatggcaattcaaatctagcaaataatttcttctctaaatagttgagtggacaaaaatcatcaaattgaatagaaccccaagtatttaaagaatatagcaatttaagctattcattctcgctagcaatgtgaataacatgtttaaactcaacactgggtggctctactatagaactaacatgttcattcactagttgtgccatggatataagtgtagcatcacacaactcttctttatcacaagagacatcaagcaatttgttttgtgacaaaggtatttcaacaattgtttccactatgggttgctctaacttagcacaagtagtggacatagttggcacattataactatgcataccttgagcacttgtagcaccattatctttaccttttttctcatcttcagaaattgtaggcacttggtcaattaaacattcctcaagcatgcgtggagctatgtataggtttttttcctcttcgtctttcttctcttcctcattacctttgttgttctcagatgcctgcaaaatattagtatccaaagcaatatgcacaataatacgttcgttttgtaataactcagacttagttgaaggcatcacaatagtatctttcctggtatctctgaaagtctcattgattctattcttcaacctttcaagatcatctttgaaaatttcagaaaagcttattggttccaatttcatttttcgaccattatgtctaaatgtgtatgtattagcaacaaaattatgcaaaccattattatcatatacccatagtttaccaaacaacaaagaacatgcttgcatagggacaagatcaaaatttgcaatatcatggtaacttccaatcgaaaattttattctcacaattctatttaccttgaacttaccacaagagttgaaccatttgatgtaatatggatgaggatgcggttgtgtaagcaactcaagtttctcaaccaaatctgaactcacaaagttattgcaactctcactatcgattatagtacgacatgctcaatccttaaccgcaaactttatttcaaataattcgtggtactgccattgctccgctttctccatttgagaacatagcacttgttgcaccaaagtactgtcatcatgtgcaccttgttggtatcgctgattttgagcgccactcatacctgtcattgcaaacacaaaaacaacagcaaacaataaaggttatccctaataatctgctacgcggtgtagtggtgcccctcaacaacttagccaaatggagcaccttaccaagctcttacaagtatcttaccagcaatgctaaggacggtacaatcggtggttggttcgtgacaccatgaaggacatgatgtggcgattgcaaggatcaaagcggtgctgaccagaagtatatatgtgtagcttggaaggcacaatatatagtagcaaaggaacgcaaatgtgctaatcagaaaatgcaaagttgaataatagttcaaagtactagtcaatgtgttggcctagtctagactcaactcttgctcaagcaagcacccgacaacactaaggactagatatgaatcaatgcacaactctgcactctgaaaacatactcaaaggatgaatggttttttttctttcttggtgcggcttttctttaagcacgtttctgcaattttttttcttttctttttaggtgcggctttttttttctttctttttctttgcacctttctgccttttctttcttttttatttttttactttttttttcaacaagaactgaaccactaacctcgaacaaggactcaaatgtaaatatgaatattacagggactcaaatgcaaagaacaaaactaatattggatcacctcaaaaaaggattgctcatatcatgtaggttcagtttttataaaaacatctcaaatccgatacaacaaatatatgatatagggaaaacactcgatactcggtccggaggtggagagatcggtacggaggagggggaggtggagagatcggtacggtggagggtgggaacggcctcggtcaagtggaagagagaggtggactgtgtagtggctggtcaaggtggagatggactcttctatgggccttgatgtgaaacgtacggtggcccaagaaaaaaaacaaaccgttcttttcttatgcaaacatatatatatgcataaccggccgggataattcagaattaatagaatttcttttcaaaaagaaaaggatcaaacgggtttaatataaagacctggtaggagggtgggatggaatgatcggtgcttacctttgatggacggtggattagagcgggagtacaaacacctgggtgtacagattcattttcatatatatatatatatatatatatatatacatatatatacatatatatatatatatatatacatatatatacatatatatctatatatgcaaataggatatatactgaaattttcggaggaagctcgtcgcccccgcgcaggtgacacggggggcgaaacactagccgccaccgccgccttccttctccccctctacctcaccttgccgccggcaaaactggctgacgagctatgacggttgcggtgggaccttctcgcggtgacgcctctcctttgcgcgcgggcgggggggggggggggg

SEQ ID NO: 11044 - DNA, 7141 bp, Oryza sativa
ggggtctcccaggctggccggcgacagatctggccccgccgtcaccggacctacgacggcgacgtcgggaggcacgatgtggaggcgattaggcggcggaggttgttgcggcgcggggcagcgtggtggtggcggcccgcggggtggccggcggtggctggcgctcgcggcaggtcggcgtccggggcggcgcattggcctgcctacagctgcgccggctgtctccgtcagtcggtgggattgggtcctgccggggggtcgcgtcggcgactccgaccgctccagtcgctggcagccaccatgttatctccttccttccctactctttcttcctctttcaaccgtctcggcacaagcagtagggggtggccgccccccattttcttccttcttacagttgctatgttgctcaccccggtgctcctctctctgcgctggtggtgaagttggaggtggttgccacagttgttttggattgtcccacgaagcccgaagatcctcgctggaaacatggatgacaccgatgtctttgttgcccttgctgccagttctcagtttcaccttcagaccggccaggcctcctcccctccttgatgctcctcccttctcttggtcgcctgctcccagaccggccgtggagtcttttggtggttgagtttttttcgtccgtgttggtggtctagtctgttggtagtaagggcgcttgggcctcgccgatgcttcacgtgccctgtggctatgtaaacctgtagttgtgccgagtgtggagcgatgtgcttaccccctacggtgttagagtttttgtgttaaagtggagttggagctgtcatcgggttcagccgatgagctaggcaacgataacactcaacactcttgctctagcttcttagaggtcctgtacttcttgagggagtcttgggcgacagccctgcctggtcttctaggatcggtgacatcgatgcctatgggtgtcgtttcctcattggaggtgttgccttgtggactctctccacttcgggtgaaaacccagtccagttttgggcgggcgttggcagcggcttctgtcattgttcacctccttggaggctacgccttgaaggccttgctcttctctggatcacttctgtgggtctagtcgttttgtcacaggttttttgtgtcttttgtgtaaggttttgccagtttccctttagcaaactgtgcagctgtacggttttcgggccctattttccttataaacagggtcaattctcttctaatatatccggtagatctcctaccgtcttatgtttcaaaaaaaatatatatgcaaatgcatatgtatatgtacaaaatacacatatatgtattagacacgtataatttaaagcacttaacattttatgtgtgtcagggttacggataaggtataccctctatccttggatatacgtcatgtactggtatggtatacctgcgcgtatacggacgttctctgtacatgttaaggaaattcatcatggagtccacagatggaaggagtcctactcggatagaactgggtcgtcactgtatcgtgtagggtccgatgtctccgagttctacttggagaccaactgacctgcggtataagagggaccccccgggaggatctaaggcatcgaatctcaccgccaacacaaccaccacagcctacaaagtcggagccttcaggagcctagtcatcggggtgatctaatcgaaccaactcgactgcggtctcgtcggtatcatagagttctgctattccctttataatctgtggttttcactatataatctaatatcaactggattagggctattacctatcaaggggcctgaaccagtataatccttgtttcctatttgcttgatgtcgtactacgtagatcctcgtaccagcgtaccctaataccctctatatccggtctacgggtatctcccatcgacagtggcgcgccaggtagagacaaacgaccatgtaagacctggtcatgtaatagttctcgccgtgtgtattaaccaagccatgtaatcggaaattgagttttccaccttcacggctgggggctagggtcagtgcttttttcaaccaaggcaggtcaagggtccaagagccttatcctccgagaacgattctccgacgacaaggccgggggctagggagagtgtatgactcaacaaactgactgatcgaagtcggtaaaagagaagacgctcatatacaaaacattggtttgtaaatttaatttattttcagttttccatacatattataacatgtcaccctttgagcgttcactcgggggctatttctatctaatattcttttctgagtattgatttcaggaaaattctatttggcattatcgaagactccatgtctctatggttctataccaagatcggctaaggcgagtacgacaaatgttgacaaggctccgtcgcagattctgcgctttctcgatcactcgagaacggttggtgggtctcgacaaggaatacggaatgaagagatggtgtacccgccgagataaaatttcttgacttcaatccaaattctcgattacagcaagacgggagacttagttgtatgctctgtactttcttggttgacatcggagattgactcaaacaaaccctataggtgcccacatgaggctgataagggaagtctaacgttatctctgaactcaccgagaatggtcacgtgagctcgataacagttactccaaggtctgcggttgagaatatgaatttgttcatttgcattgaagtcgggggctactatcagggttttggataccacatacctaatagttgttgactaaatctcggtaggacccaccacataccatgtcctatacggaaacaacctgcggatataggaggagttccggataagggaagacaaccagagttctacatggaaacgacaaggactactcggattgtatccatattggtttccctagttctacttggacaaggggacacctatgagtataaatacaagaccccctaggaggagaggagacacggaacaacagaagccacaacatacaagccaacatacgccaagacaagacgccggatatcgacttcagagataggcacggctagtcccctacggtgcctacggataccgtcaggagagatatagcgctgtctctaatctcgccggatgcggattcgaggaggaaggctaccctgttgtcgactacgagtcagaccttcagaccgccatatcgactacagttagataggctaccccaaatattatactggtgtgattatgatgaataggagcaacgaccggctttggccaacaggatgtagggttattacttgacaattcaggggcctgaacttgtataaaaatccgcgtctccatctcttttactacaatctcgcatatatcctagtaccaacgatccccatactatgcaaataccggaatcgcgacatcaaacgtcgacaatgtgcatatatgaccaaaatatatatttacgctaaagtaaatgtgtacatatataaatatagacatgtattacaattcattacgtgctctagctacggcttcgacatcggtgttatctcagaagaagaaggaatgatcttatgaattgctgatctgtcgtagtagaattcaccctcgggatcaaggacttgttcattgatgaatcccatcagttgttcttgaacagccgcgataaattccttgtgtgttaggttgtctctcatgtgaataacctatgaatgtatgaaattaattaataaacaagaaatcgatacgtacgcaatgaaattttgaatggtttatacgtacatcgggctctcttgtggtgtagatttgggttgaaaggcagtgggcatactcgcatacgtagtagccgcacaagttagttccctggctctgctttgcacaatatacatagcaaacgacgagagatttaataaacacttatatttgaattagagattcgatataattttggagcatgtactcactggaaaattgaacctccggctaagtttttctttccaagaaccgcagaccaattgacggaactgatcctaagccctacatggagtttcaagctatgattaattactattcgagatccccatagtagcaatagcaaaattcgtaataacagtggaacagatgatatcacctgtctataagttcaaaaacttggtcaaaagtagactcatctttattcattgagtcatagacattgactctgctagcctccaagtcgaaaagtaaaaggacccggtggaatatgcaatttgcgtgagatgatatatgaaactatacatgtatgtacgggaacgaaatttgttcggaagatagtaaaaactaactctgtgttgtacggcagtagtatgaatgtcttgaaatgctgctccttcaggagatggacaagagtgtcctctgtgtttttcggatacatgatcatttcgatgttaactttccgagggtcgatgaatccagtatcgaaatccccccgccatcgggccctttgaatctcaattctacaatgagaaaatgaattattatggtgtacatatatacaaagagctaattaaggagtgtaataaatctaactcaacaatacttacaaaatccatgcgcttagaagagagatgtcgaacgggatccagagaacatcttctccttgcaggaagttggacgttctgatcctcgttccgatcacctctctaccgttggcaatcatttccatttactgttcatggaatcggtacatatgtgtcagtagggactttagctgctcaggcttgacaagcggtttaccgagttcgaactagtatttcacttccaccgttgggattgatgcgcctttaagcaactgagtcctagttagtccggtgtcagaaatgaattcttttattccaatttcttgcccggtcaccaacggctcgacctcctggtttggttgctcgccaagctgagggactggtttggacttcctataatatgccttcttaagtgttcgctcgtagtctattagctttaagacctccttgactagtttcaacattttcttgaagaagttcttgacacttgggtctacaggtatcttcttttctggactccgaggttttaattgcctcttcacttctgctgccacataagcgtctagctcctcttgtgtgcaatcatacggcggctccttgttttcggcggcatcaactttcgccttctgcgttgccgttgtgcaggcaggcggtggagcttggcgagaccttgacttggaaggtgccagaggacacggtgcacgagccaaaggagacggtgcaggagcctgaggaggagacggtgcacgaggcgaagaaggcggagaagatggcagagccgaaggagatggtgcaggagacgtcgcttgtttcccaagaaggatgatgtagcacttgcgccatagtataatggtttggcttgtgtctcgtagatgcatatcaccgtctccttcaaggtagtccaacttgaggtcctcgtacgcggcttccaccagctcaacttcgaccctcgagtatcttggtggaatcggcctgcagtgttaagtccctgaagggtccgttgggatggccattcccgacgccaccttcacgtgatgagaggttatcttctattagtaatcaacctaagtagcaacttgcggaatgtacatgtcaaaaatcataaaactatgagcataccttgattgataagttcttgaagggaatatacagctcacatggtgtccgctacgtgatttcatcaatggggcaggtggtttcgtcctgagtttgcatggcgtccatgctctgtgatcctacctgccccgttgaggcacagctactacgattgcctgaggggctgaccatgataggaggaatgtatggctggggatcctggctccgatatgcggccatgcgttcatccacctttcttgccacctcctcttgcatgctaagctcgtagttcgataccttgtactcaagatctgcaatttttgcctcagtatttctcttgctcctcatccgactcctgtacgtatggatgtcctccatgaatccaatcttccaaggaaccacgcctttccctcgtgttcgtcctggatgctcgagagtctgtagggcgagtgtcagctcatccttctctctgtcgggtcggaatgtgccctgagaagaggcttccactgcgtccgttagtcgactggcagcctcacgtatctgattgctgaacaccagggagccatcaacaggtttgagctttccaccgtgagcatagaaccataactttgatcgatcgggccatttagaagtggccagttcgatacccctctcaatcaagccggcttccatctcctcccacttcggcattgcgacgctatagccgcctgacccaggtggtgatggtacttcttcttagcggcattttctttgtttcggtccatcagcgcttgcccttgtttccctgtcttgtaagcaacaaactcatcccaatgatcccttagcttcgagaatatgttgaagttcggtgtctgcccctttaggatgtatttatggtagagatctcccttgaagctctagaactgttctgccattttgctaagagtccactgtttcactatgttctccgtacccgcagggagcgtgaatgtctcgagcattgtggtccacagcatctctttctctgaatccacgacaaagcgtcataatccctgcgtgcccttgttctgcgctagtacactttgctaataggcacgttatcccttacaacccaacagctgtgtcgtacgtaattcctggctacatctgacgtggcacttcagttatgatgtgccgactctctatcttcttcacggcacctcgttttcggcatgccctcttctgtccagcggagggttgacttccactagcctcctcctccttggtttattagagaatctgtacgagcgccaccaacggatgcccaaaaggaataagttcactttgactcccttaataattagtgtccaaatctgattcctatccctaaaccataataccatatatcacgacccctaactattgaaaccggaataatttgactctttcaacggttttggagagcggtttcgctgacatgacg

SEQ ID NO: 11045 - DNA, 10014 bp, Oryza sativa
actaaagatgaactttagtcccggttggagttaccaaccgggaataaagatgatttttagtcccggttggtaacaacaaccggtactaaagatctttctcttataaaccgggactaaaaatgatttttagtcccggtttttaatggaaccgggactattgtggatttgggtcgaccgaccaaagatggtttctctactagtggtagaggagttgataaggaagaagacatgggcattctcttacagaaattttagaaaatgcaatgaaacggtaagtagtgacatattttgaataaccgtagtattgtaatggcataagttcaaatagttaaataataacggtatttctcaaaatcgtggatgacaagctagctcatatatataggctgcttgagctgactcaagcttgaagggcagcttggattggcgcattgagagctcgatcgagcaagctcgttgcagctcgtgagctagtgttcctccatcacttgcacactgtatatattcatcctcctactcctccgtggcgatcggcagaggcaagcgagtggtgcggcagttggcaagcgtgacgaggggtgtgcagcgagggcagtgcagcagccacggcggccggcgagtgcccgatgagcgcattgagctggcaaccacgatgaggggatcggagcactactacagaaggcctaaatggtgccggttgagaaaccccctaaggtgccggttccacctttgaggcgccgatgagcctaaaaaaaatcggctcgatgcatcgagccgataaattgagccatcaagccaatcccatctaatacccaaatcccaacatttcgtcaaatccataaacacatgctatagtcaataatcctcagaaaaacaacacatcaagaacacatccatcaagaatacaacaagaagaatacattcatcaagaaccggatggagaggaggagggcgccactgccttctccaccgccacagacgtctccactgccaccgccgtcgtcggatggagaggaggagggcgccgctgtcttctccaccaccaccactaccactgtcgcgggaagccgctgtcgccacctcccgggctatcggaccaccgccgcctcccctcccatcgccaagccgccacagccacctcccctcccgccagatctggcggaggggagggcgccgccgctgggccatcggaccaccgccgcctccgctcccgccgtcgagccgccgcagagccaccgccgccacctcctctcccgccagatctagtggaggggagggcgccgccgccacctcccgggccgtcggaccaccgccgcctcccctcccgctgccgcacgacgttgcagcagccgcctctgggtcgccgcaattcggtcgagggagagagagaaagagagccgggtgaggtggagaaagacagagctaagagagaaagagaggggtatggataaggataaaatgaggggaggagaggataagatgtggaggttggttcggctcggctcggctcaaattttggggtaaaaaccgccacctataatttattataggtgttcatttttaattaaccagcacatataacatattaaaggttccggtttttataaaaaaacggcacctatagaataggtggcggttcttatttggaaccggaacctataattgtttaaaggtaccagttttttgtgaatgcaacccgcggaggtgacgaaaaggtctataagtatcggttttagcatttccggcacctatagtgccgacacctatttgatgttttatagtagtggagggtggctgctggcgagcatgatgaaaggagatgcagccagcaagcgtgatgagaggagggtgacggctgatcatgacggggaaacaagtgcgatggtcatgggtggctggataccttgcgtacactagtagagaaacgattttttcatgcggttaaaagtgattttcgtatgcggatcttccaaccgtctggaatgaagtatctgtaaaaatcgctatttttgtgtgtgggtggcgcacccacaagcgaaaatcagatttttcgcgtgcggggtggttatgtcgcccgcaggaaaaaaataaaaagccaaaaaaaaattaaaatccaaaaaaaaacccctaaccctaaagctgccgccgccgccctcctcacggtcgtcatcgtcgtcgtcgccgtcgccgtctgagcccgcccacccgtcgccacctccacgggatccaggtgggggacggccgctaccgccagatccggtcggggggcagccgcctccaccagatccgggtggggggcggtcgtccgccgtcgtgcgcccgctactcccgccttccaccgagcccgtcgctcccagtcaccaccaagcccgccgttcccgcccaccgctctccatcgcctagcaccgctgcgtgcccgtcgccgagccgcgcggtgccaccggccgcaccggagattgagagagagagagagagtaagagaggatagtgaggtgagagggtgagagaggatagagaggtcagagggtgagagagatagaaatgataaggataaggatgaggatgagtgcatgagatgaaattttgaagtgttgaggagggaaaaagaagaggatggatagacttgtaggtaagtgtttaagaggtccgcacgtgaaaatctgcttatttttgcgtgtgaacccttaagaggcccgtatgccaaaatcgattttcgtgtacgagcctcttaagggtccgcacacgaaaatgggaggccgattttttgcgtgtggatgtgaaaacagtccgtctgtaaactaaatagcttatcgtccaggaaaattgtttctacactagtggtagtcgctgtgctgggagaagtgcgatggcggggcgactgttgtgcaagaagttcatgagattgggatgcggctgatgacgctgatctctggtcattagaatataaggattagggagttagggactatggattggggtggattttggagtacgtttttagggcttagtagagaattggacggccactaattggcgcgcacacgcgtcagctggcggtttcacgtggttttttctctattattttcgctttttcttttttttcatctttttcttttttttccttttttcctattttcttttgtgtttttccccattttttttaattattatgacacgtgttttcaaaaatatttgagttgaaagtttttaaatcttaacttgaaagtttttcaatctgaagaaaatttcaaatctagagttgaaggttttctattcttgagttgaatgttttcaaatctcgagtccaaaatttttaaatctggacttaaaaattatctcaagttgaaagttttcaaatctcgacttgaaaattttcaaatctgaacttgaaaattttcaatctcaagttgaatgttttcaaatctcaaattgaatgtttttaaatctcgagttaaaatttttcaaatctaaattgaaagttttcaaaatttttcttacaaatttaaatttcgagttgaaaatttttaaattttgagtttcaagttttcaaaatttgaattcaaagtttaaatgttaagtcaaaaaatttcaatcaattagtaaaagaaaatcttccgaaaaaaagaataatcttatcttaattaccgtcattacctaaaactaattcagttagttaggagtttaatacagttagttaggcgctccgggaacacgtgccaccaacacgcgcgcccagttgctgccaagtgggttgctggcctactgattgttgagctcgcaagccaactcaaactggctgcctggcccgttatggaacacgagcataaatgatatcttgcctcgttaaagaaaatgctacgagttgagtcaagctgagatgacctagccatagaccgtattaacgataagcttttcatccatccatagttgggagggctcgggggttcgtgttcttttacacgaggggacttgcctttcttattttacattatattattgttactttcattgacagtatatgtgatgttcctagtgcattgtatttgacagatcgatcaaattgacagcattccaatatactaactaaaatatatttaaaattaacggaaaaaaactgaaactgcagcaaaatcttcacaagcgggcagaatcctttggtgactggccttacattgttggctgaaaagctttttcataggcgggttatcgcccgcctgtgtaaatggttcatttgttttcatatgcctttagttaagagatttgttccgatccaataaaaagtaactcgtcatacttacggtatcaaatcatttttgattgttagatggcagggtaagatgggtattgttagatccaacgatcgaaaactatttggtaccgtgaggtaccggtacctcgaaatactttctgatcgttggatctaactggacaaaatgagcattgttagatgcaataatcgaaaactatttgataatgtgggatatcggtatctcgagatacttgtttttaagatgggatcaaatctcttagttacatgtggtacatcgaaccgcatgtaaaacccattttcaaactgcatcaagaaaatagttttccgtagtgttgtgctaactgctaattatccaactgatttcacgcaggtttgtggaacagacaaggagatagatcgtgacctgtggtggtggccattgtgtgcgtgacggcaggagcaccaacgtcgacgacctcgaccatcctcacagcagtacgtgagctcgtgaggcaccaccgtccttacccgcgaacgacgcccgggcacagtgttatgacgaatgagtacgagttggatacagaggaagacacagtgttatgcttccttccccttgttttttatatatagggtgtgtttagttggggaaaagaaaatttttaggtgtcacatcgaacgtttgaccggatgtcggaaggagtttcggatatgaatgaaaatactaattttagaactcgcctggaaaccgcgagacgaatcttttaagactaattaagccatcattagcacatgtgggttactgtagcacttatggctaatcacggactaattaggcttaaaagattcgtctcgcgatttcccccataactgtgcaattagttttttttatctatatttaatgctttatgcatgtgtccaaatattcgatgtgatgtttttgggaaaattttttagggaactaaacgagcccataatatgttcacagacacagtaagtacggaggatgtaattaatgtgttgcccattgtatttcagacagccaccaaccacgagcacagaaaaccatgggcgtagggcatagtagggtagtagtggtttagtactacccagttttagcctctgtaccccttacatgtttgtgtcaaaatttggctaatagttagtttcatttgagaaggccaaattgtttagaataaccggtgcattttgagtgatttgcttgagaggtcaattgagattgtgtgtgcaggaatttgtgatgcatggagagatcgtgtgtacaaaatgatgggtggccgtagcatttcatctggtttggagatggagagcagagcagcactgcatacctatgcagagtgccgtgtagtgcatgcagcgatagatggagcttggtttcttgtgtctttagccggatcgtattggtgcttgatttctgcaatcatatggaggcatggcttctgatcacatgctgtgtggatttgctggtggaatatgcgaacggaagggcgtgtgcagatggacgctggagatcgatcgctcggctgcattgcatctggctgcgcagggtgccgtattgcggtgatctagactatggaagatatggaagatagagatattttggtagttaatttatttagattaaatcgtattaggcctggtttagttttcaaatttttttctaaaaacaccacgtcaaatctttagacacatacatagagtattaaatatagattaaaaaaactaattgcacagttagggagaaatcgtgagaagaatcttttgagcctaattagtccataattagccataagtgcaatagtaacccacatgtgctaatgacggattaattaggctaaaaagattcgtctcgcgcgtggtttacaggcgagttatgaaattagtttttttattcgtgttcgaaaactcttcccgagatccgatcaaacatccgatgtgacaccaaaaaattttttttcacgaactaaacaggccctagttaacttgctagagtttccatgtacgtagggcttgtaggtccggtgcttaggtctccctatatataccggggtattagatcagattgaagaccccaacaatttaatctattaatttcatgttctttactttaccgttactttttattttatttttatggctaagttctagcaaccctaaaatttagttaatctttgccttttgcgttgaaaaacggttgtgctcctccacgaaagcgagaaggttatcctttactagtttgctcggaaactactcattcgtcgtcacgtaagtacgatgttatcttctttactaatttgctcgtaaattagtcgtttgattccaaaatataaggatttttagacccagacacagtcttcgagatgttactttaaccaacaatatatataaaaataaaatattttaaataaaaagagttgcatattataatagtttgattaatgataaatctagtaacatcaattttacatgattgatcctttaattttttttactgttaatagtcaaagttaaaaataattggcttggcactatactaaagaaacctatattatattttagaacggagggagcagtggtttaggactaaaccagttttagccccaataccccttacacttcttcttctcgtcagtgtgagtggtactataatttaactgatagatatggaggggacttcaactcgcctgaacatagcatagacctgtctgacgatagacactgtagtctataggagatcgacggattgagatcaagtgcggttgctattgtaactgcacaatagtaactgcacataattatggccattcgttttcagatccaacggctctagataactgctacagtgtgagcataacagtgcatccatgctacagtatttttgctacagtaccacttcatctcctgactctagatcatgtgatgttgtgatgcacatgtaactgcttaagttacggttataataacgtataacgactgcacaggatcctgatccgagatcgacagacacactggccagctcgtgacgatatacacaggaactttttgacatgagcatgttcagaggatgacgcattgacgctctgtctacgggaggagaccgttcgcacgttttacggcctgtttatgtcttgaacgaaaatttttgactttgtcgcatcgaatatatgaacatatatatttaaaatattagatgtagactaataacaaaataaattacagattttatatagaaactgcgagataaatttattaagtctaattaatccattattaacaaatatttactgtagcaccatattatcaaatcatggcacaattagacttaaaagattcgtctcgcaatttacacacaatctatataattagtttttttatatatttaatactccatacatgtgcctaagcattcgatgtaacagggtgaaaaatttttgtctgggaactaaacagggccttagccgtgatgaatctaaaaagcaaataagcacttatcaggaatttatatctaaaccttactatattttatatgaatgttttcaccgtccagcatggaaggatggtactaaattaatatggaccgtcgatacaagatgatcgaacggctgcctaagaatcaagtacttggcggtaccggcacacataccgtctagtacaaaccctcttgagggcaaaattgtactttcttgtttattctcacagaagccacatcctgttgaatatataagcacatgatgatttaatttattccataaataaatcaagacattgcatagataaactagtataatcgcatcatacaatctacacttgtaaactagacagtaaaccataaacagatcgtatatgcgaaacacatttaatgtgcaccgagggttttgaaagatcggctgcacaacaggaataagttgcggtaccgggcatatacgacagcacgcagcactcgagctaagtggaagatgagctgttatggactaatagcaagcagtcgcgcaaagcgcttcccaaaaaccttattgtcgccttctcccagtgcaggacgtcgaaggcgaagattccggtgacctactctcccgatggccggtgagcaggatggagtagactatgagcgacggcgcactacagaggaggagacaaaccctatattgatttcgtgtgtattgcttggatgcagcggctcgctttatatagagatattacaacgcttgatcagggcgccttcaagatctacaccccacgtaaccgaaccggataagtcatgtctaatttatccggactccacgcggctccacgcaccggattattcggtgtgtttccaaaaaacaaaccgaatttcctgcaacaaaacaaaactgcaaaaggagaccgcatctacgcaagggtgaggaacaaattaattttgaccaacaattcgacgtgtatgtcgttgttgatgtgaaaacacgacggcctgagagatctgcttaactctagtgcaggtccacggctagcctcgagtgtgtcaagggtgtgccagctgatttgattctgtaatcagcaagaaagacaaaagtagagttagtcagccgatagccgactggccgataggccgatagggtatcgttggtggtctcagccaaagttaggcccaccaagcccaagtcataccatatcgatagtatcggccatcggcttcatcgaccttgatcaactcatactctatgtatagccgatacggtgtccagccgatgcgcaatctgactccaaattcaactcgattccacaccagatcctcgtcgatcttcttccttcttctccgaacctgacgcaaattccattgttaacagtcgtgtacgtgcctcgcctcgccttgccaggagagggagcacacgcgtgtgctcctcttgttctctccaccagacatgcctcaagtagctaggagagcatcctcccttataagaaggtctccctctcctagaataggcaaggttgtactaaactccccatgcatgccatcccatgaggtgggcttttgtgattttcaaagaattaatcttcgaatgggctaaggcccatccactaattccaacaatcccccactaaatatcaaaatcccactgggatttgccttattccaatgtaccgcttatataccagcagttcaatggagatggattaaggttgaacatctacctacaactccaagctacacttactcacaacttgaacaatggactacaccttgaattgcaagtcttgtgcaagtaagtttcactcagagtcttatctggtactacaacgtgagtagactaccctcgggtgtagcgtataggtcatactcctttgtctcatagtaagcttcctagaagattcacccaaaatatccgtagactgcgaccaacagtcaaggtcaaaaaggtgcgttctttcaagaatggtttgtaggatagtatcttcgctaattaaaggcaatagaactcattaaggcatagccaacctgccttgtaactcatgagagtacatgcatcttcacttagagaaggtttagattgatagtctcctctacttaactaatggcttattcttcctaggttctaattcacgggatctccgatgacatagattgggttaccgccatagcataactcacttgggtctcaagcccatctcctttgatacactatctatcacatttcatgatagtccattcgtgaaggaatctgccagggttttagctgtttggatataattcaatgttataatctcggagt

SEQ ID NO: 11046 - DNA, 514 bp, Oryza sativa
cattagcgcgtgattaattaagtattagctaatttctttttcaaaaatagatcaatatgattttcttaagcaactttcgtatataaacttttttgcaaaaaaaacacaccgtttagcagtttgggaagcgtgcacatggaaaatgaggcagatggagctgggaacttgattcgaacacactagcgaagggtggcccgatcttcacgacagtaggtagaaaccaatgataacttgctgtagaaacagtgggtaactagctttatacctgccaaggttggatgcgaccaagcgacggggagagagacaccgaaaccgtgaggacttcgactcgatctccgaacgaccgcaaaaccacaatccggtatatcctcacaatacggtgcagctgaactggaagccgtagagcacgaactaggggccctcaaagagatcttcctcacaagtccaagaagaactcgcaagaacaaaggggtgtaagatactcaagcagctcggctgcaaaaacgggggatcc

SEQ ID NO: 11047 - DNA, 1374 bp, Oryza sativa
ctgtgtgatttaaaacttttaaaaattgtaagtatcacatataactagcatatacatgatttaaacttgttgaaacctctaataatcgtgttgtaattaacatatgccatacatttttatatggataatcaatacatccaaaatagtttacatcgtgtacacaataattacggcattacatcggcagtgacggttgaccgcacgtactttctcctcactattgttccctccttgtgatcgctgcgtgagtaaggggtgtcttcatttgataggaggatgctagggtcaatcatcaccgtgaaagggggttgcccatccaactgatcgtaatcctcatcagtcttgtcctcaactccgacgatttttcttttgcctgggagaaccacttgacgcttaggctcatcaggccctctgtccttctttcctttgctagacatgtccttcacgaaaaagacttgcgttacatcattggcaagggcaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacatggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgtcgtgtaatccatgcatcggatttaccgatgttcctggcgcgaactagaaccaagtgctcctcgatgtaaggagctaccaatgaagagtgttgcagaacagtgaaatgggctttacggaataaattgttgtctaccgtcattattgctttccttcggagagtctacagtagtctcccttcatggcgtgattcaggtaccccgattgggcgaaggtcttcgataaattctacgcaaaattcgatgacctcatctgttccataacccttgtcgatgcttgcctctggaacgagctcggttacgaacacacttcttcagaacgccccatgttcctctcgaaaggaaacatgttgtgtaggtacataggcccgacaatacggatctctttcacaaggtgacaaagcagatgcgtcattatattgaaaaatgaaggtggaaatatcaactcaaaactgacgagacattgcaccacttcattctgaagggcttctaatctatccg

SEQ ID NO: 11048 - DNA, 1348 bp, Oryza sativa
cccatagggtgttcaaccaggattccttttggtggagggatatcattaatctctctgtttttttagggtgattgcaaggtgtgatttactctatgggacgaccactctcttttgggatgatacgtggaatggtcatataaggagtaattcatatccaagtctatgtactcatgctattaacaaagtttagtcagtggttgtcacttgttcgaaactcatgaggcttatatggaattcctacagctcagagcggaacttgatagtttaactttgtcccatcagcaaggggataattggagcttcattcggaagcgcaacctacacctcaaaatgcttttacatgctgaactttgctttcatgcaaccttcaagaccttttcactggagatggaaaacaagatgtgtgatgaagaacaaagtctttatttggttgcttttcagtgataggctgaatacaagggacatgctggatagaaaaaaatgtgctcctctgaatgctgatcttatatgttttctctcttctttgcagcatagggaaacctttatttatctctttttttcaatgccctttcagtaagagatgttggcataagcttggaatatcatggaatacctctttggaattctttcggatgttggtcttggcaagattgaggtttaggcataagggtttcttggaaatttgcttcatagcatgttggcatatttgcaagcaatgcaatgggaagatttttcagaatatttgtcgatgttttagatcacgactaaggtatttgcatggtatggggatcattggtaccagagtatgtgtaagattgaggtaaaagagacggaaacaaggactttaatacaggttcgggccccttattcatcagaatcaggtaatagccctactcctgttggctgaagccggtgttgctctttttcatcagaatctacaagtacaatatttgggataacctatctaatcgttgtcgacttggcagcatggaacaccaatatgtagttgacgacggggtagttttcctccttaaatacgcactcggcgagatcagagatagcgctagatccctcttgtcagcctctaatggcaccaaattgggtatgtgttgatggtccttaaattataatatctgaccgtcaatacctgcatataatggaataaaatatcgtattcaacttagtggtagagtttattactaatcatttccactagtgatggtatatattcggatggcacctgacaaactaacatagttcagaggaaatatgcatgaaaactgacgataactcaaacacatctccaaacttatggagttttggaccccaaaacccaattaaacacctc

SEQ ID NO: 11049 - DNA, 6476 bp, Oryza sativa
tgttatttaattactttgtctaagtaagatagattttcatctttgtgggttcattgcttagtattcatactaagtgctctaatactagtgtaggatcgaatcacaagaactaagccaaccagaggggggggtgaatggttgatatacccaaaaaccaaaacttttagcggaaataaaagttaccctcaaattcgatggatcgtggactgactgaaggtgttgcgccggtctgaccgcttgatgaacatcggtctgaccgatataaatcgatcggtcaacccgccgagattgcctgctgccgtctgaaaccgccgccggtttgaccgctcttatgccgccggtctgacctccgccttgccgtcgatctgaccgccggtatatcgctggttagaccgccgaacccgaagaaacacaaatcgaagaactctcaaagtagatgacaactttattgcttctctttgtgtttacaaagtgcaccaacagcactcgttacaaaaatctcaagtaaactcgaaaccctagctaaactagcaactcaattgctctcaaaagcgataccgggaagcctcacgctccccctctatttatacatgaggtaggcagcctaaagccacgaaccaaactcatactaagagtcctaaacaccttaggaaaccctctagtacaaggaagaaactttacataatcaatcgtaccaaatttggactccttccaaattcgactccgcatcccatactcacacaatacctccatcgtatgccatatggaatcttcaccaaccacgtgcatcaactctagccttagtatcccgcatgatatctgaccaccacggacatcgtcttaccaccaagccgactcccgatccatcaccgcaaatactctcccgaggcattgagtcacctacacatgaaacaaacaaagaaaccatattccgagaccaagctatccccaacttgagtcattagtagcaaataacagtattacatacgtatagtatccatctcgaagccataaccatgaaacaatcacggatatccaaagaaacaacccgaaaccgataccaacacagcgtcggccggtcagaccgcgggcctggccggtctgaccgctcaacacaagccggtctgaccggcaacctccgcccggtctgaccggtcccaacaaaaccgagaaaacagttatatccagaaccacttcgacagtaatctccaaatatcaaaaccaataatcatagatgccgattgttcatcacagaataagaatcaaaacacactttgatcttacaactagcactttggataaagaaggaagttcctgtacaagtattagagtagtaattaataacttagacgtgatgtctaggttagagattacctctgtttgttgtgtatcccacagatttgtcagaggtagacggtaggtggtgacagccctgaatcccgtcctagtaatcctccgcgttcagatacatcatagagatatagccggaaccatgctagcagactagcaggggtcggtacccgaagcaatagataggaaattacctttaacttatcttggataattaaaacaaatagaaagtcctctctagcctaaccagcctacctatagttgttgaccttggatagtcttagccttaggtagattacacgcgttccctgagttcgatatacttttggggtcacccgaagatgatgtgctacatcagtattccatcgcttgcagatttatctgtggtcgtaagaaataccaacagtatgtctaggctaatcttttatgatgatatctggcggcttgtattgttgtatattttgactgagcctgttgattaggcttgtcctcctattaacattgaaatttggtaagtccctaagagaattatcacaccgccaatagtcggattcttgctatattcggtgaatgaaattaatctattaaaggaagcttatccagaagtgaccgagttcaatgaggatgcggcatggcaaattatcatggcaaattatccctataagaactttatgttttccttttatctttaggaaagtttcttttttgtcctaaaagaactagtatctccccatgggtataaatatgtacacccggggtcattataatttagctctcgatcaataatactctcggcgcatcgccaccctcttttctgaggtttttacttatcaaccgacgaaatttggcacctgacgcggggctgcatctgttcagttcgatctccggcgaatgggtaactcctacgttccgccggtgcaggcaattgtcttgtttacgttggtgtcgtttaaggctgcatcagtacattcgacctcttggattgctccggtttggatgatatatttgtctgcctatttatcatatgtcttagttagtctaggcttagtatctcaatttagctctatcgattgtctctcgctttagggtttctgtcggtatcggctaaattgttttacaagattagattagctaaggcatctaccaccctaaaaatcagtcaagggcttaattttctagatatgatgtttcttttcatacttagtgttgcatcagttaagtttgatctactaagtcgtgtttagaaccataatccctagcctgctttttgactgccaataagggtttcatcgggatttcagccgatgagttatctggatgttgcatcggcttacaaggattacatacaagttggatttagctgatggcaacaaaaatttcactgtttaatctaatattgtggatttatgacattggacctccagccgatgtatgctttaaccttcggatcagtgcttattctatcatgtcattgttagccgattggtttctactagattatattattgatatattatattatcatcagtcgattgtctttatatcattatccacattgggtatatagcagattgctcaaaaccatatcgctagcggctggtatcggcatcggctggaattattcctttggtttgacaaccgatcggctcattggtctactatttgtatatcttgtcagttgcagcaacaaactgactggcacgcccgcatctcatcaacctttggacctgcactggagctaagcacatctcccaggccagtgtgtgtttttcgcatcaacacctcccctccctaggaggtcttctatttatacccatagatgtccccttgtccaagtagaagtagagagacaagtatggatataatccgagtagtccatatagtttccatgtagaactctgcttgtccttccttatccggaactccttctatatacgaggtatgattccgtataaggcttcgtacaaggtgggccccgctgaccttaatcgactaatattgggtatgtgttatccataaccatgacaatattgatccttcgtttcacaattggtggtgtgctttcagaaatgatattcttctacatatgtgtaggacaaataaaattcttaaacaactagtttttgattggttgcacagcatttaatttcttttctggaggtgtttacctcttgtaacattcgctgtaaatatagttttttctcttttacaaaattacactactggggaaatgtctggtagcattcaatttcaaaaaaaaaagaaatacataacatctgatccatttgatatagacccaaccaacatgattctatgtaagccacataatcatctatccaccaatttcactcgtttaatgggcgccaaattctggtacttttggggtcatgatgctaagaagtatactcattggtctacttctattttgttgtgaaggtagatagcaaagttattaaatttgtcaattcccctttgaacattatgtatagtacatagctagttatcaaatgtagatcacttcaaaattgtttgtggagaacaaaagcaaattcggccacactacatacagtcaaatacctcgatacaaattcagccattgggaagttaattcagccaccggaatctaagtctccatagactacatagaacagaacttaacacaacagaaatcaaatgaagggtgttgtgtccctgatgttgcagagcaagatgcagggtgccgagagcccgagacgcgatgggggaggagactgcggcagcagcgacacagtcacgcgcatcatgggaaatggcgtggggcttggggggtggacaggttcggtagtgttggtcgcaacaccgtagccacagagcaagtacgcacagcagggaggataggctgcggtggtggctataggtgcaggcggcgacaatgacacatgcgaggtgaggaaaccacattgccgcaagggaaggagggtgcccctatcatacccccgatgattgaacggtcagatttcatttgatacatgcttgtacaaagtacctggaggtactaactgctggaccggaacaaaacacattttagatggaggtagtaaatttcaagcacccaagtttaatcccaaaattagtgcacttttaaattactactctctccatcctaaaattagcaacatagtatgcaatgagacatcctagtattatagatgtggacatagcagtatctcatcttatctcatctcatacaaagttgctatattttgagatggaaggagtatatgccccatcagttgaagcatgggtactggtcggcgttgctctcagtccgcacgggtggcaatgccactcaccatgccgtgcctcccttcctcccctccgtcgctgtccaagctagcaatcggatatctgtgcagcggcaaggtcaaaggcggtgggggctgcttaccagctccgcaatggttgaaggcaagcagtagctatcagatctgggtctccgctcctaggtctagatgtgtggtggagtggtgacagggatcctctccggttcatcaacaatgatgcccctggcttgcggatggtgccgatatgggggctttccccagttcgtggatggcggtgcaattagggcttctccccggtttgctgatggtgatggtggggctccattcctgagggtggtgacagggtgcttgaccatgggactaggcgaggaggtgatagggtggtatggcaacggtcacgattgtgggaggcgacgatagtagttgaggccagtcagccaggcggttcacctggatctggcgggggtggcacgcaagtggtggtggactagcggctctaattgctggttagcttggtgttctccggtgaagcggtcttggacatggccaactaatgttggttgctaagaagactgggctaagcaggggagcatcgaggtagcgagcggccgggtgagcgagccgggtgagcgcctagatccggtcgcgtggtgccaagggcagcggtcatggtggttgtgcttttggtgtggatggcaaagatggccctaggggcagtggctaccagattggtctttcttgtccagattggtcgagtggattgaaggcaagtgttgacagtccttaaatcataatatctaaccgtcaatgcctacatataatgaaataaaatatggtatccaaactagtgttagggattattactaatcatttccgctagtgttggtgaaatatatgtatgcatgtattttaaggagaaaacacatctgtcctgtgacaaaatacacctccggataatcaggacacgtttacatggattggacggcggaaatgctactgggcgggcgagcgccctcgctcgcccagagcgatcggttccccctcccccctccccctccctctctccacctggtttccttttttggcaccgcattactttcctattttagtaaatttatgcacctaaagtttatacacctcaagtttacacatttaaagtttagagaccaaaagtttataaatcaaaaagtttatatatccgattcaaatttgaatttgaattcaaataatttttatatatatagtatttctatacatctaaagtttatacacctaaagtttatatatccgattcaaatttgaatttgaattatgtccgattcaaatttgaatttgaattcaaatatttttcatatatagtatttctatacatctaaagtttatacacctaaagtttatacacctaaagtttatagacctaaagtttatatacccgattcaaatttgaatttgaattcaaataattcaaatattttctatatatagtatttctatacatctaaagtttatacacctaaagtttatagatccaaagtttataaatcaaaagtttacgtacccgattcaaatttgaatttgaattcaaattttttatacataaatttttctaactttttgttttttttaaatttttttgtggtgtactgtaataggaaaagaaggggaggaggaaggggagaaaggagggggggccgatcgctggatcgctcgcttagcgagcgatcgcccatcaagcgcccccattggagggcccatatgccaatcaaaaccacttagaattggcccaaatcatagcataggatg

SEQ ID NO: 11050 - DNA, 9105 bp, Oryza sativa
ccatgttgatctgtgcacatactagtactaggtgttggggttatattactgaatatgcatccttagttcaataagcaagacataattttcatgagtgattggccaagatagtatcatctaaaatttaatggactcttaataggataattcaagtatagatcagccatctcagtgcatagttgatagcaagaattatcttggatgatctacaagtgcatttgagttaagcattatatctgtatatagttcagtaaagccatcatagaatgaattttgaatgcatgcatagttagaaataatcattgttctatttaacctcaagaggttaagataactagataatatcactattgtgctactatttctagttaaataggcagagcctaaatgggtagacagtaatctatttctcagtatagacactaaataaagcatctaggatccattggcagaatcataggtatcaatattaggtcagctagaagagcagagcatatttagagaaaagaatgacatctattaggtcttgttcagttactagggattaaatccccaaggggaagcaaaccagggagggattgagtgaatcccaccatgtcacttaaaccctgtggggatataaattcctttctcctaatccctctattaatggaaaccctgtgttcggttatcaatttttttttttttgctactgatcaataggaacagccgaacaaccaccctacaatgcttatgtgcattaaaatgtgacagacatgtgtgacgaatgatcttgaaccaaaacaaaatgtaattttttaatggccgatgatcaagagcatcaatgcatatatcaactacatttgaatgctcatttcaactgcacgtttcgatatccgtaaaatcttttgctgatgagcaactgcggaatacatacaaatcttcatccaaaaattcgacacaaactggctgtcaacacgaactggctgtccaggttgtactgaaattctaaacaaatgagcatagaaacaaatgagcattgtactaatacccaaccaacagtgacccctccttccctgtgctgtgcacactgctcaaagaaaattaatgatcctactagtatctcacagatcattcgaaatgcaaatgcatgcatacatgttaatttaacctgtccttttcgttttcttgatcaatgctggggcaaaacatatttacaggtgcaggcttgcagctagcatgcatggggcaaaacagatttacagtgcaacactgtgatgagtcgcgattaaacagtcagatcagatgacaaactatgccaatttatgaaacaccaacttatattacctttttttagataattaacaccaacttttatattacttgtaacaatgaaagcaaagaatgccatgaaatataactgaagaaatcaagaaatccaacaatgtgcagcaatcaatcgatcactagagattagctagctaagctcagtaattaagagaaaggaattcatataagagccttcgcggagaactctatcagtttctatttggttaccgaagctaaatggacccgagctgttgatgaccgaatagaaaggtttattttcaatggcatgtcctagatgatgtaggctttgcttcctcagcattaaaccaatcttcaggattctcaagcgtttcagctatttctagatcaaccaaaagctcataacttggtttattcttcggttaccatatctttgaatgacaaagtgcccgggaagaaagatctagatctctatcatcatctatctctatatctaaatatggaagaaccctcgaagcctgtccccgacgacgatgccccctgggtgaaaggaaaggggccgccattctctttctttcctcaatcgttccgatcatttctctcattcccttttgtttgtttggtggggccccgggttggttcgtttattcttttccatgtattagattatccgtccgagccatatcaaattaaaaatatctaaaatcaaattcaatatagaaattggaatagattctattagaaaacatatatatatcgatcaaggatgctgaagacatcccagcgtattgaagtacctaattatctactggcccatccaagaaccaagggaggaggaaatctaggtgacacatcaatgggaaagaagacaaattcaagaatgccgctgtttacacccaaatttggcacctagggataaaataggaaaaattgccaaagtttggaaatctgccggtttcctccgagtgggccggtttgaccgccatgtgttggccggtcagaccgccggtcgaaggccagtcagaccggcggtatgtggccggtctgaccggtagagcccgagttcgggtctgtttcgccgggtctcgaggtttccttgctcgggaaggcatgtttcgggtttcctttgaattctatcctgagttggacgtggaggaggcctgtagagggcaagaccaactcctatataagggacatggccggttcaattataactaaccaatctacaatcaatcaatcgaatcgttttttatattgcttttagttttctcttagtttgtccatctttgtcgatttgtgccgtaaatcgtccgccgccgctgcgagagtgcgacacctctttgtaggtttgtcctgaaaaccttccgttttgcccacgagacgggtagttatctagaatcggctctgctagccggttttgttatcaaaacccatcttggtttagcttttgctagatcgaggtggttggtgactctaggatcaccgcaaggcatttaggtgctgcgatcgtgcttgtcaacttgtcacaaaaagttgccaacacgatttttggcgactccactggggacatctgctcaacgtcaactcaacttcgacctcaccatgacgaagccgccgtcatccaaggcggaggtggagctggccaatgtgataccaatcatatttgatgatttcgaaggggaagatcgcaagtccatggaggagtacattaaggagatcacacaggaggcgctgatgagggcgtgcaccaggactcgtcaaggcgtgatcatcaagcctaagccacgtcctaagcctacttacgatgtggtaagtaatgaggaggtaacacaatttatccaacaacacattgcatctacaatagattcatctatgattactttgaataataagttaaatgcatctattcagaatcatgttgaaggatttttgaggactagattcggccctctcgtggccgattttatgttcaaagacaaagcctctaccagtgctagccaagccactatagatcagataagtagtataaccaacggggcgaaaacacaacagcacggcgaggggtgggcggcgcacacagccagtctaaccgggcctggtggccggttagatcgcgatgtcgctgtcggtcagaccggccagacggccggtcagaccgggtattaccccggcggtcagaccggaactcaggccggtctgaccgcgccactggacgtcggtcaaaccgggtcttgggccggtcagaccggcacaatcatcccaattcagggggtagatccaatgacaaataatgcttatttgtatcatcttagaacatttgattcccctgtatctactgccactacttgtccccaaattctcctacatgttcctaatgcttataatgatgtttctagggggtatcctcccgatactaggcaaggccaatataattatattgcgccgcaaccacaacctattaggccaccaaacccaccaccaaaccaacataggcctgataatatggaggaattgattagtggaatcattagggataaattcaggattgaagctaggaatcgtgctaaggtttaccaaaagccgtatcctgactattatgacaacataccatatcctcgtggttatagggttcccgaatttaccaagtttaatggtgaggatagtaggaccacatgggagcatgtaggtcaattcttagcacaatgtggagaggctagtagttccgatacttttaaattgcgcttgttttctttatctttgtatggtactgcttttacatggtttacttctttaccggcaaattctatacatacttgggctcaattagaacaaaggtttcaagattatttccatactggtgaaactgagtttaggttatctgatttaacatcagttaagcaaaagtataatgaatctgtcataggtttagggatgttaaaagctgatattatagtttaaacataactgatagagatttgtctgatcttgcttttaatggtttaattgctcctattaaagaaagattagatgttggccaacaatttcttgatgttagtcaactcgtgcaaaaggcactagctcaggaaagccgggttaaggatagcaaaaaatttgttagaccatatgagaagaagcctaatgttaattcaattgattaccatgaggctagtgatagtgaaggtgagggtgatcatgatatgtatgttgcctgccgccgagccgtgtgcgccgctgccgattcctccacccgattcgctcgattctctgagccgtttcttgaattagttgaggggatttgtttcccttatcctcctctatctcttcccccaaaaaaccgactttatccctttgaattcgacgcgaatttggattcgttttcgagtttatgtctccaccaaaccctaggttttcccggcgcgattccttgcgttccaagcctgatctctctctcccgtcgctataaatagagtcccctccctctcctctttcggccgccacctctccctctctatgccatcgcttgtagcgccgtccccgtgttcgccttctctctccgccaccggcagctgctccagccgccgtttgccgccgcctcagctgatgccctcctgtgccgccacctctctcggctctgcaaggtcaagagcaagcccggcagccgattcccttgcaccgaagacccagggaagcccgtcgtcgccatcaacccgaagctcgccgtcgtgttttgatctccggcgaggctctgctgctcctcccgtcatcgccaagcttcgccgccgcctccattggattcgcagctgcgaagtgaagcctggccacccctgcattgtcgccgaaggtcgccgaaacactgtcgccgccgtggacagtacctcgccgccatcccgttctcgtcgccggccatcttccatcgctgtccgtcatcacgtaagtgttggtaagaatttccatcgccttctctacctcccggtgccctccgtttgcattattgtgtcgtggttcgccggcaaccgccgctcctatgtcgttcaccggtgtagtttatccctagggtcttaatccaatataatccaatccgtggttggtctagcattgtcatctccgtgtgttgctgccggaacgttgtcatcatcccttcctctccgatcgctttggttcggtgagacttctattcgttctctcttttcaatggcatattatttctttttaatatatgtcatctaccaaatataatctaatattttccggaggttgttttaatcttttctctcagttataaatcatttataaatggtttaattaatttggaatagtcttttctttaataggtttaattggaattaaatcttgtaaaattcgtaattaatttatatgaaatcggaatgagaccgttcaagtctcataattcatctaaaatcatgatctacatatttgtttacttttatgtactgtttatttggtttttattagtctttttctttgttttgcgtgttagcttgtcgtttccgtcgttgcgaaggcaagtcacacagatcctaaacacaattcctttgagcttgttgatcctatatttaaattctctatttatttcaactgtgcatttattttcgaatgtcatcgggtggtgtgaacctattcctttgttatggccaatttgcattgaataccctattccttcataccttgggtaacaaattaattagcttgaaccttatatattggtttggttcagctaatagctatatatatatatgtatgtatatatatatatgtatatatatataaatgtatatatatatatatgtatatatatatatgtatatatatatatgtatatatatatatgtatatatatgtatatatgtatgtatatgtatatatgtatgtatgtgtatgtatatgtatgttgtgtgtgtgtgtatgtatgtatgtatgtatataataattgcttagccatgcttagaaacattagctcattaatgggatgaatcacactacattattacttatggttatatttaattgtagctcatgatggttaatcgtgttatgataattaactgataattaaaatttgattaatggtgggttgtgagcacatggttttgaaggtcgtgctcatgacaattaaggaccggtttgcgagctactgttgtgagacattaaccgtaccaactacaagccagcgtgggcaacggctttaccttttgtatagcatggttctttacggggtgctagactgagaagcggtgagaagtccgtgggggtcgctggggagtccatgcctctggttatatttatagagggggtgattatgatccaggaatggtgcattgtggtgagttgtgttgtgcagagggtattgtcacaacctctattcgggtactttccagtatcgcgacgcatggtagacatgatgttgaggctgtgtcttgtgggtatagtggtacacctctggccagagtaaaactattcgaatagctgtgcccgtggtcatgggcgggttgagcaatgtttttcgtgattagtctcacacctctcacaataattattgatgctataactggtaataatttgtttagctcctggtttggagttagatctgtacagccgggtatggttgttcagaatggttgggcctgagcagcatgggcgtgttgttcagtgttgattaaaattaatgattaaattagtttattgttttactactcttaaatgtttattaaatgctgcttttgcaaatgagcctatattatgccattctttggtatccttgtgcacttgcatatttgctatgtggcttgttgagttgtcatatgctcactttgcaataattaatcaacctcagttgaagaaaatgatccagaaggagaagacgtttggcttataccccagttgagctgcctatgggagtggagccggagcttcgctagaccattaattttgctgttgttttcttttcttttgtaagtatgtaacgatgttattatgatggatttgtatattaaattgtcagtttgtgtgcctcggctgattccgggacgagggttttatgcacaaataagttcggaaattgctagtgagtttccgggcgtgacaccaagtggtcatgggactaacaaaaacaagccttttgtttgttctaatttaatgccgactcctcgtaaagatcggcaaagtaggattaagtatagttttgatgtggccaaatatgataagatctttgattatcttttgcaagaaaaacaaattagattacctaaaggtcatattatatcatcttaagaagaattgaaacgtcaagcttattgtaaatggcatgattctcactctcattctactattgattgcaatgtgtttcgacaacaggttcaatcggctataaatgaaggacgattgaagtttaccgatggttccaagatgaagcttgatcatgatccttttccggtgaacataattaattttgatgataagaaggtattgattcggccggagcaagccgaatctacaaaggggaaaggaatggtcattggagagcctaggccaaaaatgatggtgccaaagaatccggaggttggtgtttgcaaggaaaataggagtgaagcttcaacttctagagttcctaagaagactaaggtgaccttcaatatgcttttggagaagtatgagaagcaaggcggtgagagagatcgcaacaaaggaaaaagaccaagatcacctcctagggagcgatttggtcattgaccaagacggtcggaatcacctccatatcatcattctcaagacatgtcatgggggccttacccaatgccgccgccgggttatccttatccttactacatgccatggggggcaacaacgccaatgttcaatcatatgcctccaatgcaattcaaccaagggtagggaggaccaaggaggccaattcatgagcatttgtcttcatcaaacaatggttggttttatggtaagaaccgggccaatggagaaaagcgggaaggaaagcgcgtcaaggtgaagactaggacttcggaggtgattaccatcaaagtggggtctcatgatgtgccaataccttctggagatgaagttggggagtcctcaagcaacaaatctgaagccggtaccagctcatcgaagtcggccgatctgaccaggccctctggccggtctaaccgcagccatacggccggtctgatcgccaatccaacaacggtctgtccgacgcctcaggccggtctgaccgctgacctaatgtcggtctgaccggcacctccggccggtctcaccggtggtctaagtccggtctgaccgggctccagcgccagtttgacaggaggtttgcaggaagcaatgtaggggcttcctcgtcttcaaatagacttaacagggggcactatttacctcctggaacaaagcagaaacctaggtggatgcctgaggatttgacggctactccaaggagaaggttgcaacgtcttcgggctcaagagataagagagaaaaaggccgaagaacaaagagataggaggttcaatgagttgtgaccaccaccggtatggaggagtaaattcgtagagaaggaagaaccagttgttttgcaagaggaaaaggaagaacaatcagttactaaagatgaagcatctccaaaggaagacatggaggtcaacatggcgtgtatgttgcctatggagttttgtgctatggatgaagctgaggttgctcaattttcactaggtcctaaagatgcggtttttgagaagccgatgagtcaaaccgtcatatgaagcctctctatctcaaaggtcataaggg

SEQ ID NO: 11051 - DNA, 955 bp, Oryza sativa
ccatcactcgctatttcctcctggcccgcttgatttccttcaaatccaacatactgagcaaagtccggaatattgtcgtcttccacttcatcttcttccatttcaacaccttgctctccgtgggatatccaacaattatagcttggcatgaaccccgactcaaacaagtggaaatgaatagtcctagatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacgcacattttctctctcatcaacttacaactaaattttggagacaaaaaaagtgtgcaaaacataggtgcaaatgtagtatgacaaaaaaaacattggaggatgaagttgtaaaccttttaggcacctccgatttgtatgtaatcaccaaaataaattcaatagaaattttggcatgacctcccctcttttttgaagaaattttgaagcttgctcgggcagctggaggaggaagaagacatatatatatataggggtgggactttagtcccggttggtagcaccaaccggggctaaagatcaccgggatctttagccccggt

SEQ ID NO: 11052 - DNA, 23299 bp, Oryza sativa
atctttagtcccggttggtaacacaaaccgggactaaagatcaaatacgcccgttacccttttgaaccgggactaaagatcatctttagccccggtttttattgcatccgggactattgtggaaatcggccgaccgacgaaagatggtttctccaccagtgtatgccgcttaatagctctgtcattcgagctgcatgaacaaacacaaaccttagattctctatacttatatttcatataactcttaacatttatttttgtagatataattatattttgtatataactatatcaattagcatatacgtatatttcggacccactatgatttagcagataagatgttttttcttttaattaatatgaaaatttctaacatccatagtgaatgtagtagcttgcttctaaactatgttaatctttacctattgtaaattcgacacgactgtcctcgatataaaatggcacgacttccgcgtccactgtacaatgaagcatcacaagtgaaaaattactcctcactttcacttgcaccaaagacaagcaaacaaaaacacttccactgctcatgcatacaggggtgactagtcgagctgtggaagccactttcactgcaccatgtctgactcagtctgtctcggtgagtgtcctagcctgctgtagctgtgtctagacactatttagatggaattaaaactttttagtctgtatcacatcgaatatttggatgctaattataaatattaaatgtagactagtaataaaactcattcaataaccctggactaattcgcaagacgaatctattgagcctaattaatccatgattagcctatgtgatgctacagtaaacatttatatcggagaatttatagaggaaatcggattttaaatttccagaaatagctctcatttatataattagttttataagtagtctatgtttactactataagttcatccgatatgatagggattgaagtttaaagtttagtccctcgatcagacaccctaaactagtgatagtagcaaagggcattatgggattttattatgttacagtgcatgtcagcacgtgtcatcttcaggcgtaaaccatatctacctggcgctaacaactctggccgctcccttcacatatcaatgcccgcgtgaatcttagcacggtcgtacggcagagattataggtacatatgaactcgagcactcgagctcaaatatgcattttcatatatatatatatatatacacacacacacacacacacatatggcaccatggtatgaaatacataaattcgttcaaattcttcaaaatttttaaattgtgagtacatacctagttataagtattcgatgcatatctatacatagcaacaaaacaactcaaattgaactttatttcacaatccaatattacatacctaactaattatatgttcggatgctatatacctagaatcaaaatctaacaaaaacaagttcaaattcagttcaaacttgctttgaactagttattagttaatgttcatacctaaatatttaaaaaaatttcatactcatttgaattgggtatatacttaatttgaatcatagtgcccggacaccatgaagcaccaaacaaattatttatatatatatatatatggaacaaatatgaaccaaggttcatatgaaccacagatctcagctgttcagatgttccaagatgtatgtccaagctgttcaaagttatcacaattgagtggtacttgggaaagagttaattacttaattgcttaagcagctcgctatggtacatatgtagaggggtgacaagtatggctatgttttgtcttgtcactgaactttttttgaccaagtagaacaggacattgcactgcttgctccataaataaagacatgacaagcttagtggatgtgattggggttgagtcaagagcattggtaagaataattttataaatttgtttctatttttgggtgagtgaatattgatagttaattagttgctataactgatttcgcatgtcagatgctattcttgaaactggctttttactaatcatatattagtgattttttaatgtattagtgttaacttggtcggattagcatatatatatatagtttttttaatctattagtgttaacttgctataactgatattttaatgctatatactggtttcgcatgtgaatattgtttcttttctcttgttatccatggaattttaatatacatgaccattttggaaataacacacatgtgatttttttaaatttggatagatgccaaggatatgatatcattttgcaacgtcatttttagacctcacttttcaaaatgatattttcgttgtatttcattttcggcgttaacaaattgtagtgtacgttattttctttgtcgattacgaaattatattttgcaatgtagcatatatatgtaaaaataaaaatcatgtgtttttatatttttaatatatgccaaatgatatatcatttttacaatgccatttttggatataagttatattgtaacttttcaccatgatacaacgaatctggtcaaaagctaatcatgctttttttagtcagatttatataatatttgtaacaattttttttgacattctgacctgcaactataattttttaccaaaaggtacattaccattaatgttttaaaatggaggggacgcagagttttttttttgtcgggattttttttgctgtaaaaaggtacacctgccgcatgtgcagccattacattttgcattcatatcgtgcatgtgtggggtcgccgtatagcagcctgagcaagggcaaaaattgagaacgcaacatgtacctatctaaccctgcaacacacagccgtatataggggctccatggggcaggtacatctttgattatggttaccagacataataaagccctagatgtactggaatatgtgtacacgtgtcgctcaaaggaatgaggtgcatatacacctcggttcacattatccaactcctactttattcatagacattcataacaagagggtaataagaaacatttatcacaaaaacatttatacatatataatatctcacatttaacccccaagaacttgaatgcacatacaacaaatagcttcacatacatcacagcttacatatatccataggacacaacctccctaatgcacacatcacaggttacatacacccgtaggccgaagcctctaatgtactccttggctgggcttgagctcacaaaatgcaaactgatccagccaaccttttgacgtgttttggtacagatcaccaaaacatgaaaaacaaatcaacgctaaggttcaaatccaaaatagtccaacatagcagcatagcctaggtaggagcaaccattgttaagttgaatatgaactccaagattgctttcatgaagagctatatcaggatgatagtgtattactacaaaaccatcataggaatcggtcttataggtgccagttcctttaaaaccgacacctattggtcatttcccatctccacacgctgaaaatgtaagaaccgacacctttaaggcactataggtgctggtttattagtaaaaaccggtaccaataatatattataggtgtcggttcttttaaaaaaccggcaactatacaaaacgagccgagcgtcgtatctcacctccttatctaatcccacccacatctggtccttatctactcgactctctcgcgctctctcactctcgcaactctctccctcccctttctctagcggcggctttccgacggaggctgctcggcggtggcggcaggcttccgaggcttgcggctgtccggcggaggcggtagctctcgctctcgcaactctcccctccccccctatgtcacgtctctctccctctcctctctctagcggcggctgcccgacagaggctgcccggcggaggtggcaacggtggtggctgcggcagccgcaccctccctcttccggatacggcggctggggaggcgacggtctcccgcggccagcggttgcccgacggaggcggcagaggcggcagccgcgccctcccctcccgtgggccgcggcgctccctttcgccagatccgtccccgacgtcttcacatgcgagtcctccaccaccgccatcccggcgacgctcaaggggaaggacatgacccaagggccccgtcgccgccgcatcatcctcaacgccgtcgactcaacgggttcgagtatgttctttttatctcgttcttgttctctttgtttaatttctctcaagttctcctgttcatatgtgtaccgagaacatgaggatttggatcagatgaacattataattaaatggatgtaggaattgttgttgttattgatgtcttctttggattttgattttggatgtggggatattgttctggatctgaggatgtggacgggatcacgggatggggattggggagggtttcggctcgattcaagctagttatggattcggctcgatttgatctggagttcttttttttttggctcgtgcagacaaaaaggtgtcggttctattttacctataggtgccagtaccagcaataggtgccgaccaattggtgccggacggaaaaccggcacctattgccagttcacaaccagcaccaatagggctttctgtactagtagtgatatgtaaaatgaaactttttgatggctgctttttgttgtaagtggaaggtagcattaattggacctaaataattctttttgtagacatggtgcttgatatccaaaagggtataacacccatagaacgtgagacagaacatcagacatgtgtttccataaaactcatgttctaacatgacaattaacatatatcaaattctgacaaaatataactatgacagtttatagttcatagttagcatcacaagatctttgatttattgcaaaataaatttactaagttccagtcctttctaatctgaaataagggaacatccttgtgatctaatcgtgctgtggatttatgataagttcactgaccttgacaataagggaaaaagacagatgttagaactttaagaggacttgtcgctgtaggtgagttgaactttgcaattgtggcagaccaccattgccgcatcctcgctagtgcagttacatcgaggacttggggggcgtggcttggtggacggcctcctgggtctccaagcgcattgtgccgccctttggacagaggaagagaacctcggtggctgtgaggggatgaacgacagaccagaaccctcggggtaggcatgaccaaatctagcgcctcctaggtttggggcagccagatccgattcctagctcccatacaatctccgggctagctggccctcctcgccattggtgatgatgtccttgcttgtgtgaggtgcggtggctttggcagaagagaagaggaagggccatgaggtgccgagtgttggacaccggtggcaagcatttctagcgaggattcatgtgagagggatatgttggaattagtgcatgggcctcagcccattcgaagattgattctttgaaaaatcaaaaaaagctcacctcatgggatggcatgtatagggagtttatgtcacgcccagaaatatacaccattttccaaacgctcagtgcattaatcctcgtcccaggaggtgaggtacacatagatattgttgattattacaagccaaactttattacatgggcgactctaggccctcacactcaaagataaacaaataaaacagcggaagaatacggaacagcagcagccacaggcactcgacagcggagcgaactagagatccaagcattcatcttcctcagatccatcctctggattatttttgtgagcaagagtgagtatcaccatcgtactcagcatgtcacaccggaaatgcaacaataatgcataggggaaacaaggaaatggctgttctaagaaacaataatgcaacaacagggtttatttgcataaagccatagtttaaacattttaataaggttaaagctcattttaaaacacgatcctgttctaagccaatattttaatatcatcaaggtctcatgagcctgcgaacctgccttaacccaggttaatttccacatgactacatgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagatgtagataattcctctcaatcaataaagatctaagcagcggaaaataagataaacggcgcagacggctccacttcacaggcagcttgaccagggctacgcctaatcctccccaccatcagcatcactgtagaactcttcctctgatgaatgattgcaaggtgagtatatgacatactcagcaagccacgcagcaaatatgcaagtgcacgaggataacaaaggatggcatagtagggttcatttgcataaacagcatttagtaaatatttcagaatttaataaaatagttaataattaagcaatattaatccaacgctatacaacataccctgttgtataggcccaaccattctgaacaaccatcccggctgcacagttctatctccaaaccaggaatataccattccaaaccaagagctaatcaaattattaccagttatagcatcttttattatggtgagaagtgtgagactaatcacgaaaaacattgttagacccgcccatcaccgcgggcacggctattcgaatagttttactctggccagaggtgtaccactgtacccacaagacacagcctcaacatcatgtctaccatgcgccgcgatactggaaagtacccgaatagaggctgtgacaataccctctgcacaacacaactcaccacagtgcaccattcctggattataatcacccccttataaaacaaggcatggactccccagcgacctccgtgggcttatctccaccacttctcagtctggtgctccgcaatgaaccatgctatacaaaaggtaaagccgttgcccacgctggcttgtggttggcacggttaatgtttcacaaccgaaactcgtgaaccgatccttaattgtcatgagcacgactctcaaaaccatgtgctcataacccaccattatgaagttttagttggcaagtaattaattaaccaatcacgattgaccatcgtgaactaacaataagccatcattaaataatagtgaatcataagttatcccaatagtgtgctaatgtttctaagcatggctaagcaatcacatctaatatctagctgaaccaatatatatagcccaactagtcaagttaaaataacccaaggtatcaaggaataaaggaatcaagaacaaaaagggctataacaaacaataggttaattccacccaatgacattcgaaaataaatgcaatagttgaatagaaacaattgctttaaacgggatcaacatgctcaaagggttgtttgggatctgtgtgacttgcctttctggccttggaactcttcaaattcttctcctgcgaaaacggactctccggaaacgtcgaaatctaaacagaaaagagcaaaaacaccaaaacagcacataaacaagcatgaacagtacttgtggatatttttaacatgtagatctcaattttagaaaaatttagagacttgaaccaactaaatccgagctaagatgaattagttatgaatttttaaagattaaatcggattaaaacacctatatggattttaatggaattatgacgcaataatgaattatttttgaaaaggaaaagagatttattgcgtcagcggctagggtttgcggtggaccgggcgcacggcagcggttcacgggaacggacggccgagatcgatcttatccaaaacgaacggccgagatcaaccgatccacggccgggccacggcggacggtcccgatgacgtcagcggcgacgtcatctccggcggcggctcgggagcgcaagctcgccggcgaacgacggcgctacggcacaaacggagggcaccaggacgtagagcgcggcgcggtgaactcaccgatgaccaaaacgacggcggaagatgaacggacggcggcggcgtcgaggaaaaggcggcggagtccttcggcttgacgacgacggcgatgctccgtcagtctacagcggcggcgaaagggcggacgaggacggcgacgcgacggtgaccacgatggtgaccttcccgagcgacggcgacggctggagcgacggcgaagcacggctggagcgacggcgacgacggcggctcgaggttacacggcgctggggcgcttccgacggcgagagacgaaggcgagggtggcggcgggtagcggcggacttggggatccttttataggggcaagaaggcggcggcgaaggcccacggcgaccggcgatgcgaaggaaaggttagggttcagaggaaagagaccgatccacggatttccaaagcgatttagacgatgattccaaaagagaaaaggtagagaagatcccgaagatcgtttcccctctattgatttcaccggagaaggaaagacgcggccgaatttggaaagagacggcggcacggctcgactaggattcgggcggcggtggctggaggtagacgacgggtccgacaggtgggacccacctgtcagcgactgaacgcgcgcgcgcggtggctgcggactgggccgagttgggccggggagagagagaaggttttgggccgactttcggcccaaagccaaaagagacttttaaaaacctttttcaatttaaattattcatgaaatgaaattccatttattaaaaatacttccttagctcaaataaattccagaaaaatctaggaattatagaattaagcaaagtatttaatgaaattttatctggccccattttatattggaatttattaattaaagattagatcttctcttctaggctttttttaaaaaataaattctaataattccaattaaataacaatttatatattttggatttttagggtgtgacactacaccatcatgacttcaccctcccaaggtttgaaaaaacaagactaacttttggtacattgctcagcttgcccataaccgagggtgcggatattcgaatagttttgaactctgatcagaggtgtacaactttgcccataacctcaacacgtgttgccacgtgccgggtaccaccacggtactcggatagaggtcgtgacaagactatacatctaggactacccaaaacaggagaacccgctgaggtttcgttgcccaccggtccccgatgaggagacaggccctcccttgcatcgggtgaaaatcggccttaatcctggccccacacccttccaaccaatggtatctcttttgagaagatctaaactttcagtcaggccttacccactagacttgtgattacaagaagatgccttgcaacagaggcccgcagaccggtccttatattagccgtggtgcgactaccaaagtaactagcttgcaccccgagcctagcccaaaaataagttttagttacacaaaacattttatcccccatctattgacaaaccagtcaatagttaataactaaaccagttttaattgttaaccaacatagtctagtttatccaaaagttctaggttggaactaagcacaataagcatttacctaaagcaacttgtcagtccatcatgtagagtactagactagtcaggttataattttactagggttcacaaagatcatggatatcaaatcaacatcatggccataacaaagagcataggaattgttgtcgaaaggacaaccgcatacgtcgaaagacgtggttactctacagtggttggaaaacagttatagtatattaaattgagattttttcttagggatcccccttttatatggccctataggtctatttatacccttgttacaggcctccccattagggtttaggttttacaggggaatttacatggttgcccttatgaaagggacatttatatgggtatacagtgtaattgaggtacatgggcctctagtgggcctgctggcgaacgctggcccaacggcccccgggctcgatcgactgagatagcctcttgggcctccatgaaactggacttgccatggcgaagccattcgccttcgccacacagccttcgcccaagagcccagagaacagataactttcgtctggtcatttacccttcgccgccccctcaagcctttttttgagcgcctcgagaatcttgccattcgtgcgatctgccgccccatttgactgcgggtgcgcgatcgaagcgaacttgatttccagatttagcccttcgcacatttctctgaatttgttagagtcgaattgcttgccattgtcggtgatgaattcttttggtattccgaaacagcaaacaatgttcttccatacgaacttctgtactgctgccaaagtgatcgccccgagtggttcggcctcgatccatagggagaagtattcaatggctacaattgcgaacttgtacccgttttgcgccacagggaacgggccgatgatgtctagcccccatctggcgaaaggccagattggtgcgataggctgcagctcgtattggggcgcggtttggctttggccatggcactgatagctttcgcacctcttgacttgctcgacatagactttcagcatggtgggccagtatacaccctgtcgaaacacttttgaggcaattgttcttgtggcctggtgtgcgccgcagagcccctggtgtatttccttcgccatttcctcaccttcggcaaaggagatgtagcgaagcaaaggttggagcaccccggagtgatatagctggcccgagacaagcttgtactttgcggctctgagctgaaggcgcttcgcttctgcttcatcttctgagggctagccgttcgagaggtactttacgaacggggttcgccagtcctctgggtcttcacctagctctgcctagtcgattgccatgatgtctgtgctctctatgggcacacttggtgcgtacaggacctcaaaaaagatgcctggcgaatgcgggcctccacaagcagcagatttcgccagggcatctgcttcctcgttctggcctctaggtaagtgttcgaccgttatgccggtgaagcacttttccatagaccagacagcctccagatacctcttcattccttcttcttttgcctcaaaggatttgtcaacatgacttgccacaaatttggagtcagtccggatgagtaagcgccgaacccccaatgctttcgccttttttaggccccgcagtatagcttcgtactctgccgcgttgttggttgtgttgaactgcagccttgcggcgtatcgaatcggtacgccccctggcgaagtgagcactgccgcagcgcccgcccccttgtgcgaccacgagccgtcggagtacatcacccaaggttgttcgacaggctcaggttcaagggcgaatgccgatgtccattcggctacgaaatcagctagtacttgggacttgatggcagtgcgggcgacaaaatgcaagtcgaagggagataattccgccacccacttgctaagctagccagtaatttccttgccccggagcacttcgcccaaagggtactgcgatggaccgtgactttgtgggcctgaaagtagtgtttaagcttgcgcgaagccatcactagggcgtaagcaagcttctccatttcaatgtatcttatcttcgccccttgcaatgcttcggagatgaaatacactggtttctggcctgactctgtttcttggacgagtgctgcactgaccgccaccggcgaagctgctagatacagtagcaattcgcttcctggtgctgggctgatcaaagcaggtgtgctctgcagatattgcttcagctcgtcgaacactgcttggcattcgggtgtccaggtgaacttttccgctccccggagggtcttgaagaaaggcaagcctctttcgaccgcttttgagaggaattgactgagtgccgcaatttggcctgcgagctttttgtacttcgcgtacgctcgacgggggcttcatttgctaaatggcatcgattttctcggggttcgcctcgatacccctttcagaaacgagggaacccaacaacttgcccgcgcgaacaccaaagacacacttgtcaagatttagtttcatacccgcagtgcgtaagttgtcgaaggtctcctgcaagtcggacgcatggtcgaaagccttgcggctttttacgacgatatcgtcgacataagcctccacatttcgccccaactgcttgtaaaggatcttgtacaccagcctggcgaaggttgccccggcgttcctcaggccaaagggcatcctgaggtggcaataggtgccgaatagtgtgatgaaggctgtcttggggatgtcggccggattcatgtggatctggtggtagccggagtacgcatccaaaaagctcatgagtttgcagccaactgtcgaatccacgagttggtcgatccgtggcaaggggaaatcgtcgttcgggtacgctttgttgaggcctgtgaaatcgacacacatgcgccatttgccgttcgatttctgcaccagtaccgaattcgccagccactcggggttgttgatctcctggatcaccccagcctagagcagcttttggacttcggcttttgctgcttcttggagatcagcggacatcttgcgcagcttctgtttccttggcttggcatccggtttgactgctaggtgatgcataatgaggtttgtcgaaacacctcccacctcgtcggggccccaggtgaggatatcaatgtttttcttaagcacctccatgatgttctcaacttctctttcacctatgtcgcccccagcgatacaagccttgcgggatcggcgtcgtcgacctgcgggcttcggcgcgtgcttcgcccgatcatgcggttcggcctcaacattgtgcactgctctgttgatcacggccaaatcgccctttgatgtagttgaaggttgaagccccttgaccacgattgaccacgatcactcctgcagggccaggcatcttgagcttgagatagttgtggtgggagatgtcttcgaacttgttcaaggttgcacggccgaagatggcattatagttgtatgggatgtcgacaacgtcgaacaatatttgctcttcgcgcctgttgtcacctgtgccgaaggctaccaccagctgtacttggccttgtacttgaactgcttctccgccaaaaccgcgaagcgaggccggtgcttgggtgagggctagcgctggcaagcccatcttgttatatgcttcggtgaaaatgacatcggccgaactttgaaaccagctacctcggccgagatcaccagtgggtcttgatatgggaacagcactccttcggcatcttctggcccgaaagagatctgctggctaaggtatcgcggggccccttcgcccgccgaagtgatgttgtgcaccattcacagctgcatcttcttttgtcgttttgacggttgattcggcgggttggcccttgtaattacttggattactctgcgttgcccatcttggcgctgttcggccggaggtgcttgttcttgagcagcttcgcgaggtgcttcgacgactgcaccttgttgcagccttggatcttgtacattgccacgctgccgaatgtttcggtattgctcggtggtgtgcgaagagcgtccgtggaaggcgcagtaaaggtcttttctaaccttcttgcgaacgggctgctgatagctgcttgtttgttgggcgtcgaactccttacgaagggcttgaatttcttcgacagccatcacagccttgcctgcacggtcagttctaaatttcctccaagtcatgggagcttgacttggccttggcggttgtccttggatcgccggctgagattggtgaacggcgagaggagctggttcggcgacctgtgcttgtacttgggcttgagcagcggcgactgaggccttatcatactcggcttggatcgcttgccgccgcttggaatcctcttcgccccttgcgtacccatcaatgatgcgaagcaggtgctcgagtgtctacggctccttgttagtaattttgcctttgagcagcccgaccgaagcggcgttgatgacggacgcttcagttatgtcctgcacttgacatcgggcttacgagaagcgacgcatgtactcccttatcgactcccccggcctctggcgaatgccgagtagatattgctgcgtcttcggctcctcgtaggtgcctcgaaagttaaggacaaagacatcgcgcagttgctcccatgagtaaatgctgttagctggtaaattgaagtatcaagaacgagcaatgccgtctagaacgagatgtattaccttcgccttggtattttcgtcgccatgagcggcttcaatcgcggactcgtagatggacaggaactcctttgggtccgtttcgcccgagtaccgcaggacgggtgggaacttgaactgtggtgggattggacgaatattgattcccccactcagtggtagcctcttttcgcccccagccttgttcgcggcaccctgctacagatatggcgtggcgaagggcgaagtcatggcttgtgtgtgaggttgggccacagtgctcagctgccctgctccgaacagtgacgcttggtgcgccaccatggatgaaccgaacgattgctgggtccatgccatggcgacctgctttggcgcctgatttgctccgaagcctggtgtcggtgcctgtgattgaatggttggtgcttgagcagcgttgctgaaattgaattgtggtccttgactccaaggcgaagtgtcacgcccagaaaattagccctaaatttccagactattttgtgtattaaatccctgtccaggaccagccagggtacacaaaacgacaagtaatatacagttccaaacgtaaataaagcataaaatacttacagaagaggcacttagtcctcacaccgaaagagaacgacagcagcggaaaaaggcgatcctagcggggcttcagctccactccacaggaaaaactcaactggggtctgagccttggtcttctaacttcgtcttcagctcagaagcactacacttctgaaaaaggggaataatagcaaggctgagtacaaccactgtactcagcaagccacaccaatgatgcagacgtgcaaagggaatccaaggacgccttgcggctatttgcataaaggcggttgtaaaacattttattgagcaaaacagtaaaacagttgagtaattaaggtaagattaaatctccactggtcaacgctacaccacgttgaacaggcccaaccaacccacctgaactacagtgcattgggtcgatttattaagtgtgagactaatcacggtgaatatggtcgatcgcccataaccgcgggcacggctattcgaatagttttactctggccagaggtgcacaactgtacccacaaaacacagtccaccggcatgtcaccatgcctgcgcacacacatcaccatgtcgagtgattgtgacaagactatccgcataaccctcccctaaccatccacaccacgctaaggtttcacccccacccctcaaaaggcagtgggcagtcccctcttgcaccgcggtgaatccagcaactggacaaccggacaccccggccgacccaactccatcatgcccacccttgccaccggtgcttaggaaagggtcgagctatacttcagatcaagcagttacccactcctgcttgtgataagcactgttagtcttccagggtttcccgtgaaccggtccttaattgccatgggtgcaactcgcaaaaccatgcacccacagcccaccattcagtcgcattttagttggataattacgaccatgaaccatggccagatgtctcgagcacgcagctcgtaaagatgctagatgtctaaaactgtaattatcccatcaactgagctagtggttattaagcatggctaagcataaagttctagctaggtcacataagtaacacaagctagtcgatttatcacccaaggttgacaaaggacatatatcaagtaaacattgcacaagcgagcagataggtaaaccctgatcccatgtaattagcaaaacatgcatatttatttgcaaacggtaaaacatttataaattaggatcaacatgctcaagggggaatgtgtgacttgccttgcttcttcactttgatcttctaaactctttttctcgcgactgcgaacttccgaaacaacggattctacacgctggcacacaaaacgaggaaaaactctaataaaaaccaagaaaacagtacataaaaagtaaaaaatcatgtagagctcacttttatatgaattttgcaagttgaatggcccaattcggagttcaaatgaattagatatgaattttacaagttttgagccattttaatggatttctagaattaaaccgaattattgcgcaataattatttattttctcaaaggaaatagggagatgctgacgtcagcaaggggcgccggcgccgacaggcgggcccaacgcgtcagcgggaccaagggggctggcgcacgatggaccaggtccacgcgtggcctcgggcgcgcgtccaccacgtggacggcccaggtcggcccaagccgatcgggcggctgagcagagcggcggccaggccacgggcgcggccgagactgacccggccggccatggcacggcggctacgcgcacgcgcccggacgaccgccggcgacggcagcgcgtcgcggcgatgggcacggggagcggcggatggggaaaaaggagagggggcggtggggattctcaccgaggacggcgacggcgagacgaccacggggaggcggccggcggcggaaaatatggcggcgaccggcacgggaggcgacgggaacggcgttccgacgacgcccgaccacggcggagccacggccgagggccggcaagacctagggaaaatattggagcggttagggagagaaataggtgaccggagcggcgagaagaggccgctggaggcggtagaggtggtggtggctcgggttggcggcggaaacggggctccggtgatggtttggggatttggagtggcggccggtgtgcggggcagcgcggcgaagccgagggtggcggcggatttgtgtggcgatggctgaggcggcgaggagcagtggtttgaggcgacaacggcggtggtggagctcgggtcgacggtggaagcagtcctcgggcgacggaatggacgggtggagtggcggccggggcgtggcacaacgcggcgaacccgaaggcggcatcggcgcggtgcggcagcggctagagtggcgatggcaggcggctggaggaggtggaaggggcggcggctcggtttcatggtggagatggagttccgacgatggaatggggaaatggagtggaggccgaggcacgacgaggcactgctaagctggcggtgcaagcggagcggcgcggcagtggctagtgcggcggctagaggcggctggagctcgccggagagcggcggcgtgtgggctcggtgcggggagagcaagggagggctcggcggcttgggaaaaatggaggaaacggatgaggggaggccggggattttttttataggggagggaaggcgggatcgagcccgagagaggtagaaaccggccggcgacgtggagctcgacgtgggggtggcggcggcggttcggcgccgattccgtgaggagagtgggggaagtgggggaggaggaggtggggatcaagtccacgctcccgcgagacggggtggggcgcgggaggcgcggcgtcgtggggtggaaccggcggccatggcggttgcagccggccggatggaggtagggggagaagctgacgagtgggccctacggtcccacttgtcggccggagtgagagggaggaggctgagggggacgtgaagtggacttttgcaaggggaaaggggaacgggccgacggcccaagaatggagggggaaggccggcctggcctgggaaggagggggaagggattgggctaagcccaaggaaagaggggagggattttatttgtttttcatttaatttaattggtttaaatgaacttattattattataattacttctcgagctccgaaaatttgcaggaaaatattagagaatattttagggcacagaaaatattacaaaatattctcgaccaatgatttttaaaggaaattttttaatttccccattatttcacttgattaaattgatttatcttttatttaatttatagacatgcattattaatttatttttaatcccgaacgaaaatcggggcgttacacgaagcccccggaccgggctggttcgacggcaaccaactgggtgcaccttgacttgtactcccctctggtcgggccgaaggggttgtgcctgaaatgttatggggttggctgagttgctaaaggaaagcttgaagctgcgcctgcagagccgaagtcccttccgccattgcttgtggcatttggttgggtggtgaaggttgtacttgggcagcgactggccgaacttgtgactgttatgagggaacgggtgtactgttgcggccgaaggctgcccggcgatgtacactggcgcttgcatggcttgcggcggaagggtctagattgatgcttgcgggtggacttggggtggaatgtagcccaccgaatacggaaggattggggccgaagcgaccttggcttgccgcgctgcctcgtacgcctgctgttgttcttgcatctggcggagcatgtcttggagtcgcgtcaagttctggcgcatggcctccatgtcggcttcagtttgtgcttcgaggttggggttgacttgtgcggcggcgagcgcggtccaagccgtcgccggctgcgacggagcagcttggggtaccagtagctggcttgtcgaaaggatctccgccctggtctggagcgccctcgccgccgcggctgccttcgctgcgtcgaccgtgttcggcaccagccccgacgaagtggctggagcggaaggtggcttcgccctgacagactcgacgtcttgggctcgagcccccactggttggcccggtttcggcaggtccggtcgaagggtctcatgacatgccgccaacacgaataactaataaaacaatataaataatgaacgatataatttataaagcaatgcaatacaagtaaaaaacataattttcacaatatgggattcaacatgttcaagatagatatgacttgccttgatcactcacaaaatcttcggcatcaacggcgatgaacagctgatctatcggaatggcaggatttacacgaccaacgcgaagaaatagaaaaatgcttataaaaaccacatgaacagaagcaataaagcacataaatgggttctatgcatttttaggagaaattagagatttgaacgggtcgattctgagttcaaacggtcaagatatggccatttgaagtttaggtgttgtttaaatggaaatttgcaattttgtgaattatttttctaaaggaaattagaattattgcatcagcgatgagagagggtgcgcgtgaatcgggtccacgggatgggtcccacctgctagatgcatggtccaccgtgagacgagaacaccgagacgactcacggtgtactggcgcacaggcacagccagccagagcggcacccggcgacgaccaacggcgcggcggcagtgcaacggagcacgggaagataaaaacggaaagtggaggaggtgacggttctcaccgagcagacgtgggggcgagaggtcgaccgagatgccgatggcgagggagaaacagcgagaagcttcggattacagtttaggtttgatgaaaataaatcttgatgaattttaattgttggaggctcttttaggcttttaaaatttctagaaatgcatttaagcacgatttaaatttagggcgattttcaaggcgttgcagctcagtaccaccttgtagagggagacctccttataagggagattgctctcctagccactttaaacatgtgaggtggagagaaaaggggaacacatgtgtgcgattgcggcgtgtacacgacatacacgtcgaatggtccaccaaaattggttcctcacccatgcgcacatgcgctctccttttgccgttttgttttgctgcaggaaattcggttttgtttctggaaacacaccaaataatccggtgtgtggagcggcatggactctggataagatacgcgcgacatatccgatttggttacgcggagtggagatcatgcaggcgccctaatcaagtgtcttgatatctctatataaatcgagctgccacctccatgcaacacatgagaaattaatctagggtttgcttcctcctctgtaatgcgtcatcgcttgtagtctaatccatcccacccgccggcgtgcactgatgatcgggagagtatgtctccgaaaccttcgcattcgacgtcttgaaccggtagaaggcggcaataagatttttgataagcgctttgcgtgactgcttgctatttgtccacgacagctcatcttcctcttccctagagtattgcgcgtcatcatcaacactcggtactgtgagttcttcttgctgtgcagccgctcatccaaaaccctcagtacacattcaatatttttcgcatattcgatctgtttatggcttattgtctagtttacaagtgtagattgtatgatgtgattatgctagtttacatctacaatggcatgatttatttctggaagaaattaaatcattatgtgcttatatattcaacaatccaaaaaccttactataggtattgtggttttactatggctggttttgctgatgcactgaggtcagacaaatgcaccagtgtgcacttcatgagatggcagatcaaggtcactctgtggttgatggctatgaaatgcttctaggttagtaatggcaaacctgaaggagttctcactactgaaaagcagaaagaattcgaggaggccactactctctttgtgggatgcctttttaacgttcttggcgaccgtctggtctacgtttatatgcacatgactgacactaaggagttgttggatgcaatgaataccaaattcggtgctactgatgctagcaatgatatgtatgtcatggagcagtttcttgactacagaatggttgacaaccattctgtagttgagtaggctcatgaaatacataccatggctaaggaactcgaactccttaagtgtgtcttacccgacaaatttgtggccgggtgcattattgtgaaactatctccctcttggagatgtttcagtactgcactcaaacacaaaagacaggaatactccgtcgaggggttgattgcatctcttgatgttgaggagaaagttcgggaaaaagatgccgcgtctaagggcgatggtgggcagtctagtgccaatgttgtgcacaaaggtccaaaacaagtacaaagagaaatacaaacctcagcagagcaccaacttcaagaaaagaaaacgaagaatagcagtccaaaccaggatgagagaactagctttgtgtgtgaattgcattgtcatctagaagtgtccacaacgcaagggatgatggcacctgtagggcagtcttctaaatctgccaatgtgacaattgacaacactggagatagaagcaggtatggtaatttacctacagtttttttagttgatcgtatactaactggtggattgatacaggggctaatgcacatgtttgtgctgacatctcgcagttttcttcttatcagatcacacaagattctaccgtcctaatggggaataggtcacatgcttctgttcatggtgttggcatggtacatctaaagtttacttgggaaagatcatgcagctgaagaacatgcagcatgtccctactatcaacaggaatctcgttagtggctcccgtctatatagatatggatttaagttggtgtttgagtctattaaagtagtcgtgtctaaaaatggatattttattggtaaaggctatgagtgccgaggcctgtttcgcttttccctttctaatttctgtaataaatctgtgaaccatatttgtggcagtgtggatgatgaggctaacgtttggcactcacatttatgtcatattaattttgacttgatgtctcagctttccagtatacgtttaattcctaagttctctattgtcaaaggttctaattgccatagttgtgtgcaatcaaagcaactttgcaagcctcacaaagctatcgaggagagaaacttggcatctctagaactcctatattcagatatttttgaaacgaatggggtcttgacaaagggtggaaaacaatatttcatgacgttgattaatgatgctactagattttgctatttgtatttgttgaaaatgaaagacgggctctagactatatttaaatttataaggcagaagttgaaaaccaacttgacagaaagataaaaagacttaggtctgatcatggtggatagtttttctcaaacgagtttgacttattctgtgaggaatatagcatcatacatgagaggacggatcactattcttccgagtctaatgggactgccaaaaggaagaaccacacactaactgacttggtgaatgccaagttggacaccgcgggactacctaaggcatggtggggggaggtattgttgacctcgaatcatgtgttaaatagagttcctaatagaaataaggaaaaaacaccatgcgggatatggattaggaaaaaaccatcactttcttacttgcggacatggggttgcttggcgaaaatcaatgtatcaacaacgaagaagcacaaacttagacctaagactgtggactatgtctttctgggatatgcttataacaacattgcttatagatttttaatagttaaattcgaggaacctgttatgcatgttggtacaattatggagactcgtcatgctaccttctttgagagattttttccaatgaaggatacacatagtacttctagccaatcctctgaaataattcacagttcaatcacaccaccagaacaaattgaacatacaaatgaacttgtcacttaggaggattatagtgaagctcctcagagaagtaa

SEQ ID NO: 11053 - DNA, 3159 bp, Oryza sativa
tttaccgagttcgacatgtatttcacttccgccttttcgattggtgcgactcctagcaattgatccgtagttagaccggtgtcagtaataaattgttctatcgtcatttctttaccggtcaccaatggctcgatctcctggtttggttgctctccaagctgagggactggtttggactttccagaagatgctttcttcagcgttcgctcatagtccgatagcttgatggcctccttgacagatgcagacatacccctgaagaagttcctgacactagggtctataggaatcttcttttctggacttcgagacttgaattgtctcttgacttctgatgcaatgtaagtgtcaagctcctcttgcgtgcaatcgtaccccgggtccttgttcttggcggcgtcaactttcgccttcttcgttgcccttgtgtgggcaggcgatggagctgggggggcccttgactttgaaggtgccggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccggaggagatggtgcacgagacgccgcttgtcgcccagggaggatgatgtaccgcttgcgccatagaataatggcgtggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctaaagggtccgttgggatggccatgcccgacgccaccttcatgttgtgagagattatttattagtaatcaacatatataagaagcaactagcggaatggctaaatcttagctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatctgactcctgtacgtgtggatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctattagtcgtcgcgcagcctctcgtatctgatcgccgaagacagtgagccatcagctgggttgagcgttccaccgtgagcatagtaccagaacttcgatcgttccggccaattggctgttgccggttcgatacccctctcaatcaagctagcctccatctcttcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttctttattccagtactggctgcttccctccgcgattgtatcgtacaatatctgttcctcatcgcgggtcagccatctgttgatacaagaaacatttgctaagtcacgagacatttatgttttaacaatctaagtcatgtatgctaagtgtaaatgtcgtacattagaaccctacaaaaccttacgtgctaagtctaattacaaatcgtgatataagctaagtctatgtgacgtatattatacaaccctagctagtaaataattatatactaagtctaattacaaataaaataatcttatattaaaactcaaataatatgacatgctaagactaaaatagtcatgtatgctaagtgtttcgtgcgtatatgctaagtctaattaagactacaatagtcaattgctacttgtcacaccacttccgtagtcaataattacatactaagtctaattacaaatatagtaatcttatattaaaactcaaataatattacatgctaagactaaaatagtcatgtatgctaagtgtttcgtccgtatatgctaagtctaattaagactacaatagtcaattgctacttgtcgcaccacttccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacagtcttatatgataag

SEQ ID NO: 11054 - DNA, 4628 bp, Oryza sativa
tcgctctgttacggagtatctgcacgagttcaatcgtcttactcgttatgctccggaagatgtgcgcaatgatgaagagcgccaggagaagttcttggaaggacttaatgatgagctttcttacccactcatgactggagattattatgatttccagaagttagtggataaggctattcgccaggaggacaagtacaatcgcatggagcaaaagaaacgccggattgctcaattcaagacacaacaggggaataatcagaagccacgtcttactttaggaccccagtctatgccacagggaggttcttcgtctgttgttcgtccgcagcgtcagttcttcaacaacaatgctggcaacaacatccgcaatcaagctctacgtcctgttgcagtttcgacacagcaacaacctgccaagaaggagcaaggcagcaagcccgtggtgtgtttcaattgtggagacccaggacattacgctgacaagtgtccgaagccccgacgcgtgaaggttgtccctgcccagagcaactctaccgcaccagcatcaaaggcccgtgtcaatcatgttgctgctgcagaagctcaagatgctccagatgtgattttgggtacgttccttgttaactcagttcctgcaacagtgcttttcgattctggtgctacacattcattattatctatgagttttgcgggaaatcatgggatggaagtagaagatcttagacgtcctttgatggttagtaccccaagtaatcaagcactctctttgcaacgtagcccctctgtcagaatagaaattcaaggagtatcatttctggccaatcttatcctgttagaatccaaagaccttgatgtcatcctagggatggactggttagctagacataaaggtgtgatagactgtgccaatagaaaagtaactctcaccagcaatgatggtcgagttgtgactgttcatgcattgtcttctgagtctttaaggtcaagactgaaccagataactttggaagagattcctatagtccgggagtatcctgatgtgttcccagatgatttacctggtatgccgcctaaaagggatatagagttcagaatagatttggtaccaggaacaactctgatccataagagaccttatcgaatggcagccaatgagttggcagaagtcaaaaggcaagtagacgatttgcttcagaaaggatacatcagaccgagttcatctccatggggagctccggttatttttgtggaaaagaaagaccatacccagagaatgtgtgtggactatcgtgcactaaatgatgtgactatcaagaataagtatccactacccagaattgatgatttgtttgatcagcttaaaggtgccaccattttttccaagatagatcttcgatcagggtatcaccagttgagaatcaaagaggaagatatacctaagacaacttttaccactaggtatgggttgttcgaatgtactgtgatgtcttttggacttaccaatgcccctgctttctttatgaacttgatgaataaggtgtttatggaatacctagacaagtttgtggtggtctttattgatgacattcttatctactcccgaaccaaagaagagcatgaagaacatcttcgccttgcactagagaagttacgagaacatcaactgtatgctaagtttagcaagtgtgaattttggttgtccgaagtgaagttccttggtcacgtcatctcagcgggaggagttgccgttgatcctagtaatgtggaatccgtaaccaactggaaacaaccgaagacagtttcagagattcgcagtttcctaggcctcgcaggatattaccggaggtttatagagaatttttccaagattgctaagcccatgacacgactgcttcagaaagatgtgaagtacaagtggtcagaagaatgtgagcaaagttttcaagagttgaagaatcgcttgatatcagctcctattttgattttaccttatccaaagaagggtttccaagtgtattgcgatgcatccaaacttgggttaggttgtgttctgatgcaagatgggaaggtggttgcctatgcatctcgtcagttgcgtccgcatgagaagaactaccctactcatgatcttgagttagctgcagtagttcatgcgttgaagatttggcgtcattatcttttcggtactcgtacagaggtatataccgatcacaagagtttaaagtatatctttactcagtcggatctaaacatgagacaacggagatggttggaattaattaaggattatgacatgggaattcattatcacccgggaaaggctaatgttgtagcagacgctcttagcaggaaaggctattgcaatgctacggaaggacggcagttgccattggaattatgcaaggaatttgaaagattaaatttgggaattgtcagtagaggtttcattgcagccttagaagcgaagcccactctaattgatcaagttagagaagcccaaattaatgatcctgatattcaagagatcaagaagaatatgagaagaggaaaagctatcagtttcttggaagatgagcaaggaactgtatggttgggtgaaagaatctgcgtccccgacaacaaagatttaaaagatgcaattctgaaagaagctcatgataccttatactccattcaccctggtagtaccaagatgtaccaggatctcaaggaaagattttggtgggcaagtatgaagcgtgaaatcgcagaatacgtagcagtatgtgatgtttgtcagcgagtcaaggcagaacatcagaaacccgccgggttgttgcagcctttgaagattcctgaatggaaatgggaagaaatcggtatggattttatcactggtttacccagaacgtcatcaggccatgactctatttggataatagtcgacagacttaccaaagtggctcatttcatcccggtaaagacaacctattccggaagccggttagcggaattgtatatggccaggattgtgtgtttgcatggcgttcctaagaaaatagtgtctgatcgaggcagccagtttacttcaaatttttggaagaaacttcaggaagagatgggttctaagctgaactttagtactgcttatcatccgcaaacagacggacaaaccgaaagggtgaatcagattttggaagacatgttgcgagcttgtgctttagacttcggtggaagttgggataagaatctaccttatgcagaatttttgtataacaacagttatcaagctagtcttcagatggctccttacgaagcactgtatggtcggaagtgccgcactccgcttttgtgggatcaaacgggagaacgtcaggttttcgggacggatatcctaagggaagcagaagaaaaggtgaaaatcattcaagaaagattgcgtgtggctcagtctcgtcataagagttatgccgacaatcgccgcagagatttgagttttgaagaaggagattatgtgtatcttcgtgtcacgcctcttcgaggagttcatcgttttcacaccaaaggaaaattggcaccgcgttttgtgggaccttataagattatcagtagaagaggagaggttgcttatcagttggagttacctcaatctttggcaggagtccataatgtgttccatgtgtcgcaattgaaaaagtgtttaagggtacctaccgaagaagctaatcttgaacagatagaagtccaagagcatctgacctatgttgagaaaccaatccgtattttggaaatagatgagagaagaaccaggaatcgagttatccatttttgcaaagtccagtggagtaatcactcggaagaagaatcaacttgggaacgagaagatgaattgaagtcagctcatccgcatctattcgccagttcttccgaatctcgaggacgagattctgtttaaggggggtaggtttgtcacaccctgaaaattcaaaatatataaattgttgtttaaatggaatttttagaatttattttaaaagcctagaagagaagatctaattttaattaataaattccaatataaaatggggccagataaaatttcattaaatactttgcttaattctataattcgtagatttttctgggatttatttgagctaaggaagtatttttaataaatggaattgcatttaagaaataatttaaattgaaaaaggttttaaaagtcttcttttggctttgggccgaaagtcggcccaaaaccgctctctctctcctcggcccagacggcccagtccgagccgccgctcttctctctctcccgctgacaggtgggccccacctgtcagggtcgtcgtcttcgtcgcgccgccgccgcccgaaaccgtagtttcgcgccgccgccgttcctttccaaatccggccgctcatttccttctccggccgaattgaaagaggggaaatgatccccgagatctcctctaccttttctcctttggaaacatcggctaaatcggtttggaaatcgatggattcgagttcgaatcggatcagcttttctctctgcgagctcgagcttttcatctcgtcgccaggcggcgtgggccttcggcggcgccttctaacccctttaaaaggaccccccgtgt

SEQ ID NO: 11055 - DNA, 287 bp, Oryza sativa
gaggataagattacactcttgcagtcccattatgtggaaaagatcttgagtctattcggctacattgatagcaaggcttctccaacaccttataatcctagcttgttgcttcgcaagaacaagagaattagtaggaatcaactggaggactccaaatcattggctcacttatgtacctagctagcgcaacaaggcctggcatctcttctgctgtaagcaagttgagccggtttatctacaaacacgggatatgatcactggcgtgcacttgaccgagtaatgcccta

SEQ ID NO: 11056 - DNA, 16179 bp, Oryza sativa
  unsure (1)..(16179): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctctacatatttggtagtactatagctgtaccgtaactactacatgttctatgttactacaatttcattaggacattactgtcaaaagtgcagtaacattctatatattttacagtaacgcggtgtgttactgcacttttacggtagtgttactactggaacatagtaacatgttatgaaatttttttataacatacctactttgttctatggtggtaatgaaagatataagaatcggttatcatatttctttatcgcaaagtaagatgcaaaagaaataagtaataatccttaaaactaaacgtgccatggggtgaattggttagaagaacatgttatgaattaagagatcatgggttaaagtattgaattcactaatttatttttttattttttaggaagagaaaaaaggaggattgttcgagggagagaaaaaaaacgagggaagggatggagaaagggagtcggtgccaggaggaggaagggagaggagagggcgccggggaagggagggattgggggtgggcaccgggagaagggatgagagggagagagagcgagagggcgctgggagaagggaggggaagggagtgcgtgccgggagaagcaagggagagggagaggtgccgagaggagagaggatgcgcgtgtgggaagagtggtggggaggatgcgggggaagggtgggcctgatccagatagagagggggtgtagagagaagagatgtggactacaaaattgtaaatagccatagtacggatttcaagacgctgtgtgtattgagaggggagactagatattaatggtgtagtcagtatgaaatgctggattgatcaaagcctactaagggtttattcggttgaaaggatttttaaatcacaagaatagaaaaagtaacggattcggatgccacatatactccaatccataggattttttctaagaagtcttacctcatgctaaagataatgtagaataaggttttaaaactatgatccttaggaatttggtagaatctattcctatgaaacaaatgttgcatagagaaaaaaatcatatggtttcgattcctgtaataattctttgaaaatcctttgaaccgaataaagtccagttatgtccttatgttagagtattaggtgtatgtgtaagttaggtcatatttaacataacttatgttagagtattaggtgtatgtgtaagttaggtcatatttaggaagtttaagattttgagaaataattggttagtagacaacttttgagtatccgaagaaacttggaaaaccatccagtttcaggcttatactctcttcatccaaaagtccagtacgtatattttttttgaaaattaagtctatggtctttgctgtgagatacccaaagaacacgtatttatttgataccataaaaatatgatagtgagctgctggacatccgacgtattattttattatatccagtcaataaggagaaggacagataaacttagataaaaggaaaggttgcccttggggtcatcttgtttaacctgacctaggaccagttcgaaccagacccttgccagtctcagcccggggatagtgcagcggtaagctaggtcatcaacggcggcgagatgtggtgacagcggattcaaatggcgctggcggattataacagcggggctggtgggtttgatcatggtggattcgagcggtggggagcgacggcagattcaaaggagatcgaggggaggcggccggacggcggcagtcggtggaggccagcgctgctgggtggatttttttttcttttttccttaatgtatgattcaatctgtgttaaatgattcgatttggttgaatgtgtggttcgatctgtgttattgttgtgaatgattttgagaatgaatatgttgctgtaaatgatttaggatgaactattgctgcgagtgatctgggatgaactatattgctgtgaatgatctgagataacatgtgtgagatatacaaaatagaaaaaaaaagaaaaaaaaaacttagtcccagttattttaacttaatcccagatttttactcccggttagaaaaccggaaatataaggggttaccaactgagagtaaaatacatttctccaccagtggcagcttcctcatgtttgtccgtccgtccgttccggcggtagagcacctgcattcgtggaggctcgccgaagccgtacgagcttgtaatgcctaaatacgaatttaatcagggaaaaaatctggagggctcggcccatgacagtgctcccggtactgtactagctagtagtgcccatataattatcaacgcgattaacaaaattgtaatctagtttgtgctaataaatactactatcactgcttagataacaatgtggttaatatttgtagttaattgtagtggcacgtatttactgaccgatgcgatggtgatagagagatactggtactagtgaacaaactcccctttacaagccgaccgactaagctaattaccacgctctttcttttcctaatcagggcaaaatggtagtttcgacgctctttctttctccatcttcatcagatataataaaataatacgttggatatccaacagctaattaccacgtttctatagtgtccatgacaagataaagttctttgggtgtctcccagcaaaaacacaaatttttagtgccctgttttttttcctggtgataaaacaaataagtcagacttttggatagagagaatagtttattttctgaattctatagccacagattatcaaaatatagatgagaacatggtttaccttatcgcgcggtaaccgtgtggttaacaccaagacacggtaacggtttttcgcaatatggtttggatgaatttgagcaaattgaaaattatgaaaaaatttgaaaaaaaatgaaaaaaaatcatggatgtagttattgatttagtggtagatggtgaaaaaattttctgaaattgagtaagataaattcaaatttaagggcaaaaccaaaaatagtttagaaattggaaaaagaaaaaatgtattagggttaagtcaaatactggaatacactgtgaaaggttgatgtttattgagatatgaagatttgtgaaacaggtgaaaggtttgctagtgacgctgaaaatggttttgtagagttgatatgttatttatttggtgagtagatatgctcaagtttgttgctcatgtgaaatatggtagtgatgtgcaagtatggattaaaacggagcggatatggacggataatgctcatgccatattcgttttcatcttttttaccggatacgaaaacgaatacgaatagctcgaatacggaaacaaatatggattatctcgaatacgaataagaatcaaatatgattggatacgaatacggaaataattttttctcggtacacgaaaaccaactcaacttctaatagaaacaaatatcaacatatataattagctcattttatataaagtaaagtataatttataaatattttttaaaaatttaaataatattaatagtatggactagtgttaagatattaactactattaaaatctataaaggtatattgaaggttatagatttagaaagaaatggggtatgtctcatggcttctgcggatatctgaatagcactgttcagcggatatccgaattattatccgtatctgacggaaaccccaataccatatccgtatccgtatccgtatccgataactattcgatccgaaaggtatccgtatctgtttttgtccagagcggacggaaactatctgcttcgttttcatccctatgtgcaagtaatgctaatttgtaattattatgctatgaaatattgaattgcttcgaagtacatataatatagaaaaggttatgccgattttttatattttacacccaacagttagatttgtaattatcctacatattcttccaataatccccaatttctacatatatttaagcattttcttgaatttatttttaatttcatgtgttctactacacaaccggcgaaccgcacgaatatcatggttatcaccaaaaaccgcgcggtaaccatgaaaccgctgattttttaaattcaaatttttagaggtgaattttacgcggttttcagcgattaccgtagtaacctcaaatcagtaaaggtatccctggataagaatctaatataattataacttctagaaaaagctgcaacaaccagaagttatttcaaacttagcctttagttggattgggatttgcatcaggtgcagtcacaacagtaacttgcaacttaagaagaagcagtatggcatcatcggatacaagccggacggcctagatctaacgtatcacaccgcactacagcagcaaatactgtagcatggagtactgttcacatggtcagtgtagctacggatctagctagaccgttgatcgtaaaaataaacggccgaagttgcttgcagttgttaagttgcgtaacttgcattcattgcacatgatccgaattcgttggattggtgattgccatgacctacatacagctgtaaggtgcactagtgcacgtcaacgtttgctggaggtgtggccaagtcaaataaaataagaagtcatgtcgtgaagtgtggatgagctagcagcatacgagtatatatatgtataaatatgttactggtgatcatatatattttttctattctaaaatataaaaggttttaggttgatatgacacattccagtataatgaatagtataatgaatctgaacaaactccctaccaccaggtgagtgtttattacttaccggagtaagtaacggttgtttgcacgtactagtctgtcctaaaaaaagccaaactctggctataaatctggacacacatgtgtccaggttcatagttaggattggacttttttcaggacggaggggtagataagtgtgttagtgggcaattaaccacgtgagtgttgtcggctaggtcctgctgcctgccagtcgttagataagccgttgcttgattggtgtgtgtgcctattaagataccccgcgttttactgtgcgatttataaatgtgtatatgttaaatatttttgaaatgatcaaagttaaaatgttgaaacaataatgtgagcaagataatttgacacatacttgttgatctctatataatataatattgtagatgatgtgtcatgtttgcatgggttttgttagtgagtgaagaagtggcatgcttgcatgggtttttaaatggactaaaatagtaattactagtgggtgatgatgtgatatgcttgcatgttgagttttagcttctaataattgttaatggtaccaactatatagaaagtataaattaagtatatgaaactatagattaagtatgtactgtaaatcatcttgttctgtgagtgagtgaaaaggaaaaaaaaaagcactggtgtgctgcagggtttaccttaccgccggggccagggttaccgcgccccggcggtaagcacggttaccgctcggtaaccgcggtaaccgtgaaaaaccgtacaaaaccgtgcaaaatttatcaaaaattcaaattattttttaaatttatttgtatttaaggaagttaccacggtatttatattaccgtacccccgcggtaagcccggtaaccgcggtaaccgcgcggttaccggcggtgagttaaaccctggtgtgctgtgcagcagcagaagaaaaagaagacctccattgtgtctgcgcttctctttcctgagccaaacacggtgtgttaatgtgtgggatcttaattcttaattgttcggacgaatttttgaataataagaataatcaaacgttataaaaaaaaattaaaacggtaaatattttggaacggtgggagtaattgtgagctgggccatggaggacagaagccagggggcggactggcagaggcaaaaggccggagacacgaggagatgggtggccggaggagttgcggagagacagcaaggggagcgaattttttttatttttaattttttttattaaaagttttacaaaaataattttctattttgaaaattgacggaagtagtcgcctaccgccctctgggaaggcgatttttaaaaatcgccctcctagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgaggggggcatggaattttgcaggcggcccccttgccgccctcggcgagggcgattttgtactgtgcggggggccgcctgcaaatgggcggcgagggggcatggaattttgcaggcggcccccttgccgccctccgcaagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactatgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacactctttgttcgatcatcaaccgatgtaaatgtatgtaggtcatagtacatattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataacttgttgacttgaccaccctaaactctctctgcaaggaaactgcccaatgcttcaccgccttcttcatctcatccttatgagcatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcacaaaagatgtatgggagcatacctgtgatgaattgagcgaaccagcagggcttcgccgctccccttctgctgccctcccctctctctcttttgttttttttggatttttagtgaatataatgaaatttcacagagaagggactgggctttatagggggagaggcaaaaatcgccctcccccagggcggcaagggggccgcctgcaaaattccatgccccctcgccgcccatttgcaggcggcccccccccacagtacaaaatcgccctagcggagggcggcaagggggccgcctgcaaaattccatgcccccctcgccgcccatttgcaggcggccccccccacagtacaaaatcgccctagctgagggcggcaagggggccgcctgcaaaattccatgccccccctcgccgccaatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgattttctcccagagggcggtaggcgactccttccgtcaattttcaaaatggaaaattatttttgtaaaacttttaataaaaaaaattataaataaaaaaaattccaaggggagagacgtaacgaccgtcgtttcaacttcgtttctcactattacaaaaatcagttttacaaactgtcaaaagtgatttcacatgcggccaatgccaaccgcatgcacccaaaaatctgcgaaaatcagaccgcatgcaaaaacaaattctgtgaaagaaaattaaaaatggaaaaaacccggccgaaccctagcccgccgccattgtagacggatccgcgcggggcggcgccgctgctaccgcctgagccagcacccctgcgcatcagatgcgccgccggctgctggccccaccacctgccgtcgctgtcggatctgtcgtccccactgccctctgtcatcgtcggcatcacatccccgcgagggagggcccctatgctggatccgcgtgggacaggctactggcgccggttccaagccaaggaagcctgccgtcagccaatgtgcccgaggaagcccaccatcagctgcacccgaggaagcccaccgtacccatgtaagcccgctgctggccagctggcagcgccgcccatcacacccaaggccacccgccgtcggccagctgagggcccttggctgctttctcatcgtcgtcgtcgtcggcggtggcggcagtggtagtggtgccggggatggagccgcccgctcccgaccgcacgcctcctcatcgtcggcggcagcgctaccgcccgtcgctgcccactcaaagggagagagagattgagcagaggagagtgagacgagaggaggagaggagagaaagaaaaggtgaaaaaaatttgaagtggtgacgagagaaaaaaaagaggagatatttttgtatgcggatcacttaaggacctcacatgttggtggaggtgtggccaagtaaagtaaaaagtaccgcgagggaaaagaaaaacctccaccagtgtgcagtgccacaaaataactttcgtgtatgcgtttatcattcctaagccaaacaccgtatttgtgttagcactacttaaaaaagtttgttctggcggcactcttacacggtttatacggacgtggcttatagaaaaaaaccgcctacaacctagggctcataaaatcgtgggatttgcattaacaaaataccgactgctcatgggaggttctctcttaaaagacccgcccataaaagcgaatttttagtttttgattttatttttagggaaaagaaacctgattttttttttgtatttttagatctatttggggacccataattttacacgtaaaatataggatttgaacctagtaccttacacttaacatgtagtctccatatgactgtatcatctcacctatgaagcagttctgtgactatggggatgctgctattctttcaacttcacctcttacaaaagctgtaatatatattttatactccctctgttttatattgtaagactttctagcattgcccatatttatatagatgttaatgaatctagacacacacacatatatatatatgtgtattcattaacatatatatgaatatgggcaatgctagaaagtcttacattataaaacagagggagtataataaatgttaatctagacataatcttgtagattgcgccaacctatacaactttgatgtagaccatatgtcacaccctgaaaattcaaaatatataaattgttgtttaaatagaatttttagaatttattttaaaagcctagaagagaagatctaattttaattaataaattccaatataaaatggggccagataaaatttcattaaatactttgcttaattctataattcatagatttttctgggatttatttgagctaaggaagtatttttaataaatggaattgcatttaagaaataatttaaattgaaaaaggttttaaaagtcttcttttggctttgggccgaaagtcggcccaaaaccgctctctctctcctcggcccagccggcccagtccgagccgccgctcttctctctctcccgctgacaggtgggccccacctgtcagggtcgtcgtcttcgtagcgccgccgccgcccgaaaccctagtttcgcgccgccgccgttcccttccaaatccggccgctcctttccttctccggccgaattgaaagaggggaaatgatccccgagatctcctctaccttttctcctttggaaacatcggctaaatcggtttggaaatcgatggattcgagttcgaatcggatcagcttttctctctgcgagctcgagctttccatctcgtcgccagccgccgtgggccttcgccgccgcctcctagcccctttaaaaggacccccggtgtctcctctacccgccgccaccctcgcctttgcctctcgtcgtcggaaacgccctagcgccgtgtgccctagcgccgccgtcgccgccgtcgctccagccgtgcgccgccgccgttccagtcatcgtcgtcgctcgggaagaccgccgtcgtgctcgccaagtcgtcgccgtcctcgtccgccgcttcgccaccgtcggagaccgccggagcatcgtcgccgtcgtcaagccgaagagcgccgccgtttcaacctcgtcgccgtcgccgtccgttggtcttccgccgtcgctttggtcgccggtgagttcgtcgtgccgtccgctacccgttggtgccctccgttcgtgccgaagcgtcgccgttcgccggcgagcgtgcaccgcccgagccgccgagctgccgccgccggtggtgacgtcatcgctgacgtcatcggggccgttcgccgttcaccggttgtggaccgatcgatctcggccgtccgttttggatcaagtcgatctcggccgtccgttcgcgtgaaccgccgccgtgcgcccggtccaccgaaaccctagcccgctaacgcaataaatcctcttttccttttcaaaaataattcattattgcgtcataattcaattaaaatcaatttaagtgttttaatccgatttaatcttcaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcccgtttaaagctattgtttcttttcaactattgcatttattttcgaatgttattgggtggaattaacctattcattgttatagcccttttgttcttgattactttattccttgataccttgggttattataatttgactagttgagctttatttatattggttcaactagatattagatataattgcttagccctgcttagaaacattagctcacttctgggataacttatgactcactattacttaatgatggcttaatgatagctcacgatggacaatcgtgattggttaattaattaatgtgccaactaaaacctggtaatggtgggttttgagcatatggttttgagagtcgtgctcatgacaattaaggaccggttcacgagtttcggttgtgaaacattaaccgtgccagccacaagccagcgtgggcaacggctttatcttttgtatagcatggttcattgcggggcaccagactgagaattggcggagataagcccacgggggtcgctgggagtccatgccttgtttttaagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggtgggtctaacaatgtctttcgtgattagtctcacccttctcaccatagtaaatgatgctataactggtaataatttgatcagctcctggtttggaatggtatattcctggtttggagatagaactgtgcagccgggatggttgttcagaatggttgggcctatacaacagggtatgttgtgtagcgttggattaatattgtttaatacttaactgttttattaaattctgaaatatttgctaaatgctgcttttgcaaaagaaaccctactatgccatcctttggtatccttgtgcacttgtatatttgctgcgtggcttgctgagtatgtcatatactcaccttgcaatcattcatcagaggaagagttctacaatgatgctgatggtgtagaggattaggtgtagccttggtcaagctgcctatggagtggagtcgtctgcgccgtttatcttatttttttccgctgcatagatctttattgattgagaggaactatctacctctgtaatgacattttattcgcttattaattagagtaataattgtactatattatcaatttgttattgtgtgcctcggctgattcctggacgagggttcacacacatgtaagcgtttggaattttggatagaaattccgggcgtgacaccatatctccatcctagctcatttgaaaaagtttaaaaaaattgttttgcaaaatagatccgggagtttataatgaatatttgggtccctaaataatattaaattaaaaaatatacaaatactaagatgtagatctcgttaactggtgctcctatttttcaagggaaattttcttaaagataactgttcgtgaaaatcaatttttacgggctttccatttccaaggataattttcttgaagaagtctggctataatgtataggtcaaaagcttgtaaggaatatttagacatctaatgatcgcatatataaaacctttcaactatataaagttgtagatcgtgtcaagatatacagttttactagacaacatgtctcccatccaacatcgtttggaaaactaaaatataatctcaaaaatagatgtgagggcaaataaatgaatatctgaactcgtaaacaatctcaaatgaagaaactttcaactacaattgtagatctcattgagagctacaattttcaatagagtttgtaatcatctgaggtcgtttcagaaaaataaaaataaaaatttctaagatagatccgagagagataaatgaatttttgagagaaatgacctggaagtacactggtggagaaatgctttttagtcccggttcgtaacccccctgtagtcccggttttccaaccgggactacgaatccgggactaaagatcgctatctttagtcccggttcaaataaccgggattaaaaatcgatctttagtcccggttggtaacaacaaccgggactaaagatcgagctgaccttttttttttttggcatggccctgttgctgcatggtttatatatatatatatatatatatatatatatatatataaaccatgcatatatatgtttcaatacatatatatgcatacatatatatatgtatatatatattatattatattatatgcatatacgtgcataatatatatgtatttatacatatatatgttatgcaaatgcatatatgtatatagatatatatatgaccaaaatatatttacattatagaaaatgtgtacacatgcatatagaaacatatgtagtcatgtattaattacaatacattatatgtcctagctagctacgatttcgacgtagtagtagtcgctgatagctcagaagctaaggaccggtgaattgtgtttccgtcgtagtagaattcacccttgggatcaaggatttcttcgttgatgaatcccatgagttgttcttgaaccactgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtagtagccacacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacttccgcctaagtctttctctctatttgccgcggaccaaatgacggaaccgataccaagccctacatggagtttaaagctatgattcgtagtagcaattaacataacaagattttcttaattaacagaggaacttatgacggtacctgtctataagttcaaaaaccttgtcaaacgtagactcttttttatccattgagtcatatacgttgacggtgcaggccgacaggtcgaagagtaaaagcacccagtggaatctgcaatgtgcgtggggtgcattacatatgaaacacttagcaagttcgtacgggaatgaaatttggtatgtaggaagacagtaaaattgaactaactctgtgttgtacggcaatagtatgaacgtcttgtaatgctgcgccttcaggagatggacgagattgtcctctgt

SEQ ID NO: 11057 - DNA, 2407 bp, Oryza sativa
agaatggttgggcctatacaacagggtatgttgtgtagcgttggattaatattgtttaatacttaactgttttattaaattctaaaatatttgctaaatgctgcttttgcaaaagaaaccctactatgccatcctttggtatccttgtgcacttggatatatgctgcgtggcttgctgagtatgtcatatactcaccttacaatcattcatcagtggaagagttctacaatgatgctgatggtgtggaggattaggtgtagccttggtcaagctgcctgtggagtggagtcgtctgcaccgtttatcttatttttttccgctgcatagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttatcccagtgttattagtactgtacatctattactgtactaatggctcattttccagcaaaagttttacaatgttattttatttaatcttgctgcaataaaataaatttagcaagttgattttataactttcttttatttcttttgaaacctgttattcaaaagtacaaaatttgtaaccatgtttccaactgtttcaacttatcttgcaagcttggtttactttatttacttacctttttactttgattttctaactttattcaaattaattcaaaaacttgtgctattaattggataaatgtcttaactccctcctttcacttgtctttagatgccgcgctacaagcctgagtatttgtttggtgttgagggatttgtccaggagttgcgtacgatgtcttttgtcattggatttgggactgcccctttttatgcccagattcctcatgatcgtcatgaagagaagtgccgagtcaaagtcaccttgaacagtaatagcgaagatattccctcagtgatgttcgaagctggaggaagaaactacatccatgcatgtcaggaggtggcaaggatcgccataggagagcttcgcgatcgctacagtgatcagttggccgacacggagtatcgctaccatcctcgccaaccccagggaagtgaccgtggcagataccttgagactgaaggaattgagaatgatgctaccacaaggcatttggttgagatgctgtgggctatggatgaaagccttgcggagactgtgttagcagctcaagatcgtgaagaccggaatcgtggtaagatttgcaagttagaggacaaggtggatcgtttggagaaggaattagctgcgttgaagggagaagcaccgccgcagaaggccaggattcgtcttaccgcaaggaagagagctttatttgttcctcactatcaattggcgccaaaggtttgtgtggtggagaaagaagttaccccagctctagcggatcctccggtcatcatcataagtgacgatgaagaagaagaatccaagcgcacccattccaagattgagtgggtagcaactcaagatgatgaagacgagccgaacgagccttcaatcgacctccgatgctcggaagaactagagtgacttgttaagtcgctgtcttagatcgttgtgttagcttgcttgttttaagtttggttgtgtgtgtctcgcatgtgatttacatcagtggtgggatgtaagtgcatgtgtttgtttgcttttgagtgttaggaagttggtgagtttagtggtgtgagagtcttcagttttgtaataatgaaactcagttaagatcaataaaagttaaagtaattctctgtcctaagtagtttcccccggtttctcctcttgtgccctgttcatgccagatggtgaacactcgtagcaacgggaatggccccagtaacaataacaacaacaatggagagaatcccacacttgctcaagttcttgctcaacagactcagttaatgaacatgatgatgcagcaacttcagaaccagcagaacccaagaaataaccatgcacttccccagaacacgttagcagaatttcttcgtgtgaggccgcctattttttctagtaccacagatcctgttgaagctgctgattggctgcataccatagagaataagttgaagtggcttcagtgcaccgaccaggagaaggtctcatttgcatcacacacgttgcatggcct

SEQ ID NO: 11058 - DNA, 517 bp, Oryza sativa
ctgcagcccgttttgacttgtgattatttgttgatgtgatgatttgatgatgtgatgatttgtgatttgtcatttgtcatttgtcatttgtcatttgtcatttgtgggatcggcttgacggctcgaagcatcgagctgatttttttttttggctcatgtgcgcttcaaaggtgccggttttgaaaccggcacctttaatctttcattatctgtgccgcctccatggtgccggatgggaaaaccggcacctaagggggtttcctaactggcaccgacttgggattctgtagtagtagtgatgtctcatcatgattgatattgacggatcgtggggcttctcaccgggagaccgtgcaggcccccctttgccggttcggccgggggcgcgaagtgaggttcttcaccctcgatctgtggaatgttcgcgagagagcaaatgcacgagacacgggcgatgtagacaggttagggccgctgacaagcgtaataccctactcctgtgttatggtggatctgt

SEQ ID NO: 11059 - DNA, 466 bp, Oryza sativa
ttcgtttttaataaaaggcaagtgtacaacaacagcaacaattcatgacaggtgggatacctatatggcatattggcatctctttcttcagtatggattttaaaaatgtttgttgtgcatgcatggaaatggtacatcaggagtgaagttccattctacatctacttacataatatatgtacaggaagaggatattgcacaagatcaacagatgatgccatggaacttatgtatggggaacagggaagcatttgttacctttattagtctagtatgatttctgggatgggtccctttagcttcctgcaccgctgtttgaacttctcgttccagctagctctgacatctagttcttgcagtgaactggggagggcacccttgggcagcgaccggatggatggacagccgatgatctctaatctcttgaggctggtaagtctatgtagccccgcagggaggcactgca

SEQ ID NO: 11060 - DNA, 739 bp, Oryza sativa
caaattaatctgttaatcgataccagtcccaggatacagtgctggtatcacaggaagacagaatatcacagcaacagaggtctctttattatagagtagaggtacagtcatgttgggctgcgaacagatcccgagctcacaactgcattacaaaagggaaacggaagccaggacttggaccaaacatcacaggcgcgacttgggaactaggccgaaaccctaaaactcatcgtagccggcttgctcctggaagaactcctcatcagcaggatccgcttagctgatcccatcagctgcagatttttcaaacatcgaactcctttccccaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcaaccacgtcgggagacctccaagctttcatgacaaggcatttccaaagccgacacaggtttaccatatgccgacgagaggggtcccagaccaacaacaggttaggtcctagaccatactgtgccaggaagcctaggggtcctccctgacaccaccccggcaaatccacaagtctctcggcatcaaggctcccctgataagctagtactcagcaggggtgcccattccaccatgtgggcggacttgc

SEQ ID NO: 11061 - DNA, 25578 bp, Oryza sativa
  unsure (1)..(25578): unsure at all n locations
caacaagaatagttttaagacctctattatggcgatagaaaactgtgtggtctccattgcactgtttataacccataccacacattgcacgtctaaagcgatcaaaccatgctcttggtgattgtttaaggccatataaagattttttcagtctcaacactttaccttcagtttgtgaggtagcaaatccaggtggaatttccatatacacctcctcttgaagatctccatgtaagaatgcattcttgacatctaactgatgcaatggccaatcaaaattagctgcacaagagataagagttcttaccgtgctcatctttgctactggtgcaaaagtttcatcataatcaattccatatgtttgactatatcccttagccacaagccttgccttgtatctttccacatttccatcaggattttgctttactgtataaacccatttacaggtaaccactttctttcctttagggaatggtacaaggtcccatgttttggtcttttcaagagcctctaacttctctagcatagcttgatgccaccttgggtcttggtttttttccttccaatcatttggaattccacttngattagtgatgtcacaaaggccttatatgtggatgacaaagaagcataagagacataattggctatgttattctcatcatcattcacaccttgagctgcaaaaccatacttttgtggaggtttacctgcattgcttcttaccccctttcttatagcaataggaagattagtttcttctccccctgtttcaaactcctctccttccgtatccgatgaaatctgtatagtatcacactgatcagatggtttatcacctacttcagcaacaattgaagattgttgctgctccatcccatccataggagactcatgttgccctattgtttgcgcctccaaagaccttgttttcctcctagtataaacttgtagattttcttcttcacatggccttctccaattttgctcatgaatgggttcactaacaggatatgggattgagccaaccacaaatttcatgcttcttgattatgtgtcttcttcagtacctgatgatccattctccccctcttgtccatcctcatcaataattggattgtcaagatcaacaaacaaggaactcaaatctgttctttctccatagaacggaacagactctctaaaagtaacatccatactaacaaaagttcgccgctcagatggactccaacatttatatcccttttgcccagaagagtaacctataaaaatacacttgacggctcgaggatccaattttccaacggatggtctatgatctctgacaaaacaagtacacccaaacacttttggaggaacaatgaattcattcttcccaaacaccatttcatatggagtcttcatcccaagtattcgtgatggcatgcgattgatgagatatgttgctgtcatgactgcctcactccatagaaactttggtacattcatcgtatacatgagtgaacgagttacctccagaatatgtcgatttttcctctcagctactccgttctgtggaggtgtgtcagcacaagaagtttgatgtactattccttctgctgagagaaaactcctaaattcatcattcacatattctcccccattatcgctcctaataactttaacacaagtgtttaattgattcctaacccaagcatagaaattcttgaaacatttcaatacttcactcttgtgtctcatgagatatatccaagtcattcgtgagtggcaatcaataaaggtgacaaagtactttgctccacttaccgaagcaataggagaagtccatacatcagagtgaaccaacacaaatggcaaaatgcttcgaagtcctctgcttatgtatgtggttcgtgtatgttttccatactcgcatgcatcacacattaatttgcttttgtccaccttactcatctcatcaggaaataccttagacatagtatcaaaggacatatgtcccaattgacaatgttttagaatcaatttagcctcctcttcacttgtgctagctaacaaagcactacatagtgctttgtccgtccctcttctatccagataccacaacccattatgcctaacgccggttccaagctttcttccagttcttctctcctcaattagacaattctctcggtcaatagtaattcgacaatccatatgatcaaccaacgagcttacggatactaggttaacaggaaaagagggagcatataaaactgacgacaatgtaattgatggagtacatttgactgttcccactcccctcacatgtcgtaaagttccgtcggcagtttgaattgtttctttaaatgatgactgaaatggagtatatgatgtaaactcactcgacattcctgtaacatgtctagatgctccggagtctaatatccaagttgagttaggtacctgcataggatgtgcgagattaacaaagttgccaagcactgttgttttctccttcactttctgaattcttccccttatttcttcaacttcttcagccaatttctcaagtatttgctcaattccttgaatttcccccatggcagatcaaccaaatcttctaggatactagccaaatcaattaataggagtaacaacactactcctcagtttctcaccaaaaacagaacagcagcagtagcactacttcctcccagcagcactacttttcagtttcccccaaatcagcacaacagcagcagcaagccaagctctcgtacacagtttcttccccaaatcagaacaacagcaacagcaaaccaagcttccacttcacctccaaatcctcaccttctcaagtagcagcagcaccagcaacagcaccaccaaagtcaccaccactggaacggacaacaatagccaatagcaccaaatccttctctgttgatcctacatccaacagctgcgcgtctctcagccgctgtgctccctacagcttgtgctgcaccaaatccttgcgcagctcaaccagcgagcgtgcgccctgctcctccttcacgctgctcgcgtcgagaacctctgcagcagccgtcgccgcctccgccgtcgacactgccgctccgcctccgctgtccgacgtcgccgctccgcctcagctgtcgacgtcgccgcagaaccgctctggtcacagcgccgccgccgactagggttcgcgtcggcgaggtcgccggtgacccagctctgataccatgtagttttgtgatttttcctctagaagcttcacttcatttcctttctcatctactatacatatacattggtggaatgggccctattgggctgaaatacacacgcctacactcaacagtgagtattaatgaatcaacatgagcaaaccacatggctgcacaggaagatcagtaatagttcacccaactcagataagacgatgactagtttaaatcaaccggataaaaggatgtgtggtgcaaagaaatgcagtttgttctgctagtagtactgtaaaggttgtaacaatgataattcaggatcattgagtggtagatagtttgcccaaacattgttgatttgttgtttaaatatgtgttcaccaccaaattcctacaatcaatccctcgaggaaaaataaatcctacgatccaagcacacgaagacatagaagtttcaacgatagtaatcaaaacattcttagcaatccatacctctggaagtttatcgagcgggagttctcgcattatgccagtagaaatatcacctcgtcgcggtggtgcgtcaattatttttgcagatgtgcccaattcgtctggagataaaaaccaactattagattccgaatttgataatgtaattcagacaagaactgctaatttgaacaaaccaaaataaaggttaatttttccacgaacgcacaaaaggattgcacgtcaatatattagaagaatagagtttttgttacacgacgcactcagccagatcggcctatgccaaggaaggaagaaaaacaaagataaaaaaaacaaggaaggaaaggaaaaaagaactcgatacaacggtaactctactccaaacagcgggagagggcagagccactctacgctcccaacaattccccaaaggaagcgacggccgctaacgaccacagccggccctccgaaaggatggactctagaaccactaagaccgaagagagcacagagtcaaagaccctggagttacgttaaaataaagagtaaatttcacaaaactacacgttttgtggtccaagttgcagaaaactacacacactttgacatttggcacttaagtacatatattttgatagtgtagtttcacaaaactacactatcaatgaatgaattcacacgcgagatgatgtggctgttccacctaggacaaggacgtggcatcgtgggacaagctggacttctatgcgcatggcccactaaaactgctgcaactaaatatacgcacatatgtgccttccaatctgtcacgccccgaactagccccgaccggaactagcccgtgacgctccaaattaacctgttaatcgataccagtcccaggatacagtgctggtatcacaggaagacagaatatcacagcaacagaggtctctttattatagagtagaggtacagtcatgttgggctgcgaacagatcccgagctcacaactgcattacaaaagggaaacggaagccaggacttggaccaaacatcacaggcgcgacttgggaactaggccgaaaccctaaaactcatcgtagccggcttgctcctggaagaactcctcatcagcaggatccgcttagctgatcccatcagctgcagatttttcaaacatcgaactcctttccccaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcaaccacgtcgggagacctccaagctttcatgacaaggcatttccaaagccgacacaggtttaccatatgccgacgagaggggtcccagaccaacaacaggttaggtcctagaccatactgtgccaggaagcctaggggtcctccctgacaccaccccggcaaatccacaagtctctcggcatcaaggctcccctgataagctagttactcagccaggggtgtcccattccacccatgtggtcgtacttgccttatgtttggatgaaattccaaggaatcggtccttaagtgcgagagtgggaaaccgtacacccggtatgttccccggtccgcggttttggaaattcatttagttcgcaagcaccgacccaggtgtcgggttttccaagtattttgtaaaacccaagttttacccaagttgttattcagatattaagtttgaaggcgtccgtcgatactcgcacagggtgcacgaatatcgagacgcaactagatggttacaagggttcatgatataacaattaacgaaggaagggtcaaatgcaacaaattaggtaggtccgccaatctgccttgcagacgagacaacagattaagtgcgatcctaacaatgcataatatttttcaagcaacataattaaatttcaaatacaggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagttttgaggaattttggaagttgaacggtgtcaaacggatttacggatgggaagatattgaatttctaagattattggatttttggtctaaaggaaaaggatttaattaaatcctttttggaaaagaaaaagaaaagaaaagaaaagagggagggattatagacttttctcgggcggctagggcgcggcccgagagaaagggcggctcggccgagcttaacgggccggccggcccaagaaggcggcctagagcggcccaagacgcgcgcgcgcgggagggaggagagagagagccggtggaccgggctcaccgcgtgcggtcccgggtgggacccgcttgtcagtggctcggctcaccgtgcggagggagcacgcggcgcggcgctagggtgggggaaggactcggtgcacgcgcgcggttcgcggtggacgcggatgcggcgggcccacgcgcagcctcacggctcgcggtggaacgcgcgcacgggaggggctgaccggggtcggcccgtcccgacctcggctgagctggtgccgacgtggcgcctacgtggctcccacgcgggccggcgggaggtagacgacgacgccggccggaacggacggtggtcgacagcggcgagcggcggagcgaaccacggcgatacaggcaaaagcgagcacaccgggtggttgcacgtgacgaggggagacgagccaacggttcggattcgccggagggagcttgacggcggcgaatcgcggcggcggcaaccggcggcgggaaaaggggaaaacggcgacgaggtcacgaggggccaattcccggcggcgagagcatctacgcggctacgggaatccgatgctagcgtcggattgggcggaactacgccgagcgaggccggcgacgagcggcgcttccgagctcgggcggcgacggcggcgagcacacggcgagcgacggcaacggtcggggcggcgccggctagctacggggaggctactcgtgctaccaccgaaaactaaggggggaagatggagcgaggaggaagaacggagggaggcactaccgtgcgggtcggggcgcagtgacgagaggccgacggcgcgggagtaatctctccggcctcgggccgaggaagaggaagaagaggacgcgcccgaagtccccttccgcgtcctagtgcgcaccggctcctccggcacacacgcgacggcggcggtcggcgagagggacggcaatggcgcgggcgagaaatagggaagattgggaggggaaaagaggaagggagggcgcctgggtttaaagggggcggcaatgtcggtttggaaaccgactttgggcggtcaaggcgcgagctggcgctcggcgcttgcggccaaaacggcgacagaggcggatgacgccggcgaggaagaggaaaaggaaaaagagggagagaaagggggcttgccccttgccgctttgggaaaaagggaggagggagcgggagcgtcgcggcagagggaggagggctcggcctccgtcccttggcggcttgcgcgcggagtggcggggccgaggcgatgacgacggcgatgacggcggggcggtttggagcggcgcgacgacacgggcgacaggcgcgggctggcgcggtagagggtgacggcggcggcgaccaggcggtcggccactcggcacgcgcgcgcgggatacaacgggcggcgcggctgggcacgcgcgctggctcgccgggccgagcggctgcgcggctgtgggcgcggcagggtagcgggaccgggcgacgcggacggcgcagacgacacggctcgggcggggaaccacgcgggcgcgcgcgcgaacaacggcgcgcgggggccgtcttcgcgagcggggagctcgccagggatggggagaaggagagcaaggagaaggggcgctcggcgcgggcgactcacgcgcacgcgcgcgcggcgcgcgggcggagcggagggggagcggggagagggagagatataaaacaaccgggagggagggagagatgggccgagcgggattcggcccatcgaccccgggggaggcaaattagacttttgcggaggaatttgatttggagggatttggatttggaattgaactcgacgatagatcggggattgagatcttgagatggcacggacactagacaacaagcgaagaaacaaatttcgcaattagggtttttcagagataattttcccgctaggcgccacgacggaacgggcgctacacaatcccagcacgatatgttaccaaggattttattctgtgacttgttttctggtcagtgatcacctttctatatggttgttttgagtttattgttcttgcactatttgttgagctggttattaagaatacttgttgatcaaactagatgtgtgaacatgtctaatggagcattataccatttttatttcatttcaaagttccatgagtttaggtctgtattgtgcttaccacaactgaaggttgtgcttggtttaggagcactttcctgcagacatgaaaggagccacctactactatctacagccaaactactgtgcttctcttgtcaagttccagtactacaagctgaatggaacaatcaattaactcaaggggttatagccacaaacttcagactcagtgatcctttccactgaagcgtaatttatctacctgaaattaagtacaatagtggactgactgtaaaatttagaatactagttccctgtcctccccttatagctcccatgttttgtactactttcatttcagaggcattagaaacctccatatttgatgaattaactgttttttttaacaaaatcaatcaacagtgaggcaaaaaactacaaacctatgtgaaatttcagttggaacttgctcattcacactagattttttagaaaactcactatgaaatgggcacctgattgattccttggaccaaaaaaaaagaaccaaactatacctgttagtagcagaatggcagagccaccatagtactggaatgagacacaaggggccgcagtactcgaagaggcatgtagccagcgagttgcctgctaactccagatctcgagcatagcatgtattggagagagatgaccagaggatggtgaggggccgccgggagagatgatgaggcctagcgaggaacctcgtggcgcggcggcgaggggatagcagtgagaggaaaggcgctggcttgtggctgacatgacgacgagatgcaggccgaaggcggtgagagctacacgatattgttcggtggtcgtcgatgggcggaaatatggaacggccgtccgcgccggcgctgacaagcataggaggtcatgcaaaaaattaatagcataggatgccacgtcctcgtttaggtggaacagccatgtcatctcacggtggatttattcattgatagtgtggttttataaaacaacactaccgaaatatatgtacttaaatgccaagtatcaaagtgtgtagttttctgcaacatagaccacaaaacgtatagttttgtgaaatttactctaaaataaagttaatatttgagcttagaccagacgagagttaacaattgccttctgtttagatagcaccttaagaaaaaaaaagtgtagtttaggtgaagaaccaaccaggttattaaaaaaaaagagttgtttttttttcaaccgccgcccctccattaaaaaggcgtctcacccaggaaaaaaaaggaacagatttttcttcttcagacatatgaaatgaaccctagaaacagcggaatcaacaatctctgtataggaattagatcaaagacttgaggacggggaagcatacttatttgaagttcatggagaagctgcatcgtcctgcacttgatggcacgagtctccatggttccacccgatctcttccgcttgccgttcatatactccaccggcaaaaaaaaaaatgcctcttgtagtgttgagaatcaaaatccagaggcgctctgtttgattctcttcttctcttgcctcccgagttcagattttgaaggagttagcggttaatttggcatcctgcgttcgaatcggaaaccgactcgagagacggagcaatcgggagaggcaaaactgaaaaaaaagaaggcgaaaaatatcaacatggaaaacgaataagaaactataggccgaaataattaaatcgaaaaaaaactgattagggaacaaaaagaaaatcacctacctgtagcccgccttggcatccgagatcggcggcgccggagctcggttctgcgctcgtcaggggatgctcgttgtccggtggataacgacggcgagcggcggcgaggcaatgaggggaggtgggagtgggactgtgggagggacagacacctctccctgctgaatttttcacattttgatccttttagaaaaaaatattttataaatagatctcaaaaagttttttaaagatgaaaaagtttttttaaggaccaaaaagagaataagggtatgtttggtttcctaccatactaaaatattggtactaccaaattttttgtgctattggtatattttgatagtaaatcaaacattaataaaggcctgttcactttgataccaaaaaaaccttaccaaattttggcaatgccaaaaatttggtatagttgctaaaattttggcatgatttcttatatagttacaaaaatttggcagcaaactaaatgtagccacttttttgacaattttatcaaaacttggtaatattgaaaatgtcatcaaagtgaagaggcctaaaaatatactattcaaagtgccaaacaatttgatagcacatattttagcttcaaaccaaaatggccttaagtttttctaaaagaccaaaagtttttctaaacttattcagacacctctcactgcgtgaataataagtttttttaaaggaccaaaaggtgaaaaatcagcagtgagaccgactcagattaatttttttttttttagaagccgactcagattaaataggagttacatttcgtacgtgttatccaacggcccagagtgcaacgtgggcctagtttaatgggctctaattcggctgaggcccatcatacgtccccatctgtaaactcactcgttcgtcggaggcgacggccatggcttcgccggagctcgccgccggcgatggcagctacaacttccacctccgctccctctccgccgcatccagggactccgccgcggccgccgaccccgcctccgaccccaacctcctcgaatccgtaagcgcatctctctgcaaccctggccccttccatggtcttcgaatcagggggggtgggatgtgctcacgttttggcttgttgactcgtgtgggctttgcggcgtgaaggtgaggagggtgtgcgagatgtgcaaggaggccaagggggccagcgacgagatggtggcccgggcgttccctgtgatgagcaagctgttccagcgctgcgccgccgcgccgacccaatccgtggcctccagcggcgtgctgctactcgtaagctgtgcttcgattcactgatgtgaagtttttcccccatcttggctgcaaatggttgttattcttacatgttaggttggaggacgatatcgttgcaatgttttggtagttttgtgaaatgtttgcatctttaggggcgagcttgctctaatgttaatggttaaccttatgatccccatttgaccccatataatcattctctgtggacaattgttggtgaatagaatcatttagatttgattagtaatgtacacacatttttagtcatcatatatttgaagaaaaacctgtctaataatacatactgtattactgctccctacccagaccattctgcagttcttcctggactttggggaggcagtcctgcatgatgctgatggtagcttgaggaccttcttccgctcttgcctaagtaggtaataatttttcttgatgtattgggtatgcgattgtttatttttattttcctgcttaccctcaatcacttggctattctttcttgatgatagggagttcgctgatcctattgtcgcagaacgtacacttgaattcctgatagcgaataagacaaagatcctgagctcttttcccacattaattccacaggtgccataccatataatgttatacagcactagaattatcaaaatatctacatcttatgtcaactaccattctttatattgtcagttagaattttttttgcataaatgtagctctaggcttctactggcaagggccaatgaatcaagcatacttcttgaaaagatctcaatccaatttcctcctttcttttttgacttttctgttttgttctctttccaaattactatttaatgatgttaatatttggcaatgctttcgtgatgctgtctatgtgcagttttttccattgttgctgaagctaattgcatcaaatggtgagaggtatgccatcttaattgctcatgaactcctcacatatttgctgatattttactgtgtaaatatgaagaagttcattctacctctttccagcaatgatttgacctatctaacttgggtttcctttgttttagattggagaggaagttctcagaagtgcttccgttaatgatgtcagcaggatcttttcttcctctcttcctgtcccttatggatcttccaagtaagccttctgattccagacttccagaattttcctctagcttctttagattgtgcaaggctgtaaacttcatgattttagaagctaattagccaagtttattatgatagtgttattaaactgttgcatgtgctgactgctgacatctggggcacatctcttccaacatgcgagatgcatgtaatgtgtataacatgctgctactgaggatgcttatcctgtactattatgctttttttactaattggtgtcatttgttctattgcttactcatggaacaaaacagtgttagtggtagcattggaaaaggtggaaagaagttctggaactctcatcggtagtagtatagctactatacagaagagtgctgctcctgaggttgatttccgtaatgatttgacctaaaagctgtaaatgaaatgtcacctatcaaaactaataagcttgctaatctttttctatcgtacagatgctacttgcactaatggatgaagcatacactggttctgctatagaagatgccattggcaatgcaggttcggatgatagtggtcctctagaccttgctgacccgatgttccttgatcttctaaaagatgagaatgatggtattgctgtaagtagttccttgaagtatgtgttccatgttcttcagtgaatgccttgatctagtcttctcattttctgatgttttcctcaggcaaaacattggacatctcctacgatatcttcaaccttacaggcagcagttaatagcccacaatcggacagattgaaacagtcactgaaaatggcacctcgttttcttacattatattttgctacagcattgcgggacgttaacgactgtatgttgcctatctttgttaattgctatacatactgatgagtgatgaccaacatatttgtgatttgaccctctactatttgtcacttcagcactcctatgcgctctgattcctgtagttatgtcaagatatgcagcaatgttccctgacaaagtatactccttcgaggtaggcaagtgggtgtccttttcccattgcgtctaatactgcgtctaatactggagtagtaactacagtactacggtaagatcattgaagtgcttacttgatgattgaaccgaagtgcttacttgcataggaaactaaattttagtcagcaattaagaatcaattcctcaagaaaacaattgatgatacacccatctatttagatatacggcttatatagttttttttaagtaaaattgttaattgctaaagctatcctaaaagttgaaatttgtggaacgtatacattacattggagtgtctaacgaacaaaatggaagaagtaaatcatgttttcgaattttcttcacatcatatgtaccttcagtacaaaaggatggtatatgttcgtatggggatttatgtttggttatttccacaattctatatcacccttcaaacaagttccttgcaataaaattgctgtaggtgaggaaaagactttcagatttcatattggctgcattccagcgctcccctgacatcattgcactgctaaaggtactgggtatacatataactagacatgcatatacatgtcaattctctgaaccaatataccatgtttgtagcatttctttttctgagagtgaatgttgtagcatatttaagcaacaaagtaaatatctcctttttctggttccactaaaaattttgcactataatttcaaaccattctacagaagcccattacagacagacttggggaggctcatgataatcctgcaaaggcaagtatatgttttaagtacattttgattttataagttcaccaaactgctaattttcacctgctctcttatcctagttctgattatcttaaatgattaatactcttctccacatcaactgagttttctgatcgaatgtgatttatttacacagactgaattagcattgcatttgtgttgggccattggtgagcatggagctggaggaaaaaatcgcaaagatgtagctcgtgaactgtttgaaaatttggagttgctgttatatgaaaatctggctaccaggtgggccctgttaaaccagtcttttttttctaaacttgcatggcatctcttttgactgacctcttatctcttgttgtgaagtcgtttgggattaagtcaggacacaggatttgatcctatgggtgcatcttctagaaaatcatctcaagctaggctcctctgctttgtggtgactgccatagcaaagctagcaacgttccataatgagttgcttccaagagcacgtgtatcattggccaaggtaggccctaatccttccagtttgaggaatattaaggtttgatatattactgtcaccactcattttcatcgtttgagcttgtaacttactttcgtacaggtcgctcgttcccgaacctcggacaggagagtgtggcaacgtgcttgtgactatttaggtctattgaatgaaccggccatttgtttatctgtactaggaccatccaccgcacaaggaaatggtcctggtattgtcaactggagtgaaggaggaacaaagatggtagctcacattccgttctacctgttagctgaacaaaaaggtaaaaaactcttttagcaaacttatattgttaaatgtggagtaagcatcctttcatgtttgttaccgcacaaacatgtttgctaggaacaaactccatatgtaagtgatatatttaagaatcaagttgttttgaaaaatgccatcctgagaaaactattaaaatgtgtttccgttaataagccttttgtaaaatgaacacacgagttactccagaactcaacttgttttgcaggtgcaccgatccatgatttttcgtttgacgatctcgtccccacggaatgatgtactttcatgagtgcaatggattcatacaatgattccctcgcggacatcatctgtgctgactgccgaggcttttggtggtaatgtcatgaatcatgaagatccaagtggcgtctcttatgagtttatccagttcattattcagtctaaaggcgagctaagttgctttggatgagaccgtatagtttctgggaactgaaatgtttgttcatggggtgaaggttatggcagaagcactcgagtatttccatgtagggattgtcgtatatatgtaatcttttgaagggtaatcagtgatgtaaataataagagtggcataaattttatcaaggagtattaaattgattgtgctgttttttgggggatatgcgacagttctgatagaatactgttgaaggcaatgaaatgcaagtcatcttacacaactctgcaactgctggaaactgaaattaacatcgccttcattgaagcagcaaggaagaactaataacaagcacagcacacacaattttggattgaaacagcactgatcaaacactgaagagaactaaaagtataagacagggacacagatctctattctgcaactcctactagctagctaggtactgggaagtctgaacaacagaaattacagatcaaattaaggggttttttttgtactccagaagaaccctaaattcataaggtagcagcatccgagaggcgaacatgaagaggaagtcaatacccgaaccaaccgcccttgcgtagtggtgacacattttttttgaaatttcccgaatttgcggaaaaactagcgaaaaataatccaaactatatatgggcaccacatggcaaggacagtctgaggtgcgttcttgacttcccactgatgaaagctccaaaattttgctgctcctgcacacaaacatgatcaaactcatcagaaattttacagatatacctctcattaactgatgcaattaatctcgcaagagttctgaagtaatttggtgcatttgtacctgaaattgaaagcacaagaagcttttgtttgattcaaggacgaagctactgcggattgctctcgccggagacggccgccttgatgcgctccaccgtgcaggcgatgaggctgttcaccgtcgccaccgaccccagcgagagcttcgccgtcgggacggagtccaccagtatctggaacgccaccgtcagcagcgacccgccggagccgacgccgacgccgccgtcgccgtcgccaccgtcgtgcgccggcccatcgggcaggatggcgaagcccgatggcagcagcgcgacgtagtccgggtcgccgccgtttagcacgacgttcatcgcaaccacgtccaccggcgcgtagatgacgtacgaccccgacgcgtccgtgcagctctcctgcaggatcagcatgttgctctggttcgagttcgagctctgcaatatatatttgtacatgaaacgggatcgatcaatacatcgcgcattatcgcatgctcgtatatatcttgcgttttgatcttggatgaattgctgcttacgttgacgcgaagaagtgagacgcagttgccctgatcccggccattggcgatgtgggccatttcttgaacgataccgccattggagaggatgtcccactgaaaataaatttattttcaaagtttaagattttgtaatttttttcgcgaactaagagtttgtaattgtattcttgttaaccttatcatggatttataggtattctatctgtttaatattataagtcgtattgacttctttcctagtcaaactttattaagttaaataaaattttaaaaaaattaatagcatataaaatattaaattagttttattaaatttaatattgaatatattgtgataaaatgtgtttgctttgtattaaaagcgctactatgtttttttttacaaaattcatctgaataaaaaacaaagcgactttttttttgacgtaaaagcgacttatgatataaaacagagggagtacctcactgcgagaggattcgtcgcggaggaagtcgaagacgcgcttgggagggacggggagccagaaggaggtggcggcgttgaggacgatgccggggggcctcccggggtcgtcgacgctcttcctcgtcatgacgcggacgtcctcggcgccgctgccggacagcgtcgtccactgatgcgccaccgacgccgtcacgccgccgcagaagctcaccaccatcctctccgccagcttcagcatgctcttcctcccctccgagctcgtaatcactgcaattatattcattcattcaacaaacacaattaaatccactgcgtggtttagtgattgaacatatctgaattttaatttcgttttggatcaaattaaagggtgaaattcgctgcatgctcgatcaattacttaccgccgatgtcgctggtggggatgttgctggccatgacgctggcgaggcgctcgcactggcggtccagcgtgccgacccaccgccgcgcgccgaacgccagcccggagttcaccagcagcttgtagatgttgtgcaccgacctgtcgtccacctccacatgctccacccacgtcacctgatcatacaacaatttcatcagttttccatgatttctgaacagcaatatatcttgaattcagaatttcagatttgatttgtgatgatgatgatgatgagctgatgatggtcaccttggagtagccattgggcatttcttggatgaggcagcctgacggacggcggcgacatttgaggacggggctagggcggaggctgtccagcgagacgtcgacgacggcccatgtcccgtctgcgttctgcttgcagtatctcacgaagtagctctctctcgttggcaccagtggcgatggcacctgaaactccactgacatctgcagagaaaacggccaaaaccaacacaattttgtcccatttcagtgaccaacatgtacacacttcgaattctttggtactaccgaatatgacagaagattcagaaaggagacaaaatttttaagacaagcatgaacacataccacttgcaatgcaccgttgtagttccccgcgacgccggtggacagcacctccagcgtgatggccctcgacacgatgttcgagaacactgccgcgtactgattctgcgcaattcactcaaaatttgaacgaaattcagaccccaacaatcaaacaggatcataaaaatcaccaaactaaaaaacattcagacaagaatagcgcactgactgacagaaaattaaccaagagcttaccgcgtccatgaggatctcgacgaggttggcgtgcgtcatgatgacgacggcgctgtcgcgggacgcctccgacctgagcccgtactgcttggggccgagccctcgggggaacatgcgcgcgtactcctcctcgctgagcgtctccatcgccgccgccgtggcgtcgagcggcggcgcgacgctccagagcggctcgtccagctgcgccatgcggaccagctcctccatcgccgccacggcgagctccacgatcatcggcttgtcgacctccgactgcaccccgcgcagcagctccccggcgccaccgccgccgaacatgtcgcccggcacgccgtacggcgccacggggaggtccagcggcgcccgcgacgccgccgccgccatcgggttcgacagcaccgggaacggcaccattggcttccccacgtacttcgccgcgatcgccgatatcctatcgatctgacaagcacaacgacacgatcagcgtgcgacgatccatgcaatggcggtgtcaccatgatcgatcgattgttcagatatggtgaaaactacctcttcgcggaggcgggcgttctcgatgcggaggtggtgctcgtcgaaggacatctcgccgagggcggcggggccgccgcagttggggcaggaggcgctgctcagggcctccttgtaccgcatgttctcggcccggagcttctcgttatccgaccgcagctgcgagttctcgtgcctctcatgctggttctgcactctccccaacacatcaaatcacacaccatttttactcaaatttcaagctaaaaacttcgaaaatctttgcaacggattgacgatgacactatgacagtgtgttcgttcgtgcaaactgttaattccaatcactgtacacgtatgcagctaggtcagcaaggtaggggaagggtttgactatggaggacggacggaggcgtaggcctgcaactgccacatttggcagtgtgcaatgcagaagcggacatgggggtgcgtgggcaagccttgtccagttatagtaatacgccatgaatgcgtcctgcaggagctaggtcagaggcttaaatgaagtggttgtgacgacgaggaggaagaagaagacgacgctctctctcttctctctatctcgcaagctcgccttctttccggccgaaattttctcaaccagaaatccaaagaatccgttgcatttgcactcgcttgcaggttgcaacgtcctgattaattacacgtacatgtgtttcctaaaaaaaagaattgtactgctacgaacacaggtgaaagaaaggtgaaaatgatgagcagaatcaacaactatttgggtgattaattaggttttttcaccttcatttgggtgcgcttgttctggaaccagaacttcacttggagaggctccaggccgagctcccggctcagctccttgcgctgcttatcatctgggtgtggacattccttgaagaatctgatcagatcagatagatttagaacagatgaaccgagattaatttaattctattagtcatcagtaagttaatagtacgtacgaattaatgcatccaggaaaaataaattagaaggggaaatttttgaagttcggttgaacgtgtgaacgcaaaattcgtactacgttcttgaatgcttcgtcttccgttttgtttgggggagagtgcaaaagaacaaaaacggttttgatcaacgagtcaactttatgcagttcgtccaggggaaatggacgggcaagagaaatcaatttgacttctacgcaagcttacatcagtccatgggaaattaattaaagacagtataattaaccagctgttccatttgtactcatctcctcacattgatttcagtagactaacacagcatttcatgcgtaattttctgaattagaacacccatgaataacattccaagaacaagctagctggggcaaaactgaactgaactcaaatatgtcacatttctaggacaatcaaacaaagtatatactatatggaatcaagaacacataattaattaagtaaatagctatgagttgagtgttattacgcttccatctcctggatctgatgctgggtgtggcggtggtagcgcttcttgcgcggccgctggttggggtcctggtcgtcgacggagacgccgtcgacgttctcgctgccggacttgctctcgaactcgtcgccgccgagagggtcggacgcacggctgcggatcatgttgtcgccgctctccgccgtcgtcgccgggatctggtcaaggagatgatgctgctgctgctgatgctggaacgcttgctggaactggtgattatccagcaagtttggctgcgaattttggagcagatcgaattaattgaggattagtatgcgtgtgctacataaagagcaaaacttagctaccaatttggtaccacagattacgcctttacagtagtagtacctatttattccgtgcgttttatacatggcatatgcattaaatagatactagacaaagtggagaagttcaaagttttgtggaaaagatagaagaaaaaattgtatgcatgaacaaaaacaacccatattgataactttctcatttctgcaaggaaaaatctggtgtgttcatacttcataaaaacacagaaaaaaatttggggataaaatggaagattgctttaaatcaggaagggatgaggagacaagctaagtgaagaaacttttctccttttttgattccctttggtatatgcagaagatgtgaaagcaagcttgcaaagaggaataagaaagaaagggtagctagatcgatatgtttcttcttcaagagtgccacaacacaaagacccaaaaagcttggaagaacaaggaagcaagcaacaacaaacctgttgaagatgatctacaggtttccctctcaatatgtgtgcaagatcagcaacttggaaaatctccctcctctccatagtcctatctatctatctatcagctgacctgttcatctgctccccttatataggagtagggagaggagtaggccagtcttaaagaaagggaggctctcatgtactctgaatcttatgacctaatatgtgtgaacagcaaccactaagtactggagataacctctttctctcccctctatatagccccccttctctctctctccacaaccctgaaacttctcattttccaagaaagtgtgactaattatcttcagaaacttcagaactgaatgtattgctttttttcccctcttctagcttttcatctcaagtagtaacacctcaaattaatcaaacacaagaaagagaaagaagacgcaaaaggtaaaaatctagcacagcaaaacgctcaaaagtctttggatttttcaagaaaataaaaggaaagcaggccaccccttgaaattaatttcttttcagctcaaattcctgacaaaagaaattctttacctggctgagtgacagtgccgatgaggatccgtacgctgcgccgttccggccgatcatcgacggcatatgcctcgccgggatcatcattatactcctatatctcaaaccctaattcttgcccttgcagctccttccatttccactcatgaacacgcgtatatgagtgtgtcccaaacccaaagaacacacaaagtgctagctctaaatatgtagggagatagaatgatagatagatagatatagatatatatatatatatcttgcttgccaagcaacgcaaacgcaagtagaaacagatctagcacacaagctagcccaacgaaccttgctgcagagaggagacagccagccagtgagatccaagacaagaactacatgcaaatatagaactcttatctctgctttgctgtctctcctacctgcacaaaagaagatgtttcaccgggtgcaaacaacaaactgcaaggttcagagggctagcgagagctagagatcacacggcaagagatcaaggtgagatcttctcgatcaggatcaggaggaggagaggaagaagaagaggagaagaaaaggggaacacaggtggaagagaatgtggagaggggggcgaaggagttattgccgcggagtgttgagagggtgcaatcgcatttatggagaaggcgtagtgtaattgctaggggagagaaagagatggaaggggagagagagagagagagagagagagagagactagtggtgcatggtttcaactttcaattccaatttttgtttttatattccctcaattgaggatatggagaaattagagtgtccttttttgacttattatttattaacacaatgtcaaattgacatgtaatatagtgtttgtacaacactggatttttgggagacctcatagccaagaacaataaaacattttttatacttcctgaaacatttttttaaacaaattttgtttttatatttcctcaattgaggatatggagaaattggagtgtccttttttacttattaacacaatttcaaattgacatgtaatatagtatttgtacaacattggatttttgggagacctcgtagccaataacaagaaaacattttttttatacttcctctaagaatttttggttatgtacctccgagatacatgtatagtcagaaactattatatttttaatgaaagtaatacatgtcataaattaattaacatttccttattgttaccaatttgtcgcttttttttcatttatctgaccatgaaacagttgtttggcaatcctacacgcaagagcacatgaataattcactgttgccccgtaatttatacaacgaattattatagaccggcgtaataattgagtggtggagaggtagatttttcactactgtttagtatagatgcagcgtatagtgcggcccaaagataagaacaaaagaaaacaggaaggcacacacgtatcgtcgtagtctacatatattttgttgactctcgatcgatactgatcagttactactaggttaatttatttgttttatatatagtacacacaaatacacaatcatagtattgtattttttgcaactttgtgattaattacatgcatgtataggaggaatgggtcaaaaagtatcctgtggaagaccagcttgctgctgtttcactatgcatgcaaactgatgcattttgactcgagtattttacttatatttttgggagtcgatcgatcagattttaaggagacaccatgcagggtgaagagatcgatgttttcactgctgtgccctgggtacgtactgttttcatgcctccacacgcctcatgcttgtttggtgtagtctttttcactctttctgcactggagtatatagccagcctttcttgctgagaaaaaaaaatttatgtgaaaaattactagcagaagaaacgtggcatgtactcgccatgtccacgaatataaatatgtttagggattttagcgtaaattaaggttacggtgaaattatttcaagatatcctcttaaagtatgggctcgccgatcccgattcgaaactcacccctcttaacaaaatttcaatacgagagccccttctctgatatccaacatttcttttttatttcacgatgcccccggcctcccgagagttcactttatgccgggattagtttcaaaataattcttcaaacttccaacttttctatcacatcaaaactttcctacacacctaaacttttaatttttccgtcacatcgtttcaatttcaaccaaacttccaattttaatgtgaactaaacacatccttaataagaaatatcatgcccagcgatgcaaactagtgagaaataatttcagtggttaattaggtgggttaggaaaataatactcaagaaatgctaacaaattttaaacactaaaaatacgtaggatggagggaataatacacaattatatcatctatacatgagtattgtatctacttgaaattaaattattttaaaaactcatgcatctaatcaagtgagaaataaccacaatcaacctttcaaaacagtatgcaaatccctcaaaatcaaagttgtaaaagataaaagaaattaatggataatggtacactatataggggattaggaaaaaaaaaagaacactactaatgagaggcatgtccggcttcattggttttttctatgagaaatgttacggctcttaaaaaagtatatatattgaggcatctaaattttacatttaaagtaatttttataccgagatagctagtatagatatcaaatttcacactaaaaaaatagtatctcctaatatcttctcaacaatggaaaaaattacctctttttctagactctgattgattgacctatgactaacaagccattgagaaacgaacgaagcaaatataatttatgggttaaacttatgggggatgctagcgcgcgtgcgcgcaagggaaaggagccggcgcgcgcaccagctgcatccctacgcgtttcttttttttaagatctcctattttaacgtcacttttttgtttccttttttaaatcgcttcttttttccagatttttttaatcgcttctttcttttccacacgcgcgaatgatttttttttttgatattttataaattcaatccttcactgtagcgcccgttccgtcgtggcgcctagcgggaaaattatctcttaaaaaccctaattgcgaaatttggttctttgcttgttgtctagtgtctgtgccatctcaagatctcaatccccgatctatcgtcgagttcaattccgaatccaaatccttccaatcaatttcctccgcaaaagtctagtttgcctcccccgggttcgatgggccgaatccagctcggcccatctctcccccgggcccccctttttcttccgggcgctctccctctctctctctctctctctc

SEQ ID NO: 11062 - DNA, 13550 bp, Oryza sativa
  unsure (1)..(13550): unsure at all n locations
agccgctttccgcgcgccgtgttcgcgtgcgcgcgcccgcgcggacgccgcccgttgcaagccgcgcgcgcgagccgagtggccgaccgcccggtcgccgccgctgtcagcctctgcgcgcgcctgtcgccggtgtcgccgctccgctccaagccgtccccccnnnnnnnnnngtnataaangncgtnatcncccggcccccgccactccccgcgcaagccgccaagggacggagccgagcccatcctccctttgccgcgaagctcccgctccccccctctttttcccgaatcggcaaaggggcaagcccctctctccccctcttttttacctttttctcctcgccggcgtcatcctcctgccgccgctttggctgcaagcgccgagcgccagctcgcgccttgaccgttcaatgccggttcccctctcccaaaccgacattgccgtccatttaagcccaagccctccccctccaaactccctcatttttcgcctccgcgccattgccgccctctgtttcgccgtcgccgatcgtcgttgcgcgtgtcggaggagctggcacgagcaaggacgcggaagaggactccggccgcaccctctccttcctcttccctggcccgaggccggagagtttactcccgcgccgtcggcctctcatcacagcgcccctcctcttctcggtgatgtctctctccgttcttcctcctcgctccatctccttcccctagctttcggtagtagcttgagtagccttcccgtagttagccggcgccgccccgaccgttgccgtcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcgacctctcgtggcctcgttgccgtttccctcttctcccgccgccggttgccgccgccgcaatccgccgccgtcgagcaacccccggcaaatccaagccgttggttcgtctcccctcgtctcgtgtaaccgcccggtgtgctcgcttttgcccgtatcaccgtggttcgctccgccgctcgccgccgccgcccgccgtccattcgcggccggatcgtcgtctacctcccgccggcccgcgtggcggccacgtaggcgccacgtcggcgccagctcagcccagaccgggtcgggccgaccccggtcggtccctccgcgtgcgcgcattccaccgcaagccgtgaggctgcgcgtgggcccgccgcacctgcgtccgccgcggaccgcgcgcgtgcaccgcgttcctccctgcccgcgcgcgtgcgccgcgtgctccctccgcacggtgagccgagccgctgacaagcgggtcccacccggggccacgcgtggtgagcccggtccaccggactctctctcctccccccgcgcgcgcgcgcttgggccgtcttgggccggccggcccgttaagctcggccgagccgccccaaatctcttgggccgcaccctagccgcccgagaaaagtctatattccctccctcccttcttttctttttctttttcttttccaaaaaggatttaattaaatcctttttcctttagaccaaaaatccaataatcttagaaattcaatatcttcccaaccgtaactccgtttgactccgttcaacttccaaaattcatcaaatctcgagatctatctaatggcacgcttagaggtcattaatagggctttattttcgctgtttgttgagttgttccgtttcgcgtgtagtttcagagcccgaagacccgcagtgcgaggatttcgaggatcaagctccagatctcgagcaaggcaagccacctttgaacatcttgagcctataattgaaatttaattatattgcttgaaaaatattatgcattgataggaccgcacttaatcttttgccccatctgcaaggcagattggtggacctacctgacttgttgcatttgatccttccattgttaattgccataccatgtccccttgtaaccacccagttgcgcctcgatattcgtgcactcagtgcgagtatcgacggtcgccttcaaacttaaaatctgagtaacaatttgggtaaaactggagttttacaaaagacttggaaaacccgacacctgggtcggtgcttgcgaactaaatgaatttccaaaaccgcgtaccggggaacgtaccgggtgtacggtttcccactctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaataaactgttcgaacagccgtgcccacggtcatgggcggatgtgaggtgattcctagcgtagttttgtttgactaccgcttgtgaaattgctgttgagaaaatgggttcgatgtttgaaaaatcagcagctgacgggatcagctaggcctgggtggccgtttgaaaagttgttggcccgggtggccgtttgaaaagttgttggcccttgaaaagctgttggccgggtgccaatcttgtttcaaatctaaagactgatacattgcacatactccgaccggacgagacgcactgtctcatccgtgtcgtttgagaagcactcatttagtcgtttttagaaaaaaaaaagggagttcaaataaaatcaattgcaaaaacaacagcctctccttgaagcctgcattaaacacttatttcccctggcttgctgagtacccacgtactcacccttgctctatataaataatccccccccagttgctgacgaagatgaagcggatcctgctgatgaggagttcttccaggagcaagccggctacgatgagttttagggtttcggcctagttcccaagtcgcgcctgtgatgattggtccaagtccgggcttccgctttccttttgtaatgcagttgtgagctcgggatctgtccgtagcccaacatgactgtactcctactctataataaagagacctctgttgctgtgatattctgtctccctgtgataccagcactgtttcctgggactggtatcgattaacaggttaatttggagcgtcacgggctagttccggtcgggactatttcggggcgtgacattcaccttcaccttcaatatcagttgagagttttgaatttgagttgaaaagtttctaaaatttaagttgaatgttttgaattttgagatgaaagttttcaaattttatcaaatattttgaattttgaggtgaaagcttttaaatttgagctaaaagttttcaaacctgagttaagttttcaaatcttgacttgatttttttaaatttgaattgaaagtttcaaatctttagttgaaagttttcaagtccgagttgaaagttttcaaatccgacttgaacgttttcaaatcgagttgaaagtttttaaatccgagttgaaagttttcaagtttgaattgaaagttttcaaatctgagttgaaagtttttaaatttttacttaaaagtttccaaatctgagttaaaagtttctaaatcttgaattgaattttttcaaatattgactcctactcttagacgtgtgtggtagttaacggcaaaaaaagaagaagaaaaaaacaagaaagaaacacggcagttgtgcctaccgaaaaaaagaaaataaaaaagaaaaaagaagcgcgcagactcggtcgtaggaggacccgccacgtggcacgctcgcgacttggagaagtcgcgcatacgcgcgaattaggattcctgtaaacttatatatttgtattgttgacgttttaataggcaaggctgaacgttaagataggaaaaatctcaaagttaacttaaaactaacattcgaaatccttttttttttttgcgggcaacaagccaacaagactataaaatcagagtgccatagagtagtggccatagtgtaaaattaaagaactggtgtgcttaattagattactggttagcctctatgggcaattaagaaaaaatatgttgttttttctaagttattcattgtgtgattataatttaattctatatatatatatatatatatatatatatgatttaactaggtcatgctaagtatgtttccttaaagaataaatatgttgtttttttataagttattcattgtgtgattataatttaattcaagatatatatgatttaactaggtcaacatgaagctgttctatatattttctgactcaaattaggaacatcactgttccagtgggtgaccatatatatttattacgagaaaaagaaactaacctcttaatttaggatccagtatttgttcatgtaattaatttagtccacagatagatgttaacacatggtagcgtataagatagcacatattgatcccaaattagctgtccctgcctttcggattatttgatgttgacgagatacgacttctacaaatttaagataggattaattaattaccatcaattgtttcctggatatatatagcgtgactacatgagatggttccatattaagtggtacatgggagtatacacatcttgttcatatagcagggtcaaagtaattataacaggggtctccaaaaaataaagcttcttataacaaattaatatatagttataactgtgtaattacaaactgtctaaaattaatttcacattgtaaattatatggcagaaacattttttttttcaatttgcaacccaacagtacgtgctagctgtcccaaaaaaacaaggttgcttttcttgagctagcttagcactggctgtctctggctcatcatcagtggttcagtactatacaggaccccatattaatgaaataaataggcaacaggcaccccggccagaaaacatatttggactttagagagtgtcaaagttaacacaccagcaaagtcaatcgaacatgccaccatttatgaaacagaaaccataataataatgcatgatcaaacacataataatatacacctaccaaggtcaggaaaccattaatatttttccctttagcgtgttgtcacttatgatcttttaggtgtgttgccaacctggactcgtttgtctccttttgcatacggtttccgatccatcttacgtaggagtagtagccaaaattaaacatgtgcgtaaaaaaaaacttcaacttttgtacagaggctgcgtttagatctaaagtttgtttggatccaaacttcagtccttttccatcacatcaatatgtcatacacacgtaacttttcagtcacatcatctccaatttcaaccaaaatacaaactttgcgctgaactaaacacaaccagacatggatgaatgcttaattcggctgcttgtttcttttaacatatagtccgaccatcatatacatactggttattcgtgttctctgttctctgttctgtagtactagttaaaagttcaatagtttatgtgtacagtcttaagttaatttagtgttggcctaaactgcacgcgtaccataataattccaatatttctctgttgcatccttccaggtatcgagatgatgacggggctagtgatgacttgatcgatcccaggtttacttttgaacatatagattttacaggattctcatagaatcagtacattttattcgttaaaaggacacctgaaaattactgtttttgtttaaagggcgcgttgttcctttgttagtgatgcacgcagcacacgtatataccacaaatgttggaggagcgtggagctgatctcatgtcagcagagagatgcttcgattttcctctctttttgtcgctaccaatatactctaatcgtatgatctacggctgataaaccatgaaaatcatgaactagcaaccaataatttataaataaatcttttatatccacttattccgtcctaaaatataagaagttttggtaacatcatagtactacaaatctgtacaagctctttgtccaaattcgtattattaggatgtgtccaatccaattaaaactttttatatttgggatggatgaagtatattattagtgacttaaaaagcaattgctagaaaataaattactaacatagaaaaatatacaaagtttacataagattacaatttaaatataaattttagttaagactaatgaaccaacaatgagacgaatctatgcgaaaagaaggatgaaaatggagggagtacatgtagtagtactcctccagtagacagaagtgaacggatcggtcatcgatcgtcgatggtatggacggaacggtggatggatggttggagacgggagtacgtacgtaacgtacgtcgactccatccatgccagccattgccatgcccatgcgtcacacatgagatgagctggagatcgagctcatcagccgcgctttccatggcgtccctctctctctctccattgaatggtctctgagcaacaccgcgtgaggtggacaccaccaccactccagctccagcagagacgagagagaagatggaagagagaagggagggggccgcatttactacgttcatgcctccctcgcatcgccggcccaatgccgccacccaccgccgccgtgcaggcccaccccacgcgccgcggatgtgtctcacgcgcctgtggggcccacctgtcagggggtgacgacgacctggcaatatatgctcatatatcgaatcgatggatggatcgatcggcgcccttcatgccactgttttcgttctaagagatccgtcgtcgtcttctactagtagggcctgttaggtttacaaaactctcaaactatcggtagtgtcaaaacttaaatacgttctgttacgatagatttttggtaagataaaattgtatttggtataaaaaaccaaaattttttattagaatatagaaactaccaaattgaacattggcgatactaatgatttggctttaaaccaaaacaaccttgtctactatgtattcaagataacaagctattagtaggtcatgttttggctttaatcaaaaacagcctgtacttcccatcaactctctttttcgtcgcatctattggtaactgattatatatataatttttaaagagcccaaacaaaaccatggttacaattgtctgaattatgataccaatagactgaataaaaccaagtcgttccacttcatttcacctcaacgtatattcttgtaaagcaaacaagcgaacgacccatcatgtcgttcgtcgatcctaaatacatcatctgagcattaccgatagacggttaaaaataaatccccttctctaataggatttaagggatgaaaatattttcacctataagagagaatctaatttaaactcaaaaaaggtggaccacatatgaaacttccaaacaaaatcgctcttttcgtactcccgtgtgaaaactctccaggtgcgtgccaacttggcgattgggagcaaggctgtgtttagttcacatcaaaattgaaagtttggttgaaattggaacgatgtgatagaaaagttagaagtttgtgtgtgtaggaaaggtcgtgtttagtttcaaaataatttttcaaacttccaacttttccatcacatcaaaactttcctacacacacaaattttcaacttttccgtcacattgttctaatttcaaccaaacttctaattttggtgtgaactaaacatagcctttgatatgatgaaaaagttgaaagtaagaataaatttggaactaaacatggcacaagaggtgcttgcgacttgtggagagcagcatttaagaagaaaataaggactaaaattttaggattgggagtagtatacgataaattgtacacccgacggaacagctcccggactacgacacagctcccggactatgacagtccgtgtagtctgggagttggttccctgtaatttatcatatactactcccaaccctgataaggcttcgccgccaatgtcaccattgtcaatcaccaaaaaatgcccttaaaaattagccggcaaaaaaaaaagctcttcgtcacccaggctccacgagtccacggcaccggcgccgttggcttggctacagcactattctctttccgtgcaccagcaagcctgacagtggttcattaacatagagatcgatatataggaagatcacgtagaattacatgtacatgtctactgctcctatactagagtactactatagtagctggctatagggcgacatggtcaagttctgatccatatatggttgctgctgctgctgctgccttaatttgcctgccaatctcgtaacagatatgcaggtcaatctgcacggagcatgcatacgtgatgaactgatgactcggtcagtccatcgattgatcgatcacgattcactagcagccagtgcattgaccattattcactctcatttaatttcctcggtttttcatctgttgaatatgatcgatctgattgcgaggtgttgtggagtaattcattccccatatggagtatgtgtgtgcatttcgtcctcctcctgactcgctcaaagtgtagtagtaatagctatgcagttaaggattcaggagattggggcattgactggcttctgaaatggaggttgaagttgaacaatgagacttccagtgcgtaagacctgtaactgtaattcattaatacgagtaactggttagaagaggtcaaaacggccatctctcatgatcaatggctgaatgatgcctcactttctggactactatcataaatgcaaggaattgaattgaagtagaaactagaaagtgagtactggtattattacaagattgaacacttcaatttgttgtttagcaaatttgcacatccacaattgacaccaaggcaaattcatgtggtacagagtacttgaatactgtatcaaatgaacttttagcttagcatttgggaagccttacccttacgacgatggtcacctcaccagctcacctcaatctgccgctgcctgccgtgcaacaagaaccaagaaccaaccccgtcttcttccccatggagcacgacatgcatctgcatacatgcacagcaccctacactccaagtcagcaacgagctagtagtaccatctgcagaaaagctgctttttgggtggcaaattttgttggcgatacaatccaaagagctttgcggttgagcaggtgtggtagtggtggtactagaaccagtacaccacaccatctagaacctcagcccagccgaaagtgcttaccaatttgttgcaagatcagccagccagaaaaactactgcatgctgctcctctgcttctgcttcgatcccccatcatctcatctcgtggacggacgctgcctgccacgctccctgtcacaacattgcatcagtctcggggcatgcgttgcaagcaatggcccccatggccatgaggtcctcctgacccaagctgaagaactagacaagcgcacatttacattggcggggccgggtacagctacgccacgcccgtcgaaccggaggaggagggaggtctttgttttaggctttcttctaatcttccctgcagaacaaacaaaatgggaagaagagaaaaaaaaatagtatgagtgtgactttggtgtgtgtatttcagatattcatttatgaggagtcaactgctagctacccaactacgatgggttggtatcgccgtgtttagttccaaaatatttcttcaaacttctaaattttccatcatatcaaaattttcctacacacataaactttcaacttttccgtcacatcgttccaatttcaaccaaacttccaattttagcgtgaactaaacacagcatatgtctagtaggagtggttcttgacattcttgtgatcataattgggatagtagtatgtactccatcaaattgtcaagctgaagtgaaaggatgtggatgttacagtcagtttgtcacagtaaaaacaagagaaaattcagggatttttctctaaaaacaatggctgcaccctacctacctaactttggttcaggtcctaacatgggcgtatttccttttttttttaatgctagagctatcgcctccttttctgaaatgaaaaggggaaaaaattgaaattttaggtgagacgactttcaagtatacaataactaataaggtcttaggagccatcaaatctcattacgacggtttggataaaactcaacaagccatatgaaagctggaggccacatgcgcagatatggctgagctgtctataaccttataggactacctttgacaagaatcaggaaaccttctatactgaattcttttggtgtacctgttcacaaccaaatttggtaatttcggcatcgggaaagaagattagatcgaagcaaagtcggaggcggagatcgagttcggaaacagagcaggaatcagctggagtccagatcggctacgattaggatcagctgggtctgagtcaggctaggcaagccgatgcaaccgattccgacaatgcgacttgatgtatgacatcgggttgaattgaggtgcttcaaggtgattgccgcacatggatagagtcctgagaaggcaattgtgtctattaattagagtgttttatgtaatttccttagagatatgcttgagcaaaagtctgccgtaaagacttatggtatcttagagtttgttagagatagttgtcatgtccgttatggacatatcttgtaattttcgggtataaatagacccgagccctatgtaacttttaacacacacgctcaatacaatctcggcgcatcgccacctttttgctttaattttatttcaacgagttcttgctttcgggttgagctgcatcggtttcgatcttcaccaagaggtaaaacttgttatgatgaattatgttctcgagattagtgcttccatctttatgatactctaatcttgtctatgtaattcgtcaagttattatatatcttacataatcttcgacaatatcgtcatctaacctacaatcggctaacatctgttaacagaaggcagccgatttggttaaatagcgacgttgacctagattatataagatatctaccactctatgaaacttccagcggcttgattgtctagatattgttcttcttttcatacttaatgctgcatcagccgaatttgatctcttaagtcgtgcttagaatatcaatctctagcatgtactctggttgccgattagggtagtgtcggagtttcagccgatcttacctgatttaactactttttatcctatatgcttgattgacatgttaaatctgccctttatgttaagatcttgctgcatttaagtatattaggcttttgtctagtatattctacttgctttaatatcttaatatagagtggtatcggagtattagccgatacaggctagatctatttgatcggctatgctatgaatgtatatagtctcattattaatatatatttcgatttaagtgatttatattgtctcggcatggcgaccgatctattccaatcacttgatttaagtatatatcgatacaaagattatatattgtcaatatctgcagccgatcgagtagatttagtcccttcttatttattaatgactgccgatcgatgtatatatgacatcggctcaaagataaatgatatgtcatcggcacctagccgatcggctatcatttatagatttaaatgcggtttctttgcttctatttcttgttgattacaggatcaaatcaactggcacgctcatacattcgaaggcgagctttggacctgcactggagttaagcagatctcccaggcctcgtgttttctgtcaacagtaccacaactttaaggagaaactgatgctgaaatccaagaaaatatagtaagcaaagaaatactattaccaaggcatctaaaaaaggtaaccaattgacttgcatacctgtttaggtatgagctgagaagtgattgccggtgttttgctataagtttttcactgtaccctttcctttattcctgctcagtaagggccactcctttccttcgatttatgcagaactctttccaacatccctgtcgaaaaacacaagccaatataacggacatgagcaacatcattgactatgcatctatgcatcagaaaattgcattctgcagagaaaatcggaagtgcaaactgatgggtgagctgctggagcctggaagaacccgagcaaggaatgtaaatactagctaattgacgtcagtacccatcaatcagtattcagtaataatccagaggattggctagatatacaatcgactcagctagtagtttgcatgaccagctgagctacctgtagcccatacagcagactcagcatgcatacatgtaatatataaaaaaggtactcaaaggaaaaaaaggcagagtgtttcttttgacaaatgtaacaatcagcgtactctttgatatatataaaaaaaacaatcagagtaactcatgcacatgagaaagaacgtattcacgtacatggtacagtgcaaggaaaataagcaactgtttatgataaagaaagtgagtgcccccttttaaggaaagttttaatggttaaaatacctatatgcatcgctttcttcttttcaatttttcatatatttgtcaaccacacttcaatatcataattatctctgttaagcaatttccttttcccgagttaaaattttgctctggtacatgtatgattgataaggacattttcgaagagaaaaaagagaaataattagcggtagtgtacttcaaataatttgaataatttagacagaccactctcagggtttcgatggatatccacattgagggctgaaaacgtgttctatgaattcaattctctcaaacctacctatgaataccaaagaacacaatctatgtactcctagggtccagaactgtctactatataaagcaacctatttatacacaatcttgcctccttcaattgtctaaaacttagaaatgttaatttaaaacaacctaaattaaacaatttcatctccttaaattggctggcatgtactaatgttactttgttttctctatttttccggtttattacaggcaaacttaaagtagttggtcccattatttttcaagcatcaagggaaaattccagatgagcatttgcttaagtctgtgatacactaggcatgacaaacttttagaaagagaaatctctaaccaaccgcagaattacaccataatgatggtgatatccaatcttcaggagcaaccaact

SEQ ID NO: 11063 - DNA, 715 bp, Oryza sativa
tctcccgacgtggttgatccccacgggttggatgatccgggttagtaatgtcatgtgggtaaagtgtaccccctctgcagaggttaacaaactgttcgaacagccgtgcccacggtcatgggcggatgtgaggtgattcctagcgtagttttgtttgactactgcttgtgaaattgctgttgagaaactgggttctatgtttggaaaacctgcagctgatgggatcagctaggcccgggtggccgtttaaaagttgttggcccgggtggccgtttgaaaggtgttggcccgggtggccgtttaaaaagcttttggccgggtgccaaccttgtttcaaaatctaaagactgatacattgcacatactccgaccggacgagacgcactgcctcatccgtgtcgtttgagaagcactcacttagttgcttttagaaaagagttcaaataaaaccaatcgcaaaaacaaacagcctttccttgaagcttgcattaaacacttaattcccatggcttgctgagtacccccgtactcacccttgctctatataaatatccccccccagttgctgaagaagatgaagcagatcctgctgatgaggagttcttccaggagcaagccggctacgatgagttttagggtttcggcctagttcccaagtcgcgcctgtgattgtttggtccaagtcctggcttccgctttccttttgtaatgcagt

SEQ ID NO: 11064 - DNA, 1272 bp, Oryza sativa
cgtgtcgttcacttgtcttgccattgtacagtttgttcccttgtttgtaatattcatccactgataagaaggtggaatgtttccaaaaaatagataaaaaatacacaattttacttcaaatatcagtactgtacatgttcagaaattggagatgttctgaagttttaagataaaacaacatgaactaaaggaggaaaacattttccaacggtgtttactagatcgcccatcaaggaaacaaaatgacatacttaacaactcccaggaatggtataaattagcgtcacaggtggatcaaatagtagtctatttatagctcaaacatgaaaaataaatactcctgaaatctgctctgctttgctggaatatctgggtagctaaatacctaagcagtaacacagaagcatacccatcttccgaaatgcaaatgttcaagactgcataccatttgagaacactgagagtatgggaactaaaaccttcaagcatgtaactgccagtttgccacactgttggtttccaaagctgtgccgctgccgcactatctagcaatccaataatcgtagttctgaatctgaaagtttggaaccatacgtcagttcatattactactttttcacaaggagaacataaaaatagttatacaactactgtttcatgagaacatgttgagcataatactagccagagtctgaagggactccatgatgcactgatatgatttgattgggttttcttgtgacggtccggtacgccattaaatttcactaagaaatggtaactaataaattaaacaatgttagaacaccttttatagtagcaaacgtaccactggagtgaaaaacaatatcagttgcagagcactggaatttaccatgttccaccattattatgccgtgatgatattttgatccataatgtatgtcagtgcaactagctgaacaccactggttcttcaggagtgatgaccaaaatataatacaaccgaagtattaagaagcctactggaactcacaaaagaacacctgcacaacaaactcccaaaacaatggtgagtaatctgattgcaacataactctgaaatggcattaactatggattaaattagtatttgaatcttatgagaaaaaaatctccaaaatgatttaagttacctgttctcactaattccactactaaagagtaaaaattggaaactggtcaacttagtgcatctgtttgatatagtgtttggaacatcttacagcacaagtgaatttacaggattatgca

SEQ ID NO: 11065 - DNA, 13621 bp, Oryza sativa
  unsure (1)..(13621): unsure at all n locations
aacaattaagtagccacataacccgatataaagataagaataatacaatgatacttgtaacatgaataagtagtcctcctaacctgtacaacgctgcagcggaaaattatggtctgttcaataacatgaaagcattcatataatttgaagtgcaaatagtgtcaaggactacttggcacttgaacacacattgagtctatggcagctatcagccctgtttattgccacgctattcacttttaaagctgtgctagcgtactacagcgcacaactagcaagcaattcaaaagtcatacttatgaatctgaaagtttgggaacaacatataagttaatatttctacttttctgcaaatggaccataaaccaattacaaaggtgccttccataagaacgtattgagcataataatagattgaaatctgaagggcctccatgatacactgacatgataagatggttattcttgtgaaggccctgttcaccattaaattatgttaagcaacaatagctatgactaatgctcaaaaccttgtatgggtggcaaaaattaaagccaaaagcaaatatcaaaacgctggaaattcatcgtaatcaaaacactgaggttgcaagtgggcagcttgttgaatactggcatccttatttagtggacagaacaaaaatcaaattacttttacatggaaagcaatgagaaggccattaagtaatcacataactcaatgttcagaaaatggagatgaggagaagaacattttccaacggtgtttactagatcgagcaaagaaaatgatatacacattttccaggaatggtataaaattagcaacacagggggatcaaatggtagtctatttatagtccaaacatgaaaaataagatctcctgacatatgttatgttgtgctctggaatgctctggtcaactcaaagcagtagcatcgaagcattgccatcatttgaaatgcaaatgttcaagactgcgtaccattcgagatgagactatgggagttataccttcaagcatgtaactgccacattgttggtttccaaagatgtgtttctgccacatctgtcttgcaatccaataatcagatctaaatctgaaagtttggaaccgtacatcagttcatattaatcttcataggaacatgttgagcagaatattagcctgagtctgaagggactccatgatggactaatgtgatttgatgctattattgtgatgccattaaatttctctaagaaatggtaagtaagaacttaaatgctgctagaacacattttatggtagcaaatatagagctggagcaaaaataaatgcaaaccttaatatcagttgcagaacactgcaaacttatcattttccacagttattaagccaataagccatgatggtattttgatccataatgtatgccaattcaactagctaaacaccactaaagtcttcaggagtgacgaccagaaatatgcacccaaagtattaagaagtctactggaactcacataagaacacctgcgcaacaaaccccaaaacaccggtgagtaatctgattgccacataactctgaaatggcattaactgtggattaaattagtatttgcaacttataagaaaatctcaaaaatgattttaaatatctattcttattacttccattactacggaggaaaaattggaaacatccattactaaagaggaaaaattagaaacaggtcgtcttagtgcatctgtttgataggaattaaaatatttgggacatctcactgcttaagtaaatttacaagattatgcaactatgtaataccattttttagataatggaaatagtttgcatcaactaattaaccataaccattccctaaatacacagcccgtaagaaaaacactatgctaccttgaagcataagatatattcatgtttaatcaaagacaagcttacaacaagcagcaacttgttcatgacagggatcagacctatatgacagctgtttcttatatatgggttttaaaaagttttctgggaatatctaggcaaggatatggtacatcaggagtcaagttccattcaacgtttacttacaagatctatgtacaggtagaggatatcacatgagatccacatgttggggaacagtgcatggatagattgtgaagttctacaaggctacaggaatgtacaacttgaaggcagtgccctgcatgacagattgcaaaaaacaaacatttaatcagattgtgtagtaagtactacatcaaaaccccaacagatgatgccatgggacttactaggtagagggaacaaggaagcatttgttacctttgttagtctagtatgatttttgggatggttccctttagcttcctgcaccgctgtttgagcttctcgttgttgcagtatccgacatctagttcttgcagtgaactggggaggccacccttgggcagcgaccggatggatggacagccgatgatctttaatctcttgaggctggtaagtctatgtagccccgcagggaggcactgcaacttactgcatctcaaaaattggaggtcccggagagaggtgaggagctgaagggcctcctcttgctccttcatgaagcgctccacctcgtcgttccatccaaggcgtagttcggtgagggaggaagagaggagcaagcagatgggcttcacgaggacacctgcgaagtcatccgtcctgagctcctgcagcttggaggaacactgaagaggaggaggaagctgctgctcttgtccgtcctgcagccccccgagtatgggatccaaaccagcaaagaatctgggtgttccaaagacatctaattcgctgagctgaccctgggtgaggagaggccacagaccctcgcatctcaaatcctccccacaatcatcgatgtgtagttctgtgaggaagttgaggtttgagatgaaatccagggtctgcacgccctccttacagccagcaatcttgaggcattgcagggaggacgggaaagggcagcctggggcctcgtaggcggagagaaacttggggcattttgtgatttgtagggcgtgtttggttgctgccctggcgagtatttgcctggcctggagctagccagagcagtaagtagtagtgtttggttgcttcctgaacggtgtctatgctccggcaagggtgccggactcaggccaccaaaaatgaacgcctgagtcaggcgtgggtatgtgtctaatcctcccccattgattcttcattgatatgactgttatcaacacttgtcaacatcttactcaagtaaacaaaatgtttatatataatatattcactcaggcgtaggttttcaaccaaacaacaaaacatcacacatgcctaatcaggcacaataaaacacagcttttctaccacacaggcatggatttttctcagacaagtcagtcaggtcaccaaccaaacaagcccgtagtctctggagggagcgcagggattggagcccccatcctcctgtctcatcctcgtggctggtgggaagagcaggacgagcaacatctaagataagctccgggcatctgtagagaattagttgttgtagagagttggagaggtgtgctgggaagatcagcatcccatcgtcatcttcttgatccatggctagctggggtaccactccctcttcctccaccagatcctctgctacttgctgctgctgaatagattcgactgcttgtgtatcctccagctcaacagcagttgtttgctgctgttctacagctatacacatccgtgtaatcttgttgcagttcataagatacaactctgagagctttgggagatgagagagaagctgtgacaatgctttcccacttccatggtagctagaaatagataggtactcaactggaacttgccacttatagtcactcaaactttctgacagatggaacacgacacttgaactatcaagtctgagtatcttcagtgaagtcaacatttgaaggtaacaccccgccaaaggtgggcaattattgatcatcaactcttgtagttgggttaaattatagaaagccagaatcttgtcatctaagccatttagatctgtctttcctacaatcctcaagctgtatgtgctcatgtagtgtaattttttcaaccttgtccctacatcctttatgtatacaaagcacaaggtttgcgtgtaaggcataggaggcattcttagttgtggacaattctcaatttcaacctctcttagcctaggaaacaaattctcatatccttctgatgggcaataagtacaatatgaaaatggtaattctattacctcattgcaattctttacgatgagcacttctataagtgagaacatcgggacttcttttgccgtccactttctcaaattaggcaacccgacaagttctagccttttcaagttctgaaagctttgtcctgtgttgcagctaacaaattgatcttcaccaagtccgtttaccaaacacacctcccctatcggcggtaagtttttccatgttacattggaaagatgaagagtctccaaggatttcacagagagctctgcacctagccatgatgggcaagtagatcctccatgttcaatgatgaatagctctttgaggttgttacatggtcgaaggttctcaagtacttgatcttctttgtcaggatacctacttgcttggcatttgtcccaacttaatgccaacttcagtaagtggttcttatcaaaaagttttgcttctgccgctgcttcttttgtgtctattctctcaaggttataaataccaagtcttcttagctccatcaaatgacctagttgctttagttcaaaacttttttcctctttattgacttcaaatctttctaactcttgtaaaaactgtagttttcccacatcgcaaatagcaaagtgaagcttatcatgtttcgtaagaaaatggcataactttgaaagattgctaaagtctctaggcaaatcgagacaaccatcccatgcttctagatctagaatcctcaaatgataaaatctagaaagggcacttgttaaatgagttttacttcgacgtggtgcccctagccttatgtagcgtagatggactagtgtcgagaatttattaaaaatgaaccccacaggaaatgacattttgggcaaatgtagaacacggagagcacttgcttccttgaacaaatcatgaaaactttcagcaaaactttcatctagttccccaaatatcatcacagtttgcaagttttcaacctttactcttgtctttagtttttgtaatatgttcctaaagctttcattgttcattccatcactatcatccacaccatctgtattgatagacaagtgacgaatggaaggccaaatttccactgatctcacattagaataatgtaaactaacacactcacgagatgcaaccttcgctgctaaattatgtagcaggtcatgaataatatagcatggatgcccatcggtttcatcttttttgaaaaatccatggctgaccaaatcatttaaattgttcaaagctatatcatcatttgttttattctgatattcagaatgtaaaatatctagtcctatccaaaagcaagtaagttcttttgtgtcaaacttgtaatcttcaggaaacaaagcacaatagaaaaaacattgttgcagatgaaaaggtagataatcataactaagctgcaatgcaggcataatgtcatgattgctggtttccatttcccattctctactttctaggactctgttccaatgatattgatcaaagtggttcctcaatagtcgacctactgtttttgctgcaagaggggaaccttttagttttcctgcaatcttatctccgatcacaagtaagtctttatggacgtctcttggtagcttatcaccaaatacatatgctaggaataaatccctaaacgctccagggtccaaaccttccaaatctactgagttatccattgttttaaccatttctgctacaaccggaaaccgagttgtgactagaattatgttaccctttgtctgtccttttgttagtggaagtaaaagctttttccaatcatcactttgacacttccaaatatcatccaatatcaataaaaatcttttagacttcaatctttgttcaattagctcttctggtctaccatctttttcaccatccactttagggacatattgtttgatctcttctatgagcttatcaacactgaaattttgagaaacacatatccagaccttgacctggaaatggttttgcacttcaaggcttttatatatgtattgtatgagagttgtcttccctatgcctcctgggccaacaatcggcaagacagtcaagtccttgccgcagtctgtaccttgggttatataatctattatgctcttcgctgtatcatccctcccatacagtttaggctctatacttgtaggtgtggtgatgggacgattgctcgcagtactggaatcagtgctacggatagaatggtgtatctctagattaagaatagtggtgacctttgcacacacgagctgcagttggtcgacaacatccttcattcttatagacagacccactctgtcaatcttcaactttggcgtttctttgatcacatcctttctctgttgtggtggcttgtgcatgcaagcaccacaacagattgaaacgctagaatcatcatcaacaacagctggaaaagatgagcaatggaggcgtttaccgacagcatggatggtgttgcgagcaccggaagcaagcttgcggatgccgccgccggtggcctcctcctcctcctcactgtcatggtcgttgtatgaccaaccacagcagaggccacgtccttgcgcaccttgttctgatcttggataggtgtgactaccattatcagcagcagcagcacaggagcatttagagaatcccagccgtttgctggcagctttggcagtgtgggtgacattgaggaagaggttgcgggcgcaaccgccggcgtgctcatcggcggcgtggtaggtgccgtcgagctcgtcctggatgcggaagtagtcgagctcgtccagcacgtcgtcagcgtcgaacgccaggtctcgcagcttctggaggagctccttgagcgcagggctgcgtatgtctttgccctgcgcgttgtcgagcaccccctgcgcgtagagcagctccatcttgagggcgtccacgttgggtccgagctcccggctggccgcccacgcctccaccaagccgtccgagacggggccgagggccttgcccaccacccaccgcgccgcgctcacggcggaatccatcgatccgatgcgcgcggttgcgcttcagtccaagatgctgcatgcaaaatcgagaagacgaaccattaattctcactcaaatgcaatcgaatgaacagtaatatgacagtggtattcagctattgttgattcgtggctgctgttagaggagagtggatacgtacgttacgacttacccaaggccgtacgtgcttctgcggcgtcggcagtcgggggcacgaaggtggagcgctcaggtattgggggtgaatgcttgagagaaccgtgcaaagagggtcgagttgtggcgcttgctttggagacgggagtccggagggaagatgctggatggaggctgctaaattactccactaaccttgtctgtttttctttttttctaaaaaaatatatttcctcggttttcacaatgctagatgttttgcttttaaataaatttatacatagacatatgtatatgctctatatatgtgtttagatttatatatgagtttttagtaaatttagaaaagagataaagaagctaaaatgtcattttgtggaacggaaggagtagctatttagatgacaagcggaacaaaggtacatcacattaacaggatgaaaaacaacattgagctcgcttccttcgtcggcgggtttgcccagcttgtttgaaactttcgcacggaacaccaccgtttagtagtttgaaaaatgtgctaacgaaaaccgaggtaaaaatctgaatcttaataaaaaaaatctaggtcctttttttttctaattaagatgcagatttcacctcgatttctgttaccacatttttataaagtgctaaatttctggtaagaagttgctttaaaatatcaaataaaaaataaacctccgtgttcacctgcagataacatgtgagataacatgtcaagttaaaaaaaaaggacagataacatgtgagattgagaccgtcttcacgtggataccacacgtcaatttactctctccgtcctagtttatgaaaaaaataaacctagcatggatccggaaaggagtcatattcatatttataggttgcagcgatcaaaccgaaaaagtgttcacctgcgtggacgcattagtccaaacaaagtgtccttgtacgtagattttataaacgttaccaggttggaaacagattcgacccacataaatgagctcttgacccacagaaatgagctctccgcgcgctcctcgctggcagatctcaagaagaggtcccgtgcagagatactaacaacaatgcagtatagaacttttttaaggtacacttggaaaaaaaaaactccacacttcaacaatgcaatatataattactagaagagcgtgactattggcacgcttacaattttataacctgcacaatatgcttaatgagtatgtaggtttaatagactaacatcataccatttaatatattgatggtattaaaatggaaggggttggatattggctaccggaaattatttttctagcagaaaaaaagctgcgatatctaatccatttttttggccggtgaagcagctagaaaccctgcttcacgatgcccaacaatttttatcaatggaaaagtcgacaatagttatccaagagttctgtgtaaaaggattatcatgcaacggatcaaaggtacatcatggatagcacactatgacaccacggagatagccacttctgtcaacgacagcccctgaattcacccttccttgagttggttcgatttggagaaggagattatttttttttttaaaagaaactacatttattttgagatggagaagttaactctagtatgcatatgcactaaaattaacattgcattcacgagtgctcgtcggttttaagtaagaataggtaatttttgacactttatttttttttaaaaaaaacaactttaaagcaagcacttccaatttcaattctagtgattcttaaaaaaaagaatacaaacccaagaaataagtttgatatgaaaattgttgaaaatggagtttttttaaaaaagtttgttgaaaatagaattattatttttgtttgaaaataaaatctagagtaaatttgttcccttttgaaatagcccgggctctatgggcgcagagtagctcatgctttgtgcaaggaaaaagtacaccgaaggtccctcaacttgtcatcgagttaaaaatcgtcctcaaaccgcaaaaccagatatccgacgtcccttaactaatcaaaatcggttacaataggtccctcggtagttttgatcccggttttatcctatgtggcgctttgaccacatgtcagcgcgtccacattagcctcatctctctctctctctctctttcccctcttctctcccttcctcctctctctctctctctcactcttctctcttgggctctgggcaggccgaccaccaggtagggaggagaccgatggggcgaggcgggagaggaggtccggtggccggcgacgacacgggagcaggggagcaaggcatcggcggcggcggcggtagtggcgctctggcgagctcctcgccagcgcggccgatctcgttgtgtatccaaaagagaaaaggtatcctattcaaatgcaaacccgacggtacccttctgcgagttgcatggtcggccttgaagaggatggcgaagaggttggcagccttgaagaggaggagggcgaaccagtcgttggcgaggcggtggaggagatggcgttgggcgtgggtgcagggggcggcggagtcgaaggcggagtcgtcggagtcgatgtgggagaagagggcgtgggagatggcgatgtggacgaggaagaggaggaagagcgggaggacgaaggcggcggcgatgcgggcggtgggtgcggaggatggacgccgcctccccgtagatccctaccacgcccaggaattgcaactcctcccctgctagttgcgccaagctcctcccccatcggccgcgcccgcctctcgagccttttcgacggtgcaaccctgaggtcgcacgcgcgatgatgctctcccttctcctgccaccgccatgtcgtcggcagccgccgcgagccgcctcccttctccagtgtcgcaaccaccgccgcgagcctctcccacctcaccctaatgacctcctccccacccgccgttgccctgcagagaggagaggagagagagaggagaaaggtagagaattggggaaagagaaagggtgctaaggcggacaccctgacatgtggggcccacatgcgtcccacgctgactcagccgccacgtcagacaaaaccggggtcaaaacaaccgaaagacctaaagtgaacggttttgtaagttgaaggatgttctatatctgtttttgcagctgggggacgattttgtaactcaatgacaagttgagggaccttcggtgtactttttccctttgtgcaaggccctggcccagctaacggcccgcaggtgatacagggagattgcccacgtgggcgcctcccattggacggcactggatgcgcttctgcctctgcccagaatcatcggtctccagcaattcggctcctctctctctctcccgcacctgcagacatcgaaagccaaaaaccactcaagaagctgcaaccgcgtaatctcgagaaaacggtttactcggcctaagacagtgggagacgacggcgacggcggcggcgggaggaagccatggttctcgctctgctgttgggctcctcctcttcttctcttgcggcgccacaccctgcttgctcttccaggtaacaagcgccagtggcagcaacacgcagttgatttttcttggatcaaagttgtataaggctagatcaggtgctgttctattgtattcactgttcgaagcaggcatgtattttgggtaacattcttgatgtcaaagtcatattccacattcagtgatggcacgtaggaggagtcaggttagtacagtacctggatgaaaatgctgataagtaatcttcttattggtaggagaaaatgcagacccgctggacgaaataatttcagatgctctctgcatgacaaggtgccactgaatgctcatggagtattatccacaaaattgctctcatgccttgctgcttcgcttgttttcatctctccaccttgtcaggtacctataaatgttaacttattgtcagatgtatatacactaaggctgtgtttagttcacaccaaaattggaagtttggttgaaattggaacgatgtgacggaaaagttggaagtttgtgtgtgtaggaaagttttgatgtgatggaaaagttggtagtttgaagaaaaactttggaactaaacacggcgtaattcaaagagataacctcgggatcactaagcaagaacagttttttttaagaaaagatatttttactgttgaggattgagagaattttactgctgcaattttgattggatacataaaacttgttaatttcaattaagagaagagggaaaatggagtgagattaccagttcaggcttgtaacatggtatcgatgtactcttaatctctcatagttgaccaggctatccctgcagagacctttgtacagccaaaattgtgccaggttgctgtggtagcagccatcgacaaggctgcggttcctctgaaattcgatagcccttctgatgatggcggcacaggtttgatgatgaagggtatgactgccaagaactttgacccaattcgctactctggtagatggttcgaagtagcatcgctgaaacgtggctttgctggtcagggacaagaggactgtcactgtactcaggtattgtagtgccagaatcctcacacacaaatactagtagatcttaatctgtatgatgccccagcaatatgtacctctgaatcctgattcctgaaaacaccgatatctgacatctttgtatcaaactgatttggaataggttatcacaggcatgctattttttctatgccatttgcaccatataatgtgtaagaagattgttacagaaatttgttggtactgcagggggtgtattcatttgatgagaaatcacgctcaatccaggtggacacattctgtgttcatggtggacctgatggttacatcaccggtattcggggaagggtgcaatgcctgtccgaagaggacatggcgagtgctgagacagatcttgaaaggcaggagatgatcaaggggaaatgctttctccgtttccccacactaccattcatacccaaggaaccttatgatgtgcttgcaaccgattatgacaattacgccgttgtgtctggtgctaaagacacaagctttatccaggtcagaaactgatctctgaactgcaaatgaccactatttcttagccctctgcatgcttattctgcatattgaaagatcaatctagttacgtaagctgttccatgaaccaaatatagtgtcaaatagagacaacatagggttaagcaaggacttgaacactgagaaatcaagccaatattccttaccttcatatgcctattctgacgcattttgtaaactgaaatatcataacattgtgtcgtctctcggcaatgcatcagatatactcaagaacacctaatcctggaccagaattcatcgagaagtacaagtcctacgctgccaacttcggttatgatccgagcaagatcaaggacaccccacaggattgcgaggtgatgtccacggaccagcttggtctgatgatgtcaatgcctgggatgactgaggctttgacgaatcagttcccagacctgaagctgagtgcacctgttgcattcaacccattcacaagtgtgtttgacaccctgaagaaacttgtagaactgtacttcaagtaaactccatattgtaaaacttgtgatcaatgttccctccacatgaagatgcagttgaataaaattctcacacacagatgtctctagtgatttatgttttttcatgcgccttatcagaggaagagtttagcaaaaatcataaaatataaaatgaactgtttagcatctggaaaccttagttcatatcagtatgtactaactaaatagagattagcttatgaagagtcagctcttaaacagtgaccaagaacactgtggctggtaagcagaacgcacaatgagacagattcagggcattatgggacatgttgtgctgttattcgactccattctcgtgtgctcaagcagagagagggaggtgatggcaacacttttttctgtgcgagtctcgcggcatcnnnnnnnnnnnnnnnnnnnnnnnnnnnnnnnnnnnnnnnnnnnnnnnnnnnnnnnnnnnnnnnnnnnnn

SEQ ID NO: 11066 - DNA, 774 bp, Oryza sativa
aactaaatgaatttccaaaaccgcggaccggggaacataccgggtgtacggtttcccactctcgcacttaaggaccgattccttggaatttcatccaaacataaggcaagtacgaccacatgggtggaatgggacacccctggctgagtaactagcttatcaggggagccttgatgccgagagacttgtggatttgccggggtggtgtcagggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggttgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttggggaaatgagttcgatgtttgaaaaatctgcagctgatgggatcagctaggcttgggtgcccgtttgaaaagttgttggcccgggtgcccgttgaaaaagttgttgcccttgaaatctgttggccgggtgccaatcttgtttcaaatctaaagactgattcattgcacatactccgaccggacgagacgcactgtctcatccgtgtcgtttgagcagcactcatttagtcgtttttaaaaaaaaaaaagggg

SEQ ID NO: 11067 - DNA, 16412 bp, Oryza sativa
  unsure (1)..(16412): unsure at all n locations
tctctctaatccctttcttccttcttttctacctcttctttttcttgcctttctgcttgaatgtattttttgtatatcttttttgaccaccattaatacaatggttataaggtagagcctctctaccttttcagtcaaaaaaaaatatggataagtgcaagcaagttttcatcaatagaaagcagtgctacttatccggctcgaatgttataaaaccagccccgaaatcgacatcggtagctaaacgcggaagaaaacgccatagaagatccaaaacgatgacgacaccgagacatgatatttggtaacggagttcagccgtagcctacatctccggggcactgattacgggcgctcctccccgatccagcatatacaacgtatcagagttacaacgactcacggccggtcgacgtcggcaaccgctccctctcgctatgctaagtcgccatgcggttacaacaggcacgcccctctatttatgagagatcctaggataaaatccgactcatactctagtcctacacttagtacaactccaagtcctaaactgtaaccgactacgtacacatattcgacacaaactctaacaaactccaccttggcgaatatgccacgccaacctgaattcattacttgctcgaacctccatgtaccaagacttgagttgatcctttttcgccgctcacaccgagctaccccaataagcctccaccaggctcaccgtaacaagagactctgctatccctgtaacttcctcctcttgactccacctgcaacagtgctccaccttctctcatatcaccacagtcgtcttgccaagcgaaattgaattccttcctagctgtcatatcatagactccccgaaaaccaagttcaacttcatctaccgtcttaaatttgacttgatctaatccatggcccgttaactgacgtcatcaccaaatagataaatcaaactcaccagacttgaatagaaccttttcttccttatcgtcttatgaacaaagctagcaaatccaacatccacgctttaccgcatctgtagactgaattcctgataatctgagaaaattcacggttgccttgaatcacccgaagaaattaccaccatagcgattgctcttctccttcagtgacgcagtttccatatatcgccatcatgcaatccacgcagatcctggatatatcctgtcacgccccgaactagtcccgaccggaactagcccgtgacgctccaaattaacctgttgatcgataccagtcccaggaaacagtgctggtatcacaggaagacagaatatcacagcaacagaggtctctttattatagagtagaagtacagtcatgttgggctgcggacagatcccgagctcacaactgcattacaaaagggaagcggaagccaagacttggaccaaacaacacaggcgcgacttgggaactaggccgaaaccctaaaactcatcgtagctggcttgctcctggaagaactcctcatcagcaggatccgcttcatcttcttcagcaactgagggggggattatttatatagagcaagggtgagtacgggagtactcagcaagccatgggaaataagtgtttaatgctggcttcaaggaaaggctgttgttttgcaattgattttatttgaactcttttctgaaacaactaagtgagtgcttctcaaacgacacggttgagacagtgcgtttcgtccggtcggagtatgtgcaatgtatcaatctttaaaatagatcaagattggcacccggccaacagctttcaaacggccacccgggccaacaactttcaaacggtcacccgggcctagctgatcccatcagctgcagattttccaaacatcgatctcctttccacaacagcaatttcacaaacagtagtcaaataaaactacactaggaatcacctcacatccgcccataaccgtgggtacggctgttcgaacagttagttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccaacaccaccccggcgaatccacatgtctctcggcatcaaggctcccctgataagctagttactcagccaggggtgtcccattccacccatgtggtcgtacttgtcttatgttcggatgaaattccaagggaacggtccttaagtgcaagagcgggaaaccgtacacccggtacgttccccggtccgcggttttggaaattcatttagttcgcaagcaccgaccccaggtgtcgggttttccaagccttttgtaaaacccaagttttacccaagatgtttatcatattttaagtttgaaggcgaccgtcgatactcgcacagagtgcacgaataccgaagcgtgactgggtggctataagggaacatggtataacaattaacaaaggaaggatcagatgcaacaaattaggtaggtctgccaatctgccttgcagacgggacaagcagatcaagtgcgatcctatcaatgcataatatttttcaagcaacataattaaattcaaatataggctcaagatgttcaaaggtggcttgccttgctcgagatcttgagcttgatcctcgaaatcctcgcactgcgggtcttcgggctccaaaactacgcgcaaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaagaaaagaaaagaaaagagggagggaaattagacttccctcgggcggctagggcgcggcccgagagaaaaggggcggcttggccgagctaaatgggccggccggcccaaggcggcccaaggcacgcgcgcgcgggaggggaggagagagagggccggtggaccgggtccatcccgcgtggtcccgggtgggacccgcttgtcaacgactcggctcaccgtgcggagggagcacgcggcgtggcgctaggatgggggaaagacgcggtgcacgcgtgcggttcgcggaggacgcggatgcggcgggcccacgcgcagcctcacggctcgcggtggaccatgcgcacgggggaaaacggagggagcggctgccggtcgcggccgaggtggcgccgacgtggcgcctacgtggcagccatgcgggccggcgggaggtagacgacgacgccggccggaacggacggcggacgacagcggcgagcggcggagcgaaccacggcgatacaggcaaaagcgagcacaccgggtggttgcacgagacgaggggagacgagccaacggctcggattccccggagggagcttgacggcggcgaattgcggcggcggcaaccggcggcgagggaaggggaaacggcgacgaggtcacgaggggccgattcctggcggcgagagcatctacggggctacgggaatccgtcccttgcgccggattgggcggagctgccccgagcgaggccggcgacgagcggcgcttccgagctcgggcggcgacggcggtgagcacacggcgagcggcggcaacggtcgggccggcgccggctagctacggggaggctactcgtgctactacccgagtctaaggggaggagatggagcgaggagggagaacggggagatgcactaccatgcgggacgaggcgcagtgacgagaggccaacggcgcgggagtaatctctccggcctcgggccggggaagaggaaggagagggcgcgcccgaagtccccttctgcgtccacgaacgcaccggctctcccggtgcttggcgatgaacggcggaggcgggacagagcacggaaggcggcggcaaaggcgcggtggcggcaagcgaaacggggggggggaatcgatgggagggcgccttggtttataggacgacgatgtcggtttggaaaccgaccttgggcggtcaaggcgcgagctggagctcagcgctcgcggccaaaacggtgacagaggcggatgacgccggcggggaggggaaaaggaaaagagggagagaaaagagggcttgcctccttgccgcttcgggaaaaggaggagggagcggaagcgacgcggcagatggaggaggagctttgcctccgtcccttggcagcttgcgcgcggagtggcgggggccgggcgatgacgacggcgatgacggcggggcggtttggagcggcgcgacgacacgggcgacatgcgcgggcaggcgcggcagagcgtgacggcggcggcgaccaggcggtcggccaccacggcacgcgcgcgcgggaagcaacgggcggcgcgacgatttgagcggcgcggctcgggcacgcgtgctggctcgcggggccgagcggctgcgcggctgcaggcgcggcaaggcagcggggccgggtgacgcggacggcgcaggcgcggcatgggcggcaaccacgcgggcgcgcgcgcgaacaacgccgcgcggggccgatttcgcgggcagggagctcgccagggatggaggcggggagaaggagagcgaggggaagggagggcgctcggcgcgagcggctcacgcgcacgcgcgcgggcagagcggagggggagagcgcgagagagagagagggcgccgggggagggagggggagatgagccgataaagattcggcccatcgaccccgggggaggcaaaatagacttttgcggagggatcgatttgggaaggattgggttcgggattgaactcgacgatagatcagggattgagatctgagatggcacggacactaggcaacaagcaaagaaacagatttcgcaaatagagtttttaagagatagttttcctgctaggcgccacgacagaacgggcgctacatatcctgtactgccaaacagcccgttgacgccctcaacgattttcacccgctgttgcccgggagttttcaccagctcaagactgtctttactaagtcataccaaaacttaacacgtcactttcttgctgcatgcatcaatttccttctttgcatatgccattgctcacaagatccaagcatgtgcactggacatacacgtgtccatccctcacatgtccaccaatcttgtaccgaccaaatcaatgcacgaatgaattaacgttccatgcagctcatagcctcttcacgtgcaaagccacagcagactcaaccatcaacagcctaaccagcggaccgaccggtctttttcttaaaaaaaatcgttttttttttctctcgattaagacccagtcaacacacaaggaccagaacgatcccggcccttgtcgctccttctgctcgcctcatcctcggctcaagcgcgccgccacccagcgcctaaagacgcttcgctaccgccgctcctccctgctgactgcgagcaccagagccgccgcgcctcacctctcctccgcgccgccaccaaagatgccgcttcggttcccgacgccgctgcccgtctagaagatgctgccacgcacaggagctggtctccccttgcgccacctccctgggaccaccgccgatgaaaacgccgctaccgctgccgccgtgggtttcccgctggtgaggatgccgacgcccacggagccgccccccgacgcaggagcagcccaccccttccgccggtatccgccacctcctcctggagctggcccgcgtcgaactcgccggcacctgcacgacaactacaccaagccgtgctcctaccgctcgcagttcgtcgcctaaaccaccactgcccaagaaatcatgtccgatctcttcattgctttggttggtttgatcccgtggctctcctttgctgattttgcttggaaaatatgagtccgatccgtgtccagtacggaatcctcttcgttttcccttcctgtgtccgacatggtgtcctccttgactcttctccgctgccacaatcacgaccaaaatagaaacagactacgtgcccgagtccatgtcctatgttgcagcccttccagatctgagtcctgcacgaacacggcttttcccaagccagctaccaacaacaccgctctagtctgcacctccggctcggcctcaacgtgaaatcacgcacaccgccgtggtcctgatctccacgagcttcacgtactcccaccacaaatttcactgttgtccaacacctccagtcaattccatcgacaacaaacgacatcgatctgacttgtgcctataacagtaccaaggatccacccgctctgacttccgattgaacaccatcaatctagtcgagagccgaagccgacaagtcgcataccgtcttcccaaccaccgaacgacccgagtgccacgtctagccatctccccgtcgaacgcagctcatcgaaaggcccgagccaccctgcccagagtgtttgattccgccgatcgagaacgccgatcgcctccagcttcaatcaacccccgtgaggcctcacatctccctgttgaaagtagctcaccagaaagttcgagccacccgcctgaagtgtccgacccaccgattgaatcgccaatcgcttccgccgccatcaacctgagcaccacgtctggtcatctccctgttgattgcagccatcaaacggttcagaccgccgcctgaagtgtccgattccaccgatcaaatttcgttgatcgccgccgtgctccaccttgcgtccatgtccgtccctggacatcctgtgtagttgtcgcggcgtgaagcacctccctggcacttttaccatggatctcttgcaggctctgataccccttgtaataaaaccagccccaaaatcgacatcggtagttaaaccgggaagaaaacgccatagaagatccaaaccgatgacgacactgagacatgatatttggtaacggagttcagcggtagcttacatctccggggcactgattacgggcgctcctccccgatccagcatatacaacgtatcagagttacaacgactcacggccggtcgacgtcggcaaccgctccctctcgctatgttaagtcgccatgcagttacaacaggcacgtccctctatttatgagagatcctaggataaagtccgactcatactctagtcctacacctagtacaactccaagtcgtaaactcatattcgacacaaactctaacataggaagtttttcatgccagttagattcatgtcgagttcatactgaagttgaagccatccttaagaatccatggcatgattcctgtacactgaagtgatcagtctcagatgaaccatgggttcttgttttgcttcttgccattcttcttctcacatttccttttgtaatagttttccaagatttttctctcaaaaagtagaacagagtataatgacttctcacttgagcacccattttcactgcattcaaacatgtacaagtattctttatgttctttcgataatgggaaaagttatctgtcagccgttctaagtattcttttctgtaataaagtaatatctgaatcagctcttgaatgtaactaaacattattagttgcttgtgcttcatatatgaataaaaaggttccaaacgttgattaactacctcttgaaataatcatccttgtcttcaaaacttagcagtctcattgactatatctgatctgattccagcataacttagcagtcccatttcatcgttggaggtagttttgcattatttaggctttagaaatttggaccgttaacaataatcgcgatcccagattcccagcctccatctacacttgtactgatagcatctccatgacaatcattttcataagaggaaaggccaaatggccctacttttctttctttacatactacttcaaccgctggggaaaccagcttgacatatacttcatccccagtacagcaaggaaaaaactactgactaacagtaacaccacctaccaaaaggaaagctgaaaacagagccaagatgataatcatatgtggactactgattcaacttggagctttcgcacagtcaaaaatgtcagtaataagaattacattccctgcagggctcctgaaccttcaacttaacggatgagggggcctcttcctcaatgcatcttctaacagcctcatgagctttatgggcttctatgagagcttctttgctcatacgcagacatttgccaattttcagaaggtaaccaccataaaatttggctgtatccagtgcaatgcactcaagtgacagtaggtaaaagtctggcttgtgacacaatgctaataaactgtggcaggcggcagtagtggagcgtttagcaatgacatggtaaacttatacatgaacggatgaaccaaacaactgaaacaagtgcgggtttctgttatattatacatttatactccatacaactctggccacaaatttatgttatattatacatttataattacaaactatataaagttaaattacttgtcttggcacttaaacacatccttttcacagaaagtagcgaaatcactaaatttcggcgatatactgctacacaaccaattttatctcacagtttctccttcccaaaaagacggtatcttgagatctaccgttttgtttcaatacccaatatgacatttcctgcagggttccagaaacttatactcaacatgcgccggtactttccccgcgatgtatcttttggctgcatcaaaagctttccgtgcttccaagattcctcctttcctcataggcaagcattcacccatcgtcaaaaggttcttatcatagaagttggctgtatccagcgtaatgcacttaagcgatggtgcattctcaagaatgtgacttgttagctcaatcatgctctttgtagagttaaagccagtgattgtcacattctggaggttggcatgtctggggtgcagaatttgcctcaaatttgtatgttctccatcaagaatcgaatcacgcctttcacatcgctgctttacctgcaaaggataatagttgctcagtaaaccttggtcatatcctcctcagcaagtgcgatcactagtgatgaatatataagcttaaaacaatttatcatgataagcccacactgaattggtgctgttggcttctagtgcaataatacccatgaagcaccacagggcttttctaattggttgccttagtgcgtatttaagtgctaaactgctgattcagcccctatctataatctgttgagagaaaccatatgaagaataactacagcaaactaaaccaatttatcctgccaaatttgcagaagtccccaaactacaagcatcaactgaatttttatgccaaagtgacatacatgcaagatgaaagtctccaaggcaggggaaccatccaagaaagaaaccagagaaaagaaatcatagttgggaggaaaagccagtaattcagcaagataaatttccaataacttgagggggaggaacttgatgggcaccattggtgtactgatcatctgaaagaaaagaagagatgacttaggattaatcatatgtttcatgtgcacctatgacatgcatatgaccagcctgtaattaattgtagttacaaagcaactggatagtgcatagaaaacaataatgcatacctcatcagtagatgacacaataagtgattcaacatttggcataatggatggaagctcagtacgagcaaaacagactgtgttgggttggttgtaacccatcagacgtatgtctttgacttgcagtggatctccaagagagatttgtattccgacatccccatagataaaagaggagagtttgggagcatctatcgatatcacctctagcatttcacattttgtcacctggaggtacttgagctgctgcatcaggcaaggtaccttaaactggattatgtcattgcaatcagaaattaccaatctctccaaagcgaatgaattggaaaggaactgccctatctcctccccagaaatatgaacttcatataaatgtaagcttgtcaagcttatgttgcaacctagagccactgtaggatgaaaagaacaagaggagaggaaaagtgactgaattgtccctccacctgccttacttgatagaatggaacatgggaagttgtattctgtcctttttttgcataaagacatctccaaggagagttctttgatcccagctttgataacatgtacaaaccatttgtcaagaacagctgcatctatgttcggacaggcaaacagttgaagtttaaacactttgaccccaatgccagagtggttattaataatatggtcaattttactgatggcatagctttccatgtcatccactttaagcgctggctcatacaatggcacatcttccgcatacaaactaagttttctcttagccaaacctattgttttgctatttaatacaaggattggatagcgtctccagcaacgtagaaatccatgcgacacacaagcagcacgagcggcatctttcaatggcattagagaatatacatgatgcaagatatcctggaaaaaaacatgtttgaataattcagcattcagagagtactagcaatgcacacttcacttagaacaaacagaaggaccagctgcttagtaaaatatacttaaattgttactagtggacagtggccaacaggtcaagtgctttttcttaaatttccctatatgcggtaccaaaagacttataagtggatatacatttttctcattgggacatttaaccaaacttcataacacacggtactccttagtccttatatgtcatcaatccacaaaaaatagcatcacaggtcatcttcatgataggtaaagctcatatcgggagataacaaattagctaatgctacagaagtaatctggtaatagttaattgttctgctagtagttttgaaaagaccacaacaatgataattttggagcatggagtagtagacaatgtgcagagaaagccaaacattaaaaagtaacagtgcattcgaattcaatttatgcacaacattctgaaacctcattgagatagtttgctaaaacattgttgtttaacaccgattcctacaatctaccccttgagaaaaaaaatattacaatccaagcacaccaaaacatagcagtttcaatgatactgtagtagttaacagactatgacattattagcaatccatacctccggaagtttatcgagcgggagttctggcattatgcccgcataaatatcatcttgctgccgtggagcgtaaattatctttgaagatgtgtccaatttgtctagagatagagatagaaacaaaaggttagagaatgaatttgctaatgcaattcaaggcttacagacaagaaccactaatttgcataaaccaaaataaggtgaagatttgagcactagaccagataagagttaaaaattcccctgtctaaattgcactttattataagctagctgaagaaccaatcaggttaaggaggagcctaagagcagtttttcttctaaaacataatccctccgtattttttaatgtatgacgcttgtaactttttgaccaacgtttgaccattcgttttattcaaaatttttgtacaaatataaaaatatttatgtcatgcttaaagaacatttgatgatgaatcaagtcacaataaaataaataataattacataatttttttaaataagacgaatggtcaaacgttggataaaaagtcaactgcgtcatacattaaaatattaaaatatggaggtagtaataagtatgcaataaacgatagcggtagaatccaacgacgatctctgtataggaaggtggatcgaaagctgagggggcgggggaagcatatacttgtttgaagctcacggaggagctgcatcgtcctgcactcggtggcacgggtctccatggctccgcccggccgcttccgattcccccttgcagtctacatactccagacgccagccaggaaaggcgatccggacgtcgccggcgcgcgagattacctcaaacggcggcgaatccggccgcctcttgtactgctgagaatgaaaatcccggggggcgctccacacggcggcaaccgagatcggcggcgctgcctgcctgcctgcctcgagagccgtcggcggcggagctcgtgtgggaactcgagagggcgcgggcgcgggccggggtggactgtggagctccccggcgctacatgcggcgcagtccaccgcagtggagcgtggagaaccgcggcgatgggaaggggatgatgaaggaagttggtgaggacacctcagactcacagttcgatggctactttctcagttactcccccgtttcaaaacgtaagtcatttatttttcatatttatagtaatactaataaatctaaataaaattaatatttttttatctagattaattagtatcaatataaatatggaaaatgctagaatggcttacattgtgaaacagagaaagtacatttgttacaaaataaatttatttttattttctttacttaatgtttggttcttcgttttatttgaaaattttattaaaaaaatagttacagaagtatttatatgttatcatccaataaaaataaaataataataatattttagaacgaaagtaataatagaataaaagaatgaaataacatcacaattctcgactaccaaaataactttgaatacttattggacgagtttaaactttactttcaaactataactttcttgttttaaagtttccaacagcacattttcaaaccgttatataatatgttctgtgcaaaaattttctatttaaaatctatgatataaccagaatgcaatgtgggccttgcttttcaatgggctctctattcggcccagtaactcactcgtcagagacgaactcagcgatacgacggtcgacggccatggctttgtcgaagctttgcgattgcaaccagcgatgagcgatggcagctactctgtaatctgtatgacctttagtcactaatttcatttcttttatgttatactaataaaaccagataaagctactgcttttgacactaaactaaaaacaattctagcacaaaaatattgctcttggcttctgaatgcaagaatgtcccccaaaataccatacttgttctttacttggttgtgctgtactgctgtgcatttttacatttctacattcgatttttcttttttgcgaacaagcaaaaaggattgagcgtcaatatagatttctacacttgaatttctcctctgaagaaacgctatctggacttcttgagatgtattgtgtcagtacccaaaatgacaatgcctgcagggttccagaaacttatactcgacaaaggagggtattttccccgcgatgtgtcttctggctgcctcgaaagctcttcgtgcttccaagatccctcctctcatcataggagagcattcgcccatcgccaaatggttcttgccagagaagttggctgtatccagcgtaatgcacttgagcgatggtgcattctcaagaatgtgagttgttagctcaatcatgctctttgtagaattgaagccggtgatcgtcacattctggaggttggcatgtccgtcgtgcagaattcgcctcaaatccgtaggttctccatcaagaatcgaatcatgcctttcgaactgctgctctacctgcataggaatagtagtagttactcattaaaacttggtcacatactcctcatcaagtacagtcactaataatgattatagaagcttaaaatattttatcatgagaaaagcccaaactgaattgctgctgttggcttgtgaagcaccacagatgttctctatttggttgtcttactagtgcgtatttaagtactaaactatttctactatctattatatattgtgagaaactatattaaaaatatctacaacgaactataccgaattaattatcctgccaaatttgctaagagtagaagcccccaaaggcccaaactgcaagcattaactgaacttttatgatttgcggtatgcaacattgagaaagtggcatacgtgcaagatgaaagtctccaaggcaggggaagcatccaagaaagaaaccagagaaaagaaatcatagctgggaagtgaggcaaataattctttaagataaatctccaagaacttgaggtggaggaacttgtgggcaccactggcgtactggtcatctgaaagagaagaagaagagatgcctcaggaattttagtcgtgtttcatgtgcacgtgtgacatgcatatcaccagcatgtaattaattgtagttataaagcaactggatggcacaaagaaaccaataatgcatacctcattaggagatgacacgacaagtgattcaatatttggcaaaatggatggaagcttggtacgagcataacagacggtgtcggcttcattgtaacccatcagacgtatgtccttgacctgcagtggatctccaagagagattttaactccaacatccccatagataaaagtggagagtttgggagcatctatctctatcacttgtagcatttgacattttgtaacctcgaggtacttgagctgttgcatcaggcaaggtaccttaaactggactatatcactgcattcagaaattaccaatcgctccaaagagaatgaattggaaaggaactgccctaactcctccccacaaatatcgactttacatagatgcaagcttgtcaagcttatgttgcaaccaagagtccccgtaggatgaaaagcacaggaggagaggaaaagtgactgaattgtccatccctctgccttattggatagaacggaacatgggaagttgtattctgtccgttttttcaatgaaagacatctccaaggagagttcttcgatcccaggtttgataacggttacaaaccatttgtcaagaacagctgcacttatattcggacaggcgaacagttgaagtttaagcactttcaccccaatgccagaatggctcttaataatatggtcaattttactgacagcatagctttccatgtcatccaaactgagttttctcttaatcaaacctatcgttttgttatttaatataaggattggatagcgtctccagcaacgtagaaatccatgtgacacacaagcagcacgagcagcatctttcaatggcataagagaatatacatgatgcaagatgtcctggaaaaaaacatgtttgagatacaaaatcaacactcatcaggacatttaaccaaacttggaacagatagaagaaccagctgcttagtatctatatttaaactgtactagtggatagtggccactactaaatacgaaccaaatggttaattgccatttggctactaaacaccaagttttcncttttggggggggttttggganntttnttaataaaattaaagagtactagaatccactatcaacatcgggcattattgtgatcattttgtgctatatgctacaactagggccctttgaatcactgcacctaaccataccagctaggtggacacctagtgctccttaaattgcattgttatgatcaaaaggagaatccataagtttctgtgccaagaacaagcgagacaaagaaattgtatttaatcaaacaaaaaaaatttgtgtatgtcaataacttggacacacttctcacatacacaactaacttttacaatctcttatccattaccatgtgtgaatttgccccaaaaagccatgcacttgttacttgttagtggcaaatatgagaggttgcaaaaattatggtacatatgaaaagtgtgcattcactaatctctactattgggtagtggcataaacatttttttctccttttcattatgatatcctagtgagtgtagttttgtgatttttcctctagaagcttcacttcatttcctttctcatctactatacatatacattggtggaatgggccctattgggctgaaatacacacgcctacactcaacactccccctcaagatgggcgataaatatctatcatgcccatcttgctacacgaagaagtgcactctctagcacctaatgccttcgttaaactatcagctacttgttcaccagagtttacaaagcctaagtttaaggttccctcatccattctctctttaataaagaagcgatctatttccacatgcttcgttcgatcatgctggactggattgttagcaatatttatgg

SEQ ID NO: 11068 - DNA, 736 bp, Oryza sativa
gtgttataaagttgggttaatgtcccaataaaaaaatgtatatcccttaataagtctttgggtaccgcatatagggaaatttaagaaaaagcacttgacctgttggcccttgtccactagtaacaatttaagtatattttactaagcagctggtccttctgtttgttctaagtgaagtgtgcattgctagtactctctgaatgttgaattattcaaacatgtttttttccaggatatcttgcatcatgtatattctctaatgccattcaaacatgccgctcgtgctgcttgtgtgtcgcatgaatttctacgttgctgaaaacgctatccaatccttgtattaaatagcaaaacaataggtttggctaaaagaaaacttagtttgtatgcggaatatgtgccattgtatgagccagcgcttaaagtggatgacatggaaagctatgccatcagtaaaattgaccatattattaataaccactctggcattggggtcaaagtgtttaaacttcaactgtttgcctgtccgaacatagatgcagctgttcttgacaaatggtttgtacatgttatcaaagctgggatcaaagaactctccttggagatgtctttatgcaaaaaaaggacagaatacaacttcccatgttccattctatcaagtaaggcaggtggagggacaattcagtcacttttcctctcctcttgttcttttcatcctacagaggctctaggtggg

SEQ ID NO: 11069 - DNA, 967 bp, Oryza sativa
  unsure (1)..(967): unsure at all n locations
cccgctctcgcacttaaggaccgattccttggaatttcatccaaacataagtcaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctggatgatccgggttagtaatgtcatgtgggtaaagtgtaccccctctgcagaggttaacaaactgttcgaacagccgtgcccacggtcatgggcggatgtgaggtgattcctagcgtagttttgtttgactactgcttgtgaaattgctgttgagaaactgggttctatgtttggaaaacctgcagctgatgggatcagctaggcccgggtggccgtttaaaagttgttggcccgggtggccgtttgaaaggtgttggcccgggtggccgtttaaaaagcttttggccgggtgccaaccttgtttcaaaatctaaagactgatacattgcacatactccgaccggacgagacgcactgcctcatccgtgtcgtttgagaagcactcacttagttgcttttagaaaagagttcaaataaaaccaatcgcaaaaacaaacagcctttccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11070 - DNA, 18254 bp, Oryza sativa
gggggagagagagagagagagagagagagagagagagagctctcgggagagtgggccggggagggagagggagatgggccgagcgagtttcggcccatcgaccttgggggaggtaaactagactttgcggagggattttgatttagaaggaattggattcggagatgaactcgacgatagatcggggattgagatcatgagatggcacgggcactagacaacaagcaaggaaacaaatttcgcaattagggtttttaagagataattttcccgctaggcgccacgacggaacgggcgctacagaccaacccccctaacaagaatctcgtccccgagattcagcacctaagggagcagctccggaaactcggcgcggagaagatcttctcgttcccaggttgcttcatcttcagaatgattgctccattggactttgtagaacttgattgtcttccttcgagtctgacgttctgcttcttcaagaaccttgatcggtctttccttgtaggtcagattcttttccagctcgatattacctaggggaacttgctcttctggaactcgaagacatttctttaactgggatacgtggaacacgttgtgcacatctgcgagaccttcaggtagctcaagctgataagccacttcgccacgtctggcggttatgaggtaggggccgatgtagcggggtgctaacttgccggacatcccaaaccttctcattcctcggagtggtgatacccgtaggtacacatgatctcctttttcgaactcaaggtcacgcctccgattgtcagcgtaattcttctgacggttctgtgctgtcctcaaacgttctcgtatcagcttaacttgttcttctgctgacttgagtatgtcaggaccgaataccaaggcttcgcccacctcattccagcacaagggagtgcggcaccttcttccgaacattgcctcattcggcgacatctgaatgctggcctgataactgttgttgtatgagaactcggcatacggcaaacaacgatcccaagtgccttcgaaatccaaggcacatgctcgcagcatgtcttctaggatctggtttactctttctgtctgaccatcggtctgcgggtggtaggccgtactaaaattcagatcagttccgagtgcttcatgcaattgcttccagaaccttgaggtgaactgagtgcctcgatccgacactattttcttgggacagccaaatctacatacgacatgagtcatgtagagttctgctagtttctttccatcataggtggtcttcactggcacgaaatgtgctgacttcgtgagtcggtccacgattacccaaatggagtcgtatccgctgggggttcttggcaaaccggtgatgaaatccattccgatctcttcccatttccactcgggaatcggtaggggttgtagcagtccagctggcctttggtgttctgccttgactctttggcaaatgtcacacaaggctacgtattctgcgacatctcgcttcattccagcccaccaaaagtatgccttgatatcttggtacatcttcgtacttcctggatgaatggagtaagcggactcatgagcttcctttaggatgagatttcttaactccttcttggccggtacacagatgcgtggaccgcaccaaattgtgccttgatcgtctatggagaaattggtgtctttcttctcctgtattctttttattaattcttttatcccttcgtcgtctttctgagcctcccggatttgcgactctagggtaggctgtactgtcaagctggcagggacacctgactgcaccacggtcagccttaacttctccaattctctgcacaggtgatcttggtcaggccgtatttgagctatattgcaataggccttgcgacttagcgcatcagcgaccacgttggctttaccaggatgatagtggattccaagatcgtaatccttgattagttccaaccatcttctctgtctcatatttaactcggtctgagtgaagatatacttaagacttttgtgatcggtgtatacttcgcatctgttccctattaagtagtgcctccagatcttaagagcatgaatcacggctgccaactcgagatcatgggtggggtaattgacttcatgaggcctgagctgcctggatgcataggccacaacctttcgttcttgcattaggacacatcctaagccctgtcttgatgcatcacagaagatctcgaagtcttttcggatatctggcaaggtgagaactggggcagtggtcaatcttttcttcatttcttgaaagctgtcttcacaggctgtggaccattgaaatttcttttccttctttaacagctcggtcataggtctggctagcttagagaatccttcaatgaatcttcgataatatccagctaagccgaggaagctgcgaatctccgacacattcttgggcgggttccacgcaagtacagcttcaactttgctgggatctacttcgacaccgttggaggagatcacgtgaccaagaaaagctactcggtccaaccagaattcgcatttcgagaatttagcgaatagttgatgatctctgagcttttccattatcagcctcaggtgttcagcatgttcttcctcattcttagagtatatcaggatgtcatcgatgaataccactacaaactggtccaggtattccataaagattttgttcattaagttcatgaagaatgctggagcattggtgagtccgaaggacattactgtgaactcatatagaccataacgcgtcgagaaagcggtcttcggaatatcttcagatctgattttcagttggtggtaacctgacctcaagtcaatttttgagaagactcttgctcctttaagttgatcgaataagtcgtcaatccgaggcaacgggtacttgttctttatagttacttcattcagggctctatagtcaattaccattctctcagagccatcctttttcttaaccagaagcactggggctccccaaggggatgagctaggtcgcacataacctttactttccagttcttcgatttgtcttttaacttctgctaactcattagcggccattcggtagggtctttttgcaattggagctgtgcctggtgccagttctatggcgaactcaatctctcggtctggtggcattcttgttaattcttccggaaatacgtcgggatattcacagactatgggcaccgactccaaggaggtgacttgcaaacaggttaggatagaccgacttgcggtaggggtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagttaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcaaacaggactattgcgggtacggagttgacagagaacatacccatcacaacgtctggagcatcctgagcggtttcagcttgaatgtgattcacacgtcctcgaccaaagtggttggaagcacgagaaccttgtccacttgcttgagagctaggacgagactgagctgccgctggagtaggagttctggcagtgctgccattagcatgtcctgggctggtgttggtaggattctgaggacactgtctagcatagtgacccatctggttgcaccggaaacactgaactgctgacggtccctgtggtgacttgaaggaggtaacactgtttggcgcagtgttgccactaggggcacgctgctgtggcggaggtgccggacggttcatctgaggacgaggggcgtagcttgactggcggttagcctgagtgaccgactgatggtattgcatgggctgaccgtagcgagggcgaggtgcgcctcgggaagaatttccctgatggttagacttgcgtttcttgtattcttcggtggcctcttttctggcatcctcaagtagaagtgctttgttgatcatatgttgaaaagtggggaagtcatgagcaagcaactggagtctcattccaactgcgattcctttcaagaatttcctgatctttttcttatcggtgtctacttcctcaggggcgtaccgagccaacttgttgaactgacttaggtactcattgacactgctgtggccttgcttgagtctgttaaattcttctttcttcatgtcaatagtgctttcaggcacatgagctacacggaaagccgtagcgaactcatcccaagcaatgttagtgggttcaggatgtgcattgcagtaattctcccaccaatctgcggcaggtcctcttagctggtgagaggcgtagagcgtcttctcaacaggagtacactgcactaagttgagttttctatccacatctttcaaccaatcgtcagcctcgacgggctcgatggtctgagagaactctggtggacgtgacctcagaaagtctgtcagcttggatctattgttgcccacgtgagggtggccatttccatgcgcattatgctgaaagctggctatggctgtggttagaccttgcaagatctgtgtctgaactgccattatgtgttgcatgttgttttccacatgaggtggggaagggaggcgttcttctccagaattgtgactggcagtgcggtgagagcggtgagactgctccaactctgcttcacgggaaactgtgcgatgcgagcggctgctgcggcgaggttgctcaacctctgcgttgcgggaaacagtacggtgcgaacggttgctgtggtgagaatgctcattagctggttcgtgatttgcttctgcttcaactctaccatcttcaaaaccaaagcggactggtgcacgagctgtacgacgggggcggctagccatctaaactcccagaaaagggcggggtaagagtcagataagcacttaggagggcaaggagcaaagcaaatagcaactcagatagcacacactaggcataaactggattttttcaaatcgtaaaaacacctgatacaacgggtgtggacaagtcacagagctacgccgagcttgactgtgcgcacacctcctaggagaaccagactaccaaacaacacccacatcaaacacacacacgcactacctcgccacgactccaaaagagttggcggcggaacaaaagggcctaacacacggacggctgctgaagactgcctcctctactcctcgtcggcctggctgcctcctgtggtcggctcctcagtcgaagaaacgtcgatcggctggcgcgaagggaccggcgggacctgtcgagggccggcagcagcacgggccgctggcggtgggggagctgggtggcggaaacggaacacggtggaagaaccaacaacacgcttccgcgcagtgcggataaagcgtgggccacggcgggaggaagcgactggagtgtgtccgggggtgtaggaagggctaactgggtgtgggtagggggagtacactggtgagtacggcgcacgcgagctgggggagcgcgggccactgggagtgcgagcagagccgcgggagctgtgggaggacaggtggctggcgtggcagagacggcctgagtcccaagagatagtgtcaactgaggtgacaccctcctcggccagacgggcctccaaggcggcgtagcggcgggcaagggagcggtaagcctcaaggagtaggtcgtgctgagtggcctgagcctccgaaagctcgaccatgcgagtcagcactggctgagactcgctgtacggacaagggtatctggcgtctgcgtggccagaaggaagacgtggaagctgccggaaggcggagcctccgagacggtggccgtagtcgtgggccaggcggcgaagcgcagtccaggagaggtcctggtacgcgatctggagagtgggcctggccacagtgaagtggtgggggcgaaggccaactccgtgtatacctccacgagggtaaaggtacacagagagctcacagtgagggggaacacggtccacggagtaccccgtgtactcgggacacgagaagccaaggaaacgggcgaggtcacgaagctgggcgacgtggtgaccctcaccaaaaccgtgggaactgaaactggcgttcactgccatctacaattttgaaagaggaagaaaggatcagtaaccattttagaaacaaactattgaaaagaaagaagaagagagaaaccttagcttttcgcaagtagttttgaatctagtatccttagggtcgtcctaagcgtcgggtttcgccctagggccaagcctgtgctctgataccatctcttgtcacgccccgagctagtcccgaccggaactaacccgtgacgctccaaactaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcgtagccggcttgctcctggaagaactcctcatcagcaggatctgcttcatcttcttcagcaactggggggggatatttatatagagcaagggtgagtacgggggtactcagcaagccatgggaattaagtgtttaatgcaagcttcaaggaaaggctgtttgtttttgcgattggttttatttgaactcttttctaaaagcaactaagtgagtgcttctcaaacgacacggatgaggcagtgcgtctcgtccggtcggagtatgtgcaatgtatcagtctttagattttgaaacaaggttggcacccggccaaaagctttttaaacggccacccgggccaacacctttcaaacggccacccgggccaacaacttttaaacggccacccgggcctagctgatcccatcagctgcaggttttccaaacatagaacccagtttctcaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgttccccggtccgcggttttggaaattcatttagttcacaagcaccgacccaagtgtcgggttttccaagtcttttgtaaaactccagttttacccaagttgttactcaaattttaagtttgaaggcgaccgtcgatattcgcacagagtgcacgattatcgaggcgcatctgggtggttacaaggggacatggtgtagcaattttcaacggaaggatcaattgcaacaagttaggtaggtccgccaatctgccttgcagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacggaacaactcaacaaacggcgaaaataaagccctattaatgacctctaagcgtgccattggatagatctcgagatttgggaaattttggaagttgaacggagtcaagcggagttatggttggaaagatattgaatttctaagattattggatttttggtctaaaggaaaaaggatttaattaaatccttttttggaaaaaggaaaaagaaatgatgaagggagggaatctagactttcctcggacggctagggcgcggcccaagggaaatggagcggaccggccaagctaaatgggccggccggcccaaggcggcccaagcgcgcgcgcgcgcgcgggagggaggagagagagggccggtggaccgggctcaccacgcgcggtcccgggtgggacccgcttgtcggcggctcggctcaccgtgagcggggtgcacgcggcgtgctagggtttggggaggggaggcgcggcgcatgcgcgcggctcgcggtgagggcggaggcggcgggcccacgtgcagcctcacggcttaccgcggaccacgcgcacggggagaaacggagggagcggctggccgggtcggcttatctggtcgcggccgaggtggcgccgacgtggcgcctacgtggcagccacgcgggtcggcggaaggtagacgaaggcccagccgaaacggacggcgggcggcggcggcgatcggcggagcgagccacggcgatacaagcgacagcgagtacaccgggtggttgcacgggacgcggggaggcgagccaacggctcggattcaccggagggagcttgacggcggcgaatcgcggcggcgacaaccggcggcgggaggagagggaaacggcgacgaggtcacgaggggccgattcccggcggtgggagcatctacgcggccacgggaactcgatgctagcgtcggatttggagggaacacgccgagggaggctggcgacgtgcgggtgctacggaactcgggcggcgacggcggcgagcacatggcgagcaacggcatcggtcggggcggcgccggccaactacgggaggtctactcgagctaaaaccgaagtctaagggggggagacggagcgaggagggagaacgaagcgaaacatcaccgcggaaaggagaggcgctgtgacgagaggccgacggcgcgggagtgatctctccggcctcgggccggggaagaggaagaagaggcgcggccggagtcctcttcggcgtccttgctcgtgccggctcctccgacacgcgcggcgacgatcggcgacggcgaaaacagagacggcagtggaggaggcgaaaatggggagggaaggagaaggggaggccgggggtttaaggaggcggcaatgtcggtttggggaaccgacttgcgcggtcaagagcgcgagctggcgctcggctagcggccaaattggcgacagggaggatgacgccggcggagaggtaaaggggaaaaaggaggggagaaagggggcttgcccctttgccggttcgggaaaaaggaggaggggagcggggcgacgcggcagagggagggggcgctgcctccgtcccttggcggcttgcgcgcggagtggcggggccgggtgatgacgacggcgatgacggggggaacgtcttggagcggagcggcgacaccggcgacaggcgtgcgcagaggctgacggcggcggcgaccgggcggtcggccacgcgcgcgcggctcgcaacgggaaggcgcggcggatggtgcggcgcggctcggcacgcgcgctggctgcggggccgagcggctgcaggctgcaggcggcagggcagcgggaccgggcggcatccacgcgggcgcgcgcgagcaacggcccgcggggagcggcagcgagggatggggagacggagagcgaggggggggcgctcggggcggcgcgcgagcagcgtgcgggcgaagcagaacggggggggggggagagcgcgccgggggagagagagagagagagagagagagagagagagctctcgggagagtgggccggggagggagagggagatgggccgagcgagtttcggcccatcgaccttgggggaggtaaactagactttgcggagggattttgatttagaaggaattggattcggagatgaactcgacgatagatcggggattgagatcatgagatggcacgggcactagacaacaagcaaggaaacaaatttcgcaattagggtttttaagagataattttcccgctaggcgccacgacggaacgggcgctacaacaacgacaaggaggaggagcagtgctgcctcctccctcgtttcgctcgccgtggcattatcgcacgtcttcttttgtacattaccaccggccgcgacatatccatccacagctactatatgtaggagtacgtactaaagattagacgaagcaagatcactatctagctagcactaggtgccacgaataaatagaagtgcatgacgatcggagagcgctgggcgcctagcaacagctcccgcagcaactcgggataaaaaccgactcgatcgctcatcgcgttggaaaccgactcgatcgggcaccctgcaccctgttgtcgagtttcaaaacgggcctcgcgcatatccgccgcgggcgcagacgccgccaatggagggtcccgcgcagatgtggcgcttctttttgctttttttttttcccgctgctgattaccgcaccgtgtagggggactcaacatttaaaactttcaacttaagattttttgaaatttttaactaagattaaaaaatttcaagtcaagatttaaaaacttttcaactcggatttaaaaactttcaatttagaaaattttcaactcggatttgaaaactttcaattcagacttgaaaactttcaactgaagatttgaaactttcaactcaaaattttaaaaaatcaagtcaaaatttgaaaacttaacacatgtttgaaaacttttaactcagaattaaaaattttcacattcgacttaaatttgaaaacttccgtctcaaaattcaaaacatttaagttaaatttaagaaactttcaactgaaattcaaaactctcaactcatatttgaaggcgaaagattgaatttgttaaatatcgtaaaacaaatcatgcgtgtgtgtggagaataaaataggaagcgatttcaaaaaaaaaaaagaagcaatatcaggtgtaacacgtttcttagttccctcagctttacgctaagtttgaattgcatcattcaaccgcaatatcaggtgtaacacgtttcttaacttgcaaaaccggtgtacttgaggtctcagggcaatatatcgcatggttttgcctgacgtggttaatgggacctacatgagccccacatatgtcatcgaccaactcttcttcctcatctctctcacattcttccctcttttccccatccctctttagggcaggtgctgctctctcgccgcacaaaagcgtcgtcatcctattgcacacacggaggtgcggaaggacctccagccaatgtatacattaatcatcgaatctgcatctatcccactatatcagtatcggccaattggttcattggtacagttctttctgtcatctttgttatagtctctaatgacatgaattaatacatagaatttatattagacttgtaaaaaggtagagtctattaacaaatttatattaggcatgaattaatgcaatttcaaattcaacttgtaaaggttgtaaaaaaataacaaattttgttacaacccgcagaagtcaaatttgaacttgcattttgtgaaatgatatattaattgcacatgaatctatcttgtcaatttttttaaaaaaaaaatcataactatttagttgacattcatggtcactgctgtagtagtacaacatactccctctgtctaaaaaaaatctaggattggatgtgacatatcctagtacaatgaatcaggacggactaggatatatcacattcagtcttaggtttattttttgtgggacggagggagtatatagtaacctcttaccgctttatgtgattcctgctgaaatatttggaagtccggacaaaatacagccttcttttttgccgggtcggccgaccactttcattaagatttgagggagaaaaataataaattgttacaaacgacaatactacgatgtcgtgccagttcgggaaagatccccggtccagctaagaacgaaagagaaagaaaagaaaatagccggggcaaatcctcgagacctatccaccgtgatcactcgccaaattgggaaaagatcccagccactctccatacagtaattgcagtgacctgcatatagcctagtggttacagtgacttgagtagtaccccaaaatcctgagttcaaatctccatatgagcaaatttcagattgggttgtttatggagctagattccctatttcaatggcagtatatatacagttggttgtagaggtcgggtaaaaaaaaaacccttctctaaaaaaaatacagcaatttcctctcttatatcctccgctagttgctccggtaacttggacacatgctgaaatattcttgcattacgttccttccaaatcaaccagcaaattagcatgaatgcactgtcgaaatccgacatgtagctcgtccgaaaacaacgtcttgttgcaagccaccaatcggccagagtattgacatcatccgccgggattgcgaagttagcattgcaccatcttcagagaaggatgtgtggtgcaagaagctttcaatagaaacaactgaggaggggcatcaacatcatcaactaccctctagctatatcatccttgtcagaatgatacatctttgtcagggatatttcattctgcacataatcacaatatctggttaacacatctttgtcagggatgaaaaagccttcgaaacttctgcatattgcttgcctttgcttgtaagatttcttttttgtgttcttattgtttctgaagagcgtgtttgtaaggaacatcccaatggcgtacaagatgaaagggatcttcaagggactcaaggtcatctctcagatctttggtcagtacaatagtacaatgttttgggcttttcatgctcctctgcatctaatctcctttcttgcttgctgacatctctcattttctactgacggtcttctttcttgcattctctgaatggtttttgcagtagtgaaggagcatgagatgcagattggtagtccgacagacgtgaagcatgtcgcgcacatcggttgggatggcctgacagggaatgcttctccaagctgggtaaatgtacctgaatttcagtgaaatgatacaatcatcttcttgtttcaaattgtctgatttctctcatctgttctttagatgaatgacatcagggcatcgtctgaacttctgtctttgggcaactttgcaccatctgcagggacctcttgggcttctcaaggtatggcaagaattacttgttcttcagagtggaagattttctgtgttggtgcgattgcttcatatgattgtggcttctttgggaaaggctttggtctgtcttatgagtggcatgtatggataagcatgcaaacttggcaagttactctagtttaatcctagaatcatgggcacgtctgcatgttcttgatctgggatccggagttgcagggaacactccgataaaacaaatccacacttctgatttcctaactaccagcagcatcttttgccaggcaatggattgtgtgtacacatgattactgaaccttttgaaagaaaacttgatgaatgataaaaacatgtaagcctctggtaatcctcttcaatcattatgtgattgatggttagaatcacgagaatcgaaatttattacgagttaagtaagtgtgaggaagttcagagaaaacaatgtttaaccaagaacaatacactgtatcatgcatagtttaatactgcaatacggagtgagctcgagacgtggtctagctaataaactagcagaaattttcttgttgaactcatatggcaggacaggattcggatttgataagaacatgatgtccattgtccactcatgcataaatagatccttcccaaggcacaaacaccgtagattagattcccattgtcacaaactgctgtctgacagacaacaaacaagcatgctaatggccacggaacgactgaaattttgcatgatcactcaacatattcagttaaacactgctgcaacaatgcagttcttggacagcatcagcaatcggccatgtcgatcctaatgtcttcttggcactcacatgctgatctgcttccactgttgggacagatttcgaccagcctcgagactcgtcgtccttcgccacgccgtcagagaacaccagcctgcagcagcaagaagcggcgccgcctcctgacataccacgcccgccggcggcgaggaagacgaggcggaagcggaggtccacgagcgactgcccggtgccttcttcttcttcttcggcgagacccagctgcgattccaccatggcgcctgcttccgacgccaatgcgtcgcaagatcaaaactgcaactctgcaacgtgaagtgcagcactgatcgaatttccgggtgtgctactgctacttgcgcagagagtgctgtacatcgttgtctgttcagtgctctctgctttgcgccaactgtacatgtaaatgggtttggagtttggagtgcagattaatcggcgatcgtacggagaaattggaatgtgatcgccgtttgtgtgtttgattgtgactaaccagagaagttaatttgatgttcaaggatagggatttcgatgagtaggccccaattgcctctgcactactctgtagtctgtcctgcctggccggattactgtcaggtgaccacatatttttctcttctagaaaaagagaagttttttttagtgaaaaaaaagttctcccaccaattttaagagttattgagaggtattacctctgcttttaaatttatgacattgttgatttttggatatttcatttgactatttgttttataaaaaaaagctactcatttcattctagaaaataaaccaaagatttaccttataaattgtttttttatgaagggtgtatgtaagtatcatttattttgtgttttaaactaaaattatcattattttattattaaagacactctaaatatgactaatatttttttatatttatattttttgaatgagatgaatgatcaaacgtcatattcaaaagtcaatagcgtcatacatttaaaaacacatggagtattatatcttctagcattatttttttttcgccgggcttctagcattaatttgcctgaaactaataaaagttacttgtgatgggatgaacaggggagtgactaaaaagaactaagacacttggaaaagcctgcaaaaacaatcatgttgccttctggataaactgatatcacaattgccagtgtggaatctcagcgccggctctccagcctccagccatgcgtattccctgacgctaaagaacaagttgagcaagccaaccagagactaagattcgttcaaacaatgcagtacaagattcctaccaatggtggacagtttttatatcagctccactgttttaatttatacacatggttaatatgcagttatgttccaagccccagcctagctatagtctctgcttgtctcttccggagccgatgaactgatgaacaccgagatgcttttggttggataagatgccgttcgtccctgaattctctgaatccgtcctacttctggtctgtttatagctggatcatcatttcggtttgttgccgagtgaaccaagaacagaaaggattttaggtgcacctttcgctctgacgctgatgaatgatgagtaggaggttgacattgtcacaggtctgccattgctgaattcttaagtttagtacgatccctgaaggtcaatatcaaatcggtgttaatgtgtgtagatggtactaagtttgttgcagtgatcattttcagaaattgtatagtacttgtgctgttccctaacccagctagccttgactgactgcaaaatattcttagctagagcagattcgtgtgccagatggttcctacctcgaaatatgtcttaaatagtacgttttgttcttcaatatctcagagtgatacctgattcagacttcgaaatatatcttaaatagtatattttgttcttaaatacctgattcagactctaggcaatttttactccatttcttgtacttgtactattccctaacgcagctagccttgactggctgcaaaatattcttagctagagaagattcttgtgccagataattccaacctccaaatgtatcctaaatagcagtatagtacattttgttcttcaatatctcaaagagtaatacctgattcatacttcgaaatatactacctccgttttttaagtacataacgctgttgactttttacatcatgtttgaccattcgttttattaaaaaaaattaactaaatattttttcttctgttgtggcttgatttatcacttaagtaccattaagcattacttataacttttaagatgtatacaaaattttcgaataagactaatggttaaatgttgtaacaaaagtcaacaacgtcgtatattaaaaaactgagggtatatcttaaaagtacattttttcttcaatatcaaaaagagtaatatatcttaatagcatttgatcggcctaatcctttggccaacccggcaacaaaagagtaatacctgattcatactgcaggcactttttactccatttctccactggtctttgtcacaaatgtcttgaaatggcaaggtaacctaaaagaactttttgataaatctttatactagtacttttacagctgccaagttgtcataaaaaagtttagtacattaaagtcagtactaaggattaaggaatatggataacagtcagacatgtcaagtggcattgtttaaagagcaaaacttatccacactatgaaaagagattttcctagcagagtcggagataggatcttcatggaaagaaaatagtctgcaagttactactaaatactaacataagtgtgaccttttctagacaactaatctgatgtataaagtataaacaactgggcctatacatatcatatatgattagtaaggcaacatgctatgctccatattctatcttcagagcaaggaatttcacatgaacttcgtgagaaccttttgccttaatcagttcatttccggtaggagacggaaaattttcagcgttctagaagagcccgaaaagaacatgttcaatatctccactcaatcttaatgaaatttggccggcctaatcgttcagccgaccccacaaaatagaacatggtcaatatgatgtttggaagtcttcaaaactaactatatacagtacaattggaaatgctcctgaaaattcaaaccagttaatgaattccattatttaaagaaacaaattcaaaccagttgaatgagaatcacatgcctacatcctatgtcctgtaaaatgctacagtttgtactacttagaagggatccatggatgtgcttagaattgtcaagaattcaaggtccactagatgctagctgcatccttgtgatggcacatgggaattttcttatgttgtgatataaataagctacctgctacccctgcaacatgtatatattctactgaactgaaattattcaagcagacaattggtacatgctgtttaggtattttgggaaggtcagagagatgccccttgtacttattctgactgaataagcagaggcaagtggcactttctggtcactaaaaaaagattagcttcttgtattaacaagtattacagcctgcttctacctagtgagcgatcacatcactgacgtttgcagaggtgcaagggcactcatttaactattgatagaatgtaaactgactgaactagttgattaatgattatacttagttattaaagtttgagaatttaacattgcacttaacactctgcaggtactaagttgctatcttctagtaatagatttacaggtcaatacctgtacttcagaagaatgaatgcagcgtgaaaa

SEQ ID NO: 11071 - DNA, 9306 bp, Oryza sativa
agcatgataggaattaggtttctgatcatcagctgacacaagagagtgatatatgaacactatcgttgtatacgattatattaaactgaatactgacagtacacattaacagtacaatcaatcatccgaggtaatttatcaacatggagagagggaccaagcagagccctttcttcctcagctcattacattcatacaaggacttgtcgttgttgttatcaacactgactgtttcttgaagcacttcagccgccggctgtcgtgaactggcatcgacaaaatacttggcctgcaatgttaagtaaacttgtaaggaaacatacatggatacatataattgggttctgaacaaagaaagaaaatatagagaaactgtttcagaaacttaccagctgtgtgatgttgatatctttagcctccattgttggcattgacttcatatcaacattgttcaagttgctagttaactgtaaaacaacagatggtagctatgtaagaaatgcaggttatatatgtaatgttggtttgaacaacaagaagagatgaacagatgaacaggcatacaggcagaatcttttctaaccttaggggcagctgcagaagaacaggcagtgtcctgcaaggaatcatcgtcatcgtcgtcgtcacacatcatctccgacgtgatgaacgatgcgtcgtcataggaagtagcaaacgaagaagagaagccagaggagaagctgctgctgccagagatcactggttcctggcacatctcctggctgttgtacggtgatgccaagaagttcgcaatgtgcatcgcccagctgctctctccagctgacatggacgacgtctcagctgctgggctaatgcaagaagagtaatgagatgtgttgttctccatgtgtgattctttctagctcgacctgtctctctctctgaatttgtgcctagcaatatgcagcagtagcagtgtgtagctagagctggatgatggtgtgtttatatatagctgcaagaatgcagagaatggatatgatacacaagagaatgaactgtctgtcagagactgaggcaggccagcattggaaaaactaatgctagctctatgggaatcttctcgttgcaattgtttaattcttgcgatggagaattattctacagtagtatacaagtatgattattatggtgatgatggtttttatattgtgctggtgattaggccgaggcggttgggacatacaccatccaatgatccccagtgagagctccacttcacctactgctaattgcagcttctctcttaccaattcactgtactcttggccaattcttagccttaaatctgaattgaactgaatataatatataaaatgcaaattaaagctcctgcctttctttcagaagaaaatctattggaactgaaaatgcagtacactaataatatattatctccatttgcatctaacttctacggatgaacagctagctacccctgttccagtactaagcttttgacgacttcgcgagtaataatggcgaaaagttgcatgtagtagtagtcttggcctcttcttagccttaaatcttaactgaactgaacataatactcccttaattccataattataaggcacgactaatttttaaagttgtttcataatataaggtatgcatgcatgcatgtcattaactagcacatcttttacactaaaatattattatttgaatcctccatcatcaaaatctctaattttattaggtgcatgcattctatttattaggttaatccaaactatgaggtgatgataattatttcttggtatttgtgttaagggtggttgtgtcttatattttggaatggaaggagtataacatacaaaaaagcattgctcttgccttatcttatgaaaagaaaatctgaactgaaaaatacaaatacagtgctaataatatatttccatttgcaatttctactgatgaacagctagctatcccagttgcagacttgcagtagtcctgagctttttttgacgaattccggagcaataatggcgaaaagttcccttgcaatggaggatgcagcagtagtactgaactactgaagagaagacgaatcaggattcagagggattaagatacgctgcattttctctagccgatccattctgatcatgccgggcgatcgggcgccaaagaccaaatcgggccgtggtccattgctcatatcaggcacgtaatcagagtcgtctctacctaatccgatcatgtggatgatcacaaatttcacacgaaatgacacgatcttaagcagagggacggccaatatgcatgcatgcatgcaaagaccgtatctcgcggaaaccatagtttaactagatttttatctctgaaacaactcaagcaagcttttctgaggtgtgatagatgatgatacggcggtgtgatgaactgataatatatacaatctgcatatgcttgcatggtttgcttaacaaaggattaatccatgcagctagtagcatgcaactgttataatgcagccaataacaataagcaagtggtcaaatcaaaaaattcaaaaaccaaaatcgaactgaaaattaaatcacatcgaccattacagacaagtgtgtacagctcatcactctgttctgtgtgaggtgtcatgtgggcaatgcagggggtggggcccacatgtcagtcaatgaggtaggcatcgctcctaggtgacgtcatctcgcgcgtatctatcggatcctgagttagttggtcgcgcgcggcgcgcaatccagacagatgaacgggctggccgggtcaatgcgtgaatacgtagttgatgattcgtataattaactccatcgtctaagtacctagctacagtagcctagtgttcatagccagtagctaccaatttaacaatcttgcagcacacccggcgtagcctcaaccattgattagagatttagaaaaactcagcgcgtgtgctcgtttttctcacaagcatatacatacacaacatttagttatatttagtgcaactggtggtgtctatcaagaaattagctgtacgtcatatatacctatcgatagcgaggagtccatcactttatcaattttaagatataccgctccagaatgcatgcacttatagatttaggtgtacgtgcgttcatatgggtgggtgtgcgcgtgttgtgtttctaaaaagaaataatcttattttggttaatttttgatgcagcctattagcatcaagccatgtgttgatcgatgaagcgctggctgacgttctcgtggacgaatggagattctagatctcagcgacaacgacatgacttgctaacgaacgcgcgacaacaaagaggatcatcgtggatatgccgatatggctcaactgctcaatatagaatttgctaaggccctgtttagttctaaaaactttttctcaaaaacatcacatcgaatctttgaaaatatgcatggagtattaaatgtagataaatttaaaaactaattacacagttagggaaaaaatcgcgagacgaatcttttgaatctaattagttcataattagccataagtgctacagtagcccacatgtattaatgacggattaattaggctcaaaagattattctcgctgtttctaggcaagttatgaaattagttttttcattcgtatccaaaaaccccttccgatatccggtcaaacgtccgatgtgacaaaaaaaggccctaagtaaaattgtttttgttagaaatgaaagaggtaggaagagagagattttatttatacccaacttagcgattttatatatatggtgatgggatggacaatagctagcttggtcgtccagtagttgagtcagcccaagacgaagtgtcgcatcatcgccaaccaaaactcatcagtcatcacggtaatgaatgtcaacttgccaagaaaagaaactcataaggaattaaaaaaatctacagttaagctaccagtgtgaattctcatttctcaaccccctgtgctcaacctatgcaagtggaactgtggaaggccttgtttagttgctattttttttttcaaaaacatcacatctaatctttggataccgtagaacattaaatatagataaaataaaaaactaattgtacagtttgcatgaaaaatcgcgagacgaatcttttaagcctaattagtccatgattagtcataagtactacagtaacccacatatgctaatggtggattaattaggcttaataaattcgtctcgcggtttctaggcgagttatgaaatttgttttctcattcgtgtcaaaaactccttccgatattcggtcaaatgtccgatgtgacgcttaaaaattacttttttcgcgaactaaacaaggccgaaatatggatcctccgtcttgacgatcactataagaatactttctggggttcgcatcaaatgctacagatacaaacgccaccaatgcagtttcagtccacagttaaatttccctggtaaaaaaaagggttgggaaaaaaaatcaaggattcaaaaaagaagaaaaaaagtatatatatcacgttttgacaatcttttattatcgatgtttcactttgaaccaccttttaattaactattatttttattttggacatgataattttacctttgtgatatttagacaatctacatcaattttgtcatacataaaaaaacggtctacatacatccgagggagtttattgacgagtaagagatggcgtacacaaggttgttcatatgcttgagaagagagtcaggtgatccaaagtaaaacatagataatattatctggcctaaaataaaaatattggttaaatgacagctcaaaacattaagaaaaacatcggtaacacaagatagctcaaagtaaaatatacattaagaaaaaagaatgggaacgcgggccaggtcacggcctcaaaccggcgagcccattcggatccccacggcccatgattggctaaagcccattaaatcctcgtagaaaaaaaggcccagtaaaccactcaccacgacactcccccccacttcgtcgtctccgcgcgccgccgccgccgccgccgtcgcgcggcgcaccaagccaccaatcctcccgccccccaccaccgcggcgccgagcccgcgcgcgcgcggggctgaaatggcgccgctgaagcccccgccgccgcggctcctcctcaacggcgtctcctgcatgcggaacgcgcaggcggtgctccgcgacatcaacgtcagcgtccacgacgggacggcgctggtgctcaccggcgccaacggctccggcaagagcaccttcctgcggatgctcgccggcttctcgcgcccctcggcgggggaggtcctctggaacggccacgacatcacctccccgggcgtgttccagcagtacaagcttcagctcaactggatgtcgctcaaggacgccgtcaaggagaagctcaccgtgctcgagaacgtgcagtggttcgagctcctcgaggggaagcacggcaagtcggccccggccatcgagctcatggggctcggcaggctcatgaacgagaaggcgaggatgctctccatgggccagaggaagaggctccagctcgccaggctgctcgccatcgatcgcccgatctggctcctggacgagccgtccgtcgcgctggatgccgagggtgtcaagctgctggagtacatcatagcggagcaccgcaagaagggtgggatcgtgttcgtcgccacgcatttgcccatcgagattgaggatgccatgtcgctccggctcccgcaacggttccctcggaggaaaactttggttgatcttgtgcgttgatgtggggtcaagaattcagctgtatgattctaattcatctccattcatatgaaatccgttggaacaacttcttgatggttcagttttgtgacactttctttcggaaattaacaatgcactcaccatttgaatatgtatgccggttcctttttgctaacataacatacattgaatttggtgcattcacatgtatatgctggtggtgggttattctgttccctaatcaatgtagaaattgaagagtatttgatcatgagttgtgtattcactcgagaagtttcaagtggggggagatcaggtggaggaaatgctttccaattttgtctgaaggaaatattgactgaatcaggtaacctattgctggtttaagagtaatttcgctgtacacattcaaattaaaacattcctgaatctcatgtattgactaatgtagattatgtacaatagttatgtttgtctgaaatttgtgtacaatggtacatcctacatatatttttgtttccaagcacaatagtttcaaatggcttactgttagttcatttttagggtctgtgctggctagtgcaatatacaactcaaccatgtctgatctacattaactaattattctgcctggtatacattttccggctggtgtttctccttcctatttgaatttttggacaaaaggcatgatggccctgcttttactgaaaacataacagctgtctttcctatttgaatttacttatttgtgtgcaattctcatgaatttaagttaggatgcccctgtagaattgagcaagtatgttggtttatctagaaatttgccatctaatggaagtctcaaatgtttggtatgaatatgaaaagatcctatcgtggtcttctgaatctctaacttatggcttgttacgaatatggcatcacattttgcacgcatgggtgtaatgatgtgcaatagtgttgtgttgttttatactctcattcactcattcctgctgtaaaagattctaacctgttgtgttcataaatataggcctcagatgttcttggggaagtagcttgctttgttgattttatgaacacttctgacctctgtatgccatatgctgaaattaaattttctgtgctctgtactgttttaaaactatttcaggtggcaatcttttgcgttatgtgtagcacattccattcttctacatttttctggcaacagtatcgaagttttccttttgtccttgtataattcattaattctattatgcttgtatacttctaacttataaacctaaactgatgttcacattgatttcagatgcaaagtatgatcaagcactattttgaacttgaagagtagactggatctttcacactgattttctcttcgctgtaatgtgaaatagaagatcattgcactaaccagtcacattcgccttaagttgaatatggaaagtaatgtgcagtagcaatctcgtatgtccatctatgactactcaaattctagttcctactctgaactttcatgtattagtatttacctgctagcttcaaatttctgcaagctactagctttattatcatcagtaatctatcattctgggcaaaccatcatatttttttcttagatgtacaaataatttctgcattattttgtatacggaaatatgtaagatcagtataaccattgtaagtgtttccattctccaaccatgttgttccctctagactaataaaaggtagattttcaagagagatatgcatatctccctctcttgcaatgttatctctttgtacagggaaaaacatatattatttgggagcaatagctaaaatgaagttaaaattttatttccacctgatactctttgagtaacatcatcttgctgatagcaagtcgaatggtctgggatagtttacattcagtatactaggctggtctgtgactctgtgttaactctggtactacacaggtgcaggctgtaacaagggagcactgaatgctccactaataagtccccagggaccattggaggtgctatctgaccccatgctggaagtagctggcccactattcaagacaaggtataaagccacttcccagtccagcaccaagccaccaatactacataaatgcgcactgttcttttgctgtattttgtttggttgtaaccttctcttcaggcccaatctagaggatgctagcgtggaatatgtgcgcaatggatcacggtcgaaaattatctttatattgcaaacgatcaggtctagcccagatctgagataacttgttatttttttctaaatgaaaattactgatccgtggtggaattcaattaggatcttggccatctggttcaatacagttgtgttgaaatgctcatgttgtcatctgacataagattgtgattgccctctatcgcgttggtgaactttgttttctcttcactttataaatcccatgtttttcaattgcagagaaaagctccggtttgcattctacaagaaccaagaagggtggtaacttgttgaggtcaaacagaatatttaggatggtttgacacattacgtagcattaattgtcaaaatgctattctattaactaaagggctattggatgtgggaagactgagagtatagataaattgcctgaaataggtagaataactttatgaaaaaagtattggatgtggagacttgagagactggtatatccgtccactcattttcaaagatgatcttttggtttatcagtcctcttattttcaaagataattgttccattagttatctcttcatatcttaggagatatatttggtttgttcctgcaattactactgttttccagcacataaaccttagttatgtttaaatgtttaataattgtgatggaaggagaaagacaactaattgcattgagaaggaggcctgaagatccaaatatagacaagctctaacaggtttgcagcttactcccaagttcagcttactacttgtagcttcacatgtgtgtataaactacttgcattaaattgtcatcatggaagactaccactattaaactggaaaggtatgatatgccattcagataaagctcccaattaattggcagcttagctctttcttttccgagagctgaaacagtatttggagttatggatgggctggtttttattaaacactggagtagaaggaatatgacaatgatacctagagtatatttatgacattaaaactaatgtttgctagaattcaagcatcatgctgatttagctttaaaggatggcctaaaaggggaacttcttctctgtttgcctggttgtgcttaagagaatatgcatgggccaagtgcccaacccttataaatattgccaggtgaaattgttcaccatgcctgcctcttgtttgcactctttccttaaagactgttgtagttggccacatcaaacatttaatcacagattcaaatcctatatcattccttaaagga

SEQ ID NO: 11072 - DNA, 8627 bp, Oryza sativa
gctcaattcacgagaatatttaactatttggcacttttagcctgcgttagttcccgccgttctcaactcccctcctcgttttccgcgcgcacacttttcaaactgctaaacggtgtgttttttttaaaaaaaaattatatacaaaagttgcttaaaaatcatattaatccttttttctaaaaaaagctacaacttaattaatctcgcgctaaacgttgcttcgttttgtgtgccggggagtgagcaagtttaagagcaagtataatagtaggctataaaccggctaaatgctgagttgaggagaaaagagaggagagagagaagaagcgggctgtaaacttacagccggcttggacataagaaccaagaaacactatgagagagacaagtggatcatgtattaattgtaaagagctaactattatatgggtaggccaagagaggactacaaagaaccttatagacaataggtcggctgtattattagccttgctcttagatagtatagctaactactggctccaaatcaactatagctaatctaatagctcattcataaaatagttaactataaaaatatactacaccattaatactcggtccacctctcatacacacgtaacatttcggagtccgtgttgcagctggctacaaatctgtagccccctttcttctctctcttctcttttcttctcgatatgtggttatagttgaattatagtctgctattgtatctgctctaagtgtggtacttaactatacttgcaacatgcatgtcataaacacattattttcaaatagtttttcgctaaatctaagagtggtaaatagttaaatattctcggttcacgtgtgcttggttcattggagttctgttctacaagaaaatttatttacatgtagaaacttttgatgtagcaacatttgaatcaaactcgaagttggacgtacaaacttttggtttgtaaacttctagtgcataattttcgatcagtgaaaaggtagaacacggtgaaaaacaacaagcacgaacgttcaggaattagccctttctgtctacgtccttttgttgtgtacatgttccattccgtttttcctggaccttcacgttgctgacactgggacgcttgctggctggctggctgctactctcaaactatgcaatctgaacaaactgcacatggacctgttgcttgttgggttactatatttatggtcgtactgatgcctagtactgctccaaccgaagaagttgaccagtcaaccatccctcgtcatccatcctatataccccagctcctacagaaaaatggtgaagctgatcgtacaaaaagaaagctcactgccagaaccaatgtttgcctttctattctcaatatttgacgcttgtttttcctacaactcaaaatccactcaaattttgctgtttcaagcaatgcacattattatttcggttagcgagcccggtccaacaagcaactgaacctaccgaatgaatgcttgatgctaacaccttcatcgcaaaatataataacttttgattataaatctggatataaagttatctaaattcatagttaaaaatacttatatttttgagatggagggagtacgtttgtcgtggcagctaaaataatttagctaaaataatttgccggtgcactgcagacgcgcgcggttcgtcggcggtcgcacccgtacaggcaggcgtacgcctcgccgtccggcatttgtgctgcctcgccttggatccgcgcatccccctgtcggtgatcgcgcacgcggggctgctcgctgaagcaacagcaggagcagccagcaagggcccccttctcaaccgcgcgcacgacgcacgcgaggggacacaaatcgtctcgcactcgcagcctacagtcccctgacgacgcgccactgcgccacacgggtttgacttccgtctctccggcagggtcaggtgcctgatcaattgcctcagcgagagctggacactaataggtgcgctacgcgctgcacggtgccagtatcaacacaagatctggcctgcatgcaacatcatcgctactgggctctgttgcgcgctcttcatcagtcaggatggcgctgtcacgctgtgcgttgatacggcaccgatcacgcagtgttattaaagtttgttcccagctagtatactttttcctactatatatatgcacaggagtagctagtggctgactcctgactagctgtacaacgtacatgttggtaatgatgggttagcgtacgcaaaatgttggcttgcggcatggctcgtgagtgcctccaagcattcaccaccggccgccctgccggcttcatgtgacgctcaacaacaatttagcgaggggcgcggtgagccgtgacacgaacgtcgcagctgtgtcgtcgagactgcattgcgtgacaaaaaggcttaaacacttcgcttggttgctacaaaacgaagtaggtggccgggcctggcccgtcggcgtcggcgtcgacaacctgcctgtgattgctcggtaatattaacttgatcgcttgcacagatgtgccatgacatcgcgcgtcacctttttatttttctctatttttctagtaagtgagagagcgatcagctgtacgaatcttgctcaggaaaacccctgctatggccagcaatgttatcacgagtatgaaatggtgaaaggaacgcctcaacttaaaccatacgccctaattagtactcctatttctttaagactgccttggtcggctcactcggtcttcaatataatggtcggctcccctcattggccaaagatggccagccaaaattgccttgctaatcatgggccccacgcatgggcccacccatttctcactccgtccgcctctctcaagcgtgccgcccttctgcgcgccgccaacaccgttcctccgccgcgccgtcattgccaccggcctctgccgcaagcgccgctcccgtcggccgaccacctccctcgtcgttgccatcggcctccgcgcaagcgccgttcccgccagccgaccacctccctcgctgctaccttcccatcgctgcatgcgccgcacccgccggccgaccgcctccctcgtcgctgccttcccatcgccacacagccgctcccgccggccgaccgtctccctcgccgccgccttcccatctccgccgcataggctccacagcgccttcgctggccgaccgcccccctcgccgccttcccttctccaccacgcgcggctccacaacgcctccgacgcgtgcgccgctcccgccggcagaccgcctccctcgctgccgccttcccttctccgccacgcgggctccacagcacctccgccaccgcacgggttcagccggcggagatgagaggagaagaagaagaagaagaagaacaagaagaagaagagagagagagagagagaggggggtggagaagaagggtgaaaaaactgacacgtgggacccacagttacagtggagaactgtaatagagaggctgttggagtgaaaggcagatttgactatccaaatttttgtcaaggtggctaaatgcatatttggagagtgagatttggagatgttgttggagatgctataagagtttgtaattttgctgaaacttttctcacatttcgcaaaaatgaacttctcgatccacatagaaacaacatttcgctagaatttcgaatggactacggccatttcaaatagagaaattttacagttcttgagaaaatatctaaaggtattaatattttacactagaaattcggatacattaagataagatacttagtacttagagataacaagattttacactagaaattttggtacatatgatacttagtagctagaggtaccaaattttacactagaaaatgtggtacttctcggtacattatcaaggacggtaaatctaccctttcgaaaaatgagaaatatgtttttttaaatcctataaacagtttgatatcaagtggaattaaatcagttcaataaaaaaaatgatactaccaaccacccccaaaaaatgatactaccttcatcaaaaagtagttgtttatgtaaaattccttatactttggaactggtaatatttggtttaatatttttctacatttctctacgcattcccataattttccacctttccccatcccttttcctaattttgtactatatttttgccacatattttaaagttctcctcatttctcctgcattttctaattttttttctcacattttttgggcgatatgtctgtttgtaggaaaacataattgaatttaatttgggctattgatcccctcgtttatcgcctcatgtttatttttttctaactaatacttccaaatttctaggattttaatcgaatttcatacctgattacttgattcacagtcgctgaaaatttatattcacattttgtttcttttcaacttacattgaaattcttaatttttgctcaaatatttcacaagactcgtcaacttgctagggctcacatttcaatcgccaaacgagattgtaaaccctggtggatacacacacgtcgtcctgtttagcgatcaacagttctgggtccatttacaactcgcagccgatgatctcatcatcgacggtcgcgatagatgcagatggtgatatagccgtacacaaaagaaatggacagcgagaggaaatgggtccccttcaactgcaatccagcaatctcagcatcaacacagagatgatagagtcgatacatggaccctactactgttctcttgcagctgccaggcgtatgagttcgatccccatggactaattaagccgttatcaggtgagtaggtggcctttgatccatttgttcttccagaaatatctgtcaaatcttgcaacacgcaattctcatcctctctgatcctgtatagtttgtcacataccaaccattttcggctaggatatacacgaccatactgcagggtcgtatgtgtgtcatggtcccctgcagttagtccaaagcggccaaagggtcccccttggctcgagagaatgctttagtgtatagtattgacatttgagacacgtaggaattaagccaatatccacttgcatttggggaaggattgggatttacgaaggggattaggggagtgtgaggcaatcaaagcgattaggataagagacgttgcattgcattgcatatttgcatgtgcaagcggcagcgcagtggaagatggcggagaccgcggcggcaaagcgatacagccttggataagctggcttcacagcctggaaccctggaggactcctgctgccactgcaagtgacttggagtaggagccccccttcccgaggcagagtacgtagggacgaccacgtataagagcaagataatagtgggctataagcaagctatatgcttatgtggaagagagagataaacaaaagtagggtgtattggctctcatgtaagagctcactatacacaagctacaagaaatatgcattaaattcatactgagagaaagagagaggatgaagaaaataaaaatgatcttatagccaacctactatacatgttagctttaacattgactaataataagcagtgagctatactattaaacttgctctaagagcaaggtcaatattacagctcactactagctctaaatcatctatagccaatgtaatagccaattcatacaatagttgcttactatactattaatatctggtcccacctgtcatatacacattacgtttggagtctgtgctgcagctggctacaaatctgtagcccgctgctcttctctctctttatttatctctttaaaatatatttatagatggcttataacctgctattacctgctctgacaagctcaccaatatttcaggctcatttgtatcacataatgtcataaatttcatagaacacaggctaatatctatagtataataaacgatttaagattttttttcttttcggtttgtactcgctaacaaaattccagtgatggttggtagggagacctagataagagttctggctttgtcatgtttagttctgtggagagcaggtacaccaaaatgttccagccttatccgcatacgtgcaatgcagatcatgtagcaggggcctaacctaacttgtcctggatgtatctacgtccttcttatcagcggtccatggcataaacgggacatgaatggcggtatgctaatgcgtgggggcggattgatgatacctttgatatgaacaagagattttctctccattagattgcaatcacagatttgggtgaattacaaatggcgaccattgctaaggacgagggtgatgataagccttggatggaatcattggagcatggaaggtgcctgttgcatctatgatggcaatatattcgaccttttttggagcaaaagaatggatggctgatggacggcaaggacaagcaaagcatgcggattacgttgcaatattgcacagggaatacgctggaatttacccaaacatattgctgcatgcctcgtcacccgacctataggcagcatgattgcacgttttacaatagttgggaatgtccttgccattgttcaccgtacacctccaggcataattcagcagcgacattcgatccaaagcgaccaagcagcccaggatggaaaatctttaacagccacagatcgataaacaggaatgtaccccccagccacggaacatggctaccgcgcgcgaaccctgaaacagcatcgaccgttctttcctggcagatccacccaacgcaacagcatgtgttcctatccccacattttggaatccctctcttgtgggcaaccaacctagcccggctaatgaagaagggtcaactatccaaactccaaaggtcatacttcccccgtggtccaggtccttacgtccatacgttgatgcaactgcacatcatgctaaatgatggtaaaatctaggcaaaaaaccgaacacccctcaccgagccggccgcgccgccgcggcctcctcgacgacagaaacaaacggcacggcgggcgcgcgcgcgcgcacctacctaccactaccagcacgcgcgtcacgacgcatcacgttggagtattacgcttcggcggcagcggcaacaaaaactactagatcgtgaacctccttttcactcgcggtcgcggaggcgaccgggcacggcgacgcggacatgccaaccgacggggaacgaggcgggagagaagaccgcgcgtcccatgatgtgagctgccgccgcgtgacatgccaatgccaatggcatcaggcggcgaggagagactactagcgagaggaccacggcgcgcagttcgctctcaatcaagggcggccgccccctccatggccgtctccatccgttccgtcgtccatcgtgggcgagcaatagcgtatcacaatacggcactccacagtccacaggggtcaggagaaagacagcaccggtattctgtactgcgcagtagtacatttttagggtttccgcggaaaggacacaacattttgttgagggcctttttctaccgagaggagaaagagacacagtttcgccggaggtacggcataaaggtggtgtggctttttcggtgatgatactacaatacagcaactggcattgttaacctaaagtgtacaaaagacagaaacaaagaaagaaatacggctcccctcttctctaacaatattactaccaacagaaatcagcatcgtctgcaattaagaatgagcttgattgaagagcatgaatggaacgacaaggacattaggcgcgacggactctctagtacgaaaacacacacacacacaactagtcaatcaggtgctgattagctttagctttacgaataaaatcgagtagtaatcagcagcagaagcacgtacctgtcagaacccccaccaaaggaaagaaaaaaacatttatacggcacaacacctcgatcgcaaggcacgcaacggagtagattcatcacagcgaatccgatttacgaacagactccaattccaactccaagcacagcaagaatccaagcaggcgattaagccacgggtaaagtcagaaaagaaccccgtcggttagaccatcactttcgcgcgagccacacccgcgcccggcccggctcgcccgcggcctggcacgggcggagaccgacgcgtgtggcgggcgcgccgagctgggacgtgcccttcaccatggccccacctgccagcgacgaggacgattccatgtaccaaatgacacgaaatgtttcttctacaatcttcgcagcctcgcggtcgcggggggagatatatatttatattttttggttggacgcatttagcggagggcgacaagtcgatgctaagtgcgagctggcaaggaaagtgagatgatcaataaaaaaaaaacaaaaggttcttgacgcctctactatagagttgtggtgaagatgaggtgagatgagcctgagggggtgttttgtttgtgcgaaaagaaaaggaggagaaaagacattaaagaaaagaaatctttgatggcatatggcattggcaatgtgagaggaggagcacaataatgattttgcaaaagaataaagcggcgagagagggtgtgtgagtgt

SEQ ID NO: 11073 - DNA, 1026 bp, Oryza sativa
cccacgcttccgctccgcgcatctccgtgggtgggttgggcatataccttgcttcagtcgctttcccatctcttgcttcgtcctgccttcttctttcttccgtgatcccggaacccggtggtcgccgccgcctcggtggatcttgctcggccctgcggggtgctcaggtgcgtcatcccttcgctgccggtgggcattggcttgtgttgctttggttagtctctgttcaggcattccgtcgagcacctgtgctgcgttggggcattggaggccttcttgtttgtttgatctgtaattagctctggtggtgctccttttttttttcgtgcattttgattgttgtgtgtatcttcccttttcctagttttagcggtcctgaaaaattctgggttttttttttctgtgtttctttcagcatgtccccttcatagcaatgtacgctggtcatgatctagatccggggttggctacttgatgtgtgaaccgtgaataagtttggtaatcaagtgttgtgagttgtgatttggaatgggtttgcaatcatcttgtgtgaaccaagcatgttcactactcaaagcagggtgaattttcagcatgatgtttgaatttcatcttatccatgttgcctggttatcgttgtctcgttgatggtattctgtgaattacattaggttgcagaaaatgtttatacacttacctgcctggtgaaattgcctattttgtgtctgcattgtagtgatcgcatttgagaagcttatttgcacaatgtcctacacaaactgtttgaggagatatccagttagagccatctttccatacactaatgccatcctccgagcttttttggagaaaggatctccggaaaagtcactgacagattacaacagtatgcttcgtttcactgctttctgccctgattacaggacatatgtgctccttctcaaggcttgtgcaaaaatgttcaaatatctatgctatcatggaaatccattcccatctcgttaaacttggcctgctatctaatca

SEQ ID NO: 11074 - DNA, 869 bp, Oryza sativa
gcggtgtggggcgacctcttctctcaccttcatctgcaccatggttttcatgcactagaaggaggatctgtggaactccatcatcgccggcactgccactacaggcttcctctccatgcaccatcgagggcgccgggcttatgcttaacagcgtcctcgcctctcaccgtcgatgaccccaccctcgccgccgccatggcccaccggccgtgtcacgccctgaagttcccctccttgctttaaaatttgttaaataaatcgtccgaagaaattgtttaaattaacctagaagatgaatcccctaaattaataaatgcaactaataatcagaatcggcatgtggaatttttcttggattctacatgtcaaaatatgctaacaggatttagtggaatttttcagagctcaataaataattttaaccaattaaaaacattaaaccacaataaataatccctggaaaatcctttttttttttcttttctcttctttttcttcctttttcctctctttttcctcttgttgggccgtcggcccacttcctcccgcgcccttcctccttcctgggccggcccaatccctccctcctctctccgggtcaccgacaggtggggcccacctgtcggccccttcttccacctccagccggcggtggcaaccgccgccgaaaccgccacgccaccgccgctttccccgctcctcccgcgcccactccgcgccccacgcccctccccacgtcgccacccacgtcccgccgtttcccgccctcgcgcgcacccgagaaggggcaggattcgattcgaatcctctccccactctctctccccacctccctcacgtcggcgagaaatccggccgcctcccggcct

SEQ ID NO: 11075 - DNA, 1361 bp, Oryza sativa
agtgtagatacgaactggtacataactggcacagttagctagtggaagtgtggaaccacataagtttgtatagtacatatatgtgtgcttccgcatgtttgggcaaacttcaaataaatatactataacatcttataagttacaaatgaaaattattattataatccattctaataattatatacatgagtgcatgagatcaatctacctagcctacgaatacgcatgcaaaataacctggtcttttacaaaagatccttcaaacaacaaacatgttttcgggagtggggaaatgggtgtagagcacacccatttgcctcaactccatctcaaaggaagataagtgacgttatgtgtccatatgatctttctctagagacttttaactctgtgggagcaatttattgcaggggcctatacccttgtggttttcatggcaagaatgtaacaactgctatgagcaataattctagtctctcagttgttataggttttactatagttttaacattaaacacaaattttgttatatttaacatgtatttctgttaaattgatcttcactatttgctcaaaaacccttttgcttgtctagctcctatgcaaagaattgaagatgacagtgtatgcatcgaagacatgatgcggaagtgtggagttattgattctagagttgatcagggcatggaaggtcatcctatcatacccactagtattttatctgatctatttggcagcagcagtaaaatcgatgctaatttacccaacaagaaggtttgtgagaactgaatttcagtcaaatgttctgtactttcaccatataactgtttgcatgtttacacattacagtatatatacaactgatgaaacctgatgcattgatatggttcaacagattcgagcacatctaagatccttgaagcctggagatgcttgcgaacttttagaaaaattagtatcttcatggaaaacaaggtgtccatgactcttttcccatgtttgatcccccacaacgcattttcattcgtttttatccttgtatgcttaccaattgctgatttattctctacagatctggtagtgcataggttgttttgcggtggatatactgcttattaattatacatggtcgttttatcccctttgagaaatctaaaaaaataattagcgaccttgagaaggtattatatgtgttaccagtactatctcttgtgtgctatgcagattatttgaaacatgttactgtttgggttgtcatcatgctgtgttgtagtggagttggggggttaagctattagcaactattgccttaaatgactgcagaatgtggataacatattctgattctaatgtaaagacca

SEQ ID NO: 11076 - DNA, 3138 bp, Oryza sativa
cttcacttttgtagatcgtcaaggatccaaacgatgtttctgagcttccatcagaggagatgcaggattcagcggctgctcagtctgatgaagaggaggaagatgatgaaattgatgaaacggtgtatggtgaagacgctgattcgtctcaaacaagtgatgacgacgctgaatagaaacactgagactaagcgtagcattcttatgatgtgttgttttatattcaaacttgattaccccgtagtcaggtttgtatgactaagcaaccccgaagggttgcgcagaattttgacgaggcgaagcatcctctgaatttcacctcggtgtttctcccctgccttcaccttttaccacaacacggcattaagaccgagctaaagctcatatgccgtggttaactacttgatgggttctctcaagtgttaatgcctgcttttttatcacaccaacccaataactttagtccaagatttagattggtgatcactgcatcactttgatcacaccaacccaacaagtagtccatgatccaacagatggtgatcacaacatcacgttgactacaacgaccgtgtagccaacccggcgaaactttcttcgccttcaactaaacattgacaaaaacgacatgctaactggggcctcctgacgtgtccttccaacccccccggcctagtaaagagataaacgaaccgtcggcgccatccaatttgaaccgtcgccggccggtgctcaccagacaccagagtaccagacccattcaggccagggctcaccaaccccccacctttggcgctacctatttaaaccgctagctgccactctctccggcatccactcaagcagagcagagcagcggcaaagcaagtgatctctttagctcggatcatctctgcatttgcatttgcagctgctcgtcacggcaatggcatccaccaacagctggacccacgagatcgagtcgccggtggccgcgccgcgcctgttccgcgccgccgtcatggactggcacacccttgcccccaagatcgccttccacattgttgccagcgcccaccccgtcgacggcgacggcagcgtcggcagcgtcaggcagttcaacttcacctcaggtatatatatatatatataccgccgtccactaagctcaatattccatcatccccgagatgcacttgatagtgcggtggcaaggggtgtgtggtttcaactatgacgtccgtcccgtgttcaatccccaacacgttcataattacattcacctgctgttctttctgcagccatgccattcagccacatgaaggagaggctggagttcctggacgtggacaagtgcgagtgcaagtcgacgctggtggagggcggcggcatcggcaaggcgatcgagacggcgacgtcgcacatcaaggtggagccggcggcgaacggcgggagcgtcgtgaaggtggagtccacgtacaagctcctccccggagtggaggtgaaggacgagatcaccaaggctaaggagtccctcaccggcatcttcaagaccgccgaggcctacctcatcgccaacccggacgcttacaactaaatcgtcatcatgcctatgcccccaaaatatgtttgataatatttgatctttgcgagtgtgtatgatcgaaataaagctgcttccaagcagtgattgagaagtgagcagcgagaagcttggtgtgtggtttggtagctgtcgaagaatggttttgtttgacatgatgctgtcaacaccgcgctatgttatgtatctatctagcatctacctgttggttttgcgtgggaataaaaacatactataaaagataatgagctcgaaagctactatctgtgaactgtgaagtactctgctttgcaagatatcagctcactgtcttctgcttcctcatagaaagtttcactgaacatgattacatttcactccttttcaatgaggattagatagcatatcagtaatcagtctggtgaggccgtcgaaaattgatttttgtatcaataactattggttgccaccatttctacctatcatgtagtgctacactagggaggtggatttttttcccccggagaaaggatgtccctctcattttaatgttttaataagatagataaatatgtgagatatcagtacataaatatgtaagtatagatcatttcccaaaccttaatgaaattggatgaccttccttcagctgtcccggaaaaaaaaatcaaagtagaaaaattaataaatttggctatgtagcgtaagttgaatttaaacttacccctttatatagtgatatatcatatatttttctttcttgttattttttttaaaaaatatgatttagatggcatgcaaatacagacgagaagaaataaaccttccttactagttactactctatcttttaaaattctaatagtatactgctgtactagttactagttagaaggaaaaatcgtttttcatactgatacaagatacaaatgatgtttccttgtcgtctaatccatttattgcattcaaattaactttcaaaattattttgcagcacattctaaattattttgcatgtctaaattaaccagagcaaattttataaaaattatgattgttttgtgtgtgttgttggatttagggtagtatgcttgtttgtttggcctgcggcctgagtccgggacatttaactatttgcaattcataatccctcatgtatctataatatgtgagtatagtaacaaatttttaattacccattcaaaagtgacaaatagttaattattcccatgagtccctgttgagagttgtgtgcggtgttaccgtgttcgaaagctggagtccccaacgctttgtatcgaaccaaaccttacgctttcagtaaaaagctgggctctctgggcctttctctaaaaaaaactatgattgtatttgttaattaccggttagcacaatttaaacaagtcatttaaaaattataacaatagctgatgattttagaaaactacaacttaattcattttgtagaactaaatttaccatagttagttaacgtatatacacaatcaactttgttttttcattgtgatatgtaaaagttggattttatgtcacatgtttgtagagaaatatatcac

SEQ ID NO: 11077 - DNA, 2914 bp, Oryza sativa
ctgctggttgtccatgcaccggcgcacctggatccggcagttctggagcaccacctgcgcgttgccgaagatgaagtcgatggtgccggtgatggtgcagtcgcggtagtactgcctgctggtgtgggtgtagagcgtgtcctggtgcccgtcgaactggcactcgtagaacgccgactggtcgctctgcacgcggagcgccaccgcctggtggttcttggacccggccgtgttctccacgccgatgccgcgcatgaagaacccgttgccgatcgcctccatggtggccgtgtccttggtggtgatgttgagcatgaagctcttgttccccgtgatgatggtcttggtggcgccgtcgccgatcatcaccaggttcgtcacgttgcgcgccaccgacacgtactccttgtacgtcccggccttcacgtacatcacgtacgtccccgtgctcttgaccggcaccttggccagcgcctcattgatggtcttgaagtcgccgctgccgtccgccgccaccgtcacgtccggcttgaactccttggagcccggggtcgcctccagcagccggcgcttcgcgttggacatccacacgggcacgccgtcgtcgccgagcagccggcggctgaatccggtgatgtccaggttcgccagcgtgtcggcgaactggtccacgatggcgaggatgttctccgtcagctcctgcgagctcttgagcgccttgcgcatcttctccgacgcctccgtcgacgtagagttctcgaacccgtcgaggcacgtctcctggtacgtcagcgccgagctgagccacgtcttgacgtcgtccacggcgcgcttgaagttgctcgtctggaacccgccgagcttgtcgaacgtcgtcttgaggtcgtcgatggcgtagtcgagcagctcctcgcagtccttgagcgcgtcggacgtgcgcgggtcgttcttgaggtcgttgagcacggcggactccctcaccgccttctcgatccgctcagacgtcgccttgaagatggccttggcgaggtccgtcgggttcgtcgcgttgcccgccgtctgctccagcgtggtctcgcacgtctcccggtagtccaccggctggcagaacgacttgatcgacttcaccgacgtcgacagctcgccgtcctccttggcattgctcgacccgttcttgaacgacaccacgcacaccgccgccaccaccgccaccaccagcacggtcgacgcgccgatgatcgcgcctttgctcattgcaacacaatgcaaccaccagtcgacgattcacgcgagatatgtatcaaatgatcgattttgcgcgcgcgcgcaaaggcgtcgggatcgatcgatgcgtcgtcccctaccagcggaaggggtccggtttattcggtctaaaaattggagcaacgaggagtaggaggaggaagagtagcaggaggcggcgacagcggcggcggcggtggcatctcttatacgagcccgcgctaactttggacatggctaaaaacgacggtggttgcgcatgggcgtcggaggtcgccacaggccgaggtgaatggagagccacacgacggatgccgccagtttgtttttgctttgctcgtggggattttctagttgcatgcaggcaaccatctgaaattttgttgtgctatcggctctgaaattttgttgtgccgtactgccgtcggccactaccaagggtgaagctcctggagctgctattggtggagctgcatgtaggcgccatgttgaatgaaggccacgccaatgtgtccgataatgcttatgcacgggtgcccgatgagagagaaaaatatccggcgctcgcacgtctcattccacgtcacttggctccccacacctcgctcggctcgcctcctctcccccgttcggcgccgcctcctctcccacgagctctctcgcttgcgccgccgtctctccccagccgacctcacccgcacagtctcctctcccgtcaatctcgccagcgtcgttttctccgttggatctgccgccgctttttgtcttcctggacgttgacggcggcttcgtccccgtggtggcggccgacgcggaggacgacacacgtgcggtgaggtgatggcggcggcggtggtggtgtaggctcgccggctccctctctcccccaggagcactctctcctcatctccgccgccctcccccttctcctcctacagatccgatgatgggagtggtggagaagacctacgcgagcaagcctgtgttcatcggagagaaggaagatgcagtccatactaggttctgtgtgtttttttttctgtgtttcaagctagtatactcgtgatgttcttttgtgtttggatcaaatgtcagtggatatttcgatagtgttctatatttctattttcgacacacaggttttgttgatgtttcaatggttcaaaaacaatgtttcagttagtgtacttgtgatgtttctttgtgtgtgtgtatcaaatgtttgaagtggattttagatagtgtttaatattttcaaatacacggggtttgttttgatgtatacaaggtttaagtgtttcaatgacttaaatcgtttattgtatatattgaattaaattgtttcatctaactatctcactatgtttcacttttttttaagaactgtaacattttttttctaagtgctgaaacatctattatataattaaaggaatagaaaaaggagcctccacgttcgctctcatggcctagaaattctcacattaatcggagaaaaagaaaaaacagagtccatatagaaatacaatttacaaatagctgaaattcggaattaaaaataaggaatattagaagaggggactagagtccatatagaaatacaatttacaaatagctgaaattcggaattaaaaaataaggaatattagaa

SEQ ID NO: 11078 - DNA, 4409 bp, Oryza sativa
  unsure (1)..(4409): unsure at all n locations
catatagaaatacacttaggaaataactgaaattcggaattaaaaataaggaatattagaagtagactatatcatccatatagaaatccaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttacaaagaaatttggaattaaatatataattaaaggaatagaaaaaggaacctccaagttcgctctcatggcctagaaattctcacattaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagaatctgtctatatagaaatacaattaggaaataactgaaattcggaatgaaaaaaaggaatattagaagaggagactagagtccatatagaaatacaattaggaaataactgaaattcagaattaaaaaaaaagaaatattagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaatgaattaaaaaaagaaatattaaaagacgagtctagagtccatataggaatatatataatttacaaataactaaaatttgatattaaaaataattaataactaacacgtatataaatataatataaatattacacattagtagttttgtaaagttattgtacaatttagaattatgttgtcattttaatatatttgaataatataatgagaaaacatatatgctattatatgagagaaaatataatgatgctagccgcgcaatctgcgcgggccactatgcttgttatttttataaagggtgaaacaatgtccaattttaaatcgggcgtccgaatttgtagacggctaggcgcctcccagtacgttgcgtaggatgaaaccatcgttcaggccggttaggaggcaaaacgaatcggtttggtagttgagggatacatatcagactcgtcttattccatatttttactagtatggggtgggagtggaagaactcgaaaggcccataactcagggactagctagtagaacaaggaggaaaggaggccacctttttactcagccttactgttgaagtgtcgatgaaaaactgaaaacatagataagtccagcaagcaagtggttagcctcttaaaacgtgtcgacgatgatgtatcacgtcacgtacgttctcgtgcagatcaaaaggggaggctagcatacacggcctcggcctgtacaagttgtactctacggagacagcgacctcagccctccgagacgcaaaatgggacgggtcaattcacccaaaagttggaatacttggggaaatgtcaagggctgtgctctcttaaaaaaaaaccatcaataagcttaaagccaacggatcgattatacgtcaagcatcacgtaagtttgatggtacttcctccgtttcgcaatatcattctaacattatatatatatatatatatattgatgttaataaattttagatataacatcaatataaatgtgaaaaatattagaattacttatattgtgatacggacagagtagtaacaaaggtgaacgttgattacggcttccctgccgcattaccaaaatggaagagagtggcgccaaaacacgacaccagcttgcttaattatactactaactcccaaaagattaaagaaatagagggaaaaaaatcgaccggtagattgccggattgttatctgacaaatctcccaacgggagatattttactcccgtgtacggatacttcgagtagcaccaccgctgtgtgcacctcttaataaacaatacccatgacatgcaaggagggagccgaaagaatgtcccaatactcgtacaagaaacatctcgactcactcttgcctttttttcccctttttcaaaacgaaattgagaaggggaaacacattcacccgcaagatttttttcgatggaccaccaaatggcctctttttcaaactgctacagtactaaactacgtctacaaacaatctgccatgcacgagattgccccgctcgcatgatcgcccccccgaccggccatttcggatttccatctcttcggagccagcaaaaatcgccgaaaaaatcctctggtccaggcgacccggcaggcccagcagcaactcgttttttgctcgccggaaaaggcgcccggcccaccagccacgagcggggcaatcccacgacaccaccacacaagcgcgatcgtgcgatcgtccaatccaacggcgtcttgttagcgagcgttgaaggcggcagcggcgtatcgttttcggtcgtacggctgcaaaagagcactccagaacacctccagtgcacatccatcgcccacacgatcttgacgcgcgcgcgcgcgcacaaaacacacaaaaataaacgtcaatttgcaatcgtcaagagtagagagagtcgctagaaacatcaactgatggcaacatccacacggcgtcgaggaaaagaaaccatttctaattgctgcaagatgccaaaagatgccagcccgagaggcagagatcactagagacacatcaatagtagcaccagtagtgtaacaaattgggaatacactgtgggagtaggacagggacaatgacacaggaaggcagaagaggacgcatgatgaacacatcaacaagagagtgaaattcaggacgaaatgtcgacaagatattggaatctttggccacgcacgcaccaattcttgggtgacgcggccggaatcgaacgggacacccgacccaacccaacccagcgaactaaacggagtcaatcatctgatgacctaaaaaaagggaaacaaattctgccaattttattggtttttctttcccgtttgcttcctctcttcttctgcttgtctctcttttcatcacttagaggcgtgtgcacgtctcgtacaccggcgcgccggtcacctgcgcgactgcgccgggtagggcgcgacgcgcgttctccgtgtgccgtccgacgggacgcgggcaccgacgccgncgncgcggntttcgccgtcgccgctgacgatgtcttgcagcatcttctgcaggtcctcgagtgtgtccggcttctgcactcggcgagatcaccggtcatcgcttaagtatgataactaagcctttttttaaaggtgataattgtggcgattactatacgaattggtagagaaagtggttgcgtgctcaattgcgcctacctcgtttttcacgttatccatcatcaccagcatctactgcatgaaatcggagaaatcctgttcgtctaaaaacagggcagaattttaataaagaatattatatactaatatattttattgcactattagccccaaatttttttttaaaaaagaatgataatattggttgctacgcaagaaaaaaaataatcgaggtttcacctggtcgccgtatgcggggggattcgaacagcccggcgtcgtgacatggatcgcttccccttgtcggacagaactgcagcaaccgcgcaaaaaaggatttagttcgatcatacacgtagcgagcgcaaactgggggcggccgagccggtgagccttaccggagtacacctcttggatccgctggaaccgccgattggcctcaacggggtcgttcacgcaccggatgcgggtgccacttctgtgcgcgcaaaaaaaaggatccaattcacaacacaat

SEQ ID NO: 11079 - DNA, 5560 bp, Oryza sativa
aggctcatttttaaaaagaatatatgaaggcctttttaaattaaaaaatggatcttaaaggatatttttttttcctaaatagttctttggaacaaaggatttgataccattgaattttatgagtttcctttggaataggtccaaagttagcatgaagttcaacctcttggaaagtctcttttcatccaattcgtatgttttcattcggtccgtccaaatggtttcccttatgttttgctttttttttttgtataggcattcttgccaacatcatgtgttttaccatcgttgtgtgattgtgtctgtgatagctaacagttacgaacaccatgattcttttaagaaaaaaaatcatgtgttataccatccctattgtttcaaagagggttaaatagctcgcagttctacataaaagtatggtgaaacaacttgtaatgaaaagcattcccaataagcatgatcaacaggcctgggaagcatgatagagatctgcaagttaagagtagtatgataattcaatgagctatgcctggctaggcatggttgaaaaaaaatcctatgtgtttggaatgatacaggcggcagggaaaagagtacaactaagaaaataatacgtactgagaggattagttccatactcagtacgtacttgtatggaataaattagcctcaatctccatgtgagggtttaaccgaaagaccttacagtctttacagtcttacatatgctaacccgcgaaacaatgtccacttacatcccaagttcagagtacaagcaaaaatatccaaatctgaaccagaacacttgattaatccacagaacataaggtgtgagaatcttcacaatgtgggaagatcacatatccaactccagaatagatggaacagaatttatatcacatctcctattcactgttacagttaattactccataaccattgtaaactgtgaatgacatcgatattcaatgtcagtcatcaaactcccatgaccattgcaaacagcccaccttcctccagcgatattcaatgtcagttatcaagtggagtacttgtagaacaatatacttcatccgtcctaaaaataaacgaatctatagatatgatgtgatattttataatataacaaattttaagatatctttgtacaaatttgttgtactagaaaatataacatcatatttaagattaatttattttgggacgaagggagtacaccgttgaatattttcaaaccaaaataacgaaatgcgtgagagttgatagtaaatatagtttgaagctaagcctcttgcagtgaattgtaccaaaattatcacaagaaaaattagccagccacatggggaaccagctactcctacaacagtaggaaggattgatacattattcaggcattagctcgggacacctaggatcataattcctccgaagttgaagaaatccatctctaaacaattaaatcggaacagcacaatcatcaagttacgcaatattcggacctgcatatagcattcgaagattattagaaagcaagggaactattaagcatggtttgattttgaccgaaacatcagagaaccagatgatctttgacagtttcacggaagtaggcactgccccgctcaaaggaacattttttttttaagataaccggcatctacacccaaaggatgtgcacagctcaaaggaacatgcatgaaaataaatatagaatatataatgatccgacctgcctaagataattgcgatataaaaacctatagaaacaggagagctaaacataaagatcacctaattaaagtttggcattaagcaaaagcaattactcaaccccagaattgccattcaaagagataaatgaaaattcgcatctaaccaactaaccaagatcttcagaagcaacgcataactgaatcccaaaaatcctaaggaccttcttcagactgagcaccacaatcgaaccaaagaccatcgacatgctagaaataactgaatcccaaaattcccaaggaccttcctcaaactaatcagcataatcgaaccaaagaccatcgacatgataaaaacaacacagtagcactactcccacagttcaccggagcaaatcgacagaggccggcatctcattctttatacgggtccctctgagctctctgcatttccaagttatacaacgcctcttgcaccagagccgattgggcagcagcatccacggtagcaggagtttgctgccacatcctatctctgatctcttctcgcaggcctcttatgaataatgccacgtcgaagcagttgctggagactggatcgaacagcttggcatggtacaagcgctcctcgaactggtctctgtactcgctcactgtcatgatcccctcctgcctcagatccaagagtgccgtgagcttctgcttgtgatcatagggcccaaatctctcctccacggcctcacagaaccgaccccaatcacgctcatggcgcttctcataggtcatcatccacagctcagccatcccctccatgtgcatcgaagcccaggaaacccacatcttcattggcatgccgtagaactcgaagtagcgcgtgcacttggtgatccacaggcgcgggaacgtcccgctgaaagtggggaacttcagcttcgccagacgaaagaaccctcccgagtagccgtcgatcctggcggcgcgcgacgccgccgccgccgcctgctccttcttcacgtcctccaccagcgccgccgcaacggcgatctgcttggacagctcctcgaggcgatgttggtgcccctcgaccacctggctgagcaagggcagcgccttcagctgctccgcgatgcggtccagcttcgcctccatcttgccgtcggggagaaccgtaggttgctgcggcccagaaatttcgagacaaatcaggtccgatgaggtcggaggcgtccgcgaacgagacaaataattaggttttcaaagatcaaataaaccatgaagaagacgaataaataaagaacactaaaagagaaaaagaaaatcatggcgcgggtcgagaaggggtggttgctacgacctcaccttggccttcgttcgatcgtctcgtctcgtcggcgtcgccggttgcgctgcaacctgctgcggcggagcacgcggaagcggtgggcacttctccatctcctcggggagaggcgccagcttaagatggtgtttggttgttggggataaaatggagctaaattttagtccctcttaaaaaaatataagtccctattatagggacttataattttcccaaacagcccctaagtgcttccttctctactaagctgggccaagagaataggcccatgaagattagggctttctatccttctactgactttttttttccaaattagatttcttttctggttttacaggcttcctatatattttaggctgcctatattttaagggtagagaattacaaagttgacaaatacttatacaattatcctcaccaataatgttattgctaatatgttttggtcttacttccttcgataataaatctttgacgttgatgataaattttgaattggaaatcttattatgttgcgttcgatattttgcacaaatttatcaaactaataaaataactaggggattttcccttaaaattttgtgcaagtatatataattgaaatataattatggatacagtatttgtaatttctactccagcggtccctaagtcaagatgcatggccaaaaataaggtgttttagggggggtggaggtagtacaatagtagatttacaaagtaaatttgaatcatatacaactcctatacaactcctagcacaccggcgagctggcgcccggctagtggccaaaacgacccggtgtgctagcggccaaaaatccaataatcttataaattcaatatcttcccaaccgtaaatccgtttgactccgttcaacttccaaaattcctcaaatctcgagatctatctaatggcacgcttagaggtcattaatagggctttattttcgccgtttgttgagttgtcccattttgcgtgtagtttcggagcccgaagacccgcagtgcgaggatttcgaggatcaagctcaagatctcgagcgaggcaagccacctttgaatatcttgagcctatatttgaacttaattatgttgcttgaaaaatattatgcattgataggatcacacttaatctgcttgtcccgtctgcaaggcagattggaggacctacctatttgttgcatttgatccttcctctgttaattgttataccatgtttccttgtaaccacctagtcacgcctcggaaatcgtgccactctgcacaagtatcgacggtcgccttcaaacctaaaatctgagtaacttcttgggtaaaacttgggttttacaaaagacttggaaaacccgacacctgggtcggtgcttgtgaactaaatgaatttccaaaaccgcggaccggggaacgtaccgggtgtacggtttcccgctcttgcacttaaggaccgtttccttggaatttcatccgaacttaagacaagtacgaccacatgggtggaatgggacacccctggctgagtaactagcttatcaggggagccttgatgccgagagacatgtggattcgccggggtggtgtcggggaggacccccgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatatcgtgtgggtaaagtgtaccccctctgcggaggtgaacaaactgttcgaacagccgtgcccacggtcatgggcggatgtgaggtgattcctagcgtagttttgtttgactactgccttatgaaattgctgttgtggaaaggggatcgatgtttggaaaatctgcagctgatgggatcagctaggcccgggtggccgtttgaaagttgttggcccgggtggccgtttgaaagttgttggccgggtgccaaccttgaatcaattcaaaagactgatacattgcacatactccgaccggacgagacgcattgtctcatccgtgtcgtttgagaagcactcacttagttgatttcagaaaagagttcaaataaaatcaattgcaaaaacaacagcctttccttgaagcctgcattaaacacttatttcccgtggcttgcagagtactcccgtactcacccttgctctatataaataatccccccagttgctgaagaagatgaagcggatcccgctgacgaggagttcttccaggagcaagccggctacgatgagttttagggtttcggcctagttcccaagtcgcgcctgtcggtgacatggggccgggggtatcgtgactagaggcttgggtagccgcggtcacccacgtggcctgaccccctcgggggggggggggtcgggcccgacggtcgtggccacccctccctctgtctccccgaggggtcgg

SEQ ID NO: 11080 - DNA, 6051 bp, Oryza sativa
cagttaagtagtgttgcttttgcttgcttgtctgaaagctgaatcagcagtgtgaccagtagcatcagtagctttggtccaagtcattatggattatgtaagtgtgtactccttccacggtaaagctaaaccgtggctgaatatgaatgatggtctgttgttgttgcataaaagtactcgtagcttgttttgttggacacttaaaatcaacatatgtgatgtacaggtacttcttttctcttctttccccccattttcattccttcttgggttccaaatgaaccgagcaatgaactctgcttattttaatctggccatgaactgaataattaactcctacgaagtttgagcaaggaacacatctgcttgcgtgaagaaaggggatggactaattcgccccacacttatggaagtcacgagctgaacggcacctccctgatcaatgaatgcatggttgatggtttggatttcggaaaaccacaacgaaatcaaagttttgtttggataagctgtgaggataagttgtccagctgctctggagaacccctaatccgaggagaaaaatctacaaaatccaagggggacaggttcaggatgttgctttccaacaaggctatgatagcctcctctttgatgtgaagttcctacggattcccggtagatccggaagaaaaattaaacagcgagttcggaatttctttgctctcaagcgatgtcatttccttttcttctttttttttttagagaagtaagcgatgtcatttctttgctctctagcctttgttctgttctctcttttcctcacgatctgtcgctgtcccaattatatttgtggcgtaaataaaaaggaattccactgatatgtcaaccgaaatccagccggccacatgtttgcattctcattttataagcttaaatctgacttagctgtaaaatggtattcctccgttagaaaaaaataaatttcacaaaactaagtattttgcacaatctattacttttagcatgaagtgatggaatactaagatcactggtaaaatttactaaaaaaaaacgttacacatctagcgtttggaatttgtctaacaagggtcccttagaacactaagatcaatttataagggtgctaatctacccacttcatggctagaagtacacaggttttggacgaatggagtacgtgtagccgtgtaggactctaaacttgtccggtttgcccttaataaccattatactccgtatttctggcaggcttaggcttcaccggtcaccacaagagccataaaaatcgtgaactccgtcagaaagtgcatgcggcttctagaatttcttagaaaaggcttaactgctttaagcatttcacaaggaaaaaaaaacggtgatgacatcctcttcagtagcttctctgattgctgcacccttttgcgtgcgtgccacgtgacatggagtatctgggacggagcagatcagcagaaactgacacgatggttaatttcctcgccacgagatagacgtgtttacagtgtactattcactactctcgattctcggcatgaaacatgtgcggtgaatttacggtttacggagccctccagctttgaacgttacaggtgccaataaaactttatcggctcgactaacagcatcagtctgtaatcgtgcacgtacgtattagactagagcaatgctccggtgctttctacttgtagtattatactacaagtaaaattaatcccgaccgttcattttaaagggtagattagtaatctcctaatatatattaggagtaattttggccggatcaattttctctgtctcggtcggtcttggcttgatcgcgtcaggtccgacgcaagcacaacatctcgcccgacgcacgttgcttatcactactcctcccagcacgcggcggcgcggcgcggcgcggcgcggcgaaaccctcaggcgtcccctcctcccacctctcacctgtctatccgttccccctcctctcctgtattccacgccggcatcctggttcgccgtcgtggccttctgtccgctgcgagtggccttccgcgcgcgtccgattccaccggagcccctgtgcaagacctgagattcttggcagtgcccactttggaggattcaatccattccgccggcgggtagtgatctccattccgtgttgccccgattgtgtgggctgcggccacttgggaggcaactgcgatacattccggctccccggttcccctccgtgcgtgcccgagtcttgtggcttgcatggcgagcacctcctcgaccgcgagcaaggcatgagattcagaatatgcaacagtgtcgctcgctgcgtgctgccgtggaaggcgtcgccggcgaacctgatagaccgcaatgctcagaggtttcagcacatccgtgctctcagcggcgtcaggacactggatcgggcgctgaacgatgcatgcggcatacccgatctgctagctcaggatggtggccggcgatgatgtccgcacgctctcctgcgggcatgacttccacgaggattgcaacactgcaaagtggttcagtgacaacaagaaggcctgcccagttcattctgcttgtaatattcagttgtatggtgttatgtgtcgaatacttcattgactaattgacgaggtttgagatattgatgtttattggatcttgtgactgtcccaatatattcattgttcagtaatggttcaagtaaaaaagaaaaggtgaatagtgagggactactagtaatgtcaatgtgttgaccatgtcagtgtgttgtgcatttttttgtgtgcaactgtgatggggtgagaagagtccaggcaatttgaactgaaatatgccatcctgctcctggatcagtaaacaagttgttttgctcctgaaaaagtgagactgaaaaaaatctgataaactgcttaaatgagatttttcactatcagagttttgcccatatgtaaattgcatttcagtcagagctgtaattcaggatttgttttatatttcataccattgaaacatctaattgcattctgtcatattctggtgctctgaatcatcgctacatgattcctttcttttgctcatatgggggtagctaagcgctcaattgccactagattgaatttttttttcaagtcataggacaatgtctactaatgggggcttagaacatattgattcactctttgctgcaaactccctggtctactgtcgtgtttatgcaaaagcatttgcattagctccgcggcagctagtgaagtcatgcacagtccctattcatgtagcatccaaacgcctcattcccaagtcccttagccgctcgtacgggccgcggcggcgaccaaatgccaccgcctcactcgagctccgccaccgcacatcgccggctgccgtagctcatttcttagacaatccgagccgtccaccacatccccatactacactcgttcattcacagttgcccattcctcctacctcgcagccgttcgccggaacccgtcgaacgtcgtccgctgtccaattgcccggctatctcctctgtcttggtcaaagctacatggcaggactagtcgtccgccgtgggcaaggaccttcagcggctcggcgaagaggagaagggccacccttggtcgctagagagggagaagatgtcgatcgcgctggagatgatggagtcggagaggaagatgcacaggcgacgaagtcgacgatggatggggtcaggcgcttgagaagggcgaaggtgtagagttactgaataataatttacaataatacccttacgtgaattattatctatgaacaaatatacccctccatgtttctactaccactaagcgtggtggtagtagaactagatctcaacctgacgattatatacgatcaacggctcggattattttctactacaagtagaaagcaccggagtgaggctcattagactattagcaggcagaaaaatgttgttgcatatgcaagcattgagtacttactactccttttacctccgttttataatgtaagtcattctaacatttctcatatttaaattgacgttaacgaatctaaacatatatatctatatagattcattaatatcaatatcaatatggtaattgttagaatgacttatattataaaatggaggaagtattaaaaaacagtctctgaacagtggaaggcaaaatagtcattcaacactcatttaagagttactgagacgtactcaaatgttacttgtgctaagatacagtaccttctggtacgtactttgacactacaaggagtgcataagagaagggcctggggtctttacggctagcaacacaaactacgagctagctggtacgggttcaagcctcactcccttagtttaaaaatcaatatagtcctttctagattaatcccatttttcaaaaggagtgcataaacctatcgatttttattaaaaaaacactgtaaggaaatctatcacgaaaattgaaaagtattcatgtgcggcgaacgggaccctatcccccgaaaatgcaagcttagtgcatttggagtttcctctttttaaaggaaaagggcaggatttccctaagaaattctacaagttgcaacctcttacgatgagtgcaagattttggtggtttccccctagatctccctcaagcaaggatcgtttcccacatgagcggagctagataggaggagggttgcctaggaacccgatcaaaaaaatttttaactatagtttagctattttcacatatatacaccactcgatctaaattcagacactcatattagtctaaatttaatctaaaataaagtaaagcaagcgagtgacccccctctctagtatgttctagctgcaccctgatttcccaagtaacgatttaggcttcgttcgttcctgggcgatccaggggattgagagagaaaagtatctcattttccgcgcgcacgcttcctaaactaataaacggtgcgttttttttaaaaaaaaattctataggaaagttgctttaaaaaatcatattaatccatttttaaagtttaaaatagttaatactcaattgatcatgtgctaatggctcatctcgttttgcgtatcttcccaatctccacaatcctcttcttctcaaacacacccttagctgatgattgctaccatcattcgtcgtgagcgccaaaagcatgcaacctgttaggcgcatctggcaatctggcatggagcaaactgttgtggcagctggatttcctaatccacgagtttggcgggtgctctccaagattaacacgcctgaaacacgtgcagcttagtacgagcgtactgccgtactccagttaagagccgctttgaacactgcctgccatcgccaacagaagcccattgtgactgactgaactttcagcgtcccaatcaagcacctagcttttggtacactactgtactgctaccgctgttaatatacttgagaaggtacgtgtaggtattaaaaatttacactaaaaattttaatatctcgagatatatgatatctgaagatattaattattatatcagaaagtatggtatcttccgatgttttttttaaagaagataaaattacacaataaattttgtttttgcgggcatgaaaaaggcgactttctccaagccgacgacgatatgcatgaaccgatgaactctaccaaggcgcttcgtacctgggggtgtggctggaaagctcgctctcctatctgatcctgtggctgctagcgcttgattgaaccagtcccaccaccatggccaccgcctttattatcattgggttggtttgttttgtagtataaataggccttaccaaattttgtcaatgtcaaattctgataagttttggcatgactaattttggtaagggaaaccaaaatagcctaagttcactattgaaatggcctattttcttaggcataccaaaatctggcttcaaaccaaatatacactaaacactactaaaattaccaaatattgataagcctaatttagttctcaaaccaaaccagcccatcgtg

SEQ ID NO: 11081 - DNA, 1996 bp, Oryza sativa
ctactttatttcaagacgagcacatgataccattcgaacgagatacttttatggaggctaacgtgatcctgcccctactcctcgtgcttgcgtcctcgcgccttgagccagcgcgacagcagtagtaaggaacaagggtcaagtcgagaaaaaaggagaatatgagaggagacgctgatgcttggtacttgctacctcgcaagtactaatcctgccatcctggtacctagggtactatgtatgatacctattgtaccgctacgaacgatatatcatgtaacgtacctgcacaaactccaacgagaagcatgatggctcaccgtcatgtcgctgtcaatgaaaacaccatatctagaagcttcattggtcacacccttccatcactctcgacaacatgcctagaaggaggaggttgagaagcccacgccaatcaacgtcctttctaatggcttcacttcttctgattgcccctggttaccatgagagctagattccaatgggtgtcgccatgcctcaaaagcatgagatggaggaggccacgagattggtgccgtccactatccttggtgccgacatgcgctcggactggatcaaagcagtgaagagggcccatgcctctagatccgttcttgggggcttgctccaccattgccatgtctacatagggaagctctttgtggagaggagaagaggggaaaaaaggggaaggaggggaggataacgaaggctcgaataagactgaatcgttatctacttatcccatttccatgggattttgtagagtagttttttatgttattttaattttcaaagcatagcaaaggtcatgccaaaatatcacgcatggctcctaacatcctgttatcttttctattttctattttttccccacaatttcttagttttctacaatttatagttttccaaatagtatatccgtcccaaaatatgttcatttttcacccatcaaacacatatcaataaaaaaagattagaaaaccactactttatcaaatcacaatgcaaccattcattactttatctattctcaatataattattccctactttcacaacttcaatgcaatgattacttaacaaataaagttattttatgataatgaaagaagctaaaacaaatttaatatgggatgcataaagtattgcgtacaagctcagaaacctagtcaagactcgagaggcggtggcgcgtcgacttaaccgttgggtaccagccggcaggcgctactatgcggttgttctgtgcaacaccaatccttattattgccgcagagaaagaattagagacgaaacgagatgaattcggcgtccacccaaaggaataagttcactttaggtccctctatttgtcgctcagtctcattttcgtccctgcagcacaaaaccagatacaacacatcccccaacttacaaaaaccgtgcaaacaagatctctcgcgcggtatagtccctggttttagctgacgtgacgcctacgtggcgtttgacatggcaaaaaaacctaggacccccatgcaagtgattgttcgattaaaaataaattatttacggtgggacccacgtctcctccagtcctcctccccaatctcgctgtctcctccccaatgcggcgacccagcggtggcctccccatctcctcctcctccgggatccatgcggcggcggctggaagggtgggaggacgagtagtggccggcgaggaaaaagggcagagcttgccgacctgtagacgctaggaggggtcttctcctcagccgacgttgtcctcctcacagtcggcgccgtcctggttggcttcctctcagtgtccgtagcaaccgtcttcgcctcaccggccgccattctttcctccatggcgccgcctgctgccaccttcctggacttcgagacgatggaaggggcctttcgttggccggctcaaaggagcccatcatctcctcgaggtttagcgagctgatccggatgacgtcctcgg

SEQ ID NO: 11082 - DNA, 1007 bp, Oryza sativa
  unsure (1)..(1007): unsure at all n locations
cgagagtgccaacaccacctaaatatcctctattccaagttactgctcatgatagaagcatggtatggttatttttgcattattcgtttcaccactttatgactaagatttcacctgaccaaatgtctatctttctcatgctttattagctaaaaagggctccaactttggttcagccttctatcaagctttcagacgagaacaacacaatactggaacagataaagaataaggtaaagtactcactgttggacctaaaaacattggcattgagtttagttttgctaatgtaattttttcttgtttacttcacagtctttcaacttgaagccagttcttgcaaagagaccgaacatgatgggtgctccaagaacgaacttgcaagtggtggccatcctggagagggctaatgctattcgccaggtttataaaccatctcttgcaacattattaatctcccttacagtttcagctgatcatagctttgtcatctatggtcatatgattattttctctcctgtaaatcaaacaggctgttgctgatgacgatgatgaggatagctggagtgactagctgattcctcagagcatgcaatttggcgcctgatgtttcttcacattcacatttcacaaggtctgtggtgatcatgccatcatggacttgcgtttcctgttcttgcataagtagagctagcaaactgtgaaatgaactacagggtatcatctgataaataagcttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11083 - DNA, 8609 bp, Oryza sativa
actataaatctgtatcccactgctattctcttttcttttttatcttattcaaatgtagcctctgctattatactgctctgatacatactttctgcttggggttcagcgaatcgtaggcgagccggcgaaacgagcggcgactcgaccgacccgctgccttggcttgagttttcgctgtcccttttaccattttccctcggtggcaggctgcctgagaccatgccgtgcctgctgctccgacgactgggacgcgagagttggcacggatcaatgcattgacgtccagaaatgattccagtctagacgcagtacataggtgtggcgtgtagaacgagccgttggcgagtagtattagctgcagagaggtattagcgagtagtatgtacgattcgcttccaaatgaaacgaatcttacgaaaatacacggggtgtgtcctcagcgtttggtattggaataagttcattttagctctctggtttgcattgtcctggtttcagaagttgggagattagttgtatcttgtttttttttttacaagggtaggtgtgagtccttgtcggctttctggctggataattattgtaattttatctcacatctcgccggtgttgacactatggctgagtaatatacctccctttccccggaaaaaaaagaatgaaaatcagactaagtgaccaatgaagccacctaaagttgaaccgattttgctaaacatcacacgggtgattttttcgttgatatttgacagatttttgcccctacaattatgcgccgagatcagtacacgattctgcgtcgatgttgtcgtgaggtggagatgagacctcgtaggtcccacgtttgccgctgatcacgattcacaagaaatttacatcctagctacgtgtaaatatcctatatagctaaaataaaatataaaattacagtcctatttaactaaaattgtatatgtaaattcagttgatattaattacaatcctatttaactaaattcacatttgtaaattcagttgatttaacatgtaagtgcactgtaattttgataaaaatattgtgtaagtaaatatgtacttattattttctttaaaatataaaattacagtcctatataactaaaattacatttgtaaatttagttgatttgacatgtaagtgcactgtattttttataaaaataatgtgtaagtaaatatgtacttattattttctttaaaatataaaattacattcttatataactaaaattacatatgtaaatttagttgatatgacatgtaagtacactgtgattttgataaaaatgtcgtgtaagtaaatttgtattagatattttattttctagtatgttggacgtaaatccaagggaagaaaaaatctgggtgaacccgagtgatgcataggcggtccctgaacaaagtgaacttaattcttttgctatttcgcagggacaggctcatcttaattgggcctgcacattgttgagccggatgctaatggacggcccagcttataaacccaagaaacgggccaccaattttgctcgtgtgctgagctgaaaggcacacatgaattctcacatgaggcagcacagatgatcgcggtattgctgattgctaatccctccttgctttccggggagctgtctcggccatctccaatccaccggaattgagggggggaaaccaccaagggtcgccgcaaccgccacggcgcgtggcgagaggaacacgacgccgtccatcgtttagccccgcgggcacgcgcgtcctcgcgctcgactgcatgtatgaagccaaaacaactctcgccacttgtgccaaaaagccctgcgtcctacaggcacttagcccttgttttcctcctgcttctaggcacaaaagcacgaaatctgccgtcacctgagttcatccgtgcatactgcccctgatgcaactccccctgaccccctctataaattggctaagctactgctagtcgatagtacattgagcttgcgatcgacgtatatatatgttggtgtacttgtgcagggtggagaagcagggcacgtgagcggccatccagtgtagcttcgctgcgcgtccatggcggcgaacgcgcgtgatctggagtttggatggtcgttcatgtgtccgtcttctccaccgagcactggcatatccaagaccgagacagcgagactccgagagacattggtcgagcgagcgcgcgcggcaccgtatcctgcactgtctatgagttgacaacacagacagctgtgctttgactgtctatattcataacactgatctactacaagaaagtgtcatatcttatagtactatgttagtttattttaagatactgttacattttattttaaattggtatatctcatattaggttgatttattttgagagacgattacatcctattctggttggtttattttaggatagtactgtaataatatatcaatatctcatattaaattaatttattttaagactgttacataaaatttttgattgatttatttaagtacagagcgggtaagtaaacgtacacgttgccatgtcgttcacgtttgcaaccaaggcaacaactcgctacatggatcagctcatcagcccacggaaaatcggtgctgccgcgtgggctgctcgtgtagtaggcccagcccatgagtccaggaatcacccagccgtctctctccaaagcctctcaactccatcagcgaggcatccaccagcgagccctttcctaatccgacccgcgccgccgccacttcttcctccgctgcccaagagcgatggccgcctcccccgccgccggggccgcggccgccaccgtctcgtcgttcgtctcgccgtcgtccttctcctccgtcaagtaatccagtcatctccgcgcgcgcgcgcgctcgcgcttcgttgattgattcgttgtgctgtggttctcactctgttgggcgtgattgtttacagggcatcgaagcccgaccgcctccgtccggcgaggagggcggcggccgtcaacgtccgatgcgtcagcagccctccggccaccgaaacttgtaccgtgctctccctttccctctccctctccctcctagcaactcatttatggttgctcccaaactgctcactgccgcttagtaggtttttgctatagtagtatcgttggaggtgtgcaatcgaatgcaatgagctcgatattgcctccggtgatgctatcacacgcagtttaggaacaaccagaaagttactgatactatcactagcactgtggtagtaagtttactgaaagattcagctttcgttttgaagctttcaagacgaaagtaccacgaaatgccaatatggccaagctgcaagctggctatctgtttcctgaggtttgttttgttccaaccatttcctctctcttctttccctccctgtcttcgttgatgctgttttattgaaattgcatgttgatattggttctttgccaactgtggagcagattgccaggagaagggcagctcacctgctgaagtttcctgatgcgaagattataagccttgggatcggtgacactacagagcccattccagacgtcataactaatgccatggcaaaggtacatcgttgctcttaatataataaacaccggttgtgtagcttcagatgatttatgttgcagtttgtcaagatcgtagttaaatttcttattgaaaaaagaagttcggcattgcatggcacacagttcttatggttcaatgtaaatgattttgtcagacaggctgtgcatcttcctaggagtaaactaagaaatcatcatcttcttttcttttttcttttttttttgcattttttgtattatagttattttttttcaaataaacattgatctttgatgggtctatttgtaaatgcagagagcacatgctttatccacagttgatggttatagtggttatggagctgaacagggtgaaaaggtatgcttatcactttactagcattttctgccaatacatcagcattcagttgacaagattgtacataactattttgcttcatatatgattttaaagtttgtgtagaatattctagaataattggagcaggatagatctttgtgctaatccatgaggttcagtaacaccttatggcatctgctggtgtggttcatcgaattagttttttgaactattaacttcttgcactaatagctgtcacaaagatcaaacatctgccacattttcttgatgagtggattcttacttttcttttactgccccattcaaatatattagtcttgacattgcatacatttcatatagcttcactatcatacgccgtttatgttcatcattctgaaattatacattaattttctgcacagaaactaagggcagctattgctgcaacctactatgcggatcttggtattgaagaaacagatatattcgtctctgatggtgcaaaatgtgacatttctcgtctgcaggttctgaaataatcctatcctccctttcagtttatcattcatgctataatgtcccttacatttcttccaattttcaggtcctttttggatctaatgtgaagattgcagttcaagatccatcatatcctgtatgaaaattcttcacttgatgttaacccttcctagtgcatgattccattcttaaactgatgtttatggtcatgtgctccttttttttcatttctatcatactgcttcttattactaactattactttcacacttgtctgatgtgtattccaacatgtgttccatttttataggcctatgttgattcaagtgttatcatggggcaaactggtttatatcaggaggatgttcagaagtatggaaatattgagtacatgaaatgcagtcctgaaaatgggtttttccctgatctgtcaagtgttccacgaacagatataatcttcttttgttcacccaacaatcctactggtgctgctgcatctcgggaccaattaaccaaattagtcaaatttgcaaaggacaatggatccattatagtttatgattctgcttatgccatgtacatatcagatgacagcccaaaatctatctttgaaattcctggagcaaaggaggtaggctttgggatttaagcccttcctaccacatatggaaatttatggattttctgcaaatacttaaatccacacctgtcatgtgttttcttgtgtgtaggttgccattgaaacagcatctttctccaaatatgctggattcactggtgtgcgtttgggttggactgtggttcctaaggagctccttttctcagatgggcatcctgttgctaaagatttcaaccgcatagtctgcacttgcttcaatggtgcatcaaacatttctcaagccggtggtttaggttgtctatctccagagggtctaaaggtagcgtttcagagtttctgaaaatcttcatgtggctcttttggcaatgcttcatttcatctctttgttcctatgcaggccatgagtgacgttgtcggcttctacaaggaaaatactaaaattattgttgacacatttacatcacttggattcaacgtctacggtgccaagaatgctccatatgtgtgggtgcacttccctggccgtaattcttgggatgtcttcgccgaaattcttgagaaggcacatgtggttactactcctggtagcggatttgggcccggtggtgaaggcttcgtaagggtcagtgcatttgggcacagagagaacattattgaagctgcgagaagactgaagcagctgtacaaatgagcagtgatccggcctttatattctcaacctcttggggagccatatcaaataaaaccaagcagagttcgaagacaaaatttactctgtcgggctatcagtagatgttagaattgaaacctaatactttataggcagttgttctgttccgctcggtatttatccattcagagccattttacattctgaacttctcttgttgtttagccctgatgcacctgagtgaatcgcaagcttatttatctccttttgctaagttcgtttctactactctgcttaatttgctgctgccgtataaggctcagtgatatctccctggatgcattgaaacgttaggcacacttgagtcactggttgcaacaaaattaagagtagagaacattgctcagaccaattcagttttctactctcgtacaggaagaaggtacagtaatactctattttaccagactaccagagtaccagtgtagaaagtactatcaaatatgaattgtactcagctacctagatgcgagagaactcattggagaatgaactctattaaccgaaatctatgagcatggagagaagcaaatcgttgacttcttcaggtcaagaacttacacgatcttaatttactgaccatgtgatatgattcccccgaaatatcacatttcccagatctacagctgcaatagtgttcatacggcacgcgccaaaatctaccgagtttcacagtatcagtatcaggatgcagaaattcacagtatcactatcagcatgcagaaattctgccgaagaaatcccacagtgcacttaagtacttaacaaagctccacaacgacatatcatttactcttcgtatgtactttgatagagaaatactcttcgtatctatcaaactgtaaaactcactagaaaatagctaaatcttcagggggacgcttctgtgcaaactgcaaagacaagtacttatatgacatcagaaaaggttgcttacaacaagaattagaggcaggttaacatgacacaattgtgaatattgtcaacaacagtcatttttcgtaatggtgggatgctgacttgaataacagttacaagaatacatcacaaacaagtttacatcaatccacgaataaagatgacagctgacgaattgatgtattgcatcaggccctcttcaatgatttaaacaaacaatggataacgatgaacgctaggacgaaacaggaatatagaaactgaaaagtaggttacagccaagcacactttggagagctccgagcctctcatatgtgacaaactggatatcttgctacctaactaccactaatagcgagcagagaggccgacaaccatatccttctgaaggtaccaataagcacatgaaaaattcttttgagtaagacataaccaaaacacttgtgacaaaagaaaaatctaaaccattcattgaatatcaccggaagaatactattcatcgaataagaaatatgaaattctatagaaatatatagtggtgatcaattaacagagttcccttcactaactcaatttctagaagtgtaagacataaattatgccagcaataaacataccattgttctcctaaaatttcacattacaacatagatatccatcctttgatgtttgatcccaacccaaactcccttgtcaacccaagtctacaaaaagaacacctttttaagattttagacccaaaaggatctacaatgaacgaaataacgcgtggcattgtactctaattatcacttatcacgtagaagtagtcttcatggccttgaatgctgggtggagcaaccctagttcatccttgacatcaagtgggttgctagtctcattcctgatcctcttcaccttcctgctgccaagcgacttgtgtgtaaacccatacatttgcaagatctgattatccccaaaattgaaagcacgctccatctgcttgaggcacctctccacagggtaatccccaaacttcccacacggcttgcatccgacaaagtgagtgaccagtggccaccggtgatcaccaagtcctggatggtaattctcaagcatttcctcatacctatcaaccaagataccccaatatccatggaggtaatacccattctcaaggtacaccttgtcaccccatttctcacgctctgtagcaaggatgtataccatggccgactgatcatcagcctcaaacaccggccgatccttcaagtacttggtcaaaaccttcccggcctcaatacggacagggccctttggtcccattggtgcccatgtatcaaggaaatcaagcgaccattggcagttgcgcagcaagaagctgcctgtgttgaggccaatccagttcttgtcgtcgtagaccatctcatcccagccgtgcatgatgaggttgtaggggccgtaccgctcccatggcagctcgaatgccatgtcggagaacatggcgtcggagtccatccaccagaggaactcgatctccgggtgcgcgaggagcagcgcgcggaggagcgggagcttggcccagaatccggccatctcggcgtcgagcagcgccatgttgtagaagatctcgaggccgtggacgcggcagtagtccatcttgttcttgatggacttgaggaggtagtggtcgccgacggggttctcgcacggcttgggcgaggagcccgtgacgagcagcacccgcggcttgacgtcgttgacgaagggcggcgtctccgggtggcggcggtgccacgcggcccgctgctcgtcccagtcggagatcttggggcccagcgtgtagggcgggtcccggagcgtcctcggcggcgggtccggctcgtcgtc

SEQ ID NO: 11084 - DNA, 7129 bp, Oryza sativa
ccccaccacccggtacgccacccacattttgcccccctccctctcctgccccttcctccgatccccccacaccgatcaaacaaacaaataaacaaacaaaccctcctcccccaacccaaaagcagcaaatcaaaaatgcaggcaaggaatcaccggtataccgcgtctacggcgacggcggcggcgtcggcggcgcggagtggtggtggtggtggtggtggtggaggaagaagccgaggaggttttgaaccgcggagttggaggcgaattaataagagaaagggcgaggcggagtggtgccgcgacccgcgagcgagcgaagcgcgcacgttggcctcggagagcggattgcggtggctgtctgagcgatcgggaggcggaatggaaggggaaatctggggagacgcgaaatcggaatcgaaatcgaatcaaccccctgacccggccgctgcaaggaggaggaaggaggaggagaaggagaaggccgaaggggaaggtggtggtggtaaaaggggaggggaatagccagccaacgcgttgcgagatgcgatgcttctactcctttccccgctgtcgcccggtaatttgacttgatcctctcgcgtgggcgtatgaccggtggggccacccgcgtggggccctacgggttttgtatggtaattttctctggcttttttttttgctcggttataaacggggggttaattaaccagtggcggccagttgtaaccagcccaggggcaagcgacgtcgcgaggcgattgcacatgacgcggtgacttttctccaacgtttaaacacgcgtccccatcaacggccgtgccaccacctcgctcaaacgaagcgggctgttcctccgcgtcgctgacgggtgggccattgcgtcgacactgacccacctgtcagtggcgtggtactagtttcggcgatgtagctgccggaggtggagttgtcggttgaggagctaatcactggtgtgtgatggcgatggccataacgatgttttttttaaagattaaagtggacatcagggtatgtaagccaaattactcctctagaagcccagttattatgccttttccttttgtttagtttgggttggtaagtagcgccaaacagtagtagttttatttttcaaccatgtaacatcacattggaccaggtttctctcaaatataatgtactacgcatgtttacggttccgagatggccttccgtttcgggctatgacggaataacgtttttcgtgaaatccgatgaaaaaccggtagatttcgaccaaatttcgtaaacaaatatttgaatacaaatacctagagtttaccgataaacttatgaaaatcggtcggctttggtgaaattccgagtgaaatcatcgaaatttcaattggtaattagaaaaagaggtaactgaaattgttttcctttttaattcgttattctttttttcctactataaattccagtaaatacacggaacacattaattttttcaaaaaattatatcccaataggttctacgaatatcatactatttataagatttttttccttttctatcattcaaataggtctcagatggtttttaccttcgagcctcgtcgaaatctcaaaattttgtgaaatgcaaccggttttcgtcaaaattgttaacctgggtactacgtgtactactgtactagtagtacagagatatggaacgcctcgaaaacagacttcaacaacagagacgctagaacgaggggcaagtaaccagtaatcactgccacttgaacgaattccgcacagggagatgcagatccgatctgacccagagaactcggtgttggagcgagagacagacagctgagagtgcgtgaattagcatgttcacgcactgatggatctctgagctgattccaaatttcagcactggtcttcttcatggacccttgatcagcggcgattattgtaaagcggccagtaccggtcgccgtcaacacgggaagctggggccagtgccgcccaagaacttgcacgtatctgaagccaaaccaattaataaattaagcaatcaaccaaactaaacccatttatttgccggccacttgctagaccacggcgtcgcctgcatccgcagcggtaaaactacacaaaaaagtgccggtggatccggcgctctccacttcactaccacctcggacctttccagccgatcgatacgatacctcccgtgctcctcctgctcgccaaatgctttcgcctgcgtgcgccgtatcattcatcgcgagcaccaaattaagcgcggcagaggcagcgccaacgcgtgtgccttttttttccgcggacgagccggccgtggaatcggcaagcaaacatgggcgcgtcgcgttgatacttgacctccttttgccgtttccttttggctcgagcttcctcaggacgacggggaaaaggctgcacattagcatgttcttgatggttgtgagtactatagggaacatgggcagaaacaggggtcgtgcaggcaacgcacggcagcagaaggcagcggtcgaacgagagtgagacgtgcagccacgaccggaccaggcaccacccaatcaacgagcggcggcgacgagttcgcacatggacaagtagctcgccgggtgggtacatagggcggaaactctccatacacaagtcggacaggacgactagtactgtatcatggctataatactgcatcatggctaaagcgtatatataaaactacggaacatgttaaccatttttcaacggataaaaaattggagtatatatagtctactgtggatgtatgtgtatcagtgtatacaggacccataccgcactgaaaaagccacgaggaataatgaaaaaaagaaagtatgttgttcgccatcggaccatacaagcaaaacggcaaatcggactagtgactacagaactttggtgaaaacaaataaagattcttaacgaacactaaagatatactaaaccaagcacggaggtgaccacaaggaacacatatatttcgtgataaatgcgctaaatgggccctagtggtctagcagatcaaagccaatgtagcgagcacaaagcatttgggaccacggccctacgctgctcaacattgcacgaccaactgacctggaatcatcgaaaccacaccccactaaaaaatccccagtagaggaaaacaaatctatctcgtcttgatcagttgagctcccgacttcacgtcaaaaatgagtgcagatgatctcagccagctccctatcaacacaagagaatatgctgttaaatcactaggagttatcattagcatagtgcagactagcacagccacaaggtacacgccagctaaaacgaacctatccagcataataccaggcagagggaccaaccaactgggctatcagcttaaggaaaatgtcacatgagaaaatattcatggatttatttttggacgaattgttattgaaagcaacaaggccattcaatgcagatgtatatgacagagaagccgtgaattcagtgatcaccgcaaaatacacaagtctgaacccatactgctaatcagcaatagcgtccacacatgacaaatggaccaaaatgtaacaaaaatatacatttttactgcaagaattgctacttcagtagttttaggaaaatgtaaaagattgggcttcgtgcagtcagttctcactttctggaacatcctatcaccaaagtctatcatcatggtgcattagatgaaactaatcgcatttctgatacaatattttacagttcacagcgaacaaacagtaaacagaggaaacgcacaaacatgcaaatttgtccttgttcatgaattgctaagcctacattaagacttgaggaaaatacacagagtgattattagcgttcaacggagaaaacaaatggagatgttccgcacctgtaggccattacaaagcttactctgtgggggcaaataaaccataaacattatcatgaccttgtggttgttgtagggtataactgaacccatgcaaattcctccttgtagctgacattttgatcgcatgatcctttacatgtgtacacaacaattgttgcccaatcaagagagtctggctcatttttcacaccaaagtaataaagcagctgtggcattatctgcagtacaaattagtgtgatatgtaagcatgtctgtgtgaaaaagggggtgggtgcctgtttgccccttactgtcgtacaccttagggatggtaggtcttcactgactaagtagaagaaataatttgaactgatgggatttgaaagaaaataccaaactcaacataaaggctgcagaagtatttgataatctcatttacagtactattttgagcagggtatgaattcccactaagccatggtttattggataccagcacaagccagtaataacaaagagccaccgtcgggtatatcttggctcagtctggcctggtatcacaactggttaacaggcagttgagctagcagccattaacttttgggtcttgactctaaaattgatgcattggtgtctgacaatatgcacagtatgtacccagcgaataattcattcagcaaagatataagggcaagatatttggcatgagggagtagggtttgcaaatttattacttgtgttgcaatgtgcaactggatataagtgtatacccactatatttcagtgacggaatttgccccagaaaaaaaaaagaccaacctgaaattcatagcatagtggacctctacagtagctacatgatgggatatcggcatttgatggacatccagccgataacgcccatagaggtttggcattctcttctcgacagtatctgcataatgtaagcaagtttattcaaattcctgtaacataatattttgagaaaaaaatatgcaagggcactaaaaaaggctaattagaacattaactacacaatgctactattctgaccaggcaaaggctgatcagtataccaccaaatataaaaaagaatccaagcaactgatgcaatctcacctcaatacttgctttggtgctcttgagacccgctcttgaaaagacgcccagcatttgttgtcagcatcagcctacaaaaataatagtggttaacaaaaacaaagatgaacagataagaaaaaaaaaagaaaagagagagagagaggatgtagggttaaaacctcaaattgatccatccatgactgcatcatatcatctggtttaccaggtctttgcatcaccaaggactttgagttactctcatcacaactgtcagaattgaaagcaccctcatagtcgattgcaatctcatattctggccaagatttgctagcaggacctgcaaagagatgaaactataaaaaagagatatgattcaatgtttacaagcttatcaagcactcaaatacaatcaccttttcctacagcaggaaaaatagagcttgaagcttcagaagaactgattaactgtaggcaatcactcttatggccagagcgccagtgcagtgtctgacaaatagaaaaaaaatagttcaacaaagcatgctttagggcatatatagattaacgattagcgggaaaatgacttataaatacctgatgcttctcagagcagtagcgtgctttcttgcagctactacagagtttatcacctttccatgtaccgcaccaatggcagacaggagctgacagcatagttgaataattgaaagaaatctatattatttgactatcaattaaaacaaagagttcaaccatgaaaaatggccacctattaataaaagttaaaacagtttaacaaggctgaaaaagaaaaatgttgcctatgaaagcatgtcacacaagaaaattcagcaactagcataacacataaatcttacacagggtctctgcaaatgaacagaatgattatctagaccaaaaaaaagctgggaaaaacagaagaaatgcttattaactttagaacataatgtaggcagtacctgacatgctgagaaaagtttttgcaacagtagaaaaaataatgaggatgaagctttaagaatttatcacatggaagattcgatcaagtcacaagtcattatcaatcagatatttatacaacagctagataagtgaggaccgatgatccatacacataatgcaggaaacacatcattttgatacttagaatcattaagaaaaagaccaaacatggaaaggaatgccaagctgccatccaaagaagaaaagaaaactacctcctggacatagtggcttgtcagaatcattgtgctttggtggttcacttgagtagaaggcattactacggggaagctggcaccggaaaactttcacgctgtaacccacagcagtcaaaatcagcacaccaataggctattagcaaaacagctgtagaacttcaattcaccttctacacggattgccttgtctatgtttccactggtcgtgctggtctcggagtaagcatgccattgacgggcacatgaacatgaacaaagtgcggtgaaatgatgccgcattgtcctcaatcggtgcatatatctgcacaaaattgaatcctatttgtgattgatttcacacccaaacaacaagtagtcagctacaactgcactatccacaaagcaaacacctggaggacgaactgcaggggctcgccgcaaaagccgcagcaacgcgagttccccgatggcaagttcacaggatccaaccacgcctgcaatacagcaattcacacaaaccacaacatcaacacctggtcgacgaattgtaccaatttagcgagtgaagttcatcaaaaacgcgtgcaatccgtacgcaccgggatgcctccggccttgctagggaacaggtggcggaggaggaggcccgggtgcttcggcttctccagaaaaccaagcgtcacctccggctcttcctcctcctcctcatcgtcgtcctcgtagcccgcgccgccgcctccgcctccgccgctgcgggtggggatcggtggggcagttcgggctcgtcgtcttcctcatccagcgaggtgatggtgagaccacgaagcttcacggcgttggactccatcctcggcggcggcgtgggggcaaaaatgcgtgcgtgttcggcgactcgcactt

SEQ ID NO: 11085 - DNA, 3275 bp, Oryza sativa
  unsure (1)..(3275): unsure at all n locations
taatcgtaaacctagcatgtcaatcatatgtaccccggttgataatcagaaaagccccaaaaacagaaagattgtataagcaaatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgtgatcgggctcagtatcggcgctcatcaagcatcgcgactggatcgacctttgtgccttgtgctctggcagcggatgcaggtggaactgcaattatccattcaggctgccggtatgctgtcacggagcattcccatcaagaaaggagggaaaaacttcctaacatcgtggaaatcggaaggaatcgattcatgtttaaataaaacgagaagaaggattggaaaggatacttttcccgacgatcaattcacacatcgtttccttctgaacaaaggtagatccccggcggcggcggggaagctgcccgtagtggcgcttttgatagccgtcccgtcgctccgacgactgggccccggacgagaatctatctgttgggccttgctgttcatgatggaggcccaaccagtccgagttgggacacggaccgaacgtttgggcctaaaacttactcctatctgggccaaatctgccgttctaccgttagtttacggcctggtatatggtactagagcagaacaaggtcgcctcattgatcgagagatacgtacatctgcatgtagcgtagaccgtagagtctcgaggtactactagcttgtcctggccggtcggacacgaggcagttggaagcgaggatgcagccagccggccggccggcaaggaggaggagctaggcacatgctcttgccatgcatggcgcccgcctatgccaactctgctagtcccaagtctcatcggccaatgcacaaactacaaggctaacctagcagcaggtggtgtacccaggtgtactgtactggcgaggagtagaaccccaactactggaggagtacacgggtaacacggcgcacagaatgctagcgaccaaaagacaagcgtaccgtactgcaagctacagctagccgaggacgcctgtgtggctgtgttcatttctgaatcttttttttttagatggtcaggacactctctttctgtcacggtgtcagccgtcgctgaatttgatggagaggagggtactcctactgcagaaagaaaattgtatgtgcgtggtggtacagggctctgctccatgccatgtagaacggtagggcagcatatgcatggtttatgatctgatgagtctgcctggccattggccatgctttgctgcggccgctctgaaccacgtaggcgccctgcgtacgtgtcgtgtactcgtgtcgcgtgactcgcgtcccggcatgcgttacagtaaccagtatgtacgtccgtacggccgcactacttctgattggaatttggtttcacttaaaattgtggcgccttggccacagtacaaccaagtgagtgcagccttccaggcagtcccagctcgatctgaatgtatgtgtgtgtactcagacaaacaacagctagctagctgtatgggtatggcgctcatcgtgccgtcgtgatgactcacgcgagccaaagagtgagctgtaagtagcctgtaatcgagcatatgtatgggcacagtacctgcacttcgttcagctttgtgccttcatgttttttgaacagccatcagtactcggagcacaaaacgtcgatccatatccactaactgcatgattagcaagtgagcttcaatattagcacaaaactgttgccgttacagtaagcaggaatcaaacaggcgatgcctcgctggaaggcctcataggcagatagatggagtaggcagtgcacaagcagacgaaacaggagtccatcaaatcagcgtgacaatagatgaagccaaggcacgcatatgcatgcccaatcccatgccaaggccaagctagatgcggacgggggacgggatcagactcggagcgcagcgcctgacgcagcacacggattcctcccgtgccgcgtctccccgtgcaagcggacaaccactacaactgcaaggggctctcccatcttttcggcggcagcagcagaaaagttcctgtacgtgcatcgcctgcacccgagggtgccgggctccgattcgacgaaagaacctggccgcgctgcacatgagcaccctcccggcctcccctccctgcgactgcgtgccagcacagcagattaacacagctgtaaagctcatctctctactgtccgcattgtctcgttgcaattcttaatagtgcgcgtgtagcgtcaactgggtgtactagtactctactagtagtacgactgtacgagccaagaccttgttaagagtattcttctgcgtggcgcctagtacacgagagacagagaagagagccaaaacccaagctatctggggacaggagccaagatcccggcattaccagacatgaacaaaacagagctgtgcaaagtcgatgtcctcttgttctttgagatcaccctaaccaaagcattaagcgggcaaaaaacagcgagcgagcgagctcgtcgtcctcccgctccgcacgtcgtgctcggccgcagcgggcagcgagacagcgattcagggatttcgggggagctgcccggctgatgagtgctttagggggtgtttagatggggctaaaactttttagtccgtgtcacatcgaatgtttgacgctaatttggagtattaaacatagactaataaaaaaactaatttcataaatgaaagctaatctgcgagacgaattttttaagcctaattaatccataattatgaaaagtttactgtagcatcacattgtcaaatcatggtgtaattaggcttaaaagattcgtctcgtgaattagtccaaggttatagaataggttttataattagtgtatatttaatactctaaattagtgtataaacatccgatgtgacataagtccctgttttccaaacatgcccttaggttgctctgctccccgcccggccagccgatgaccgaatcgcgagtgtacggaacaatttatcgcggaagctggaagcacgggtgcgagtgt

SEQ ID NO: 11086 - DNA, 3126 bp, Oryza sativa
tgtggtataataatcgttgtcatatcgtttttttcgttctccttttaataattataggttgtgtgcatcttagttatatgagaggttttaaggtgtttgcatttaaaaaaggtaaagattcaacgctccacaataaaaagcctgtttggcacagcttcaggtggagctggagctcagccaaacaatttcaactacaccaaaattgggagtggagctgggtgaagctctcttacaaaatgagctagagttgtggcccaactcctgaagctaaatttaggagttggtgctgtaccaaacaggccgaaaaggtaccactaaaaaggtatttaaatattggcataagtacttaggtagtaagggtaaaaagataattttctaggagatagagaagagtataattgtcttaattattagttatagataccacatcgttactggtagttatcatctacatgacgttatttgcgtgttctttttgagatttacattttttttcttaagaatagattcacacagtaatcgttattatgttatttacatgttttttagaattcactaattaaaaaaatatgtcttagggaattaaataacttaaattaatcatatcatcttggtgtattggttggaattcaatagagtttcttttattattattattttaaaaaaaaaacttctccacaagaatggcggttatctaggttatatgcatatgtgctagtggaggatatgttcttggttggactaaccactatacaatgatttctaaaaggttccatcagacgtattaaacgtattaaatttgggctttgcttcaatgaaaaacacgagggaggcaacaggcaagcgtatatatactgtgctggaaaagcatacgaacaacttcgaagaaatacccgcgctttcacgtacaaaagccaggtttgtcagcatcggaaagcataaagacttacgctaaaactaacaaaaggtcatcaattagaaatggaatactaccatttggcccggtcccaatagaacatttcttagcgataatagcagcgctctgttgagtcgaccctgccgcgctgcatcgtcggcgtcgtcttttctcaacatcatgtcgttgtttatcggcatgcgcagacagccgcttgagagctttcttaagctcgctgaagctatcgtcagtcggcaatgggagtatatattccccaatcccccactatatgtaagtttatttcgatctcaattgtagcacacccgttttgatttgcatgtacatttacacatggttttattcggttggctcagcggaaccgaattcctcccccctttctgttactacaatgtttaatattgcattctattttcccctgactttaagaatactggacattctttatttttttctcgaaggaccagcttaggcggctggcattccatttatcttagaaggaacaaatacgattttgccaaaacggcggtatgaaaaagaaaaaaaatacatcaactgcagcaaacaggcttaccgttattgtacaagtcactctaagacgatattctcgttaaatccttggcgcctcccatgctccaaacccttatctcatccaaaatgaggttgcatacttgttgtatagatgattcactttacattgtttcattccattccatctcccctcctgatgaagaaatgaatactcatgtccattgagttagtttgcgtatatagcatcacctgatgaacatgactgaatgaaatggcatttctttctagctgcacgttgccaccttgtttataccgatactagcctaatgctagcactggtactactcgtggactgcacccattcgacgtctccaaacactcgcttgtattttactccacatcagggctcaggagtggtggcaaggggggttgagcagatagatcgataacgatgaagcacatgacacccctcggcccaaatggaggctttgagccaagtaataagaagtcaccgccgcaagttggagcgattcctcaacgctcgtgtgaaacgcgacgccctgactggtcgcctctcccgctctatctgcgacgacgactctgcatgcgcccaactggcaaaaatctctccctccagatcagccccccccaattcagcaagtctttcttcagatcagtatctgatcattgaattttacttctcttgcctaattcagtactgtactctcttgggttgttgggcattgcgtgttgagtatgtccctggctagctgtaaacctgtaacgacgggtgtggcttcaaattttaagccaaaaaaaatcacaccttttgtccaaagtttctattctgtcgactggcttttcagttttgaactcggtgatgtggaatctgttgtgcaaaatgttttttccctgatattgctatcaacgagacaacgagtggtggaccacaagtaactctcggctactgttcatagagtatgattttgtacttgatcaatcgtactttccagggttttatttaaccttcactttggaccatggcgattattcaagcaagtagcaaagcatccatggacagtgacacgaaacaaccaatgagatgaccaggcaagatgttaatgcaacacgaaagggggccaatgctcagttgcacaagtccaattaacacattgaatcaagagattaacaaaatgggatgaagctgagtacacttgcgttgcgtcacattaacaaatcctttttagttgtgttctaaactatcgcattcatctagagggagaagaagagtcaaaggccaattaggtttctggaggtggtgacgccgccgtcgacgacgaggttgtggccggaaatgtatctggagtcgtcgctggcgaggaagagcgccgcctcggcgatgtccctgggtctcagcgtcgcgcccttgagcgtggcgaggcccctgaccacctcctccatcttctccacctcctggtcgctgggcacggcgatgtcgaggtcgatgtcggcgtcggcgtcgtcggcggtggaggcgtcgtggccctggcgccaggcgttgatgagcatcggggtggcgacgccgaagggggagatgcagttgacgcggatgccgtgggcgccgagctcgcaggcggcgttcttggtgagccccacgatgg

SEQ ID NO: 11087 - DNA, 1387 bp, Oryza sativa
gtgcttcacgaacagcctcacgatcgcctccccgatccccctcgccccgccggtgacaatggccaccttcccttccagcctgcacgccaaaattccaaccaccattaacaaacagctccaagaaaacgacgagacgaacaacacaacagcgccatgagtaatttgtagtagtagtagcctacctcttgggcatgggagtgggggcgccattgggggagtcccaggcgtggagcgacggcgccatggacggctggtgcgccttgtcagggaggaggtcgagtgcggcggcaggcatggcgagatcctgggcgtaggaggcgagggtagtgtgcatgtacgaccctgtcctagcaagtgatagtgtgtgcgcctctgcaggggagaccggacaccgccttatatagcccgttggggcgcgcagccgcgcacggcttccctcccccgtcgaaagcgacactgcgttttctgaccacaattccgtcgacgtgtttggctcagctgccgcgcgggtgcgcgcgcgtgagcattcgtggaacgcgactgtgcgaggcagcagcgaggcagggagttgtctcggcttcgtgacgggtagaccgagtggcgcggcacatggttggagccggtcgagttgaccgccacgggtgcgcggttttttgtttcggtcaggatccgggaccttgacgctgaaaaagagttcactctctagtaagcctataaaattcatgaaaaaatcattttaaaaaagtccagtcaatttaatttcgaaacaattgaaaaaacaacatgcactacaaatgggtcgttttttttttctgttgttccttggcatgcacatttcgaaatgttttttgcgtggatatgggtcggtcggaacgggcatgccttagactgaactttaggattgaaccggtgtggtcgtgtggaagattgaggcagagcggatcaagatcttttttggaatttttgtttgggacgtgcagctgcaggagaggtaggcttggtcaacctcactgtaagactcgagaggcgttgttggcgtttcaacttggctcccacgatttccagcggtagtggttgccgatcggaggcgagttccaactctttcaacctaaatataggcaggtagatttgttcccaagtgagggattaattagttggagtattaatagaatccggagtgtgattgctgtaacaccatcctaattgcttcacggaacaaatcagcttcatgccttttaccaagttgtcaccaaacaagtactacgtgcctaggtcgatctgaccgtgcttttttccttgcccaattggatttcgtgattaaggtagagtttgaatcagctacttattttttatggacacgcttgcagaattaataaatagagcttca

SEQ ID NO: 11088 - DNA, 3136 bp, Oryza sativa
ccatgcccgacccgatgcccgacattgcccgctcaaaccctacccactagagttagcgggcaaaactccgtgcccgtacccatgtctggcgggtgcgggtatgtctgacgggtacccaatggatctcgcatgaataataacttgaaagatatgtaatttaacaaagagaaataaaattaataatttaccaaattattggttatcaacaataatttgaattacatcacaacttagtatcagttagcatcacaaatgaaccgagagaaatggtataagaattaagaaatgagtcaaaattagctaatacatatgtatcaggtcgggcatggattacccacgggtaaaaaaatgaaacccgcctattgcccataacgtcttcgggtctcggacggacgtgcccatggataaaaaatcattaccacgcccatgcttatcgggtacccgaacccatgggtaaaattgccatccctaatagagtctccaataaagggaacatgcacgaaccagatttcgtgaagaaaatactccctgtgtgaggctgagcgtgtctccagtcacacaacaagtttgggggtttttctcaacttatctattatatactaaaaatccattaaacttcctacaaacgctcttaagccgccacgtgggattcctacaaacgcttctaagctgccacttggcgttctaatacattagaaacatctaacccttgattttcatttaaagattttcatttaaatttgtaggtctattattttaattattttagaccattagattagattaaattaaaaacagaattaatccctccctgacgtgtacgtgtatctcgcacgtacgtacatacttgattcctctttttcctccccattcaaaacgctctcaaagccgtcacgtgggatccttcctacaaatgcttctatgcgcgttctaatacattagaaacatctaacccttaatttttatttaaatttataggtctattattttataccattagattagattagattaaaaacagaattaatccatcctgacgtgtacgtgtatctcgcacgtacgtacatacttgattctctttttcctccctccccccccaattcacctctttttttattttttttactagatataccgccaaaatatatttatatcacctccaatttctacactattgatttttgatcatatgttttatcctaagccgctacgtggcactcatacaaacactcataaaccgccacgtgtcactttctaatctagccgtcgattttcactgaaattggtggacccactattttagaccattaaattagatctatttaaaaaagtctcagcttcatagaaattatttactaaaaaaataacgtacatgttatctaaaaaaaccaaacagacatcctgacgtagcaagatgaaaaagccaaaaaaaaccatatgtacgctgtaagaacaatacggtctttaaaatagcatttcctatattctacataaaatttattactccacaaatatgtacggttaatataaaagtaccaaatcagctatctttaaatgctcatcttttaaattatttttcaaaaatatatctaacttataatcctttgtattttttaattaaataaaatactgatcacttataatagttatatggaactgctaaattcattacgacacatggtgccgacatataatagtccataaaacttcctacaaacgttcataagccgccacgtggcactttctaatctaaccgtcaattttcacttaaattggtgtacccgctattttaaaccattagattagatcagcttcatcaaaattatttaccagaatcaataacgtacatgttctcctaaaaaaaccaaacagacatccttacgtaaaaagataaaaaagccaaaaaaaaccatatgtacgctgtaagaacaatatggtctttaaaataggatttcccatattataaaataaaatttattactccacaaatatgcaccgttaaactagattattaatataaagtaccaaatcagctgtctttaagtgctcatcttttaaattatttttccaatatatatctaacttataatcctttatatttttttaattaaataaaatactaatcacttataatagttatatggaactgctaaattcatcacgacatatggtgccgacatataatatgtaatgtcataattatttttcaaataatttagctaacatataataattaatgtcatgatcatttttaaaataatttcacttggtgtcaaatttgcttgacaaatatataacactaattcatatctacatgaagaaaaagtgaaacaacattgtggtttacaattagatttgatttaattttaatttatgtgagattaagattatcttttcttaaaaaaatttagaactatttgattggaatttccaggcagagatcttgctataatacgaccccttaatccatcacgagaattatggtcatatatagtttttctttcgaaattggtttggtaacaaatgaacaatcatgtgcattaaactattcatcatatatgttttatcgtttagaaattctaatatatcgaacataattgatgatgtatgtcatacaccccactgaagtgactataagtgtactccaacaaattagttactttaaatgattttgggaaatatattcttagtaaagatgtcacatgtaactatgaacaatacatgatgaaaataaaccggacgctaaacaatatatcttagtcaaaatataaagaatgatatggtactcgaagattgtcacggtcatatgtcagtatagctatatttttttattaacctcgctcattttgaaagatagtattgtatctacacagtaaaaaaaataagcattaccgattaataccataaacaattttgtctacacaaaactttttaaaaaaatcattcgaaaaatattttcatcacctacattccctcttttttttccttaaagggcaccaagcatgctatgctagcacaagtatagcaagggtcatacatatggatgagttgaagccgccccatcaaaatgccgctattgacaataatgctttactttgtaattactgatgctattatctatgagggtgctgatagt

SEQ ID NO: 11089 - DNA, 375 bp, Oryza sativa
agtgaccctccacttccactgccctgcggcgacatcaagtgcaaggacatctccactggcagagccaagcaccagcagcgaactccctgccttgcgcttcttctgcaaggcaaaaacacgagcacacgataggcacacggtaccacaacaccaaccgtagaagctcgaaaattcgggggcaatgctcaccttgctcgatagctgtacccacttcatgcaggtgtagtccagtgcgaggtgaccgcgctttgacccgggggcgcgcgcgccgccggccacctgcaccggcgggatatcagcgaactcggtctgaaagtggtcgagcacggcgtcccatacctgcaatggaggtggaaaggatcgagttagcccatg

SEQ ID NO: 11090 - DNA, 16983 bp, Oryza sativa
cactctggtccctggccgcctccaccgctgatctggaagggaaagagagaatggggagaaaaaaagagaagggagagagagggaggaggaagaaatgatgaaggatgacatgtgggccctacgtgtcagtgggtcccacaataattttgtgttgaatgacatatgagtcccatatatatattttttaactctaatgccacgtaagcgccacgtggcatgaagaccgggttagcaccaccacatcagcgccacgtcagcaaaaccaccctccaataccgccggagaagtcaaattgcactggtttcactaattcggggagtcgtcttacccggttttctagttaagggtcacgaattagatccggtaaataattaagggagtctaagtggactttttccgaagcataatggtgtaaaggactaaaggtcactccccattgtgtcgtccaaataatggaaccaaaccatgggtggactgtgcactagccgcgggccgggcagctcagttcgacgggtttgagagcagcggcgatcagtacccttagcaagtacttccttcgtttcagattgtaagtcattttagcatttcccacattcatattgatgttcatgaatctagacatatatatctatctggattcattaacatcaatataaatatgagaaatgttagaatgacttacattgtgaaatggatggagtagcaatagccacccgcccatccatctttcgagttgttgcacagccatgttatattcacgtgctagtgagtaggggtgaataactgaatattgtcacgaaaagtttcgattgaccgacgcttcgtttccatttttaccaaccgagcaacgtgaaaatggttgccgatagaaacgagaagggaaatggtaaaaaatatgaaattggaattttcttttcataccgactgttctcgacttttaccacattcttatggcaataattgttttttatattatggtaattaatatttatagtctatttctttatttgatccatagtttagagatctatcaacttctcagctaaatctctaactttgggtaaggttaaaagagacaaattataacttaacgtaactttgaatttatttcatcatattatatagtgaaaagttaaatatacgattttacagttcaatatttttgatatttattattggcttccgatcaataccgatatgtttccgtctgtatggtatgtttccagttttccgatatttctaatatcgttttcgcttctgactttaccatatttgattttgtttttttataaaatacgattattaaaatggttgagacctttttcaactattttcatcactatagtgaacgatcattgatcaactgagtgtgacgacaaagaaaaaaaaaacagttgaaagaaggaagagaaaaagacccggtccgtcccccatagaaggcaaagctactgtttgatttcacaacaccagtagtagactagtagtgctattgctttgtggtcttctttttttttcatttttaattttttaaaaaatatttacagaaatattatatcaacaaaaatatttacaaaaatagacccttccgcccttcacttgggcggcaagctaacgtggtagactactggtgttgcaaggagtgaaatgcaattattcagtgccaaaaaaagtatttggctagtttttttttcatctgtgggcggcaaggggccgagataaaaaaaatactagcaaaattgtattgaagctctgttgataacacttaaaaaattatttattggtaaaacttgttaataatattttaaaaattgtattgaagttggttgttttgcaatttcatattttaagtaagagtttatgttgtaactttttcgtcgtattagtgtacgaaattgatattggtctatcgtagtcttggtcatagaaacattatatacacagaaacaaggagaattatgtcatgtaaagaaatagtagtagaatttaaacatgatacatctggttccactggggcgccagggtcaatttttataaattttttcaccgatataatatttatgtaaatattaaaaatttaaaaaattccaacttctttggtcctttttccgtgccatgacttgaggctctgttgggttggcctttggtcgaaaggaagaccagggcatgtttcgtgcactctttcagtgtacgagatacagtaaaggtatcaacagtatcattctcccaatctccccttgttcggttctgtgatgtcatataatatgtttcctatatatcattagaacgagaaaaacaagatgatctacgcgtcaatgtttggagtcatttctgcctgtccgtaccgttgatgtagaacacgcaacaacaacaacaacaaaacaacagctggttaattttaatttacatcgtgtgacatcgacaaatgggccggttatctgaactctgatgaagcgaggaggtgtgaacggtgaaccggacagccacgatcgatatatgaaaaaaaatggtcggatcggattgtgacgtggttgtaacgaagcgagcccgcgtgccgtgtgctgcaaccggcgcgcgcccgcgcgtcgttttcgctggccacgcgatacccccggagctcacgctgtactacgtgcttccatgctggtgcaagccactgcctcagcaactacgagctcaaggcagtgggcatatatatggccatcaaattgcctgatcggcatttcaactttcggcggcccaccgctctgcttgataatggcagccgcggtgagacccgctgatttgctttgctgttccctcgttattttattacatctaaatagttataaattttttaaaagattaaaaagatatattaacatgtgatatatcactccacaaacatgtaacttagaattcaatttatacatgtcttaacgatagttaaggtatgattcttgtaacatgtagaagttgaattttaagttacatgtttttggagtatatcacattatgcacttctcaagtttttttttaaaaaaaatattcaaaactatttgagtgacatgcaaacaataagtgatatctatcatagtagggataaaaagggtacggaaacaattccggattccgagcctgttttcggaaacagaatcagctagtcggaatttctcgaaaacggaatcgaattcgaaaatattttctcgaaaacggaattgaatatgataatagcagtttccgttggagctcggaaacgatcagaaactttccgaatagtttgttggaatttccaaaattacaaaggccaatagaatacaatagtccatatttcttctccagcccaaccgaattcgtggtacctaccagactaccctaaccctagagacttagagagaagagagatatatgtacacttagaggacgagagagaccacgactctgcgagttgggtggcggagcggcgcatccagatctcacgttgctgtgtctccgccgggctgccatctcgtgccatccccaccacctctcgccgtttttgcctccatggtgtttgcctgtatttatttatcaaaagtatttatctcttaaacacggatcatttattttatagattttgttttgtgatgtactattaagttttaatacttgggcatgatataactgtgttttatgataaattattcactgttgacacttaaggatttgactttacagtgtaaagcttagtttaaggggttttatttattccgataaattttcgttactgtattcgcaccggttcattttcgctccgtttttaatttcgataatatttgattctgttttcgtgtccggggttttcgattctgaaaaaataaatatgaaatcgaaaataataaagatggtttctgtccgtttcgtttccgtatcgttttcatccctaccctcggggtttagaatagaatagtttcccgtcgcccgtgcatcactatatcgcacctcggtttcaccctctcgcagcaaactttggagtttctcatcatctcatggcgtctatcaggtagggactacagtccattcttatcaggtatcgccatctcgcgcttgacgacctgatccaatcgtcctcggaccgttcgatcgatgaccctggaaaaatcaaggccgttccgcgaccgatgctcaaagcctcaaagccccaaacctgattgctcttgtctaaaatctaccccacccgccttctctgacttcctgacgagcagcgtcctcttctcctcccagtcccagcttcccctctgaacacgaaaaaaagaagactccttttggtcaataaatcgaaataacctcggaaaaccagggaatttaaccgtgcccacacccatctgttcccttccagcatccacaacctcttcaaccgcttgcctgctcttgtgaggtagctaggcaaagatcaagaggcagtagaggtgtggaggccttggacagttggattcttggagggaaaagaaggaagaacttgcataccagtggaattcttcaggctggtcatggagatgcagctttggaggagatgggtcggcgtggagctcaggtacgtgctatactgctatactatgcgctctgcaatttgttctatcttattcatatctcctttagttctcgaattcgctctcaacctttgtatctcatggattggttactctgttcttgttacgattttctgcatgctagccttttctccatttctactcttttttttctaacggcaatgttaatcgtccccatttgttcttgcgattgatcatcaaaccgatcatcgcctgaacagaagcagcgctttcagtagtacgcgaggcctaggcacggcggtggtttgattttgcaaccactgtactactgctactatcttttagtagataaaaccgtcattttgatttggtaactgaaatctgatcgtaactgtttccaaacgaaacctgtttggaacagcgaccccgttagcacttagcagtgttagatttttcttggcattccgtggagccgtgctgagtgcttccgctgttgggttcagctttcctcttttcctttgacgttcttttctcgctacattttgattggagtcctacacatcgttggctcagcaccatgttgatagtgacgcccaatgtttgttaaacaaagtaccagtacttgtaaattcagccgcccaccacaggagggaaaaatccttgcatatggtgacatttgctacaagtaacatggctgacaacccaaaccaagttgtgtttagcttttactagttggtagtagtagtctttgtgctttcttctagatggttcagactcttcagagttttttttttctcttttttggaatcataaccaaaagaacatgccttggatgcctcttgaatcttgaattcttgatgagtcgagtaaactagaggctcctatgtttcctgtagcagtagcgtattgttcagaacattactgccactacgcactgtgatctgcccggtttccacgtagtatgtttcgccgtggtcctatgcagaaataaaatccaatttactgaggtgcacccaacacagtaccactaccatctcagcaatcgagaatcgttttgcatcatatccgtttctagattgacccacaatgatttctagtcatggtccttgcatccacattccacaaaggtgttgcagatgaaacatctggttatctcacgatcacagacaaaccgcacaaccctcttcaatacattggagcaatcagtggggtcaacttcttctcttccaattacatggattacacgcacaaaaccgcgtatgcgcccattacgttaaaaaaaacatggaccaacgataaattttatttgaaaatacaccaacgtgtggtaatattcagaaacaccagaatttaaaccctattaagtgaagtcatgcacctatggcttaactatctcaccacatagttttgtgcgatcaacttttggttcctctcgatatttgtcttagagtgaacttaaaaaacaaaactcggtttgtttagcatccaagatacagaactccaaattttacaattcactctattataatttattttaatgaaccccatattttagagcaaaatattttgcaagaccaatacaagcctagatgttacatttaacaaatatatttgtgcataatactcggaaagaataacataagagttatcaatagctctggatgaaatacctagacactataaactaatatttgaaacaccttactggagaaatgcctgaatagaaaacatgttaaaataaagatatatgaatagacacgcgtatgcaaaacatattattaaagaaacgcaggaaactatatgaatgattatttgatggtgtatagaaaaaacatgggaatgttaagtattaaatcaacagtaaataaaattttgagggctaattcgaaatacaggataaaaacacacacatcaatagaggaaatgtaggactatgataggatcaacatggaaacaaaggaattttatagggctggttgtttggaacagagggttgtcttgaacatatgatttagcttctatcctatgctagctagaggttgcggtgaattcatgcgttttcatggtaatgctataatatccctccataattcgtttgagcaattccttctacgtgaacagtggcagatccaaaggatcattaatcccacaaaaatcatgtgaaaacccttcgttccaaaggaccaccagatggttttaatccatacaatctagggtcaagaaaaagtaaaacatatcttccaatcgtgcttcgtttctatcgtacgcatagtaaaaaaaataagtttaaggtggatgttaattttcttagaattctatttaaatcatggtcacaagaaatatttctatgtctttcctatgagtttttaatggttgaactgtactagttcctataggattcctgttcttacttttttcccctccatttttccaatcaatcaaagaagccctaagtaaaaaagagagaatttgtgcctttctggtcatagaattactactccttttagataatcaaatttattacacctagccattaaacaagtaggtcaaccatgtttgaccttgtggcagacgtaagtacgagtagtactccctccacctctaaatatttaacactattaattttttaaaatatgtttgttgttcgtcttattaaaaacttttgtgaaatatgtaaaactatatgtatatataaatactttaacaatgaatcaaatgatagaaaaaaataaaaattacttaaattttttaaataagacgaacagttaaatatattttaaaaaaaagttaacgacgtaaaattttagagacgaagggagtattaattaatcctgtttcaaaagtccgtcaaagcaatggtcagtcagaatagacgagcacagatttggtcattctggttgtgctgcactgtgttgacattttttgcactcttctgacttctctactgacccgaagaaactgccacgtatccaaactctttgcagttgcaggcgctagttcttagcgcgcgcaaaccacatgctgttctgaagtctccaagcgcgcgctgctgtctggaacaagagccgggagcagatatggtcccggacggcggcgaggggcatgagatcgtcgaggtcgccggcgagcccggcgcgccgtcgtcgacaatgcggctgatggacttcatacccatctacatcccgacggtggagacgggcgcgctgagccggagcgtgcgcaagcggcggttcttggacttcctccgcgcccacccgtccagggactggttcctccggtcaaccttcgtcggccgcctccgccaccggggccagggccaggcggcgtcgggggatgacgaggaggtggactccggcggcggtcgccggcggccgcggaggcggttccgcgtgccgttcgtgaggaagatcaagtgggggaagctgtggagctacgcggtgagctggtgcaggaagcccgagaacttcgccatgatcatctggctggcgttcgtcgccgccgggctgctgatgctgttcatgctcatgaccggcatgctcgactccgccatccccgacgacgagcagcggaagaagtggacggaggtgatcaaccagatcctcaacgcgctcttcaccatcatgtgcctgtaccagcaccccaagatcttccaccacctcgtgctgctcctccggtggcgccccggcgccggcgccgaccgcgaggagatccgcaaggtgtactgcaaggacggcgcgccgcggccgcacgaccgcgcgcacatgctcgtcgtggtggtgctgcttcacgccacctgcttggcgcagtacttctgctgcgctctcttctggagctacgcgcgcaaggaccgcccggactgggctctcaacatcggctacggccttggcaccggttgccccgtcatcgccggcctctacgcggcgtacggcccgctgggacggaagcagcccgaggattccgacgaggagtcagcgccggcgcaggccggcggcggaaaccggccggcggagaacgcccgtgaggtggagatcaagatatacacccggcgcgtggtggtgagcagcccggagtggagcggcgggctgttcgactgctgcgacgacgggacggtgtgcgcgctgtcggcgacgtgcacgttctgcgtgttcgggtggaacatggagcggctcgggttcggaaacatgtacgtgcacgccttcaccttcatcctgctctgcgtcgcgccgttcctcatcttcagcgtgacggcgctcaacgtccacgacgacgacatccgcgacaccgtcgtctccgtgggcgtgctcctgggcctctgcggcttctctacgacggcttctggcggacgcagatgcggaagcggtacaagctcccggcctccggctgcgggtgcgggtgcgagtgcggcgccggcggacaggggcacgcgtgccgcgcggcggtgagcgactgcgccaagtggctcttctgctggagctgcgcgctggcgcaggaggtgcggcagtccaactttactacgtggagcacgtccggttcgtgttccacggcgtccgcaactagtacgggcgcgccgtgctggtgccgcttcctcgggaggcttccactgaccgagtgcactcgcggagcatgtcgtgcccgcccaagatcgacaccgtggcggcgctgatcggcgcgagcccgctgggcgtgcagatggcagccatcaacatggagaggtcggccacgtacagcggcgagcaccaccccgccgccatgcgtccgcctgtgcccccgctgatgcaaatggaccaggaatagtggcagcggcagcagcacgcgcgccctagctacaccgtggccatgtatacggtagtattaattctatgatacgtacggtagtattaattctatgatacgtataaggtcgtcgtctacacgtactgcaggttgtattagactattagctggtttttatacatacggattcgtttgtttgatagtaaaagaggacgggtaatttcgcttgaaattgaattagacacggggtgatcgaggttagcaatgacatccgtgacggtacgggaagccgggaaggattgttgtgataacggctactgggccatcaccatgggccttttaatcactgtgacatgtctggatctgtgtggacacaagggccgaataggagttgaggctcagattggacctatttcggcctgacgcaggggcggaggtagagtatggaggggttccagaaatttttttaagctatacttcacatatttttatcatgtgtacacctctcttattgtaaacttagacacccgcatcaacttaaacttgatttaaagtaaagtaaattaagtaagaggcaccctccctcatttcgttctagcttcgcccctagcctaacgaggaaaaaccaaaggccgaatcgaaccgaaatatcggtagtcggttcctccttcggtggggttgggggggtgtctgaggaaggggtggacataaaatcaccgaaaaccttttatttttcctatatatcggtctttggcttttccatcggtttctcttctctaacaaccaaaaaattcgtacaaaccgatcaatttctatgatcccattcccctacgtgaaaaacacaatgtccaggcctttgaccaatggaaaaaaaatccattaataccatccatctctcactaacccctacagcccatagcctatgcagcccatctgactaccaacgtggcccaatatgttgctacgctacttgcaggacttcagcctacggcatggtagaacaagtacgcactccctccgtaatacaaaataacaacctaataccggatgaaatgtattctaatactataaattttgaacatgccccctatctactcgtagtactaggatacgtcccatccggtattaggttgttatattttaggatggagggagtacattttttcagcttactcaataaactgacaaaccgaaccgagtaagttatgttaatttggctcagtttatgtttttgttacaaacaattccgcttggttttgttgagaaccgaatttttagaaaaccgaagaaaccgaagcccacccatagtctgagttcgctgattttatcattgatgaattataccgaaagcacataaacggcattttggataatttttcagcctttaacgggactgattccttaattctaagagcagatccaatgtgaggccaatcaagcatttgcaaaaaagaaaagaagatcaaacagagcacaccgtaagagtcgaatgatgtgtgccagactgccagtgaaaaatcaacttcaaaaatgaagttgaacacaagccaatataaatattctccatccggttgtgctgcagcgggaggcagacgtagggggaccgttattttctttacgtgcgtgaatctcacaaatcgatcactatgatgcagagattgagccgaaattgtgttttgcttgcatgaatcgaactcatcgcatgtctcgcagcaaaattagaggtgccctaagagcctagtgtttttttttattctcacttgaatccaataatatgaaagcaactaggcaaatatgatggcaatctgaaaattagagcatccatttatgaaaaaaaaattataattttcttaagaaaaacaaaatggagaaaatatgaagtgtgatattaaaagaatgttagtgatatcaaagattgtgcattgtttttcatctttctgagcttatgttaatgggagagcacactcgttcgtgagtgtacatgtgtagcgtacagaaaaaaaaatgaatcaatccaaaatttatggagagtggaaagagaaacctgacagtttttttttgttttctttaaaaaagacaagacaaaatccattaacagcataattggtgggttaaactaatttcgtgttaaatttcttcctcttaaataggctactccttccggccataaatattttatgtttaagactatacttgtttaagctttttaaaaagttaaccatcaatattttctcagttacttaatttaaaaacaaaaggaacaatataggtaagattcgcttgtaaaatactatcatagtatcataagtttattaaaatttataaagttaatcttatatatagtgaattgttatagttttaaaaagtttcttcaatccttgttctaagcaccaaataatttataagtggaggaagtatatggtgtgaacagattttatccattcacaatattgttatatggtttaacaatggcaatgctatgcaacgtgccaaaaataatacagccaccatgtaagtccacatacttccggcctctagctagtactactagtgctacgaaggaaaaggctaaacacacatccaccgggcgtgcagagatttcacgtgtctggtactctgttcgctgcttacaccgacgtcaaccgaccatctgacctatcaaccgccatattgtcaacaaaatgctgaactgaaagcctgaactgacggccaatttaactgctacaggctaaaaccgatgcagacaaaaccgacctaattacagcattcagcaacacgaaacagactgtgcccatctagcaaccgacctctctctcaaccacacgcgcgcgcaaatgcacgcacgacaacgggcttgtttggtttggtgccaaattatgccctaccaattcattggtaattttgaatagtgcttctatatgtttggattggtgccaaattttaccaacaccagttcttagatagtacaaaatttatccacccaaatttgatagtgccaaaagttgcctaaactttgatactaccaagattttggtaggacaccaaaccaaactggcccaacattttcaccgagctaatggaaaaaaagaaggatttcttctgtggtgacaaacgccgcgacaccaatcatcaaccatgtgtccatgtcttgctctgtcgcagtgctgctcgatccagacctccggcgcaacgatcttcagagaaagtggaggttggtgcgagcgacgcagagacgacgaacataatgcatatatttttcttcctcgatatcgcgaacgtggtgacgccactggaaatttggaaaaacggaagtggccacccaccacccgcacgatccaaggttagcatcaccacacaaattcatcagcgatggcgagtagcccccacccccaacgagagttactagtaacagttcttgaccttaattggctaatgggatgcttatggggcactttggatactcatctcggagctttacctaccaagcgaaagcgatgcgtgtgtagaaatctggcttgcatgtaaccagcagcctcgatcgcgtacctaatacctttttctcgattaagctagactcctcgtttattacttggaggcaatgaggcaagtgagtaggcgagctttttgacgagggggaacagggaagctgatgtgacgagcccgtgcgtgcgtgcgtgcgttccgttcctagcctgcatcgagcaagcgatctaaaatgcagatttgtgagttgattagtgggaaaggacgcgcactaacggcatatatgggattatcttctgctgcgtcgttctaaagaaagacagtgtcaacgtgtcttgtctcggctttctttatgtttttctatttgtagctgacactgaatcactcactcatcagtgataatgttctcgattggttgagatagctgaccacttatgatcagcgatgtgatgtagttgcgcaagtaaatgacaagaggttttacaggaactgcctctgctcgaatttttttctgcatgttttcttttttcatgaaattgatgattagttccttcttgacgttgaatggaaagtctgctcttcggtagtgcttgtgctaaacttgctgcgctagtaacaggatctgcatctgttcgaagtgaactgtgtgtttttcttcattagatttgtagtatctaagtagtatcaaatctgaaaaatcgacatcacttgcggcggctttgcaaggtgtttggtgttgactgaactttgagaggctatggtggaagtcgcactactattctacacttttacagggcagagaaatcgaaatctaatccattttggccgagccgcaagcagacgccgctattactgtcgtgataggcatcgcatcaaatatcctgcaaagatttgcgcccgtgaaacgaacggatattactggcttgacgtggcttattgaatccaggtcggatgctcgctatccgcggtatgaacaaaccgtaaaggtaagagagctcacgggataaaaggccaaaagggaagctagcaaaagtccaaaagcaacaagtgatattctgatggtaaagtggaacaacatggttgatttctttcgttttcgaaatcgacttgtttggatagaagcagagtaataattgtgaaaaatatagcatttgattcaaagaaccgttgcgaccttgtttttctctgttagctgatccctactttggctgcttccactaatatggcatagacgatagaaaacaatttacaccattataaatttgagaagtgctggacattgcagaccattttgatttgaagctctactaaaatgttagtaatgctaaatcatagacaaatttttgataccactaaaatattgataaagtagattatacctcaatgcaatagattttactaaggctggtttcaatcttaatggctacaaagtgctattcaatgatacaaaataattggtaaagcaagaattgacgttaagccaaaatggctctgtaaaacaggcaaaagcagtcgcgggtgacaaattttagtcagagatcaattctcttgttaacaattttcgttgctttccgaatgacacagtaaaacgagctcatatagtacattcacagtaagtatccatccttatttttttccctctgttactaaggtcagggatttgctatgaattctgtctctttgcacgttggttagaaaacatattttcagctgtatgtgggatacatatacgcagatacagtgtgcaagcgtatgcttcattctgtgtaattggaaaaggaaaatcacactgcggcatgcgtgaacatggtcctgtcaaaccggtgaggcacaaccacaacctaaacaagctggtgcgtccggagaagaaatttttagccagcaagttccacgttgtttgaaaaagatgcctaagcttgcgcccatgccagtagtatttctttaccccacccgatattatttcgttcttggagccgcgcatatatttatctgcaacatgcgcacgtccacgtaaccaaccaacaaccagtgcgagcgcgtgtgtgtctcgcattggttccctcgctgacagcgcactgcagtgtactacgtgctcccgaccggtccatggatggggatgcagttgttgcagcgtgagccgggaggcaggtgaggtgaagcctcccccggtcgccacgccaccaacagacgcggtagcgccaccccacgcgacgcgagcgattcatcagaatcagatgagatcgagccacgaaactgccccccgtgtgtgtgggggcgcgcgtgacacggccgatcgatgggcctgaatcctggtggtgacgcagcgcgtcatggtgccgcggatgcgttggcgttggccccgcacccgctgctgctgcggtgcgtgcggccgaatctctgggtagcgaccgctccctcccccgctagcggcttctcacactcgtgtgcccgctgtaacgcaacgaccggagggcacggggccgagtgccaccttccccgaaggccacttcccgtgatgtggacctgacctggtcaccttgggctttccttcttcctactgatctgagtttttttgaagataacatgaacaactttattcaaaaagacagaatttaggggatataccccaatacatcacataaagatacaacttaagccaagaaaccatttttaacaaggtagagagtaaccactctaaaaaagcaaactttctgatgaaacaaaacaacagtaggaaatcagatcaacagagttttgcagcaaagccacgacgattgaatcctttggcctccattgacatgcacaccgcttgacagactggaaggctcctacagctgtcaccacggaaacggcacagatcggaggtttgtttctgagccgtagattttggtgtaggtatcaccggactcagcaggttggttccatggagtctttcattagatctgaggagcagagattgctcaacccgaatgatagaccctgtatggatactgttgttttgaagcaaaaggaagcaagattcggtagaacaggtagtccacatgacgagaaatcatatggttgataaaacttctgtctttgtagaaggccgaggattgctgcaggattgtagaactgaagcggaccacaacaaatgaaaaggagcaagctcccaacgaagaagtaaccttcagattggagaaataagatgccatacccacacaatgttttcaccgttgtagaaaagcagcagctcaagatatcaccggcgcacggagcagtagtacgaagagctccaaggctatcacaagaagcaacaacacctggagtttgaagactaccacacagagcaacaacacttgggctgccaaggttgtcgctcggagcaacatcgccagaaatttcaaggccgttgccaccacacagagcaccggcacccagagatccagggccgccgccgccgctgtacgaagcagcgccacctggagatccaaggcaaccgccgtctgcacacggcgcagaccaatgagttcggcaccagcataagaagaagattctgtccttcaagtcgcagctccaactccggtaatcatcaccaccagcaatcagagctcttcgcttgaacgtaaccaaacgggacatagccacagaaacaggaaaaacctgacaaagaaactacaacctagctacactatactaataggggaggtggccggacccctcctccaaccatcatcggcggcgaaccaccggaatttggggggaagaggggctggagaagaagaaggagctactgtagcaaaggggaaagttgggaggagaggaggtggggaaagttgaccatccaacccctgctgatctgagttgccgaggacagtgaggactgaggagtggccttcttttgagttttaacagtcggagctgcaccgtactacggtaatgtacaagtacacggggtagaagcgactagtgagcagtacaaccatcagaaaatgtctccgttcaaccgtggtgaaagtcgtcgggtgagccttaatctaccgctttcaccgttacacttactaagtgcgttcactgatcagagtggacgtacaccgtgaccggctggccagtctgtgcaatacacgctgcgttgcacttcgatccgctgttagcctgttattaaggctgttactaccgttagtagtaaaacttgttgactgatggtgatgagctacttgca

SEQ ID NO: 11091 - DNA, 539 bp, Oryza sativa
tgtacgaggcgctcaactccggggacgcgcgcagggcgcaggagctgctcgcgccggacctcgagtggtggttccatggcccgccggcgcaccagcacatgatgcgcctcctcaccggcgccgaccacggcgagtcaaggttcctcttctcccctcgctccgtcgacgccttcggctccaccgtcatcgccgagggcaccgacgacacccgccagctctactgggtgcacgcctggaccgtcggccccgatggggtaatcacccagctcagggagtacttcaacaccgacctcaccgtcacccgcctctccgcctccgccgccaagaccaccgccgccatttcttcctccaactccaccacgcctccttttcggcgccgccgccgccgccgtccaagcccaagtgcctgtggcagagccgccgcgccgaccgcgcgcacaagtcgctgccgggcctcgtcctcgccatctaagaacgaactcaaaagacatcaagaactcaaggcgcaaaaagcttccctaaattaatcacatataaaa

SEQ ID NO: 11092 - DNA, 1625 bp, Oryza sativa
agagtgaagagaggaagaaactgggtctcatgcaaggcacaactcaaacacgagaacctgtgcactacactgggagagaatagtgttttcataatagatgaaaaataaatatgatgggtagagaagagagatgatgtatttattagtagcctacattaataaaccatgggttatagagtgtagtttctatcgtgatgtcttattaacatggcatcatagacactgtttatgaacgctatgggttgggaccgacctaatttggcctgatacacttgtcctacctaggttgcgacgaccacggagacaagcaccctctgcatgttgcacacagagacggaatcaacggcaatcaccgcgatgaacgtgagtccacgtccacatgtcgcggcaaactagcggaatgacccaataaactattgacggtacaaaagtgaagggatcgcggcacctgttcgggccgggattcagctcatcagctggctccgccgagtgctcggctgctcgctgagctgaggcatcatcgagacgtacgggtacaaaccgcgacaggtcctcacatctggctgggtcacaggcagaccggttcgacttcgtacgtgcacgccgcacgcgacgttcctgcttggctccggtacgaggagaaaatctcacgtcaactcgatcaacgtcgagccaccgacccccgtgcgaacacgtcgttattagcaggcgtgcatagataatactcctactatggacttgttctccgtgttgcttatttatgttagtcaattactctttagcttttttattcaccgcaatagatggaagcctggacgagtaacaactaacaactcatgcgcaataatcctcatcgatttgttagcaaaaactgcttgattagctacgcattttgcttcgttttcgaccccacatcaattttccatttttccttcacaccggaaccatcgcgaaatgccgaaatcctcatgaaccctctgctctgcttgattcaccgagtcatcaaccgaccttgcgcagttgtgctagctagcaggagagcaccctgcacgaacctcacatgtgtgggcggtggggtcacccgaccttgccaaacaaaacgtctcatcggcacatgcgtgggcccacccattcatcccaagatcaaacgccagcctgatatctgaccgtccgttcctgccctagctagcatcggacggctcaccccgtgtctcgccacgcggcccgaagaagaaaaaccctaccgtttgagcagtctccgctccacgggcccactcgtcagtgagaagtcgcccagttaatcatcgcctcatcggctccacgctcctcgtctctctcggccggcgtcgctttccacgcccttttgttcaaaaaccacacagttttttttttctttttgagtttttattagcaaggggaaaacacggagaccaaggaagcaaccagcaagctgctgacgcacgcggcgccgatcccccagttcaaacccaccaggccaccaccaccttcccccaaatccccagctgtgtgtgtgcacgcggttttccaatcgattcttcttcttcttctacctcacatccctccccccaaattcccacattcgctagctcctgattcggccatgg

SEQ ID NO: 11093 - DNA, 4169 bp, Oryza sativa
cacaacgccaacgccaccgacccgaccaagaacttcctcccccgcggcaccggcgacctcgtcatcacctacgacgtgctccaggcctacccctcgagctacctcgcgctcgtcacgctcgacaacaacgccaagctcggccgcctcgacaactggcggctttcctgggagtggcggcgcggcgagttcatctactcgatgaagggtgcgtacccatcggagaaggacacgaccggctgcatctatggggcggcagggcagtactatcagagccttgatttctcccaggtgctcaactgcgacaagaagccggtgatccttgacctgcctctgtccaggtacaatgacactcagattgggaagattgaccattgctgcaggaatggcacaatcctgccgaagtccatggatgagacgcagtcaaaatcagccttccaattgcaggtgttcaagatgccaccggacctgaaccggacaaagctcttcccaccggccaatttcaagatcgccggtgcatcatcactgaacccagactacacctgtggccagccggtgcccgtcagtcccacagagttccctgatccaagcgggcttgattcaacgactctggcgatcgcgacatggcaggtggtttgcaacattaccacgagtaagggggcgaagccgaagtgctgtgtaaccttctcggcatactacaatgattcagtgatcccctgcaacacctgcgcctgtgggtgtccgtcgaaccagcggggtcctacttgcagcacgactgctcaatccatgctcctgccacccgaggcgctgcttgtgccattcgacaatcgcacacagaaggcattggcatgggccgagttgaagcactacaatgtgcctaagccaatgccttgtggtgattactgtggcgtgagcatcaattggcacatatctacagactacaacaagggctggagcgctcggatgacattgttcaattgggacaatgtcgacttggcaaactggtttgctgctattgtcatggacaaggcttatgatggttttgagaaggcgtactctttcaatagcacatcagttggcaagaacaccatcttcatgcaaggtcttgaggggctcaattacctggtgaagcagaccaacatgagtggatcagactaccttgtgcctgggaagcagcagtcagtgctctcattcaccaagaagctgactcctggcatcaatgttgttgctggagatggtttcccttcaaaggtcttcttcaacggcgacgagtgtgcaatgcctcagaggattccaatgagcaatagtggattcaggacccatctcagcagtgtcctctcactggttttggtcctggctgcttcggccttcgtattgcttcagcaataatcctggccgttgctccgattctttcattctttcaggtggttggatcgacgccatttgtaagaaacctttttgtttctggcggtttactagatgcgtaatggttgctatgtagcagaatctggcagcaattgtgcggcgagatgaacacatagggggaggaaacattgttgcagacttgcaacatagcatcaggatcactttcctgaatcctgatgatatttattactacatgtttacatcaagatgagtgatattgtacatctctgatttaagttggtgtagttgccaggaatgtcttatgtttagttatgttatatacaaaatacattttgccatcaaaccgtatgtctgctcattttctgtctgcttttctgaagctaagctgctctcttcagtttattgtcataccatacgatacatggtactagtaattctgaaactgttgctcttgcaagtgggagcaacattggatgcttcttaatcagatctctacagtattaaatacgaactaaatgaatgttcgtatgcttcttgtatacaaacttcaaaacatgtttggaggataacgctcgaaatggccgttgggttagctggggaccacagcttcagtgccaatgtaatttcaaaccatttggcaactttgcaagcctatagtttttttgcaacgttcaggtttcaaacagcaagaagcctttcgctttcttgaaagcaacttgcagctgacaatcttatgcccttctttatgagcattggccgaatcaaagaaacggacgatactggtatacaggatagatattgttttctctagtaatcttatgacatcgcacacttcagttaacagcaacgtccttttggttctgaccatctcctccatccagagagtccagacttgttccgagttgcagctgaggaggagtagcgtattatcatctctgcacgcaatatcaatgtgttatatgtccatgtcaaacctgagataacataactggcacgcacgatcatgtgtttgttttatgcttatatgcatgcaggattggggtggtttgttcgtgccaggtggtggaacgcaacaaacaccgtgttttagatatagactgcgttaaccctggggactaccgattgctgacattttctaactgtacaggctgttgatgttgtcaaaagctgatgtgttcaaaacctactatgattcttcacgtgagagcttgtccacacggtaccactgtttcatgttttagtcatctactagttgtgaaaacaggaggcaatgtaattgggtggattgacaaaatgatgtagctgcattgctcagcaatatggaaatcgaaggtccagcaaccaaaatgatctggcatgacggtacgaatttgacgaagtgatgtactgctagatgtagccaggactgatggcactaacatgctgaaaagtgatttgaggaataaatattttttttattgattcattcatgcggagcatgatgctgcaaatcctgcgctaccgttggtgcaagctgagcatcatttggttgactttcttttaacacatgcgggatgttctggttctagctgatctttctccttaagaactcagacgtcctggcgttaatgctacgagtaaacatagacttcttgatggagtcaaaacccagaacatcctccccaaaaaaaaagtcccctatgccgcgagttagagtctcatcgggtgctcatacaaagtatttcccaataagccgttttggcttattagaaaataaaaaataatatatttgttcgtagcgatttaaaaaccaatattaaaaaaatacgttgaaaatatcttaaaatcaattttaaaatttagtttgaaaatttaaattttagcttttactttgacttattaggtcaagtgatggggttcacactggccagtgatcacaaatcaaagtgacggtgatgtaaacgtgctaggggcaatattccactggaaacttctgaaagtagctgattatggtcgttttgaaaagtacagtgtttgttagcttctgcttttctcgttgatctttccttcagcgagaacggtatttgattcttgatttctaagtggacgcaaagagaaccaaactagagcaaatctcaagtcaatgcgatctttgctatgcctcagcttttccaacaacgaggagtcccacaattgcaaatcggcagtctccagttctccaccaaggtttatcttaccagcagcggaaactgccggtaaaatttggtaaattagttcgaatttagatttgaaaaaaaaataaaaaaataaaaaaaatcatataagtaataccgagtttgtagttctatctgataataaggttctatgaaatgtactaagttaactccatgtattgcagccgaactgaaactgagactaaaattagaaaaaatagacagatgggctaggccaatagtgaacactattcatgaagcccattaaagtccgcttgagggaaaaatgtgattcctactttatttcaagacgagcacatgataccattcgaacgagatacttttatggaggctaacgtcatcctgcccctactcctcgtgcttgcgtcctcgcgccttgagccagcgcgacagcagtagtaaggaacaagggtcaagtcgagaaaaaaggagaatatgagaggagacgctgatgcttggtacttgctacctcgcaagtactaatcctgccatcctggtacctagggtactatgtatgatacctattgtaccgctacgaacgatatatcatgtaacgtacctgcacaaactcca

SEQ ID NO: 11094 - DNA, 865 bp, Oryza sativa
tcgacagatccattaatatggttttgacatgcatttgattggttccaagtgaaagaaaagaaaagcctctatccagtgatccgggatggaaggaggaacgggtctctcaagaaggcagtttggattcatggagagttggccctgagagtttaccgggtacgtgaagaaggtcgccgcaaacgcattagtcgtgcttaattagctaacatgctgcatgcagcattgatagctgttttggcaaactatttttcaaccgcactaaatgtgcgctttcccctttataggcactaaggctttcttcgagcacgagttcggaacttctcccgtcacacggaaaaaacgagataactcattagcgaatgattaattaagaaaaacttaaaaaataaaaaaaattaatatgatttaaaaattaaattttctatagaaaattattttaaaaaataaacagcttagtagtttagaaaatgtcgtacgcgaaaaataagagagaagatgggaattataagtgccaaacgtagcctcagacaaggagaattatggcattttaattacagggtacagagagcatatgcacatcatcatactcaacacgtacaactgtcgtctgtagaaggatatcatatcaccatctcatcatcaaaacaaaacaaaagaaaataatttaatatggcaaagagtgatggcccaccactaaagcccaagaatacacagcttctacgttgggaataagttcatctgaggtcccttaacttgtcaacgaatccgattttcgctcttcaaccgaaaaaccagatacaacagatccctcaactatcaaaaccggtgcagatgagatccctcggtggtttagatggcggttttg

SEQ ID NO: 11095 - DNA, 3701 bp, Oryza sativa
tgcagacgcaggagtgtaggtgggccttcacattgtggcgagggaactgaggatgacatgtgggtcccatcattttttattattatgtgtgcgaaactgacatgtgggtccaatgggttttattatttttctgaattaaattgccacgtaagcgccacgtcagatgaagaccgagtcaaattagctatgtaggcgccacgtcatccaaaaccgccatctaaaccgccgagggacctcatctgcaccggttttaataattaagggacccgttgtatctggtttttcggttgaaggacgaaaatcggattcgttgacaagttaaaggaccttagatgaacttattcctctacgttgtatacttgtacggaataagttcacctgccatccctcaattttacaccgactttgtatgatatcccttatcattaatatcagaaatcttcacccctaaactatataaaacaattcaatttaggtcccattacagtatagatacatgtttttgctgacgtggcatccatgtcatcaaaataaaaaagtatgtgggtcccacatgtaggtgaagcgagaaaaagatgtggggcccacctgttgggaccatcttcttagagagaggaaggccggctagagagagtgggggcgccagcggtagaaggggtagagggagggtgttgacaggagatggggagagaggcggacgacgcgacggcactggcggttggcacgacggcgctagcaggatagggagagagagaggcggatggcacgccagcggcttggagcgcctcatccagaagctccgctatcctccatcgacaagaccgccgccgtatgcgtcttcgtcgacttcatctaggtctcccccctccccgcctctgtcaaagctgccgaggaccaagccgcataacttcgtcgccatgcgatagggtttcgcccaaggcggtcgcccgtcgcctccactcctgagatgtgaagagttgcctccacctccacctccacccgccttagtcgcctcccgccgccgcgctttgcccaccgtcgcagtgaaggaaggtaggcctcctaacggcggtgaagggtgcgtttgcctatgagtccaactggaggacgtttgtggacgcaagccgccacttgggaagaggggggcgggcaccactggcacgcggatctagcagcccgctgctgcgcccgctttgcctgccgctgcacctgctcaagagaggagaagaaaaaaacaagaagaaaaatttctcacttacatgtgggacccacatattattttatttttattttgctgactaggctgccacgtcaataaatctatgcatctatattaccatgggacttaaattggacggtttgatatagtttaggggtgaagatttctggtattgagcataaggaatgtcaaacaaactcagtgtaaaagttgagggattgaaggtgaacttattcctacttgtacagaggcaaacgtgtacatgggctgtggacccaacgcgccaatacgggccatcgatattttcgcacgcgccgactagaaggcccgagggccgaaaagagaagcgaagggggcagaggaagcaggagagccaaatccctcaccgcggccacaatatcgcggccctctctcctgctagtctcgtctcccttcctcctcgtcttcggcggcggcgcggcggagatgttgtccggcgacatacccccgaaccagacggtctacctcaggaacctcaacgagaaggtcaagaaagaaggtacgcatcttctcccgggcggcgacccagcgcgcggccgcccgctggccaaaatccctcgtaaaaccctagccctcccgatctgggccgctgctcgctgtcgcctactcgcctcgttgtagggtttggtcatgtagcgtccggaggtttaggatgttggaggtgttttgattttttttttgttcccatagcagttgatgaaggggggcagtcggcgggcatatgttggagttgctccatgttttctcgctagaggctgatgggaatgcccatcttgattccgtttaccaggttaagctgtcgtttggggggaaatctctcttacattgtgtgtcatagaaattcgagtgtgtagtgcaaaaaatagtctcctgttctgtgtaccataagctaaccagataaccctagtttgtgtaaaccatcgctctgttgttcaactatggtataacagtacacctctttgctcgattcatgcagtaacttatgttgatctttcctgcagaattaaagagatcactctatgcgttgtgctcccaatatgggaggatactgaatgtggtggccttaaaaacacctaaactgagggggcaggcatgggtggtcttcagcgaaattaccgccgccacaaatgctttccgtggactgcaggaattcgatttttatggcaaaagaatggtaatcatttgcactttagttgataactgatgttttaatttccaatttgatttttttatatggtgtgtatgttttgccttagagtaacattgcattgctattttttcacatgggatattaagtatttgcagagttcagtctggtgccatatgttgggctgtaaattttttacaacaaggttctaaattcaatgttaaattttcagtaatgaagctactcagatggttatcaatttaaattttcagtgatgcaagtaatgtacagttacacatggatccatttattaatagtatgataataccttgatctggctagcaagcatcatatcatttgcgttctacaatgttttgcgggatgcttaggttaatgaagtagcatagataaacatgcattcttcatagtgttggtcttacatacattataatttgattatgtagtaagcattcacctttttgttatttgtagaataacatgtcaggataatctctatctagatgctgaaaaacatatgccttaactactgtagagtcaattgctcctaatacaatctcttgtttgtatactgggcaagtgaaaataaacaatttatatggacggtctattacatcacaatcagaagaaaatagatcaggcttaatagtaccactctatttattaccaagggctagttacaacttaattcttttccttgccctgtgcagcgagtacaatatgcgaaaacaagatctgactgtcttgcaaccgaagatggttctactgctccaaaagagaaaagaaagaagcaagaggagaaaggtatttctaattgcattttcatttatggatgtttgatcgttctatgcacaaaactttctgatttgcaatcctagcagataccttcaggtagtacaggaatggggaaatactaagaattctacagtgcaagttaaaattgcattcttcaatatcttcaaaactagggcatcagcctttcaaacatctatgtagtgtatactccctacatcacataaacatgccatttcggacatacatcaacttgaactttcaaaatcttcggcattgatgtcttttaagtatttcaattatatatatcaatatcttaggtctgttataaaacacgtacttccaaagtattctcatcttcttggtgcctatgtccaaaacaaaaatgttctcatgaatggaagttgtgtagtggctagcaaaatggaaagattcctttctctatctctgctttttggatcaattgtactcctgttcattcttgaa

SEQ ID NO: 11096 - DNA, 3375 bp, Oryza sativa
gacttgtaagactttccgcccttagctttcaaactgctgtatcagttttctaacactgtatttttggaaagcaattgcttagtttagaagtctttgttgcttaaatcatatttggtcttcattctttttgttaaccctgcttttgatgctggcatgtctggtattgtggcctttgtaggctacattatcttttctcctacactggtggtagaagttagaagatgtatccctcccttaaaagccaagagaaaatcatgcccctatattcccctcgtccattttccttggtcagagatgaatgaggtgtatatgccatattatattgccaaaaatcataagtgtcacctcagtagttgcaggcatgatgattgttgaacacgtattttagtggtgggatggtaggtttcgtggccttgtgattttatacaataaagtgtgcggccttctactactatttggctattatgggattcttgttgcattcgtggccctcatattaggtgtatgcctatccattctcccatctatgagtaactttgaagtccatgaacgtatattgtgcatgctacccatgcattggcatgtttctagtggaaaagcgatcgcgcgaagatagccacagccactcagccagccaggctacagtgtagttgtgctcactcgtgcaacctatgtgctggtaggagtatctcttatcaggtcggtacaggtagccggtagcctggaatttgtaggggcgttgtcttgtcgctggacaccgttcgttccggcaaaaatcacacgagataaatcttgtagcgtactgaccttgtgaacagtatttttgtcgtgtaagagggggccgggaggaaaccatgtgacatgttaaaaggcgtttgcttgtttttgctgtgggttaattcgcctttttcacctgtgggccgggagtatgctggatgtagatggatttttttctggggttgcttagaatggtactaactatgatttgttttcaacaattcatacagaagtataggttttactgttgtctctggctgcagcccgtgatattccttgtgctaggaaacaaagcagcaaagtcaatttcatggtcgctctcttatccctgacgaaagaaaggggagattatacgatcaagtgatgacggaatcggcgcattacaacaatgctgcggatatgatgaagtgacgacgacagcatttgaatgttctgttctgtccacacaaaaacgcaaatgtgcagatcatttcaacagaagaattttacctttcgattccaaatttctcagctatttcacgcatgccctagcagtaagtagagagtactacgtataatgggagttcacaagaatcgtcgcatacacgagcagcaacaaagccaacaaaattaacaagttcagatgcactccgccggcggtacggtggggcccacatgggtagtagagtcacctcccggtgggtcccgcttgacctgacctcacccctcccccgggagaacggacggagaattaattagcctcccacaactccttaattccatctcctctcccctgctgatgtgttgtgtcatcgtgtgcttacgagaaagaaatacaccttggagaagaaacaaaaggcccggcccgacccgacgaggcgacgaagaagacgaagcgccaaaaaaagcgtaaaaggcagcgcagagagctcttctcttagccatctgaattggaaagctgcactagcgcagtaggcaccagcggcgcgcatccggcagcttgcaaccgagaaaaaagctgccattgttagcttgcaaggaggaagagagtggagggcaaatgccacctcgtcgaggcaacgaaggtcgagcaacgaagtacctcgcttcgtgcggatcgcgaagcatctatccgccagggcgcaacccaagcacgacctcggaggcacgtccctcgatgggcgtcgaccatggaacggccatcgtcgtgcgtacttccgtcagactcggctgactctcgcaagagtatcgactgaaccctacgctcccacgtccatcacaatgtcttgactgtgtgatttaatttcgagaagagagatgagaaagaaaaacgccttcttcgattgctctcccggttgaattcctcatggatggtgagcttttctgattatatttcttgagagcatttttttctgagttattatttggcgaatttcctgggattgttgcgtcgcaatttgctgggggtcaatggtgatgggatgttgatcgcagtagatcacctaatgacctaatgcatttgttatgaacaaacaccggaggccttggtgatcctttttttcttcgaataggtaggtgattgatgtgttagccatttgacttccaggtagttaactctggtaatgtcctagtcctagctcagcaactccaacaaaaaatatcttttttttttctcccccgtcttctgattgtgatcgagcacgtactggtcatcatgtactagcactttatggcccaacttttttttaagaaaaaagtctcaggttcgcgttcatctattgaaggatgctctgattgatttcttagagcctggaggttgaagcaacggaaaacaaagaattgcataaaagcaaccatagtttgacctggattcatccctttagctgttgctgtgattgcgatgataatgatccttggcatttctgttgtttatcaacgttggaatcagttggcagaagtccaaaatgcgcatcaaaattcatcagacgttcttgaattccatttaagccttacaccagatggctgttaggacataggacacatgtgtcgagtactcttcttttcactttatgaacaataatgatttggctatttttggatacaccaactaattaaaagcctcaactgatatattttgctataatcagtaaagattccatgtcaccacacggcaacataactagaacttctggcaatcttagtatcatcatgtcataatgcaaatcatgatgccatcaaattgtcccattgcatgtgtgcagatttgctgcacaggtgttccatggtctgtacgatgaggtgatgacagcatctgcacgagggcatgggctcatgctccgggtgcagcagctggaggcagagttgccactcgtggagaaagactcttgtcatacagactacctgtatgttgcttctaacaggggtatgtgcaacagcacacaacacaggtctttctgctttctgaaagaaacaacttctgtcacctctacctgtttctgctaaggaaagcgtcttctactggtctcgttcataaaaaatcgattggttttttttgcaggaatcgagtggcattcgaatccgaggttggaaagtggggttgtgacaaaaggcgacacgcct

SEQ ID NO: 11097 - DNA, 2503 bp, Oryza sativa
gaagccctgctccatgaaccattcagaagtgcagatatctttcactgactcacctgacacaaacactgaagagagggacatcatggtagacacattcagcagcatggacaaaggcaaggaaaacaactacgtgatggctggcaagaacagattgttatcagaagaagcactatcgcgttcttcggatgctcggtctgcaggaagcagcaagggatacaactctgaagttgacatctacgtggacgctctcaccacaatggattctgaggttgagacagacacagagcacagagatcatggacaccgtgccttggtaccggtggagtccagcaaaccgtgctctgatgttcacggtgccgcggtttcagggtctattagcttcaggaacaatggctcaatggtgcctaactcttcagatgttgtcccagcagaggaagaaaataatgatcaccatcaagggtatgtctgtgtcccttcaccacaggccaaacctgttgctggtgaacatgagaggagcagctcgttggaggaattgtttgcacaagaaaaaccggtgtcatgcgagcatgagaggaccagttctttggaggaattgctccttggagatgtccatccttctgggcataacatgagatcatcagctactgaatcaaatacaaatggtgttgtcagtactgttgaatcaaatggtacagttggcactacaaagaaagaaaaggataaccccatcattgcaggcatttccttcaagaagacagcgagcaagaaatcaaagtatgtgggcagcatggagcttattgtttcaaaagtgggcattttgccgagaaaactctccaaaaagcatgatccgttctctgattccctcagaaacatggccaagcagttgcttgagctgaagattgatggcaccaaagacactgagttatatgaatttgaagcaaatggtgagggatgtgatatgaagtgtctggaaatgtctcaccctcctattgaaattatggggagtgccacgcaaagcgttcctcctgattcacctcaagacaacgttgattcaagagcatgtcgaccagaagaagtgaaccaagagtatgaccatgatgttccaccaagtgatagtccccaagattcagttgatggaaatgtatttcgggacattgcattgttacgttctcaagaggaacaccaatgtgcaggtcctgtaactgttgacaatttgttggatcatgcacccgaaaatactcaagatcagattggggaacatttttatagggaagtgactgaagatattcatactgaagttgtccctgaaaatggccctgatataggcgaagaattagaagaaggcagtattactgaagagaaggtgaacgaggaagatgtcgaggaaagcaatgagtccgatgcatacacattggatgaaaacaccgagtacatagaagagcaagtggtttcagatgatttgatctcctcaccgatctcatccaagcaatctgatgatccttgtcagatggcaccactcactcttacagatgcagatgatgccttggcaggtaaaaatgtagacaatgacatctctgaaatgcatatcacattgtcaggaacaataacagaatccaatgtatctacagtggttgttgaatcagcaacaaccaatgatgtgccgtccaatataatgaacaatgctgtttacatccagaaaccagttttgcacaagatttaactcatgtcagcagctgtgaagttgaaggacaaaatgagccattaccactgtgcagctcatccatggtgggtacaactccagatctgtctgtagacactgaagaaatacatgaaaaccccattttgtgcattgacagcagttctgatttgttcagagatgcactagctccagactctagagatgtgccattaccaaacatctcaagttttgattggatgcttaatggtgcaatgcagaagtcgttgaatgtacttcctgctaaaccacctaatggaattttacaggaaaataattcttccaaagatactgaagatgcaccaccgccactaccacctctcccgccaatgcaatggagaacaacaaaacttcagccagggcctgcagttttatctgcaaaatttgggagaccaccaagaccaaaacctccagttaagtaccaggaaaatgagagttctcctcacaggatgaaagaaatagagagcctgaaattcttcaggaagcaagtctgcagaatggctcgacttcggtcactccagagaaggaaatggtagtggcaaaagtttctaatgagatccagacaaatataatgtttggtagggattctcaagaaagccacctcaaaggactcaatgagtatgatgtgcaagcttctgattcattctccacatcagaattcaagagcgtgggaggtgttgcttcagtagaaggcgacaatcttgaaacttcacagttatctgagcttatagtaattccagagcaggcatggtctgagcttgtagatat

SEQ ID NO: 11098 - DNA, 526 bp, Oryza sativa
tgttttctttgatttgtatatgacttttggttgcgacattcctgacaaaggactacactaacaagtaaccacgctttaggaaaaacaatttcatcttgtattttattcctttggggactaatagacgacatgtctacattattgtcatttttctttgaaagtcaatatataatttgacaccttttccgcccaaagaataaatactactacaaaattttctcatttcggctgcgacctgaattaaatttccaatggatacaggccggaagcttactgatctgcgataattaatcctcatcacgacatcgtagccaggcgtctctgtacaaatattgatcagcaatgtcgtgagcaacttacgacctcggcccttccgacaaactcttgtcttttttcttccgctccctccgtcctagaaaaacaagttttggatgtaacacattctaatactacaaaattagatatacttctgtacaaatttattgtactaagatatgtcacattcaggttctagaaattttttttt

SEQ ID NO: 11099 - DNA, 722 bp, Oryza sativa
  unsure (1)..(722): unsure at all n locations
cggtgtccatgatctctgtgctctgtgtctgtctcaacctcagaatccattgtggtgagagcgtccacgtagatgtcaacttcagagttgtatcccttgctgcttcctgcagaccgagcatccgaagaacgcgatagtgcttcttctgataacaatctgttcttgccagccatcacgtagttgttttccttgcctttgtccatgctgctgaatgtgtctaccatgatgtccctctcttcagtgtttgtgtcaggtgagtcagtgaaagatatctgcacttctgaatggttcatggagcagggcttcnnnnnnnnnnnnnnnnnnnnnnnnagattctgcatctgtggcctgaagcttcggaacacagatccatttagttgtcggtacttcagttgccggcgccttgttgggacttcatccaaagcttcaccagacaaatctgtctccaatctacaaaaaagaaattgccgtttgtctgagattaaaacagaagagaaaattctgggtggtatgagatgattatagtgggtgctacttggagtcattgttggctgcattaggtggtctgaaaatctcagaattttgcaaggtcggcctgatctcctggaagaaatggaaaagaaatgacaagcactcaatctattaggttcagtcaaataggatcattctaccgaagaaatctactgttttcagtttcattaccatagctctaagaggtcttc

SEQ ID NO: 11100 - DNA, 1042 bp, Oryza sativa
ggttaggtggcaacaggcgggctgtcacacgcctcgccctgtcccgtcggaatgatgagagcttcctggctctcgtccctagccggagccggcgtgctaactcctggagttggtatgtcagtcccggtcagatccattccaggcttcagcgcaagtatggcaaggaaagtcgctggccattaaatgaaggttgaaatgggcgtccaccgaaaaaggggcgagcagagcaggagacgtgcgctctgcttgtcagaggtcacttccggctgtagactagccctcattgtaaaagcatgtttcctttcttaggtggcgagaggcccttgtggtgacccttgaccagaaaaaaaggaggcccaggcctaggaagaaaagggagaggaaaaaaagaggagaagagagggggcgaacggggctagagcctgaactctctctcgctctccggctctctgtattccttcactcacagatccaccagaacacaggagtagggtgttacgcttctcagcggcccgaacctgtctacgtcgcccgtgtcttgcgcatttcttctctcgctgacgttcctcagatcgagggcgaagaacctcacttagcgcccccggccgaaccggtaaaggggggcctgcgcggtctcctggtgaggagccccacgctccgtcagcgcctgtgatgtttggtccaagtcttggcttccgcttcccttttgtaatgcagttgtgagctcgggatctgtccgcagcccaacatgactgtactcctactctataataaacaaacctctattgctgtgatattctgtcttcctgtgataccagcactgtttcctgggaccggtatcgattaacaggttaatttggagcgtcacgggctagttccggtcgggactagttcggggcgtgacaatacgacatataaaaattggtaataaaacaccaaatagaatcctaatgacgattaaaatgagggacgacgggcaggccgtaaagcaaacgggcaaggcgtgtgccgggacttctagaaagtaaaaaaataaacccca

SEQ ID NO: 11101 - DNA, 737 bp, Oryza sativa
atcacaaagttttaaaataacgagatagtttttaataaattttaagtaaaatcatattgaaaaatatatgatttcgtttgggtgctagccgcgcaattacgcgggccaccagctagtttatttagatgttcacgtttgcatctcgcaaatgctgccgtatcaaccacgtggtgacgactgacgagggcgggctagctttccagtgggccacaactgggttgggaaatgagttccatcccgaatttggtttaatggacggtgagggttaggctgggctggattagctaaagctaaagggagtttgactgggccaacaattttgtttcagtttcttggtcaccgatatcgccattggctcaacccgcattgccctcgacgacttttgcgacatgccatcgcgaaaaaccctaaaaccagttccgatcttaagattctgatacaggcatggaatccatgccatggattgagaggctggtcacaaatcaccacgaagaaaaggggaaggggctttttgggcaaacgtgctcctattctgacggcagtagtcggcgagtgcggagaagacgacgacgacgatgcctgtttggatgaggacgaggcaaattctgtgtggctccgagtagaagcagtggatcaccaaatgaggcccagccctcaagcacacgtttatcaaccaagtgatatttgacaaccccttgaccaaattaaaaaggcccattacagttttccgtataaac

SEQ ID NO: 11102 - DNA, 4580 bp, Oryza sativa
  unsure (1)..(4580): unsure at all n locations
ccgtcaagttttcaatgattgaaggaaagcagaagcacaacgagcccggaaggagtatatttttcagagaacacatatcagttttatgctcaggatttcgcatttacgttttcaggaaaaacaaagcatctcgccatgcagtttttctttagctgaaaggcaagaccagctaattgccaagtagaatcgtgctactcctgcatgtttttttcttttggttgtttggcaatctaggagaccggagctgctgcctccccaatgccaaaggatatgtacctacctttgcacccaagaactcaccatgtgcacgcacaccctgttgctttattcctgggcataccactgctgatctcaacgagtgctctgccagcctctgcttttcatttctccctcagcccaatcatcaattagatgaacagaatatgaaattatatgctagtactcctactaattaagtgagctttgcaaattgccttgcgtaaagtcaagggatcatttgcagagttgaacagctcaaaacctcgcctcaaggccaagggtgctcaggacctcaaggaccatgtaaatggatgagctcctgcgtgaaaccaatcagggccaccacatggaaggttgttggattcagacattcagttggtgcaatgaactgaaagtctgaaactctgtccgagccgatgccaattactagtaatcctatcagttgtcattgccaattaggagtagttagtgctgccatcatcatggccttatgatcaaaacggaccggataaggctgtatacttagaagcatcatgatcgtaggcctaccaaaaaaattctgcttgcacatattacaagcggaaatatttgggggtttcgatcgtagaaaagacaaggccctgtcaaaaaaaatcgttcgtggcagctttgcaaccctagagcgacaggtaatggcgttgtcgaagccagctgtagtgcagattgcagaagcctactgtctttgaattctccatcctttttttctcttcttctatgattctatccgtagcacaattcaatgcccccgtagatacaagtatacaacacggaaagacaatctagcacgtcgcagcagagagagagaggaatcaatcaatgaacaaaaagctcaccctgtggacacgtgtcgggctctgcaggcccccaagcgtccgcgtcaccaatctcgagtcggccaccgcggagcccatgcttacagcctggcaccggtagtgacgccagccaccagcgcagcgcgcgccgctcgctcgctatgcggcgcaatctgtgaccccacctggcagtgacccggcgcctccgcgaaacgcaacggctaaaacgtgcaaggccgcggcggcgtcgcgcgcgcgcgcacgttgggacgtcggggagggaagcggccaaggccaaagacgtcgtcgtggccagcagctggtgaaaaaaaaaatggccttcaaaattcgaagcggcgacgttatcgctctctcgtcgtgagcggggcgtcgtcggctccggtggatagtcaacggtcgacgcgaggatagttcaggagcggataatagttaagaaatcgttgagattttaccggcgttttttctcccagagatggttgcaaacgcagttgatttattaggactttaggtatatatatgtaagcttttcctttttctcgcgacatgtggccttgtttctgttggccgatcgtgatcagcgtgcacttaccttaggaacgggtttttgattttgggattaaaaatgtccttgatcagtactacacatgttctcacctttttagttctcatttctgcacgagttaaggatagtcaagatggttacgatcgcaaggtgagtggatcaaccacactctctgtcatgttaacatcttgctctctctctcttttatttactgtcaaggcgccgtttactttgtaggggtcgtactgttcatatttttcctttcgtgcatttgacgacgacttctcagcaataactcgctgcctgaacgtgtagtgttaatcatgttactcgcctacaaatggaaccggaactctggaagagaaaaaaagaagtatttgcgagaaagaagagtagctggaaatttgatacggtcgttttagggttgaattgatatcagatcctaaattctctctccaaaccccatactaattcggcaggatatctttcacgataagtactttcctgattcatctccttatctcaattaaacgataaatatctcaaagaaaacgtgttgagcggaaccagattaaaccgaaattcacaacaactcccaaatgtcgcgcgaaatatactccattttttcttgttagtacggaacaaaaacaaacacgaaactggagctgactgagctaaagagcagtaaaagaagcgatccgcttgacggtgactattacggccgctgccgcccagaggcaccacctcacctctccccttccacttcgctagcccgcttggcttctcagagcctggaggaaaaaaggaaggtgggagaggcagcagaggcgaggcgagggagcgagcgagcgagcgcccgaatccccaaaatcgcagcgcgagaataaacaaaaccgaagcggcagcgggagcagcagcatcggcggatacaataagcaaggggagcagcagccacgggcaggagaggagagtgcgcaggcgtgcgggagggaggaggggggaagaagaaaatcgcctgcctgccgccgcggtggtgggttggtgggtgccgcctcctcctgctgctgctgctgttcccccattacctcgccccgcttcgcatggattccccctcgcttctcccccactccacccgccgatccaccggccggggcagcgcgaggcgatgcaattgaggtgaggtgagaccgccgcttcttccgtcgtcgtcgcgtgggttttttttttctctctttggtgctgggggatacaacaacctggcggccgcgctgccgttggacgacgccatcgcgcgcctgcacggcgtcttggggtggacgaggcccagcagccgcggcggcggcggtgggaggaagaggtggccgcgcgggggaaaggggagcgccatgctgtgggcggcgcgggtgtccgggttcttctccgccgccatggtgatggtggtgctgtccccgtggctgcagtgcttcccgcccgtcgaggccatccggtcgtcgcagtttgacagccacgtacgcttacctggccagatcgcggggggcgccaggggcctnggcttccgtggcgcccccgcgttccggaatgccgctgactgcggcaacggcaccgggaatgtttgcgacccatcgctcgcgcacattgcgattacgctggacgaggagtacctaaggggctccgtcgccgcgagccactccgtcgtgcagcacgccacgtgccccgagagcgtnttattacacgttcatagaatcgacccggcgctcggcgacctcgtccgcgccgtgttcccgcagctccagttcaaggtctactacttcgaccccgaccgcgtccgcggcctcatctccacgtcggtgaggcaggccctggagcagccgctcaactacgcccgcaactatctggccgatctcctcgagccctgcgtgcgccgggtcatctacctcgactccgacctcgtcgtcgtcgacgatgtcgccaagctctggcgcaccgacctcggcggccgcaccgtcggcgcgccggagtactgccacgcgaacttcaccaagtacttcaccgacaggttctggtcggacaagcagttcgccgggacgttcgcggggcgccggccgtgctacttcaacacgggcgtcatggtgctcgacctcgccaggtggcggcggacgggctacacgcggcgcatcgagcggtggatggagatacagaagtcgccggcggggcgcatttacgagctcgggtcgttgccgcccttcctgctggtgttcgcggggcacgtggcgccgatcgagcaccggtggaaccagcacggcctcggcggcgacaacgtgttcggcagctgccgcgacctccacccggggccggtgagcctgctgcattggtccggatccggcaagccgtgggcgcggctcggcgccgggcggccgtgcccgctcgacgcgctctgggcgccgttcgacctgtacggcccggccgactccgccgcggaagggtcccggtaaccgcaacactaaagatgattcttttccttctttcgccgaccccgtacaaatttctgagttctcaattcttctccaccattacctgttcaaacacctacatgtttattttttcttcatttcttctttcttttgttctgttcgattaaatgccttgtgttagattgttcttgttggtattagtgatctcttcttccactttttttgatcgttttgttactaaaaaaagaggtcatttgtatcctactctacaggtttggaaggcttgcagcctcagcatcatcataaataaaaagcacagaaaaatagacattgcagcagcatgtgttcttcttcagtcgaaaaactttctcccctctcaatctgtttgttggcttcagcttcagcttcactctcgca

SEQ ID NO: 11103 - DNA, 1119 bp, Oryza sativa
gtactcagcaaatcataccggaagaggaggtatgatgcaggatatatccaagggaggctaaaggctcatttgcataaagctagcatttaacaacagtagttgaaagcagtaaaacagggtagtaattaatcaatattaaccaatcactgtccaacgttacaacacgttgcaacaggcccaaccaaccacctgaactacaccagttcattagctaactagggtgagactaatcacagtgaatctggtcgaccgtccataaccgtgggcacggctattcgaatagttttactctgatcagaggtgtgcaactgtacccacaagatacagccccacgacacgttaccgtgcgctgacatgccaccacgacataccggaaagaggccgtgacaggacccttcgcataacccctttaaccaatcgcaccacaccttagggttcgcccccgtccccagcaggcaacgggcagcccccctttcgtgccacggtgaatccggaagccgatcaaccggacaccccggccgacccaactccatcacgcccaccctcgcctgggtacatcggctagaagaaagctacactacaagcccagccgttgcccacgctggcttgtggtaagtacgataaattctttcagggcatcccgcaaaccggtccttaatcgccatgggcacgactagtaaaaccatgcacccacagcccaccatgtagtgtattttaattaactaacacccttgcggtggcactaatccaaagctattgccaataatcaaagtctatacattaatgtgattcccccattgtgtactagttgaactaagcatggctaagcattccctaaaccaacatctaagcattttaatacccaagttatcaatggcataaggtaaacaagatatggctgagtagtaggacccatcccacatgatattgtaaaacaatgcaatatttaatagaaatgcgagacatttgtaaattgggtacaatatgatcaatcgtaatgcataacttgccttgctctcgcactgatgagaccatagcaacgtcttcgagcaacccccggatcgacgaaacggccgaaatctacgcgacaaacaaagaacacaagcaaaacacactata

SEQ ID NO: 11104 - DNA, 549 bp, Oryza sativa
gacatcctcaaatacaaagcacttccctagttagatgtaggttagacttcccgttcgagaaactcttttttctacctgccctcaatttatgcacgagtaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggctcgggtgctttgaagcatttgttgctatctaaattccatttaaggtcgtaccttatcgcccagcatcatcttattctctatttgtattccctccatctttcagatacggatgtagccttggatgtgcccgtgcccaatgaagaggaaagagcgcaacatgaaacgtaagtacaaaagtaccggacaccca

SEQ ID NO: 11105 - DNA, 30100 bp, Oryza sativa
  unsure (1)..(30100): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttcatcttacttgtgctttaaacaattcgtacgtgcactccacaaagtgagccttccataaatccacccttaccatttaattaggcacatattcttccatcaatcaagatcgaattgatctgccatggcatcaaacaagcaaattgatctcgagtcccagaagccggcgacgtcatctccggcggccagcgtttcatcggcagcagctgccaccgcgccgccagcttctagctcggctgtacccgtttcagttggcataaccaaccgccacaacgtgcagccagagacggagcctctgctgctgctggcgggcggcgacggcgatggcggctctgacgacgagacaacgcggctggagcggaccatcacgcgggcgttccggagcacggcggagctcgccaagcacctgcccacgggcgcggtgctcgtcttcgaggtgctgtccccggtgttcaccaacggcggcaagtgccaggacgttaaccgcgtcatgacggcgtggctggtggggctctgcgccgcggcgtgcttcttcctctgcttcacggacagcttccacgacgggaaagggacggtgcggtacgtggtggccacgcgcgccggcctgtgggtcatcgacggcaccgcgccgccgccgccggacgtggccgcgacctaccgcctcaggttcatcgacttcttccacgccgtgctgtccctgatcgtcttcctgtccgtcgccatgttcgatcacaacgtcggcgcctgcttctacccggtgatgtcctacgacacgaggcaggtgctcaccgacgtgccgctcgccggagggctcgtcggaaccatgctgttcgcgacgttcccgtcgacgcggcacgggatcggtttcccggtacacgtggcttaataagaccgacccacgtggatgttttcctttccagcagctgcctcctgtcttgcgtgctttgcatctcctagttgtcttgtaaagttgtacaattgacgtataaactctgtctagattcattaatataaatataaatgtggaaaatgctaaaatgacttatattataaaatagagggagtaatagatttaacgattcaaaattacgtgaaacttacatacaagttacactgtagttacatgcaagttacagtgtaattacactataattgtactataattacatctgttaaatttttaggagaaaatttatcaacaaatgtatatgtggtcccatttattacatgtaattgattaatgattgctagaacatgtcctactgtaaactcctaggtgccccccactttcctagtgaagatttgttaggaacccaattgaacggcctgtgggctgtcagctactctcaaagccaggcccaagcaagcaaagggagagcactattaagcagcaggagcagcaccagaaaagggatgtttgatcaattggcgtgctgaggctcacggaggcggtggcggcgacctaggtgaccggtagcaacccttgtcgatcttcttctctttctccttctcgtctaggggtggcttggctcatttgagctcattgtgttaacgagccaactcggtttgttaaggcttggctcagttgagttagttgtgttaacgagccgggctcgttaatgttagcgagctaaaaggctagctcggctcggttcacgagctggctcgtaagctcgttaggcttgttaatgagctatatctcattaatatcatattaataatttcaaatttaacattttattatgtattaacgtaataataaacactaactaatataatactcactaaatatgaatagatttgatgtaactaaaagactaagcactagtaaagaaacactaagttcattaagatatggtgatattttatactaacgagctaaacgagcagctcgcgagctacctcgttaagctcacgagctaaaaggctagctcgactcgactcattaagactacgatttcgaatggatccgagctgagcttgctacgagccgatccgagccacgagtttcgagctttcttgtccacccctattctcgtcccacctatttgctagtgacttgtctcccctttttcctttttgtttcaccaaaatactggagtgttgaaacatatatggttgttgtttgaatcgaagcgaagggttattaacaatatgatatccgacccacgtggatgttttcctttccagaagctgcctcctgtcttgcgtgctttgcatctcctagttgtcttgtaaacttgtacaattgacgtatatactctgtcctgattgagatggtcaacgtggcgtggaattgtggatattttatatatagtacaagttgcttattcggatatgtaatgttcatttaagttagttatgcaattgttgatgtaaacaaaaatcgtgattaattaattagtgaatttcttacatttaattgattaatgaatgctagaacaagtcctactgaaaactcctagaaggtccccaatttcttggtgaagatttgttaggaacccaattgggctgcctatgggctgtcagccactcttaaagccaggcccaagcaagcaaagggagagcactatataaacagcaggagcaacaccagaaaagggaggtttgatcaattggcgagctgaggctcatgacgacggcggcgatgacttgggtggtcggtggcaaccctcgtcgatcttcttctcttcctcctcctcgtcccacctgtttgttagcaatctatatccccttctccttctttgtttcaccaaaactactaaagtgttgaaacatatatggttgctgtttgaatcggagcgaagggttgttaacaatttggtatcagagctgttggttcgtgggatttctagcatggagtcgatgggggagtattgcagcaacaccccatgcaagtggttgttggatttgggcaagggtggtgcccatgacacttacgcccacaacctattcgatggaatgcctagtcagcctgacatgtccaaggaagattagaggatatctgaactcgtccccatcaattccatcatgaacaaagagggaaatagctagacaaagctctagatctgatattgaagaagtttgaacaaatggaggccaagcgtacgtgtgaagagaagattgattgaattttggagaagttggacgagatataagctaataggaacaagttcttcaaggagatgagtgcctccatcaaggcgaccaccgctgacttcaattctgcatcattttcaacacccccgacctcgtctcctccagtgtcccccaagtgtttgacggaattgtaacatacccgaattctaggattaaggaatttcaatcaaaactagttgaaaggaaagttcttcaattttgtgaaccaaaaatttccattttaaacctaggggaagttgatctaactcatgcaactaaataaaatttgagggcaaattaaaacttttttatttataacctaggaaaaaaatgcaaacacaagtgtaagcatgtatacttgcatatgacgtgttttgacttgagtccttcatgtgcatttggattttcgatttgcatttcataataggtctcatgaataataactaaaatctagacaaacaactaaaccattagaacctagtgctaactaatggaaaaaaaatacataggaaccataatacaccttaaaatatatcaacaaggccaatgtcaagcctcacaaaactaatttttccactcatctgaagacaagtcatgaacatgaaagtgaacaaataaattaactcatatagggtaaattctatcttaatcgtctctataagcattctcttaatttaatactaaagtaaacttatacataaatagataagaagcttatgacatgtgtaaggtaaactgtaattctaacatatcaacatcacctcaggttaagaagagtccgaatataacttttataaacatttacatgcatttaggaaagggaaacacatttaagagattagtcttgctaattatctaaaataacttgtgcaagataaaatcatgggaaaaattcaagtaggctctactcaacacatacaactcactatatttttggtgcaatttaataactaaattttgatacctcgaataaatcagtcaaaccagtcaaatagtacactaattataatttctaatcggctaaaacctaccctcaccaaaatatgcattagactgtataaaagtgtatgagtgaaataatttattcaaatactaggtaatttatcatgaataaatataatttttccaggatttatcctcactgtttaggtcttctagaaattcaaactagtttctaaagagcccatcttctcctaatttttgtgagtaatctaaactatgagtacaatcaaagaaaatggaaactaggtacattcatctacctccaataaaatccacatgaactcatatgcaacacaaattaatctatgaattaacaagttagggaagagaaaataatctgaaaattcgtccaaaaatctctttcacacagttttctacccatcccccacactccagcctagtgtacttcgttctgggcccagttgacagtgtcttgactagctccaaccctatgcaacacccccaaccgaccagagagaacgagagggagaaagagaagccgaagccgagcgcactctggacggcgtcgacgtggcagcaccgagccgaggcttcacctcctcccagctgcatttccacacatcattttccacctctaagccgaagaaaccgagagggagagctccagctctcctcttccatctcttcgttgccggccgccaagaagaaggacgccgcaacccgtcgtcgagacattgtcatcaccaactctttctcgttccgtattcctcacttcatgcctaccactttaccctttgacggaaacgtcgccgtgcccacgggtgttccagtgcgtgcaccgggcgccgccgcagcgacatcgtcgccgttgccgtcgatttagaccaagccggagcgagccaccacgccaccagcttcgcgtcgtcgtcctctccatttcccctcaaaaatcctgaagaatggcgcatcgaggaaggagatcggccgtcgtcctcctcaacaccggtcaccgtcgccatttgccgaatccatcttctccggtgagccattgtccgattattcgcgtatacactatccctgggacctcaataacctcatggacacacatgcacgctagatcttggagtagtttgagctgtcgccgtcaacccgaaggagtttgccgccgccggacctgttcgcgagctattacggacgaccaagcttcgccaaccttgtctagcatctcggtgagaatcctgcagcctataaaacatacatgcatgcatctctttgggtagatcaagtctatagcacgacatgcaccaccacccgaaaacgttttccgctcggactcgccgccggcgttactccgatgtccactaaccgaggaaagtagaggaatagaatcgcaataacatgaccttcattttgtctttaggtcgcacccacaaacgagccaccgtttgccgctggcaagcttgagatcgagctcggccatggcctgccctgtctctgcccgactggagaggaaggcagggacttttttgaaaatttgaacaatcatagggttaaatatgaaaacatacaaaccaatgacatgtagacccatggacctaagtgaagttcacataaagtatagggacttctttgcaagacggtaagagactgacagtggaccccctggagataaaatctgagaatatacaagagagatacctagaacttgtaaaatccatataaaatcaaatatagcttattttgagatgattcaaatttctgtgatcaccaaattataaaatttaaagttatgaaataaaaacttgcactcacagtacaaatttagcctctataattcatctaagataaatcatgctttatacaaactcataaaatgcatacagaattcatttcaactcattttagagcaaacttagtttctacagatccaccaacatgttctctaaaaacaaagtgaaataaaacatatacacactttacatcaaatgcctctaaaactattacctttaaaattactagttttagataagctgaactttagaggtttgtataaaattcatcttagatcctttttgagtaaacccaaattctgtagaatcaccaaaacatatacttccaagttataaaataaaattttatacttatcgtataataaaagcctctaaatatttaagtaaggaataaccaacattaagcagccttcaatttgtaaaatttgtagaaaattcatatttagtccaaatggagtgaaccaagattctataaaactagaaagtaatatacttcaacctattagagtgaaatatggcaccctctgttcagatcatagctctaaaccttaatttggtagtataggtactaaacacataatagtggttatacaatacatatgctccaaataaatccaaataaaatttattaggaccagtggagccatagttccatccccatccaccaaaacttagaagaacatagctcatatagtaatttctaggttaatataatatactgctagcatagactagagctcccctagtctataaaaatatgaaccatgataataagaccataagcttatgaactaaaaattggattagttaaccaaattattccttttactcaactcaatcaaggacataaaactctcaagacactatatgcctacaacacgttataacttgtaaaattcataagaaaatcattgtaactccaaaaaaatgtgaaaccaaatgtgttagtcttagaaaacacatccctacatctctgtggagtcaaagttaataagaatcactttgtaaaaatattttataacactacctaggtaaatactaccctatatcgagtaaacttctaaaattcataactcccaaataaaaagtgataaaataaaaattatttcacctaaattctttttagaccaataccagtccactgttcacaaatcatgcattttagagcattttggatttttcgcatatttcagtatttaattgcataacgtgtactttgtatagatgattgcttaaccgatgaagaagtgatttaggtgctaacattttccagttgcaaggcaagtcccacctccctctctttgatcactttgaacctatgttttggtggttattaaaaatgtttgcaaatcttgcatgtcaattgtatactaataaattaaaattttgttaaacttgttagacaaactcctattattttcattatctccttaaccccacatatatccatatcctcattcctaaccttaggaatcatatcctaatactacttggaatatgagttacattgtcactagttgactatactgcttagccatgcttagaatggttttacttatcacttgggctcatattaacatgaaaaatgattttattaagattctggacagggatgaataaatgaagtatttgacaaataaaatgatggaaaacatggattttaggtttgggcctcaagtggtgcacatatggtaattagttgtgtaccgatagggggagagtgtgcctaaaccgatctaaggatttcactcaatgtctgttcattatatttaccgtacatccacatgtgtttttatggggaaccttggcctattaagttaagcacttgtctgaccttgcgttcgggaggccgttctagtataggtagaggccatcagtgtactgtgggctacctaaaggaactacccatgtgtgtgttgaatcttaggacgagtgtactgttcctaagcgtgtgatcgtaggatgataaattccatacatgtgtgatttccgtgaggggacgagtgtactgttccgcctcacggcatgggcgtctaagtctatccaatacaacgatattgtgccacgtggtgggttcccgttgtatccgtcaccacggcgttaagtttaaggcatgggcccgccacttaacggttctagatcatatatcaagtatggtctaggatggaggaacacgtatcgtgctcatgcaaggttagacaatacttaatgtaaaagcctcattgtgacctctagaccgtactcaatgtgtagagtatggtggtactgacgggtaccggacgaactagagcgattcacatcatgtgggtaaagctgtacaaactctgtagagtctaaaaactaatcgattagccgtgctcgcgtttatgatcggcatgtggatatgtgttgagtatagacttgtgtttattcttctaaatgctgaatttaccttcaaattatgttgagatttgagaatgatctccttgctgccatggatggcaattaggtgaataattatacatgataaatgcctactttgatgcccatatgctaagtactagcttgctgaaatttatttgaaatcaaatctgatttgaatgtgttttatgcaaataaaacttgctttatgctaaaaagaaccatattatgcctttcttgattatatgccttgcaagtagggtgttaggcttgtcttggtgcttgtcagtacattatttctaataatgtactgactcttgctgttgaattaaccttttgcttgcaggttttagatttagtgtttgagtgatgcgggtaatcgactgcttcttccaagacttgaacttgatggggtaaacccctagtcggtgtgcttgaggattggatagtcaagcttccgctgttctcttatatttatttggccggtcggcctatgtaactatgaagtagttgtgatttagatcatttccgtcttaagtgtattttgctatgtattttcatgcttaggatgaaagtgtgaatctagtgcatatcctgggaactagattcacatgagtatgagttaagaatatttgagatgttgtagatctttagccatttttgtcaagtctcctgcatgtgtaacacatctggtcgccgccttcgagtggtttgacaggcatctcaggctgaagttgactggcaggctaaaggcccagcaatgtctccaatattcttctctcgaagcgtcggatgtttcattatgtttgtttgatgacttgaatcattcacttcatctctcaaatataatgggaggtctggagagcctatgacaggaatgcttcaacaacaacatcacttgggtagtggcaaattcaagtcacattggtgaggtacttgctccaacagctgcctgagagctagaagacagagaggacaagcaccaagctacctacatttgtcaccatggacctccccaaggtcacgcccaccaactcttcgatgatatgttccagctacgatgccaagtccgatcacactgtggctatcgtggttacttgtgtcacctctaccgtgtcatcaatggagttgttatctactgatggcaccattggcggcaccaacatcaacatccttgatagtaccaaggcgatgctcaccaactgtttgacggttggccttgatgtcaaagggtggtgcagaccacgccagggttacgtgccagaccatgatgggtgtttctaagggtgttctagtacctgatgcatcatccgaagtctcctcgctatggttgattgctgaaatggaccttatcaagttgatgcccagtgagtgtttgatgaaatgcctcaaaggtaacaacaagttgctggtggggcatcccaagagaaacccttggccacctccctggttaggttgtgtggttagagaggggaggtatggcacattccatggtatgtactcgattctttttggacaagtgtaggtttgatgtcaccatggccaccaccgattcgacttgagcaatgcaagtcctgggaaattagagtggctattactctatttgtttggaaggaacaacaggatttggttagttacgtgacctgcaccatctttggaatttctagaatgcatgagcttgctaccaggaaaagattctttgtgttgaatgcaaaatgctaatattggatattggcccatgagtgatgaggacatcaacaccatcgatacatccacaccccacaagtataacttcatggtcctattatccgcacacgtgcacgtcaactcaactattaggtgagttctttcttgagttcatgtttctcttctttataccccggagatgcgtgcactcttattttactcaggaacgatggagaggatccgaaggggagaggattcgcgcggggtggattcggactgtaggacaacgccaacttctgacggccgccacgacttcatgcgaacttcgatttgggcatgcaagtactttatggaaagcttatcaaatctactttcaaatggatccaaccacatgtccatatctattctggagcggccgcaattgtattttactcccgattgttttctgtccgtggtgctgcgtcacctcttttagcccaatgggctgtgtatcaagttgggcctattaggggcacgtcctagggttggagcacgaccctgtggtcgttcgtcccctcttcttatacctatggccgccgccaagaacactcgggttttgtttagatcaaagtataacatcgctacttcgccggattgcttgttactgaaccctacttgttacttctgttgattcaatctaatatctttgattcgcaaattgagttgcttgttcatcttgttcttgctggttctcgattgcttgcaggaacaaataccctcgtggttgggctgatcgtgcatctgtcgagattcacgaccgcctctggagttggtgtaacgattgctaaggcgcaacatccctggatagttgtagtcggatcgccaacgtcgctcccccaattgacttatccctctcattgaaagatcgggacaccctcacacacatcaatgaggtacttgtagtgcacgtttccccctattaggcactttggattttatgtactgctggggttctcaatttacaagataaggcaacaacttcgattagggagggtgtgttccactgagacaaagatgaagatgttaatttgttggggtcatatgcagtacattagtgaatggattatgatgccaaccataaagaacctgcatggagcttggtcattgttatcgctctctgtttcaatttaaattgtttgagctgaaggcgggcaagcaaatcatatgtggtgatgcatgaattagagattgtcttgttggtgttaataactcaagatccaagtgatgataagaaaaatgacttgttgcagtcagctaaacatccattcatctcctatatgatggcacaatactttgagactattgagcaaaggcctgttagtgttgggaacagcttggatatcaacatttttcaagatacttggggctgcaaggatggaattcaaattatactaaaagaagtggagaatgcaagggatcaagccaagtgcaatcaagaatataatttcagcatggaagaatgttttcattccaaccatcaaatcattcttggaaattgacaagcaattctacaaaattacaaatcaaatgttaccaattgtttgctatgtcctgttgctacaccaattaggcaattatgtctggaaagctgaaagttagaggcaaattagttaagcttgtggaaatatgagcactatggaggaagcaaagatactaagttgcagaggaaaattttctttataaggaagagcaataatgataaggatgacttgagcattttgatctgccaagagctacaagtgccatgggacctaggcggttggcactttcagaattttacttgccatcgtcttgcaaacaagtcgaattttaagaagaggagattgttaggaacccaattgtgctgccaatgggctgtcaccactctcaaagccatgcccaagcaagcaaagggagagcactatataagcagcaggagtagcatcgaaaaagggaggtttgatcaattggcgagctgaggctcgcggcggtggcggcgatgacttggatgccggtggcaacccttctcattctccttctcttcctccttctcgtcccacctgtttgctagcaacttgtatccccttttccttctttgttccaccaaaatactggagtgttgaaacatatatggttgttgtttgaataggagcgaagggttgttaacaagatttaaaatgataacttttgtgggatatattttgaacaatgaaagtgcatgctttctaggatggagggaattgtaaaaagacaagcaatgtgggcctatctctagtcttaggtattgttattgcactgtgcttggaggtaggctatgtcactttaggtgggtgatggaccaaacagtgctaggctccagaattccttgccacatggatacgccgatacgtagtcccacgccgacccattgccacgtaaggggcacactgtcggcccacatgggagcagacgtgagcatcaccatatcacacatacaatcgtggcacgcgtatgacgcgttgtacgccttcaccatcgtaaaaaaatttaaaacttcccaactcaaaattaaaaaaaaatcatccaaaattttaaattttcaacccaaattttagaactttcaactccaaatttaaaactttcaattcaatttttttaaattttcaacttaaaatttgaaaattaagttgaaagttcacagttgagttaaaaatttaaaatttaaccagaaagttttcaaaattgaactggaagcttcaaaaatagggctgaaattttaaaattttatttgaatgttttggaaatttgagttttcaaaattgaattgaaagattcataaattggcttgaatgttttgaaatttgagttgaaaattctcaaaagtgaattaaaagattctaattgtgttgaaagttttgaagtttatgttaaaagttgtcaaaattgagttgaaagtttcaaaacgttcatctcaaaactcaaaactttcaacttaaattaaaaaattcaaatcaaaatgcaaaacttttaagtctgttatttatttttttattttatcataaaagggttacgtctactgagcacacttaagcattaggcttaggctaccttttgttttcctttttaaaaaatgctaagcgctacgtggtacattacatgacttggcatctttgtgtgcaagagatagcggcctccgtcaggatgcaaaagttatttgcaggctgatagcctgctgataggcttaggaaatactagaaattcagcgggtcaattggcgcgctcgctttatggcccgtacctattattgagtagtgcaatcacaaaaatccataggaatcaatttcattttctggaaacttatgaaaaaacatacattgaaataaattgttgaatgagatttcgagttactatttaatatactagagcttattgttcagaaaattcttaaattatctattttttcgcccatgctattccatggttccttgatttgtctaaaattataattaaattatctactaatgaaaattaggtcttgatattttttttagaaaaaataaagtgttcacatttttgttttgtgaggagttccaatgttcatcattcataacaatacttagttgtttatgttcctcgttgtggaacccaagcaaccagttttaagtcaagacttatttagtgcgtttgtatttatagtttagtattttccagcgataggctacatatgtgttagatggtgtttcttgtggtaaaacttaaccacctagatttaaatcataaatttggtacgtgtgcttgtatttgcgatttatttattttttttctagtggtaggtgaaatatgtgttgctggtgagtgtgattatttaatcaattttaaaatatattgttcagttcttggagatgctcatgtatttttacaggaactagttaggtgcccatgcgttgcaacgagaaaaaatcacataggatgaaatcatgttaaataatcaatgaatgtatttccgtggtaaaaaaccttaacaatgtaaatgttaatatgatatacatccatgtcggtatatattgcgtttcatacttcgtcgagatatatatacaaagcaactgcagtaagtagttgcatagtgtcatagtgtcagtgcaaacaatgttatgaaaagccatagactacatcacaagtggatccaagctactcaggtctgtaagaaccaccacaaagttcaaacatctgcaccaacacgggggatcctattcagcgcataggcatccacaccacatacaaatacatacatgaacaaaacaaaagtgcgccagggacacacaattagatgcggtttacagttcagaacagaacaaaacaatctcacataatgctcaacaattgttgtttcttcaagaaaagcagcatcatttgggtgctgttttatgcaagtatccacaaagcctttgacaaaaaaggtttgtttcaaatgagattctctcttcaattgtgaaacctgtacagttggtttttgcctgaaaaatgcttcagaatgaggacctgtgtactaatatagaaaattcggaagcaacctaagcactgtgctcccgaatgatttaatagtaatatattggaatatttgatgttcacttattaacagtatatattagcaattttaatattctataatgggtaactgaaaaggtaagttcaagattatgttttgatgccaagattatctacgtctcccattcaacataggtccatgtacctaactgattggcaaagcacgcaacaatcgctattgctcctaggaatattttcaagcaatacacaaatatacatacaaaagtatgttctctgtattttggctaaccatatactatattcaagatgaagtgcacacatctgtgggaatacggactggtttgccaaacgcccaaacgcatcgttatatcgcagttattgcaaaatatgtaaagaaaatttgtttgaaaccttgatgtctttgccgagccttccagccaaagcaagtagcaaggtggtcttgccagacctgggcggtcctaacagtagagtcatcctgcataatcaaaggtgcgtgttttataggagaagcatagaaattgaattccaaatgttcttggttaatctaggctccaacaaaagacaaataaactttacagtttgcagggacatgtctaatggaaaaagcatttcgtttccggtggaaccgccatcccatacaaaaatatgttcaagcaaataccttacaatctttcaaaatttcccaaataaaccatgagagcagcacaaacgtaacgttatgtaaagcagaagcgattatgaaaatgtgatgcttatgtttctttctttcacctgcggtgcttgacgctgccactgacgacgtggaggatgggcatggtctgcttcttgttgggtagaatccccagcgcattctcggctcctcgaggttgttggttatggagttgaggacggtggggaggccgctgttgccgacgcgacctccgcctccaggtgctcgaaccgcacctcgatcgtcggaatatcaatccccaccctgcacatcaaattaccacgcgcaattcatcaaacaccctgcaggcaacccgcaacctcgaccaccgccacggcgacatcgtgacgaaatgtgcaagtactgtacgcaccggtcgatgcgctccttgagcttgagaaggaagcgctcgttgtcgtcctcggcgacgcgcacgagccgctcgagcagcgcccgccgctcctacgggtcgaggctgagcacgtccaccaccttcttccccgcctcccatccccctccgccgccgccgccctcgtccaccaccggcaggacggcgcggcgcacccggtcgtacgtgggcaacttctcgagcgccgtccaccgcagcgcctcctcgtcgtcgtcgtcctcctcccccctcgacgacgccctcgaccgcaagagcaccccgttgtccgtgctccaccacatcgacgccgcccgcgacgacgacactccccccctccccctctcgtcaggctcaccaccttctgcatctccgccgccagcaatggaggggacgtcgaggaggaggcgtcggcgccgacgggctagggccggcaacacaaattattttttcgttttgaccgatcgctacaactgctgcttatcacgacgtgggatcgctaattaaaggttgatttaactttccatataagcctttggataaatagatctaacggtagaaagagaggtgtttgatgaactagtgttttttatattagtatagataagtgtgtaaatatatatgagatgcattattgtttcaacaattttattgcaaatgcagggtacaattattacgctcattgaaaccaaaactctggaccgtttactttgatgccaaaaaaaaccttaccattttggtatagttgccaaaattttagtaacttgccaaaattttagcaggatttcttatatagttaccaaaatttggtagcaaactaaatatagccacttttagcaacttaacaaaatttggtaaggttaaaaatggcatcaaagtgaacaagtcctttgttgcaaaaaaaaagcttaccaactatgccacttgccaaaattttggcaggatttcttatatagttactaaaatttgacagcaaactaaatgtagttactttttttagcaaccttatcaaaatttggtaaggttgaaaatggcgcgctctctatatgatgagtaatttaaccaatgtaagggtgagccatgtgggctccttccgctcgattgatcctgatttttctgttgtctgcatgcggagctgcaacacagcagcagaacactgcatgcggtaaccctgttatttttcatttccttacagtacgccagctgctcgtctcagtatttttttttactcttagatgctgatttatctgccaagtgaataatgacacgtggaccaatcatcaattggcaaacctgccggcttgagatttgagaaaggattgatttacaatcagcatcaggcttcgctataccgtactaagaaatttaacagggatggttggaaaattttgcccaaggacattgttacctcgcggttttagtttgtgaatatatctatagttaaattttaagaagaaaaaacttaaaaaatatggttgtttactgttgtacactgtataaataaaactttttatttctggctaaatagaagagataaatagtataaaaagtcaaaaaaatagtcttgaccctacttgtcataccgtttatcttcctgcctactcaatactcctgccctgggagaccacagtggaaggaacagagggacaacaaagcgtcatcatgcatgaggcgaggttgtccatggtcggcgtgcgtgggtgaggccaaagccattatggtgatcgagagggagaagatggttagcgagcacatggtggaaggcgctacaccgattgaagttgttcctgtctgtctagctggtcaccgactccatcgccaactccgatgtatccacgcgtagatttgcttccgtcgataccaatcggagaatatgacaattggggccaagggaatgttgtgtttgcatactgtttctcttttctattaaactgaaaataaatattgtaatgagcatgttgtccagcagcaaataaccatatttcaaaagttttttttctcttaaagattgacttctaccatatccaggagctaaaaccatgaaatgatggtctactgtagtaaaatttgcctacgttgttattatcaatgtgtggagtactatggtttgcttgaaaatttaccatatatctaagaatttatcagctctaggatttccatgaaaattctgataaggatattgttttgaatgcaagagtagaaatttaaattccaaagtgccaaatagtacattcaaccatgtgtatcgtttacaaggttttaaattttagagatcaattttacaacaagctctttggcctatccaatttattgataaatattaagataactgagaccggcccatcattctaacacagagataaataaaaataagagcagtccaactaacattctaaagcatatactacgctacacaaaatacttcatagtggaagggaaattcatgaataaggggatatatatgttgggatacgcgtaggctatgatagcataaatcaaaattttctatcgcgtaaatcaggaaccatgcaagtattagatcattgatcgttaccactcgatgcgctgtgcagcggaagaaggcgctgagaagtcgaaggaactctcgcgaagtagcgcgcgtcgatgtagaggaagtagtcgatcgcaccggctcgaccttctcctcctcatgcgttctcctcgccgtactcccacgccgatcagcactgcaaaccagcggcgcctctaccggtatcaacacgtacagggacgaaacgccacacgtagatgtgctagcacccgcgcgcggctagggttttgctcggggagggaagtgacggctagggtttctcacatgatgcaatgcctccgccggtcacacccctcacgaatatataggatccatcactcgggcctccaaggcctgtaggattcctattcggatcccttatccgaagtaagctcatattggatctccatccaatccccttattccggcccattaagcgtgcgaccctgtaggttcatatatacttggctgtaacccgaaaactccttttcggtccacgcgtcaacagcggcccctagcagaacgtattgacccaccgggcatacataaagatcatatcggctgaacgtctagtgtatacttgtatgaaccaaattgcctcacaatatcgattaagctcaaggctagatatgtgccatcctctaatagctcaatcattcactcgaacctgttgatagattatataacttgtgattgactcctcaatcacctttggcatggccatgcacttccataatctacaacattgaggggccaagagatatctctccataggaggggcaaatcccatcttgattattcatatcgcactacatgtttcatagcatacccgaaaactatttttatagctacacatttacggagtagcgtttagcagtccctaagtaagctactacatatgttgagaaccatgataatctcaggtctaaggattcaacaccaacactaaatgagataactgatgacacaacacatatggctcttgcagtgtctcatgttgggtctatccaacgacatgttcaccaacatgtgtccacattattaatttggtatctctataccatgatccatgagacatgatcatcaattaatacatgtgctgatcatataaacatatttgttccacatatgatatttgatcagggatcctttagaaatagtaacaaacaacataaagagtctcatgaaagaatcacatattcattaacctataaggagttatctatttcaaggaacaatgtcggataaatatgtaaacatagtatgtgatacaatcatctctatgattgcctcttgggcatatcactaacagtctaccaattgcactagagttaatcataaatgtatcttatacccattgccctagtgtgtgcctcatgcttaggctgagggagtggctttgtcaacggatctgcaacattcaaatccatatgtattttgcatatcttcacatctcctctacccactatctcgcgaatgtggtgataccgccgtaaaatgtgtttggacttttgatgcgatctaggctcctgggcttgtgcaatggcaccactattatcgcaatagaggtccatagggctagaagcactagtcatcacacctagttgagaaacgaatttttttatccaaacagcctcctttgctgctttaaaagcggaaatatattcggcttctgttgtagaatcagccactgtatcttgcttggaactcttccaactcacagcgcctccattcaggcagaacagaaatccagattgcgatctaaaatcatctttgtcagtttggaagcttgcttcaatgtaaccatttacaacgagctcttcctgtcctccatagactaggaacatatccttagttcttctcaagtacttcaggatattctttacagctatccagtgactctcacctggatctgattggtatcggcttgttgcactaagtgcatatgaaacatctggacgtgtacatagcatagcatacatgatggatccgattgccgaggcatatggaatcacactcatcttgtttcgctcatcaatcgtttgaggacactggttcttgccaagattaatgccatgtgacatcgtggttcttgccaagattaatgccatgtgacatcggtaagaaacctttcttggaatcttgcatattgaacctcttcaacaccttgtcaatgtatgtactctggcttaatccaattagcctctttgatctatctctatagatccttatgcccagaatatatgctgcttcccctaagtccttcattgaaaaactatttttcaacgatgtcttaacggattcaagcataggaatatcgttcccaatcaataatatgtcatctacatataggattagaaacaccagtgcgctcccactaatcttcttgtatacacaaggctcctcttcgtttttgacaaagcccaacgccttgactacttcgtcaaaacgaatattccaactccgagatgcttgcttcaacccataaatggatttctgcaatttgcatatctttttagctaattgtggatcaacaaatcccttgggttctgtcatgtacacatcctcatcgagatttccattgaggatagctgttttgacatccatttgccatatctcataattgaaataggcagcaatcgttaaacaatccgaatagattttagcatggcaactggtgagaaagtttcatcataatcaacaccttgaatttgtctgaaacctttcaccaccaatcgtgccttgtagatgtgaacatttccatctacatctgtctttttcttaaagatccatttgcactcaatggcttttacaccatcaggtggatcaaccaagttccaaacttgattgacatgcatagattatatttcggatttcatggctccaagccatttctcagagtctggtcccaccaatgcttcctcataggtagtaggttcatcattctctaacaacaatatatcacgttgtcctgtagttaacaacgtatacctcgcaggtgtacgtcgtatcctatcggaccttcgtgaagccggtgcttccacaactggttcaacaacaacttgttcaacctgttgaacaacatcttgctcagcttgtggttgtgtggacgttgaagcgttttccggtgtttcctgaatttcttcaagtcgcaccatgctcccactatcctttcttgaaataaactcttttccaagaaaacaccgtgtcgagtgacaaacactttgccctctttccgattataaaaataatatcctttcgttttcttagggtaccccacaaagaagcatttatctgatttaggtgtgagtttgtccgattgcaaacgttttacatagacctcacagccccaaatctttaggaaagacaaactgggacgcttcccagtccatatctcatatggtgtcttatccactgattttgatggaaccctgtttagtgtgaacgcagctgtctctagagcgtaaccccaaaagcttagcgatagatcagtttggctcatcattgatcgcaccatgtccaacaatgtacgattcctccgttcagacaccgcattccactgaggcgttcctggcggattgagttgtggaacaattccacactcctttagatgattgccaaattcaaggctcaagtactctacaccacgatcagatcgtagatacttgattgtcttgcccaaatgattttgtacctcattctgaaattccttaaacttttcaaatgactcagacttatgcctcattaagtagacataaccatatctactaaagtcatcggtaaaggtaataaagtacccaaaaccacctctggcagttgaactcattggtccacatacatcagtatgtactagtcccaatagttcacttgccctttcactttgacccgtgaaaggtgactttgtcattttgccaagtaaacaagattcacatgtctcaaatgattcaaaatcaaacgagtgtagaagtccatctctatgaagcttctccatgtgtttctcatttatatgacccaagcgacaatgctaaataaaagtgggattcaaaccattaggacgttgcctttttgcattaatgttatagactgaacatccatcaagattcacaatgtataagccattcatcatgggtgcatgaaaatagaaaatgtcattataatagactgaacaaccattctccatagatctaaaaccataaccctctgcttgcaaacaagaagcagagataacgttcttacacaaagctgtaatgcaataacaattatttaactccaaaacttatcctgacgataaagataatggcatagtgccgactgcaacagcagcaactcttgctccattgcccacgcgaatgtccacttcgcctcttgctaagctcctacttcttttcagcccctgcaacgatttgcatatgtgagcaactgacccagtatcaaatacccaagaatcagtagaggaagtagcaagattaatttctataacattaatacctgaggtggaactctttccatcctgctgcttctgcttgagctgctctagatatttcttacagtttctcttccaatgacctgtctccttgcaaaagaagcactctgcatccttagcgggccctgtcttttgaaccttggtcttagagttgctagtactcgtgatctcatcagagtttagctttctcttttgatcactcttcttgttgttgggcttgtgcttatgcataaccatcacatggttggagtttttcttaatgctttcctcggcagtctttagcatcccatgcaattctgccaaggtcctgttcaggttgttcatgttgaaattcattatgaacggctcaaagctaggagagagcgactggagaatcaaatcagtagccaactctcggctaagaggaaagccaagcttatccagactctcggtgtaaccaatcattttgatcacatgtgggctcactggattaccttctgcaagcctgcacgcaaacaaggactttgaggtattaaacctctcagctcttgcttggtcctcaaacatgttacgtagtcccgtgattatcgtatgagcatccaatgcctcatattgcctttgaagctcaggggacatagtagcaagcatgagacagcttatatcaagataatcattgcatcgcttttcatgctccctacgttgagcagcaggagcattgttgggcaagttagctggaaaaggctctataagcacaaactctttgtgctcttgcctgagaaaaattctcaggttgcgataccagtccatgaagtttgttccagtcaacttctctatctcaagaatagaccgcaagttaaaactggatggtgcaggagctgccatgatctacaatagaaatatatgtatgcaaaatcagcaccatgtttacatttaacctttaattaaacaatttaacaaaagatactcccactatgtattgtgaaacaaaattccctctactaacatagtgagtcaagatcctcattttattagtgtctagtgagctttggcatcacagctagacaactatcaaaataggtaagcaacacctagctaatcacatcatatgtgactcttgtgctgttggggtgacatctccatgtccaacccaacctatgccccaaggtccaaaactgttttgataaccttgtcaagtaaaccaataatttccgcatatagatgttcgacatctatcctattttatcatgataaaaagtgacactttgctatggcaaacccatcacatatgatcacaaccataataggtgcaattattggaagagcataaattacacttaatttttctgaggtaatctatcctaccatgtcatatcaaatatataacagcaataaagtaagatagatataaaaaccccaagcgaaatctaaggggcaacgcacacgccggttagcgggcggggggtcgaggggggagccaccccccgcgggtttcagggcagctccctgaaaaggtcacggggtacatagatctcatctacgattcgccatgtgaaaaccttaacggtgtaatcaaattatgccgaaaccgagtcaatctcattggctcgtttttctcattggcgtgcggttccagtggacatcggactatcgcgctcggccttggtgagtactagacattccagtgaagtcaccaacacacataccgattgatctcatcaacccatcggctatcggttcatctcatgttccgatcacctaagaactcatatacaacataatagatctcatctactacacccgcacatcaacaatatgcattgatctagatcataaactatacatggcggctttgataccactattgggatacgcgtaggctacgatagcataaatcaaaattttctatcgcgtaaaccaggaaccatgcaagtattagatcatagatcgttaccactcgatacgctgtgcagcggaagaagacactgagaagtcgaaggaactctcacgaagtagcgcacgttgatgtagaggaagtagtaaatcgcactggctcgaccttctcctcctcgtgcgttctcctcgccgtactcccacgccgatcagcacctcaaaccagcggcgcctctaccggtatccacacgccatcaccaacatgtgtccgcattattaatttggtatctctataccatgatccatgagacatgatcatcaattaatacatgtgctgatcatataaacatatttgttccacatatgatatttgatcagggatcctttagaaatagtaacaaacaacataaagagtctcatgaaagaatcacatattcattaaccaataaggagttatctatttcaaggaacaatcactggtggagaaagcgtttgtagtcccggtttgtaaccccctttagtcccggtttccaaaccgggactaccaatctgggactaaagatcgctatctttagtcccgggtgaaataaccgggactaaagatcgagctgacctttttttttgcatggcccatttgctgcatggtttatatatatatatatatatatatatatatatatatatatatatatatatatatatatatatatatatatttgaccaaaatatatatttacattatagaaaatgtctacacatgcatatagaaacatagtcatgtattaattacaatcctttatatgtcctagctagctacgatttcgacgtagtagtagtcgctatctcagaagctaaggacctatgaattgtttttccgtcgtagtagaattcacccttgggatcaaggatttgttcgttgatgaatcccatgagttgttcttgaaccgccgcgataaattccttgtgtgtgatcaggttatccctcatgcgaataaactatatgaatgtatgaaattgattagtaattaaacaacaaatcgatacataatgaaattttgaatttatttgtacgtacatcgagctctcttgtggtgatgatttggtctgcaaggcagtggcaatactcgcacacgtagtagccgcacaagttagttccctgcttttgctttccgcactataaataaatgacgaacgacgagagatctaattaatataacacttttatgtatttgaatcggagaaatataaatgtagagcatgtgtactcacaggagatttgaacttccgcctaagtgtttctctccatttgccgcggaccaaatgacggaaccgataccaatccctacatggagtttaaagctatgattcgcagtagcaattaactattacaagattcctaattaacataggaacttatgacagtacctgtctataagttcgaaaaccttgtcaaacgtagactcttttttatccattgagtcatatacgttgacggtgcaggcctctaggtcgaagagtaaaagcacccagtggaatctgcaatgtgcgtgggatgcattacatatgaaacacttagcatgttcgtacgggaatgaaatttggtataggaagacagttaaaattaaactaactctgtgttgtacggcaacagtatgaacgtcttgtaaagctgcgccttcaggagatggacgagattgtcctctgtggcttgcggatattggtcgagcattgcgacgtttacttttcgagggtcgatgaatccagtatcgaaaaccccccgccgtcgggctctttgaatctccattctacaacgataaaagggagtatatattatatatagtctacttatatacaaggacctaattaattaaaggagacgtagtaagaaatctaactgaacgatatacttacaaaatccagcaactcataatagagacgccgagggcgtccagctggtatagttcgtagattgccttgaaattgatccagagaatgtcatctccttgcaagaagtccgtgtccctaatcctcgctccgatcatctctctatcggtggcgctcatctccatgtacacctgatggaacttgtacatttgtgtgggtagggactgcagcagctcaggcttgacaagcggtttaccaagttcgtacatgtatttcacttccgccttttcgattggtgcgtctcctagcaattgatctgtagttagcccggtgtcattaataaagtcttgtattccaaaatcttgaccggtcactaacggctcgatctcctggtttggttgctctccaagctgagggactggtttggactttctagaacatgctttcttgagtgttcactcatagtccgatagctttatggcctccttggcaggtgcagacatacccctgaagaagttcctgacactcgggtctataggaatcttcttttctggacttcgaggcttgaattgtctcctgacttctgatgccacgtaagcgtcaagctcctcttgcgtgcaatcgtaccccgggtccttgttcttggcggcgtcaactttcgccttcttcgttgcctttgtgggggcaggcggtggagcttggggggcccttgacttggaaggtgccgtaagaggagcttgcggaggagtcggtgtaggagcctgaggaggagttggtgcaggagcctgaggaggagtcggtgcaggagcctgaggtggagacggtgctggagcatgaggaggagacggtgcaggagccggaggagatggtgcacgagacgccgcttgtcgcccagggaggatgatgtaccgcttgcgccatagaataatggcgtggcttgtgtctcgtagatgcgcctcaccgtctcctccagggtaatctagctcgaagtcctagtacgcgccttcgaccaactcaacttcgaccttggagtatcctgctggaatcggcttgcagtggaagtacctgaagggtccgttgggatggccatgcccgacgccaccttcatgtggtgagaggttatttattagtaatcaacatatataagcagcaacaagcggaatggccaaatctaaaatctataaactacgagcttacctttattgataagttcttgaaggggatatgcagctcacatggtgtccgctgagtgatgtcatcaacggggcaggtggttttgtcctgggtttgcatggcgtccatgctctgtgatcctacctgccctgttgaggcgcaactgctacgatttcctgacgggctcaccattgcaggaggaatggtcggctggggatcattggaccgatgtgcggccatgcgttcatcaaccttccttgccacctcctcttgcatgctgagctcgtagctcgataccctgaactcaagatctgcaatcttcgcctcggtatctctcttgctcctcatccgactcctgtatgtgtggatgtcctccttgaacccaatattccaaggaatcacccatttccctcatgttcgtcctggatgctctggagtctgcagggcgagtgacagctcgtccttctctctgtccggtcggaacgtgccctgagaagagccttccactgcgtctgttaatcaacgcgcagcctcgcgtatctgatcgccgaagaccagggagccatctgctgggttgagcgttccaccgtgagcatagtaccagaacttcgatcgttccggccaattagcggtggccggttcgataccccactcaagcaagctagcctccatctcctcccacttcggcatcgcgacgctatagccgcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtcttccccttcaggatatatttctggtatagatctcccttgaagctctgaaactgttctgccattttcttcagagtccaccttttcactttgtcctctgtacccgcgggaagggtgaatgtctcgagcattgtggtccacagcatctctttctccgaatctgggacaaagctctcatgatctccgcatgcccttgttctgcgccagtacaccgtactgacaggcacgttatcctgcacaacccaaccgctatgacgtacatagttcttggcggcttctgccggggcactaggtcggccgtcttcgtccacttccgttatgatgtgctgaccctcaagcttcttcgcggcacctcgttgcccgcgtgccctcttctgtccagcggagggttgacttccactagcctcctcctcctggttcccctccacatccctttccacgtgcccctcctggttcccctccgcatccctctccacgttcccttcctcattcaaatactggtttggatccttgttccccttttcttcgttccagtactggctgcttccctccgcgattgtatcgtacaatatctgttcatcatcgcgatcagccatctgttcatacaggaaacagatgctaagtcatgagacatttatgttttaacaatcttatatgctaacaatcatatgctaagtctaggtgacgtatatgctaagtgataatcttatactaaaactcaaatagtgatatatgctaagtctaggtgacgtatattataggaccctagctagtcaataattatatactaagtctaattacaaatataataatcttatattaaaactcaaataatcttatactaaaactcaaatagtcatgtatgctaagtgtaactgtcgtatattagaaccctacacaatcttatatgctaagtctaattacaaatctaataatcttatactaaaacttaaatagtgataaatgctaagtctaggtgacgtatattataggaccctagctagtcaataaattatatactaagtctaattacaaatctaataatcttatattaaaactcaaataatcttatactaaaactcaaatagtcatatatgctaagtgtaaatgtcgtaaattagaaccctacacaatcttatatgctaagtctaattacaaatctaataatcttatactaaaactcaaatagtgatatatgcgtagtctaactgtcgtatattagaaccctaaacaatcttatatgctaagtctagttacaaatctaataatcttgtattaaaactataataatcttatattaaaactaagtctaagtgtcgtatattaaatctaatagtcttaattgcattacaaatataaccttctgcgatataatatcgtcacttgcctgcgtgaattccttcgagggctagctaccactccggcttgagggacgactcctgacaacgtctatttcgcaacatacaaaaagatgtattaggataaacgcaaagtaacatata

SEQ ID NO: 11106 - DNA, 35185 bp, Oryza sativa
cacgttaattcgtttgatgccgtggcgacagcgaagcggcggtgtggcggcagcggatcaggggcgggacgggtcggcacgagcattggcgtgcggcgcgcggcgcggtggcggcgtggcgcgcggcccggtggcggcgttgcacagcggtggcgacacgcgcggcacggcggcggcgtttcgcggcggcggcgaagcgcgcggcacggcggcggcgttgcgcggtggcggcgtgtaacatacctgaattttaggattaaggaatttccatcaaaactagttgaaagggaagttcttcaattttgtaaaccaaaaatttccattttaaacctaggtggagttgattcaactcttgcatgaataaaatttgagaacaaattaaaaactttttcatctttaacctaggacttggatgcaacccaagtgaaagcatgcatacgtgcataaatcatattttgacttgagtccttcttatgcatttggattttcgatttgcatttcataataggtctcatgaatattaactaagatctagataaacaactaaaccattagggcctagtgtataactaatgggaaaataatacataaaaaccatacaccttaaaaaaaatatcaacatggctaatgtcaagcctcacaaaactaatttggacatccatctgaagacatgtcatgaacatgaaagtgaacaaataaattatatcatatagggtatattctatcttaatcatctctataagcattctcttaatttaatactaaagtaaacttatgcataaatagggaaggagcttatgacatgtgtaaggtaaactgtgattctaacatatcaacatcacctcaggttaatgagagtccaaatataacttttataaacatttacatgcatttaggaaagagaaacacatataagacataagtcctgcgaattatctaaaataattcatgcaagataaaatcatgggaaaattcatgtaggctctactcaacacatacaactcactgtaattttggtataatttaataactaaatttggtacctcaaataaatcagtcaaactaataaaaactagattaactgtagttcttaatcggctaaaaccatactttgtctaaaagtgcatttaactgcataaaagtgtataagtaaaataatttattcaaatactaggtcatttatcatgaataaaaataattttttcagaatttatcttctctgtttaggtctcctaaaaattcgaactagtttccaaagaacccatattcctctaatttctgtgagtaatctatccataatttttgagtgcaaccaaagaaaatggaaactaggtacatacacctacctccagtaaaatcaatactagctaatctgatcaacacattaagtattgaagctacaaaattagaggagaaaataattccggaaattcgtccaaaaaccaagctcacccatgtttctgcctacacatctctcttccacctagtttacttcgacctgggcccccttgtcagtccctctggcttgcccttcctctgtgcaacttccctagctgaccgagaaacactgagagggagagatcgagcgccgaccggctctagacgccgcgcgacgcgtggccacgacgtgtcgacaccctaaaaacgacgagctccatttctgcctctcccagacgcgtcgccactcttcacccaccattccagtgccgatccatccgagggagagcatcctcgctgctcttctccactggttctccatcgccggccgcgaagaagatgatggccgcaatcgttgatgagccgcggtcgtttcctcttctcttgcgttccatactctcctcaccatgccgaatatttctccttttgatttcatcctctctggtgcagccaatcgacgggaacgctgccgtgcacaccggagctctggagcgcgctctgtgcaccgccgcagtgacatcatcgccgttcccgcttatctggaccaagccgggccaagctgtcgcgccagcgtcttcgcctcgacctcctctccatttcccctcaagaatctcgaaggatggtgctacgagtgtggagatcgtccaccgtcttctccacctccggtcaccgtcgccgttgccgaatccaccccctccggtgagtaccaacccaattccatgcatcagtagcatccctggggcctctctaacctcatggacacacatgcatgatagttcttggagctgattgagccatcgccgttcacccggaggttcttgccgccgccgagccgttacacgagccgccgtcatcaacctagctaccccagccatgtctagcatctcggtgagcacccttcagcctatagaacatacatgcatgcacccaattaaccaatacatgattgtagaagcacatgcatcaccacccgaaaacatcctcctttcggactcgccgccggcgttactccgatgtccactgaccgagaaaagtagaggaatggaatcgcaataacatgatcttcattttgtattttggttgcacccccaaacgagccatcgtttgtcgccggtgagctcgagatcgagctcagccatggctgttctgcctctgtgcatgagaaaagaagtcagggaccttgtttcgagaatttaaacaactataaggattaatgtgcaacttttcaactcactgacatatgaggctaggtctgcgggttgattcttagaaacctcagggatctttttgtatattgatctttcactgacagtggaccccttggaaacaaaaatctgaaattataaaaggaaagtacctaaaacttgtaaaatccatataaaattaaatatagctcattttaagatgatacaaatttctgtcaactcaccaaattgtgaactttagtgttatggaataaaaacttgcactcacagtacaaatttagcctctaaaatttatccaagttaaatcacacataaagcatgcacaaatttataaaatgcatacaaaattcatttcaactcattttggagcaaactcagtttctacagatccaccaacttatgttctcctataaagcaaaatgaaatagtatacatactatacatcgaatgcctctaaaactattacctttaaaatgactagttttgcataagctgaactttagaagtttatataaaattcatcttagatcctttttgagtaaacccaaattcagtagaatcatagggttgtgcacttcaatgttataaaataaaaagacatacttacagtataacgaaaacccctaagtatttaagtaaggaataagcaacatggagcataccttaaattgtaacatttgtagaaaattcatctatagtcaaaatgaagtgaaccaaattttctatagaaccagcaagtgatatacttcaacttagtagagtgaattatagcaccctctttacagaccatggctctgaaccttaatttggtagaataggaactaaacacatagtagtggttaaacaatacatatgaaaaagtatatatatgcatggtagctccaaataaatccaaataaaacttgttgaaccagtgaaggcatagatccatccccttccaccaaaacttagtatccttaactcatataataatctccagattgatatgttaagtttctaacatagaacatcccctagcttataaaatgtgaagtaaagtaatttgaacactaaattttataaactaagattagattagttaactaaaatacacattttatacaacactagcaagttagagcaagttctggacctaaatctccaaagccatttacacatagggaatatatgcctagaacacgttaaaacttgtaaaatacataaataattcatattaactctaaaaattatgaaaccaaatgtgttagtcttagaaaacaaatatattcaccccagcaaacataaacttaataagaatcaccttacaacagcatttcacaatagtaactaagtaaatcctacactataccgacgaaacttctaaaattcataactcccaaataaaatgagataaaatagaaattctttcacctaaattcattttataccagtacctattctctgtgcacaaatcacgcattttagaacattttggatttttcgcatatttcggtgtttaattgcataacgtgtactttgtatagatgattgcttaatcggtgaagaagtgatttaggtgctgacattttcctgattcaaggcaagtcccatctccctctctttgatcactttgaacctatcttttggaggttattgaaaatgtttgcaaatcttgcatgtcgattgtacactaataaattaaaattttgttaaacttgttagataaactcctattatttgcattatcaccttaactccacatatatccatattcctcattcctaaccttaggaacaatatggctataccactttatatatgagttttggtgacactaggttactataaagcttagccatgcttagaatggtcttccttgtcattatgggctcatttcaaacatgaaaattgatttttaattaatctggacagaactttaaaacttgtgattttgataaataaaatagtggaaaacatggattttaggtttgggcctcaagtggtgtacatatggtgattagttgtataccgatagggggagagtgcgcccaaaccgacctaaggacttcactcaatgtcagttcatttcgtatacagtacaaccacatgtgctagtatgggatagcccaagcttagtaaattatttatggtttagccttacattctggtaggccggtgtgtatgagttcggataactcagaggaacttcctatttaccccgacgtggtagtttaggtgactaagtctgtccaatacaacggtattgtgccacgtgggtgggttcccgttgtgtccgccaccacggcgttaagttcaaggcatgggcccgccacttaacggttctaggtcatatttctagtatgactaggatggaggaacacgtatcgtgctggtgtaaggctaaatcatgaattttggaaaaactttgttgtgggtaataaatcgggtacttatgtatcgcgtgccatgctcttgcatgattattatttcgcatcatgtgggtaaagtgtacaaactctgcagagttaaaactaatcgattagccgtgctcgcggtcatgagcggcgtgtggatatgtattgagtatagacttgtgtttattctcctaaatgctgaaatttaccttcaaattgtgatgagatttgagaatgatctccttgctgccatggatggcaatgaggtgaatatttatacatgattaatgcctactttgatgcccatatgctaagtactagcttgctgaaattttatttgaaagcaaatccgttttgaatgtgttttatgcaaataaaacttgctttatgctaaaaagaaccatattatgccttccttgattatatgccttgcaagtagggtcttaggcttgtcttggtgctagccagtacattatttctaataatgtactgactcttgctgttgaattaacttttgcttgcaggatttagacttagcctttgagtgatgcgggtgatcgactgcttcttctaggacttgaacttaatggggtaaacccctagtcggtgtgcttgtggattgggtagacaagcttccgctgttctatatatatatatttttttttggccagtcggccaatgtaactaaagtagatgtagtttacaatcgctttcatcttatttgtgtttgctatgtctaatcatgcttgagatgaaagtgtgaatctagtgcacatcctgggaactagattcacatgagtatgagttaggaatatttgagatgttgtagaactttagccatttttgtcaagtctcctgaatgtgtaacacatctggttgccgccttcgagtggtttgacgggcacatctcaggctgaagttgactggcaggctaaaggcctagcaatatctccaatattcctctctcgaggcgtcggatatttcattatgcttgtttgatgatttgaattattcacttcatctctcaattataatggaaggtccggagagcctacgacacggcgcggcggcggcggtgcgcggcggcgtggcggcgcggcgccagtgatgtgccgcggcggcgtcgtggcgtctcggcgtttcatgccgccgcggtgtcgtggcgcggtgtcgtgtcgtgacgacgtcggcgtcggcgtcggcaacgaggcggccggcgtcaaccgagagggagagagagagatcgagatcggagagagagagctgagagggaggcggcggcggctctcaccccagagatgcggcggcggaggaggaggcggaggcggcgacgacaacgagcgcgagacgacggcgagaaacgacggcggtgtcggtgcggggatgccctaggcagtggcggcgaaggagaagccgagagagattgatcaggcaaaaacttctaagtgttggtcccctagatctttattcccgtttgatgagaacaaccgggagccagttgttctcatcaaccgggactaaagatattttcccgctatttccaaattctttttaaacccggttagggataagaaccgggactactgataagcgcactgaatataaatttccattacatatgtgtttctaaaatagaaaataatgcactaaaattatttaaaatacaaaaattaatgacaattacttcgaaaaattattgttgtctgtaataaattaagttgataaaacgtaataagcaaatatatgatttaaaataaataaaaattctaataatcatatatacttagcatattaatgatattaaattgttaaaaactctaattaacatatgtatatacatacggcattatttaaaattaataaaaatttggataatcatatagaattagcatatgaataatattaaattaattgttaaaaactctaattaacatatgtaaatgccacatgcatgatttaaaaattttaaaaattcgaatagtcatatataattagcatatgaatgacattaaattaattgttaaaaactctaatcaacatatgtaaatgccacatgcatgatttaaaacttttaaaaattcaaatagtcatatataattagcatatgaatgatagtaaattaattgttaaaaactctaattaacatatgtaaatgccacatgcatgatttaaaccttttaaaaattcgaatagtcatatataattagcatatgaatgatattaaattaattgttaaaaactctaattaacatatgaaaatgccacctgcgtgatttaaaacttttaaaaattgtaattatcgcatataactagcatatacatgatttaaacttgttaaaacctctaatagtcgtgcgtaattaacatatgccatacaacaattgatttatatggataatcaatacatccaaaatagtttacatcatgtacacaataattacggcaatacatcggcggtgacggttgaccgcacgtactttctcctcactatcgttccctccttgtgatcgctacatgagtaaggggtgtcttcatttgataggaggatgctagggtcaatcgtcaccgtgaaagggggttgcccatccaactcatcgtaatcctcgtcagtcttgtcctcaactccgacaatttttcttttgcctgggagaaccacgtgacgcttaggctcgtcaggccctctgcccttctttcctttgctagacatgtccttcacgtaaaagacttgcgttacatcattggcaaggacaaaaggttcgtccgagtatccaaccttgttaaggtcaaccgttgtcatcccactgtcatcaatcattacgcctccaccagtcaacctaacccattggcaccggaacagaggaaccttgagaggaccatagtcaagttcccatatgtcctcgatggcaccgtaatacgtgtcagttgttacatcgtgtcccatggcatcgacacgaacagcgttgttttggttcgtgctcttcatgtcttgggctctcgtgtagaatgtgtacccattgatctcatatccctagaatgtcgcgatcgacccagacggtcccctcgccaggaaggcaagttgttggttgatcgactcgttacccatgagatattgtcgtagccacgcggggaaagtatcaatgtgatgccgtgtaatccatgcatcggacttaccgatgttcttggcgcgaactagagccaagtgctcctcgatgtaaggagctaccaatgaagattgttgcagaaccgtgaaatgggctttacggaataaattgttgtctaccgtcattattgctttccttccgagagttccctttccccgtagtctcccttcatggcgtgattcaggtatcccgattgggcgaaggtcttcaataaattctatgcaaaattcgatgatctcctctgttccataacccttggcgatgcttgcttctggacgagcacggttacgaacatacttcttcagaacgcccatgtacctctcgaaaggaaacatgttgtgtaggtacacaggcccgagaatactgatctctttcacaaggtgacaaagcagatgcgtcattatattgaaaaatgaaggtggaaatatcaactcaaaactaacgagacattgaagtacatcattctgaagggcttctaatctatccggatcgatgaccttccgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttataattcgcttgatattcgtggagtatccagacggtacctttatgctctccaagcattcaaacatactttccttctctgccttgctaagagtgtagctggctggactcaagtaatggcttcatttctcctttggttccgggtgaaggtcgccgcgttgttccatatgctttagatcattacgtgcttccaatgtatcttttgactttccgtatacacctaggaagccaaggaggtttacgcaaaggttcttagtgaggtgcatcacgtcgattgcgtggcggacgtccaagaattcccaatagggtaactcccaaaatatagagttctttttccacatcgccgcgtgaccatctttgctctctataggctggcttccaggcccctttccgaacactactttaagatctttaaccatagcaaacactgttttcccgctgcgatgtttaggcttcctacgattgtcagccttatgttcgaagtgcttgcctttcttccataccgggtggtttgctgcaaggaatcgacgatgacccatgtatacaaccttcctacagtgcttaagatacgtactttctctttcatccatacagtgagtgcaagccttgtaccccttgttggactgtccggataggttgctaagtgcaggccaatcgttgatggttatgaacaacagcgctcgtaggttaaactcctcctgtttgtcctcgtcccacacggggacaccttccttcttccacaacagtttaagatcttcgaccagtggtcttaggtacacatcgatgtcattaccaggttgcttggggccttgaataataatcggcatcattatgtacttcctcttcatgcatagccaggggggaggttgaagatacacatcgtaacgggccaagtgctatggccgctactcatctctccaaaaggattcatgccatccgtactcaaaccaaactgtatgtttcgtgcgtcctttccaaagtctttaaattttctgtcgatgtttcgtcactgcgaaccatcggcggggtgtctcggcatcccgtcctgttgacgctcttcagcgtgccatcgcatcattgtagcattccccttgttcttgaacaaacgccttagccatggtattatagggaaataccacatcaccttagcaggaattctcttgcttgttagctgcccgtcaacttctcctggatcgtctcgtctaatcttgtatcgtagtgcattgcaaacagggcatgcttctaggttctcgtactcctcaccgtgatataggatacaatcattcggacatgcgtgaatcttctgaacttccaatcctagagggcagactatcttcttagcctcgtacgttgtctcgggcaatttgtttccctccagaagaatgttcttgacgagtttcaataaatcgccaaatgccttgtcactaaccccattttttgccttccattgcaagaactccagagtggtatccaactttttatgcccctgctcgcaacctgggtacaacaatgttctgtggtcctctaacatcttgttcaatttatggggctccttttcactttcgcagtccttcttggtgtcctgcaacatctaaccaagatcatccgcaacgtgttttacttatttactatttctaaagttttaaactaattttaatgtgttttacttcttttaattttcattttagtttgtttctattatttaagattaactttcactatattttccttctcaactattttataaaaccttctttagcaaataaactaaatttctatatattctttcttccccacacaaattttctctctcatcaacttacaactaaattttggagacaaaaaagtgtgcaaaacatagctccaaatgtaatatgacaaaaaaaaacattggaggatgaatttgcaaaccttttaggcacctccgatttgtatgtaatcaccaaaataaattcactagaaattttggcatgacctcccctcttttttgaagaaattttgaagcttgctcgggcagctggaggaggaagaagacatatatatagagaggtgggactttagtcccggttggtgttactaaccggactttagccccggttagtaacaccaaccgagactaaagttacgatctttagtcccggttggtgttactagccaggactaaagatccgggggggctgacaagccctgacagcatttgaaccgggactaaagatcaccaaccgggactaaagatcaaatatgcccgtaactctttttaaccggggactaaagatcatctttagccccggtttttattgcatccgggactattgtggaattcggccgaccgacgaaagatggtttctccaccagtgaatgtcggataaatatgaaaacatagtatgtgatacaatcatctctatgattgcctctaggacatatcactaacaatatatgatagtattatccccttcacatcaaatgctctttaattaccctcatcatattatcaaccacaatgctataggccttttcagtgggatggaagccatcccagtaaatataatcaaggacatttgggcatgcagtgtgatatgcaataaatatgctagcatcgagcaaggtactaccacagcatcccacagctgcaaccttgaaacctgtataatggaaaatttcagatcggcgtcagtataaaaatgttcgtacagaccacctcccagaattaataattagtagttgaatgcgacacgctcatgcagatcatcaattatcattcggaaatttatatcatatccattcaccacatacttttccggttgctcaacatgtaatattttaacactccataataattatgtatgtaattatttgtttttgtgcgaaacagttaatctctctcttattttaatatgtaatttaacgtaccataaagagctggtttttgggcaagttctagcagatagcggtagaaatccatataagccaatttgagcccataaatgttcagttctgcatttagtcgagctatctccattttcattttagaattaaatagctctgacgcatggtttcgttctggatcacatttttctgaaggatgtcctccgaggattatttgtgaagggctacaaccaactggaggaattccaaaaaatccaatcctcttagcacccatttgattcagttgctgtataatatgcaaacaagtataatgttacattacatattcaaactcagatgcataaaacaatttagaatggaaaaggactactcaatccatcccaaaatatatcattttttagcattcactgtcttggaatacagtgacctacccacctactttcctacgcctaactccacaacttcttaaattttaggactaatggagtattcactgtaaatctaaatcagcaactacaaccaagaaattccaatcagatgtacacaaagcgtgatttatcttggaaacgttcaaatattcaatatatgtaaattgtcttaaaaaatcatgcatttcatgggaccatacttcttaccaatgtgaagttgactgctaaagatacaaggaagtccacataagaaccaaggtcatactgatgctgtttaaaaggaattaagaagtaattgtttgcaaggtcatttccccccattgaggtaaagtagacggcttctgcgacaacttgtgtcatatcctcttctccaaccaatgattttagtttctccttatattcctcgaataattgaagctgctgactacttgatatcgcggtctgaaaatcagaaaatacgtctgaagtaatattagctgtatatgcgtgtgtgtgtgtgtgtcttacactgtaatcttactttacagtgcaaattgaaactggataataattagagagcagtttgtattgagacataagttctaagaagtaaaattgtaccgttattttagaagtgagagggtcatatccactgcccccagaagcaaatgctaccccactgagtagatcatcaagttgaagaccatcgccgagataaggaggaattagctccttaacacccaattttgaagctgttcgaaataatcttaattataataaaccagatattcatacggagttaccatgttattcaatcaattaataatatcagtaaataagttcagataaaaaaaactcatcaaaacttgatttttcatggtaaaatggacaagatacacaaatttacatatcccaaagtgaactgtttttgaaatcctaatagaattcttgatacacaaatacaaattcttgttcgggttgcaaactactctctctgagagttccaaatcttcttacattagattagtgtttgcaagtacagtatacatgtttgataaaaacataacaaagattggtctcaactattccctctgtctcatactataagtcatttttgacttttttttaagtcaaattgactaataagtttatagaaaaaacagtaatatctataacaccaatttaataccattgaatctaacattggatatattttgataatattttttttataaacttagtcaaacctagagaaatttgactttaagaaaaattaaaacatcatgtaaaccttaccattatgcccaagtaaatggagataccagaaacaaaattggtacagtaattttatatagagcatggtggcagatggcaaggacaaggcatgatgggtcaaattatgttattgtgtggatggaggagtttgagttatcacagcacgtatgcataattatggtttgtacatacatcactcctttatttttacaaacagcctaaaataagacccatatttaaaaagtttagcggtgtcggtaaacgcccgtatgcgaaaatcgtaaaatatgacccatacaaaaaaagttttagccggtgtgttccataaaagtccagctataaaaattgatttttctagacatgccaccatctccgccaccttccttcatattggcctttcttaagagcttctcctcactatctcatgctatcttatcttatctctcgttctcactcactccctctcgttctgtctggtgtagtggttagctacataactctgaggtgacggcggctgggtcggagctttgctgcgatgctcctttcctcttagcctctagttctcactcactccctcccgttctctccgatgcggtggtcagcgatggaaggtggcggagatggcggccggcgcagaggtgggcggcaatggtggcttgagtggtggttagtggcaacggcagaggtcggccatgacactccctctccaatggctatgacatgaggggcgaggcacagcggatccatcagtggctagcctagagacgacagatccaacggctacagccctagctagggcgtgtccggtgatagcctctcccgtccatcgcttctccgccatcttccatcaggaggggcggacccagaggtagtggcaacctctccacaacatgacttctcctagttctcttgcacggatccggtggcggcggcgatgcgaggggcttaacctgatgtggcggggccctcttccctccattgcttctctgtctcccccgtggacggatctggtggccccggtgatgggaacgtaggatccgatgacggtggctacaaagatggagaactacagcaaagacggcagattcaccgactaccggtggtgatgggatcaaatcgagctagggtttttggaaattttgtgtttttgaattttaatttttttcgccaaaaacatttcataggatggcggctttacgtgcccgcgtgcaaaatacttcttcacatggggttgttatacccgtaagggcaaaatatagatttccacatacaccatgctccaggcgattgagcagtcgtctggctagtggctgcagactgacttcggccgtttgaaaaagggtcaattacaaatttaccattgctttgaatcgttattgtaaaactgccactaaaaaatgcaaaaataccactggaattatcattcgagtggcatccttgcaaaattgaaaaaacggtggcaaatttgcttgaaaaaaagtgctctgtagcactgggtggccgcccgacctgctcaatctacctaggtgttttctccaccaatagagtaggcatctgatcgttgttcttaaatttttttgtgtatacatacttgtgtgtttattcatggaatttattgacaatgggaagtgagcgtacatttctctgacaaggaagataggtgccggtttttgcggctggtgcgtgcccctgtggttttttgtgtgggtgggaaaagtattttaagtgtcggttttagctgttccggtatctatgatgtcgtctctatgtgtctttttatagtagtgcatttcaattacttaattcaataattgtgaaatttagaagttataagttcagttacactcggtttgatgtcttgaattaaaataaaataaaaactacagagtccatttaatgataataggatttaatgaattctctctcacgtttttttcccctaagaaaatgctatataaatccatatagatatcatgggcttgagattttggatgagaattaactagcgtatccaactagggtaacgttcttaagagctaactgaacttaattagatactcctcgttttctattttctaaacggtgtgtttcataaaaaataagttattaatcgtgaaaaaaaaatcaaaaaatctattttctaaatttttaataattaatattaaactaatcatatgttaatcgtatttctggttttgcgtgcagctgatcacccacaacctatatgcaaaaaaagcgccctaatttcaccataattttctatgctaacataggacaattccatatttgatcgatcaacgagtcaccatatgagcatgagggaaatattcgccctaaattatctccaattccctttcggaagggaataagggaacaagccctagagaagaactaaagtcagctaggatgcttaatcatttattaatacgctcgagcgatgagccgctgcgtatctttttcattaagacttaatttatatataggtgacaatactacaacagaaaaaacaaactcaacaaaaacacgcacagaggtatatattaatctcacagattgtttgtgccaccgaattaagtactttcacatacctatcatgtccctcatggccttcccgttggaaaacctgcctgtggccacgccgccggggaagtcctggccgtacggcgggaagttggccttggacggcgtcaggcggttgttgttgttgcctggatcgacggtcgagtcgccgaagatgaagatggccgagatgttccgaaccggacttgcaagacagctagccggcggaatcaatatcgtcagctccagcaccatcaccagcaccagcatcggtcgaacaaaaaggcagcatccatggcgactgttgcttaggcacgtcatcgatcattgattttagcttgcttgagcttgatgatctgatcggttagcctctcattgctgcactggtgtgtgcgcctctctggggcatgtgctaccactccactagggatcgatgcgcactagatatatatgatatatatagtactcccttcgttttaaaatgtttgacaccgttgattttttagcatatatttaattattcatcttattaaaaaaaatttatgaaatatgtaaaactatatgtgtacatgaaaatatatttaacaatgaatcaaatgatatgaaaagaataaataattacttaaattttttgaataagacgaatggtcaaacacgtactaaaaagtcaacggtgtcaaatattttgaaatggagggactatatatagtacttcctccgtcccaaaatgaagccatttttgaggttggcacgggtattaagaaagtaggtgagaatgattggaggaagtgtgtgattggttgaaaagagaaagtaggtgaagaagaatggttgtgattggttgagaggaggaggtaggtgaagaaatagttcattttggaacaagacacttgctaaaaatagctatattttgggacggagggagtataggtatagccaacacgcttagttacttggacgtgctgcgacgtgcatgcagctgtgtcacgcacgcgtgtcgcaaatagtaggatgcggttgctttgtttgcatccctcgcgtgtcgcatacaagaaacggtgagaaaactctcgatatcctttctttcaatatttggtacccataggcatagcttgttccacagctcaccccacatcatcactatatatgtattaaccgtcagattttgagcagatggacccgattttttcacaatcaaactaaatcctggtcgaatctttccgatccctatctgactatcgcccatacgttcagctttccatctccctgccacacataacaaaaagttgagtaattaatagatggcaatggaagtacaagtgagcagtccaccccactacatataaatagggataaaagcggatcgaatacgatcggaaactgctctgtcatattcgttttcataattttttcgaaatcgaaatcggaatcagaaatctggatatgaaaacggaatcgaatattatcgaatacaaatacggagcgaatacgaagcgaaacgaatacggtgacgaatattatattaatcagaatataaaaacccctcactactaacaaacgatttttgctattgtgtttctaaattatgctctatcatgttattatgtttttactgctattattttggccattttttcttatgactttgttttatcaattaaaaatttgaattttaaaacttcaaataatattttgaagcagtaaataatttcagctgaaaagtcatgaacataaaagttgtacaactcatcaagacatacaacttttattttgatcatttcttaatccgacaaagtgatagtaacattgttcataaaatttacatctctctcttatattttataaaaccaaatgagagatatgcaaatgagagatatgcaaattttatgaacaatattactatcactttaccggatgaagaaatgatcaaaataaaagttatagatcttgttgagttatacaacttgaagttgatgactttttcagttgaaatgatttagtatttgaaaatattgtttgaagttgtcatacttttaaatttaaattcaaactgttcaaacaaagtcatatagaaaaatgatcaaaataaaagttatagatcttgataagaatacaactttgtttttgacaatttttccatttgaaatcagttactacccaaaaatattatttgaatttcttatattttaaaattcaaattttatatagttcaatcaaactcggatggagaaatgagttctacaactttgtttttgacaactttttcatatgagttcatttagtatcataaaattcaaatcgaaattcatttttgccaagaagtttgatttgcctcttctttgggttgggctgtattatgggccttatgtgtaagtcggatatccgatggaaaatacccgataatatctgacggatatctgatttccgatggatatcacctatatctctactactttaaaattccgtagtggtgacagtgactccaaccctgacggacacgcaccattctatccgtacaatcaccagatccaacggccagatcgatcccttcgctctcctcctccttcgcccgctcccccaccccaacccacagggttgttggatcacaggatcaaacggtccagattacgtcgcgtatcccctcggttacggatcgcctccccctccgccactcgcacctcgacccctcccccaccttctttgcgctctttccccttcacctccgttgcgcatcgcctcttccgccctcgccgatctgcatagccaccgccacctcgcaggccttcagtctttgccgccggccaccgctccgtctccctcccctctcatagccaccttcgcctcgcagttgcctcaagtttcatcaatcacatatcactgtcgcactgccatctcaagtccctcccgatgcaagcgccgccgacctcaaatcgataggaacgccgccaacaaccctctcttcaccatcgatctggcctcacaaggtggcgggagctcgagtgacggtggctgagattggaaggggagggaggagtggcgccacagctctccccggtggcccatcgtcctctcctccatctcctctccgctgccttcgcgctttcccacgcacctgctcacgccacctccattccatcggcgccgcagcactcaccgacgtgcatccaccccctgagaccccgctcctagccgttgcccatcttctcctcaaggccaccgtccggcaggtccacgaggccgttctggagtgcgagctcattcctacctagcgccgcgagacattattcatgcaatactggttgccccacgtatcctcctacaccattaagccaaggtgagaggtacgacgacctttcacagaaattcgatgacctcaactagcgtaagtgttccctctcttggtgcagtacttgctgttcggatcaatccatgcaactgaaaacaatcttgatctgaggcctaaaccagtgcggctgattatgcagaactcgactaatatattgttgtcatttctatgtagaggaaatttgaggtattagaattcagaatcgtaatgcagaccaccagggaaatgatgtgggatttgtcatcccataggtaacctttatgatttaccatgttacaaagttaaaccgaaatgataatgcaaagtagctccgtgtttattctattgcttcagccttcagggtcatggaaacgattctaaggttgggtactatgggagagaaggatagttgattgtcacgcccagaaattcataagtaatttccgaactaatttgtgcattaagaccctcgtccaggacttaaccgaggtacacaaactgacaatttaatatacagattcatcaaaataactaaagcaaataaatacttacataagaggcacttagtccttaccatgaagaaaactgcagcggaaaaataaaacctagcgaagcttcagctccactcccacaggcagctcaactgggatctaaaccaaaggtcttctccttctggatcctttttcttcaactgaggtttgatgattattgcaaggtgagtacatggaatactccgcaagccacacagcaagtatgcaagtgcacaaggataccaaaggatggcataatatagggttcatttgcgaaagcagtatttagcaaagatttaaaaatttgtaaaacagtagagtaattaatcatcaatattaatcaacactgaacagcacacccatgctgctcaggcccaaccaaacctgaacaaccaaccccggtcgtacagatcaaacctccaaaccaggaattatccattctaaaccaggagtcaaattaattatcacattgttatcattaatgagtagtgtgggactaatcacgaaaaacattgttagacccgcccataaccgcgggcacggctattcgaatagttttactctggccagagatgtaccactgtacccacaagacacgattccacacatgttgccatgccccgaagtaccaccacggcactgcaaatggggaaatcgtgacaataccctttgcccaacacaactcaccacagtgcaccattcctggatcataatcaccccctcaaaaaccagaggcatggattccccagcgacccccacggacctctcgccgcttctcagtctggcaccccgtaatgaaccaggctatacaaaaggtaaagctgttgcccacgctggcatgttgttggcacggttaatattttacaacagtagctcgcgaaccggtccttaattgtcatgagcacgaccttcaaaaccatgtgctcacaacccaccatatatcatattttaattatcaattaattatcataacacgattaaccatcgtgagctaccattaaatataaccataagtaatagtgaagcataatttatcccattaatgagctaatgtttctaagcacggctaagcaactataaataacatctagctgaaccaatccgatatataaggtcgatgctagtcaaattataacccataggaaaataaagccatcttcggccataattaaatgagaaaggttcaccacccgatgacattctaaaataatgcataacttgaaataaaacattagctttaaacggattcaacatgcttgccttgcgaaaaagcgtcttcaattcgtcttcaggaacttctccaacgaacgaacgatcctccgaaacaacggaaaactaaacctataacactaataaaaaccaaatgaacagtacaattaaagttcataaataggtagagcttgaatttagatgaattatgggacttgaacgacctcattccgagttcgtatgagttagatatgaattttacaagatttaattccaattaaacctattaaagaaaagactaatccaaattgattaaacaatttacagatgatttatagctgagacaaaagattaaaacatcctccgaaaatagattagatcgtaggtaacatatattaaaaaggaataatatgtcattgaaaagagataacaaaatttatattgattttgcaatggcttgagatgatgtggatgtcagcgataacatcatcaccggcggatggctctggatagcaacgaggactgaacggcgacgctccgacgataaggggacagctccgggagagagaagacgcgacgacgaactcaccaatggtgacggcgacgaaaaacggcaacgggagatggccggcgacgacaaatgatgacacaacggtggaaagcgagagcactaaagcgaagaggagaacaagacagtccttacccacagttgcatgatgatgggcgacgaacggcagccggcgacgagcttcgagcggcggcgagatcgggacgactgtgacggcggctttacggcgaacactggtggagaagaaggggttagggaaaaattcgggaaaaaggaggaaacggaagaggaggtcgaggggctgctatttatagccggaagagggagaggtcggctcgggaacggatggaatcggcgacggattagttaggattcgccggaaaaacggagctcgaaaccgcgtcgaattcacgcaatatacaacggtatttaaaggggtttcttagggataagatagaggagattgaggggaatccgtttttgcaaccaattttggaaacggagcacgggatgcaccggatcgagcggaggatgcggcgtcggcttcacggtcacgggacgggagagatgctggaggaggaagatggcactgtagcctagtgggccccaggggtcagagagaaagaaggaggagggagctaatgcagacttcggccaagggagaggcacgggctgcggaagggagaagggagagagaggagtgggcaggattcagcccagactgaggaagagaatttaattaactttttaatttaaataattgctgaaatgatctttcatttattaaaaataattccaatactcaaataattctgaaaaaaatccagagaatacttgggcatacaaagtattcaataaaattttatctagatcaagtttatgttcaattttttcatagattttattcacacacttgctttaattattaaataaattctaaaaattcctttttcacaacaatttataatttaacaattttcagggtgtgacattgatagaggggaacgacagtgaattttacactctgctactaataatttctgggatgctgttaatttaagatgtgctttctcaaacatccacagcgaagcggtgtgttgcggggatggcatggaggatttgagttgggcggagaggtgacgtggagaacagggggagggcagtggcggcgcagcacgggcttcggccaagcggcttgggcggggatgtggtgtcttggagcaatgggggagggcaggaaggggcggcaaggcgttgtgggaggctgtcaatgccatggctaggttgcagacttgcggtgatggtggtggcagcagatgcggagaaaaaccaggaagcgagagggggagttgctttgcattgtgatgggcgtagatgcaaagagaaagcacatgtttgcctgttatccgaaccattggatttggcgatcaaactatccatattacgtgtgtctgtcaggattggagtcactaccgccactacgattttttttaagtagtaaatgaaagccttatgtctcaattgacagagggattaatctgagaggcttattcttctaaaaaaatcacctactttttggctaataaacaatggattttgcatttagttaggcatgacctatctaaatggattttggtttggtttttttattcctctcacctaattttgtaatttaaggcaatatttgtgagcattgagaatagttgaagtttgaatatatgcctaatgagaaagtgtattacacctccaggattttgtatctgttaattgttagcttcatatgctgttaagcctgtcctggtagtgtatctatgagttttttactttgatgcgaaacggtttttctgatgtttgcacgtttcttcccctaggaggatgatatgcttcctactcaaatcgctattcagttgactaatgagtatgaatttttcccgcttctcatttaacttgacagtcttcttgatttgataaccatattttacactttctcctttcaatagctggattattgcagcggcacaattcataaatgacatattatcctattcgggatatttctgtctgtaagtgctaagttgacaggtgaatgcaaagttcaattcagtgcagtgaagaacctgccaacatatcaagggcgagggcaggggaagggtgctgagtgcttcgacacatttgcgcttccaggtaaaatttgttgctttttattctttaattgcaccttttgtttttcaaaggaagaaaattcagtgttttcctttcatgaactggattgtgccatcttatggtgtttgtgtaataagcattcttatatttggaccaaaatatgcagtgctgtgttcatctgtgcactgtagtatgtcattgtcagatcttccttcaaagtggatgggagctatctgtgcagataggttgacaaaaaaatgcatgcccatgttcagatttcataatcaatacatgtgcaagtttcagactattaaagttcagaatgatttatgcatgacatcacacattactagcttaatttatctcaaaacgcaggcctgcacaagcccaagttttagctccaaactatcaaactgcaaaattttcaaattcatgtgtttgtcaaaacataggcctgcacaatacattcatttttatttaaatgttccaataattgctttaaggtgacaaattttggttattttggctatcgtgcttccaaagttcttcatgtggcttctcatctcatttcattttggcaggctttagatcactctagcgtgtggccttggtgtactagccacttgccaggaaaaggagttgatggattatgtgggggtatgggagtgggagcttatggcacgagctggagacatggagagagattagcaggttcattagaagtgaaattgtagcagagatttcttgatggaaatttgacattgatcagaactatttatatgcaaattatgcggcaacatttttctcagtttacatagaagcttgtgttaacattctcgtctgcatagaagcttgcatggtccataacactatgggtagcgtttttctcagtttaatagaaattttagtggttttatcttcactctttaaagccaaagaaaaaaaatatttccttctggtggtgaaatcccatctttttttggctctaagtgaataaatgcttctttaaatcatgaaaattgaaagatgaactaatggttattgttattttattttttacccgttgcaacgcacgggcactctactagtcatattcgttttcatatcccaaaaaaatatccgaattcgaaaatttccggatatatccgaccgaaactatccgaatccgaaaaaaggtccggttggacgaaaattatctgaatcactttcaaccctacatataagcatgtcacggcctgataaatccatcccaagttaaaaatcactttctaaaagttataataaaaaatagtaaaagtctaaaagaaattcaaatactaaaatacgtccaagaaaaaatctaattgagattgaagtattttaattaagttctgcatgctctaaattggtccctcaatttttaattgagtttcaagagcaccctaaataatcttaaatcaacaactaccaattgcaggattaattaaaatgagaaaaccaaaaactattttcccataaagcagtatgttgatgacacttcactgtttatgcaagcctcagcccctcacctaatagctctcaaagctcttgttcagacagtttcttcatccacaacgttaaaggtgaattttgcaaagtctggtatgattccactcaatctagatgaacataatgctcttttgttggcctcaacttatggttgttctcttttgttggcctcaacttatggttgttctctgatctctcttccattcacatacttaggcatccctctcagtgcttcaaagccaaaagtgattgatttctctcctctcacagaccaaattgaaaggagaatatggttgccactttcacttcactttcccatggggataaattgactcttatactatgcatacttactacaagtgctctttgttattttcttatgttgtcattgataatacaagtgctctttgttattttcttatgttgtcattgataatatagatagggctcgtaggcattttctttggaagggtaaagatcttacaattggactagggtattacctctccttaagggccttaaccagtataatccacatgttattattgtgcaccccataagtattattgtcgatcactacaatctacaagtaaataccaaaggagattacaaatacttatgtaaaagaagtatccatcgaggtacaagatcatgaatacgacaactacggcgctcctctaggactctcccaaagataggcaaatatctccagaacatcctgaagtgaaatccgatatttggggcactccttttggagcttcccttgacactcttcttatattctaactctgctagagagtagcctaaatgtgttagtgagttgtactccacttgttttgtttattgagagtgagagcttctcctcattttatagaggctaacgacagttgtaggttagtggttaaggcagttaacacccttaaccgtcattggggacagatggggagttgccacatggaagctgatggttaggagtgcagttggtggttcggtcgaaccatatccaccacatctggccaccgtacttcgctatgagactggcaggtagacccctatggcagtgtacggtgaatagactttagttgtgtcaattttgcactaatttgtgggtcttccaatccgtgtactcacgtctaattggccggaggttatttcatcgcttttcgtccataattcacctgtatataaatattcaccaactcttaccactaaatatttttacctccgtttccttcctcctaatcatcatgatcctctccctccccttccgttctcctcatttctcccctttttctcttgtttccacctcttttttcttcctaatttatctccttataaatatattagttttgaaattatcaatgtttaagttcattccatctagagtgaaaaaaaactttcactaattgaataatcaacatttctatctttggtcgatgagagtatctttttaacaatatatagcaaaatactgatgcttgatgatatggaaagttgtacataagaattcttctgtgatggcgcatgaagtgggcgcaactggattgacttgtttttgctattattttgtttgttgtgtttcagtttatcatttaaactgcaagagtttatcaatcgtgacaattgcattcacctattacaacacacaagcatttttgctagtgcacaataaaaactaaaactaccataaattaaagaaaatgaatgttcaaattttactcctagatttaactacgaatagaggtttactcgaggtaaaagttttaatcatgtttatgtggacgacatttatggttaagaccctatgatatttttaggtttgcactatatattccctcttatcatagttcctttcctctatcaaaataacaagtaggtccaccctctgttattgaaaataattttcatggaatagttaaatctctaaatggaaaattcttgggtgtataaatatatatattcttacatttactccaaatcttataaatactcgagtataggggctaccctacaacatttcttacagagaaggctcaatatactttacacattattaatatcagctaagttattttcaatatatattgattttctagaatttcacacgctagctcaccagcatatatgttattttttcctaaataagagttatgattaatttgaaatcacttatagaatacatttatagtcgttgtatattccgtttaagcacatgtaatatataagataatatatttcatttacatcagatactgcttattttcctggataagcttatcaaccactatgtcgtatgccttttcggtaggatggaagctatcccagaaaatataatcataaacatttggacatgcactgtgatatttaatgaatatagcagcatttagcactgtgttgccgcagcatccatcagatgtatccttgaaacctgcataaaaaatcatcatgatgttcagtgtaattaaatatatttgactcacagaaaacccattaccaaagtctagttgctctatcacatgcaagctacgtatacacaaaaaactgtctctagtggtttaaatttaatcatgcttgcttgtgcaagctgcgagtctttgccaatttatgcaagttgagttgaacatatcttcgaagttagtgttcactacttaaaaaacacttttttagatagccccttttttttcaggtgggctaaaagaaaacttgtatgtaaaaggatttggacgatgtccagtaaagagtaaagagtcgtatgtgaaaatctattttgcagatctatacgtgaaaatatgtttattttcgtagacatgcctatatattaagaggtcagggttgtacggtgatagtatataaatggagtaaaagtcttttgtatacatgctcttaatcatacatatgtgccaagtatacactcgttttgatcaatacatttggtcggtcatgattagattttttttaatcggcggttatatagtaggttaattacacatctagtatatgtgtatattattataaatatagtatgcaaaatctaatttgtgtgcgtgcatagattagtcttatggtgcgacgcctgccgaagttgtccgattaatgctatcatgtacgcgtggtgtatgaatgcatacttttggtgcgagagttcagtggaaatatacctaacttatatatttcaaaccatatattacctaacttatatacctaacttatatatttcagatccgttgaactccactcaaaatatatgacgaaatgagtataatattaaatattttaaaatatttagaagtaatttacttaaatgctagaagtaactgaattctaaaatggaagtaactttttatagcattataagtaattacatatatgtgttaacagaaagatcttcgtatgtaatgtgtagattcacaagtaaatacataatattttttattcgaggtaagccatatatatagagagagagggagatttttgtttttcgataaaagcaatttatttcatctaggaagtgattctttagaaaatagatgtaactattcacagtattagaagtaactattgatattcgaagtaactttttgcactgtgtcagaaggaactgcactgctggagggaagtaacttaactaaaaattaatgtaactcttcatggtattaaaagtgactacactgctagaagaaactaacccttcatgctactaaaggtaactatgttgctagaggcaagtaactcatcgtggtattcgaagtaaaaacactgctaaaagagttaaaatcaaaaataaattttaaataatctgaatatatttaatattgtactcgttcgtcacatatattttaaatagagtacgatggctcaataagattaaaaaaatatacagttataaagatataagccataaaagggtttaaaaatactagtgcaatagtgctagacgatgtagcatataaactgcatggtgctaacaggtggatgcacaagttacgtgtgaaggagaagacgcggtatttctatttttgaaagtgttgcgcttatcgttatcgtgtctaatatagttgtagtagtatgtttttttagatctcattgtttatctaaaatgaaaagaataactaaagagaatttacaaacttaccataataaccaggattgtggatcaggtcgagcaaattgtagtatatgtcaaaataaacaacccttaaaccatcaatattatgttcgacatttagtcgatcgatttcctgcttcattctagtattaaataattctgatgcttgatttcgtaatggttcgcattctcttgatggaccagttctctgtgagggacaacaaccaagtggtggaacaccaacgaacccaatcatcttagcacccatctcattcattgtctgtacaagagataggtttagtgtgaaagaatgaaaataaatggatcatcccatgaaataatctacaatgtaaaaatgccaatatttattatctaaaatatgtacctataacgatattattttataaaatgatggcattattttttttaaataactcaatgcatacaatgatctggtgacaagtagcccaatctagctagcttgcaagtttgtaaaacatgttgaaaacgacgaactaaagtaatttcctaatggtgagaatttccatttgttaacttgctaaattaaattgtttctattaataagatgaaaacctagtgacaacgagatggttgaaatataacatgtcaagtaattctaataacaccaactcgagaacaagtaataaaaacgcgtgtatatcactcgttctttttaactgaaaatgagtttatatcactcatggaagtaataacacaacaatgtttatttgctagggatagaaaatacgaaataccacctccactctcaaagagatgttattggactttccggttttaaactttgcctactcttttttagcaataaattaataacaacatatacaaataatgctacattatagaattgtgtgatgtatttttcgtaaatacgaggaaagaattattgggcctttttaatccatttgaaggattcaagtaatagtcaactatacgaattattaaaagcagagggagatgaagatattcttacacattctgctgatcacagaaatatatgggatatttaaacgttgcagtgcttacattacaactgaaataaatggtaattttccatgtaatcaaaatggcttaaaaataatatggatgaaaaatagaataactatttaccagagtaaagttaactgcgttagagacaacaaagtccacgtagccaggaatgtcatattgatgccgcctcacaggaagcgtaaaataattgttgagcaagtcatttgctcccatgacagtaaagaaaactgcttctgagagaatacgtgtcattgcctcctctccgatcaaagatgtaagcttctgcttgtagtcactgaataaattgagttgtcctgaactcgatatggcagtctgcatgatcataacaaaatattacatatgcacatgtatacatcaattggtatttcacaattaacgaaatgtctttttttatggtgcattatgaggaaatataaatttgtttcgaagtattttctgagagttttgagctaataacaaaactataccgatatagaagtgaggggatcatatccactgcctcctgaggcaaaggccacaccagtaagtaggtcatttagttcaaggtcctgatctttgtaagctggcaatagctctttaatgcccaacttagaagctgtatgataacaaatattgaagtcatatatacaacatatagcatggttattttttatacggtaataaactcattctgttctgacttaatcttaatcaatgattaatccagtaaaaaaaatatacggacaaagaaaaaaaagacataactacaatcctgatttgctaaccatgtaacacaaaacaatctgatattgtaattatacggtatcgttagaaatcaaagtatgttatattttggaatgaccgaatatgtaataattgtaaagaacttgtatgtttgttgctcatctttcttcagatggaccctttaattttttttattcttgcatgacgcttctaaaaaaaattgcaagttgtcttgttcgtagccgattgcagttaggctaatctaggatgtatgatgacacatagagggcggttttaaaatgactaatgagtgaattgcacttttggtgaccttttcttaccaaagttatggtttggctcgaccacccttcactcaacccactaggaaattttaccaccacaattctcttatatatccacatctaagttatcctctgtcaacgaaccacatctaggcataactgatttcagaagagggcagcgacaatgaggtcacctttgaagctcgagggcgagcctcggcggagggcttggtgaaggcgactgcggcgaaggagaagggtaggggtgtcagtgatggtgaaggggaggagtagcctcatactgcctgagctagtggtgacacgacgaagaggaggaacgtaactagcggccgcggggaagcccttggttggcggtgacaatgctggccttgcgccactccaggcccgatgcgagggctgtgctaactggtggcaatggtagctgcgacgatgaccagctgctgtgaggaggtgagcaaggagggctgctgctgctgctacaagtgccttcatccgtgtggggagaataaatatgttcgaacccgatctggcctgcttctgatgtttatgtatgcttgtgaatctgggttggatttgtgaatacaaattattatggaacaacttgatttgtttcattttccaatcatgtgaattgttctctctctaatttgtgtcttgatctatggatatgggtttggcaactgtcattcataaggcagctgcatacattgttttttttttgttgaaaatattttttccagtcggttggcttcatatagttgcctgtaaaaaataattttctcacgtagtccgcttaaccatagcctgctgtaactataaaaatcaacttttgtgacctatctgggaagatcgtcgatttttcaaagcctttagtcacaggtggagtgcctggtcacgtaaaagatgtgttccatagcagtgtgtatcatttatagctaccaagtcctttccattattttttttaatcctagtgtagttcaatgacatcatcgtggcaaatcatataatgaacattattttaattgtagacatataataatttttagggataatctactccatgtcactgagtttgtctcagttcaataatttgccatagatattgatgttttctataatataccgacggcttcatcaattggtctccaatataccattggactgactattttcaaagacacccaaaatacccttaaaaatgtaccacgtcaacaatcgatttatctcagtagaagtttgaaaaactacgtattttagtgtagccttcttacacaacctggaagtttgtatataactttcaagttttcttggtattttttatttaaatttttttggcttatgatagtgaaattgcttacacaaaagataacaacacaaaaatattttttttaccatatgaaagatgatctatgctactttaagaggatctagtgggggaatagtgaatttgtcaccttatagctactcctattgtaaattttagaaatcaccccctgagcttctttatattaataacaatcaatctaaggatatcgatgcatagaatcaaattaaggtaaatgttttccatagcaacacgacaggtggaacatttcatgaaaaataaattttatctgtagcaaagcacatgcatttagctagtttacattaaaaaacaaaagcacacaaaaacttatacacaaacttccatgtagtataaagataatgtataaaaaggcatatttttttcaaaccttcttataagggtattttaggtatttttgaaagaaatgcaatacaatggcatattgtagaacaatttagtaaagtcgtagtatattacggaaattgacaatgtcaatggcaaatcattgaaccaggataaactcagtgatgaatttttacttcttatgtactaaaaatttataacatcttttcgcgataaatcttttcatatgcacgccataatatttttatgttcttcattaatgtacgcaactattataatacacttctatgctaagagattctttgcaacaaaggaaaactagatgaatttttgatgatttgatacctatgaatttcttttttactatatgatcctttggagcaaaggaatctctctctcaaatttctttgaaattcctgtgaaatgggctatttcatatgaattttggacatgaggttctacctcatgtttaattttctctttcgttgacacaaatttatgtgttatccaaactataattatgtaaccttcctttgattttataggaattcaatgagtaatgacactctattactgcattttagtgttcatttactaagggggtgtttggatccggggactaaactttagtccctgtcatatcagatgaatttggagtattaaatatagactacttataaaactaattatataaatgagagctaattcgcgtgacaaattttttaagcctaattaatccataattagcgcatgtttactgtagcatcacataggctaatcatgaattagttagacttaatagattcgtctcgcgaattagtccaggattatagaatgggttttatcaatagtttaaatttaatatttataattagtgtctaaacatccgatgtgataggaactaaaaagttttttagttccatctaaacagagcctaaggtgctctaaaaggtttattacaggattggctacaaagccaaacgttctgacaagtaaattaatcatgccacaagcccacaactaggcgaaatacattatagccctgttgtccgagaactattcataagtttaatggtgaccagtagggtagttggaatgtggtttgcattaaggtcgcaggagaaaaatatcacactatggaccgacggcatgcatccaaatgaacttaagaatatatttaattatatgaaactatcagactgcattgttttcaaataatttgttgttattctgaaattataaaatagcaattcgaaaattttcttatgcgaggaatagaaattcaaaatttgaaagttctaacttgaagttttgaggttgtagtttgaaaattttcaaagtacagtaattaaatttcagcataacttaattaatttgggagaatattgaattttaaacaaagttaggaatacttttacaaaaaatattatattctaaaatattcaaaattctcacaagtaggaataccctcattgggaaccaacacatgtaagagcgatatcaatatgatgttgtgttaattttgtaaaaaaaatgcacaatttacacaacatcatctgggtaaaaaaaaatgcacaagcatttaaatttgatcgatgacggtattgacctaactgcaactgtaattgttctgaatagagatatttaatttaactgaaaaatggttaaaacgagttgtaagatacaactcttgatagcaaaatttggagtacgacttcaacagatggtggaagcaaaacttcgtcaagaatataaatccagctgtattgaatttcaaaaagtgcgtgaaacttaaaccgaccgatgcgttgatccaacttagttactaatttaatccgttcatccggcaaataaaaaatacttttggagcataaaccgtggatgagacaaccggccgaccaatctaatgacaatgtgttgacctaccgccctgtttagatccggagggctatttaggag

SEQ ID NO: 11107 - DNA, 18804 bp, Oryza sativa
gattaatatacatcattagatttgtctcgcaaaataacctaggggttatggaatcggttttgtcggtaatctacgtttaatactcctaaatagcaagatttcggagggctatttaataacccggaggatccaaacaaagccgcgtcaagctagcatgcggcatcgctcattccattatggcccacggtgagcaaactaactgtgtcgcttggtgcgtgtaattaattgtgttgcatagggcgtgtggtgcaaaccaattaagaggtacttcatccgtcccaaaatacaagcatttttagtatactgtaaaatcaaatatttttaactttaactattagtagtaaaaaaataaaaaagatcaatcatataaaattgatgttattagatttattattaaacaaactatcataatatgtaactctttttatttaaaatatcatatttttatagatattggtggtcaaaatagcatatcaaaaactgtatgcaagtttaaaaatgcttatattttgggacggagggagtactctatctctatctcaaaaacatactcctacttaaaaacagaattagagaataataattaattgtgttacatagtgcaaaccataggacgtggagtactccttaaataaacatgctgtaaaccgaagctacacaaaatgatggtgctacgactatttagtgtcaaaataagcccgaacacgctgtcacagcttatatactttctctgttgcaaataagtgtagccccacacagtttaaattaatagagctgttcttattttggaacagaggaaatagctaaaaatagagcaattaagtgcagttacttaattagcagaaagtatccagagagtgcatcgtctataggaaggagtactccctccataaaaaaaaaattcaaagaccaatagataaatatttgttcggagctattctcggaaattaatttaggagtacgtgtgtacgtgcgtagtagtacctatcaagtcaccggggaccttgccgttggagaatctgccggtggcgaccccgccggggaaatcctgcccgtacggcgggaagtcggctctcgccttcgttagttgcccgttgttgttccctggatccacgatcgagtcgccgaacatgaagatcgccttgaaccggctactcacctgtgcctcactgatgcctggtgcaaccccggccaccaccaccaccaaaacccccagcagctgcagctgctgcagcaggaccaagcttctaccgcggcagcggcgacacaagtggccggcggcgcagaggccctgcagctgctcccagcaagacgccattggtctctctgcctggaccagcggaatgtgcgttctcctgccgccacagcactgaatatatagtacagttttctttagctcttgccagtcagtatagtactcctctgcaactacgggccagagctagctaatactgcttctactatcaattggcatgatacggtggttgtcagttaagttcattcattgcagtgcatgggatagaatgcacatggcaccatgaacccgatcaacgttttagagacaggcaaaagcacgggcgcacgagagacccgctggccctcgtcaatttgatgtgtccagcccagaatctcaccagttgtgcacttgtgctacgtacacggtataaatagattaggacgtgtgtgtaccaatggaagaaccgatcgaaacagactcgatctagctagcagacgcactaaaattaatattgtacagttacatccatatgttttgtactgtgtctaaggctgtgttattcccccatctttttcaactcaccttcttcatttccatgtgcacgtttttcaaattgctaactggtgtgtttttttaaaaaaggtttacgtaagaaagttgttttaaaaatcatattaatcaattttttttaaaaaaataataaattacttaattaatcataagaaaatgtgttgctttattttgcgtgcgggaaaggtgagttcccaatctcacctcctaaacacaccctaagaaggaccgtcaagttgacccaaattaatattctagacactgatggatcaagaagaaaataacgaggggtttcagtaaacttgagaaagctatatatatctcttcttcgtatgtatattctgtatgtgcatgtgataaaaagttttattggggattttatggtggtcctattgtcagccgtggaggcttgagctttcgtcgccctcattctagatttgcccctgctaggcagcgataggtttgtagtgtaaactagctgcatgatggcattataaattgttagtgaagtagtagatgccaaatcggatggtaataaatatgatttgggagtcgccacaaatagtcgatcaattgtcaacctcatggagaataaagctgatgagcggtaattgtcgacccggacgagccaaatcatgggcgtcatgaatgcacgccgagtacactgctacagctcgtctcgcctatagaatgagaatcactatgatgggcaagcagcatcagcagcaacagaagatggagccagtacttacagttgttgcactagcaagagggctccacttctacgaaaatcatctttcgtggcggtcagtttgggttttcgctggcggaatttggagccgccacaaagcaaaggctagtgaaaaatcaagattttcgctagcggttattggcccgcaaagattaatttttgctggcggctggcttaagacgaccgccagcgaaaatgtagtttcgctagtgggttacactgagccagccacaagagaaaatactagccattcataataaattcaacagattcattcacaaatcacaaattaacatatccattcacaaatcacaataaaataccaaaaaaaaacattccatccattgttctctcaaaaaaatccatccgcctcaccaccgcccagtccgtcgctgcgccagatctgagagagggagagggcaaggggaggagcgggggagtgggggagagagacctgggaccttgccgtcgccagatcagccgcccacacgcctcctcgtcgccacccacgcctgagctcgccgctcctcctcggcctccccgccgccgtcgccgaccgagcagcaccgatgtgtgagccccatcgccaagcatcaccgccgctggcggctccttctgccatcgccatcgcagtcttcgtcgtcgatgccgtgcccccggacgaccgcctcctttaccgcagccagccgttgccccttccccgctgctgccgtcgcccccagatctggccgccgtcgccctttgccgcagccggccaccacgggggagacgaagagcccgccgccggaccatcgcccgccaccgctgccagccgccgtccaccccaccgctgccatcgcccttccttgccactgccgtcgcccctagatctgccacagccagccgccgctggggagaggtgggagggagaaggctaggaggaggtgggagggaggttggggagaggtgggagggagaaagccggagaggagggggagccgaggagacggagcatggatttttaatagcgtggagcgttgggggggggggagaggcggtgcatttttaatagcggtgaaacatatattttttgtagtggtgctcttcctggtccgccacctaaaatcaggttttctgtggcggacacttaagaggtccactacgaaaaatagagtttcttttatgacggatctcttagtgtgcccgtcagcaaaaatcggttttcgttggcggtccgtaaccccccctcgttatatttttgttggcggtttgtacgtattgccgccagcgaaaattatagggtaacgctatgaaaaatcgttcttctagttgtcctcaatccaaaacaataacttctacttatccaacacaataaattcggtctacttatcggcaaatactactgtatatatgttggtaatttttttttgacaagaagacaatcatgactgggacacataaacaggctagccagctcaacctagctcaagatgagttttgatagattaaaccggctagcagggccgatttagatgaaacaggcggtaacactcgtctcatgggcgaacggaaagtgtacgggacaaaactacaaaaggatttcgcactctcacagtgaaggcggacgatttacagcacaaattgacaaagatggacgaacttggctaaaactaggcgaaaagtagatgcaatattgaaaaggtgattcaattggctaaattgtgctgagagtagattatacctccgattgaactgaccttgtccctaatataggggttggtctacttagagtccaactggtccccctctacataccttccggaacaaggaaacccaagacccgacaatatgtagtggagtcggggtcagactttgccggtctgaccgcccacacaccgtcggtcaaactggtccataagcagcggtctaacctgcttcgtgaacaatttaaaaataaaaaaatagcgtaattgtttgtaccttgtggtgtagctttaggttgtgttgggtaataagagttgggaactcaccccaagcatgcacaatggaacgatgaattagcacatgaccaattcaatattagtgaaaacatttacaaattgattaatatgaattttgaaaacaacttttcaatatatctattcacaaaaatgcatggtttactagttagggaacacatgcgcgtgaaaaagaagggagcataagttgggaaaatgtagtatgtgttaacaacaaaattttgctgccatcttttcacatcaacggtatgtaacattgccttaagcttaagatcgcccatagcaacatcttaatttaagtttatcttctaatataaagaattgtactataaatattaatttattgtttaaggttacctttacgaggaaagtgaagatgcacttaaagcgggtacattagtcctgcataaacgggctataaaagttaacacgtcatttctatactatgacagaggaaagagagtgctaggaaagagaaaaactcaccgccacaccttgagcacgttatgtgcaacccgtggcggcacccggagacgcgtcgtcgtagggagtggtagatgccgctattggtaattcttatggtcacagataaaatccgcaagcgcactgatataccaatgtagcacttcacctacggagtattccaagggtatcgaatcgaagggaacgtgtgtgattaattcttcctccggttcatctaaggacaccaagcaaagaataggctaggatagagaggatttaccagtgagaaacagtgtctaggaaaagcttaactttaatcgtaacgtgatacttgaggcactgggaacccgctatttccagatatcgctctactacatacctggacaggaaggacttaagtgctcttgagggctgtcaccacctctacctacctcaaacgtactgtgggatacgtaataattactggataataattacctaaacaccacgtctaagcaattaatatataccttagtgtttataactcaccaaagcaatcactatattttagttgattatagtgacaaaaatcccatatgctatttacgaactaaccaagagataattctcacaagataaatctaaaatactcaggaaaaataattctattaatatcagagttatgaatagaataaaagaaataagagaggattaccgacagctccggaattctcccgacttcttctactctactctcttcctaattctagtatacaaatagtacaatagagtctcttgtaattcaggtgaagctcggaagtgtctgaagaagtgaaggagtgaagctccttttatagagcaggtaatgacggttgtggatggggaattgtccgaagtgccctgcaaccgccattaggaatgcatctgggacgtccatgccaaaccataggatcgacggtggagatgtgagttcggctgaaccctggcctggcccaacaagcccaggatttggcctgtggacttcccctgacctgccttatccttttctgcaaatttcgggctgattctttggaagttaaaaagcctactcttgaatgaataagttccttctccaactttagtctgattttcctcccaacttctaggtttaccatctacatacaaatatatactaacacttgtagaaaatgtgagatttaacacctatcagtatgttggatgttttattatctggactttatgcagatgttggtggtatataatcggcatttaacagccgccaacaaaaccccccacacttagctttttactcatccctgagtaaatattggtgtagaatgaagttttccaagatataactcaagcatataaattattcaaaaccatacctatacctgtgaactttatcagtggctaacttaccatcttgggtaattggtaaatggaatggtcttgattccagtccttcttacttcatctatcaaactcttgggattttatgaagtttcgcaaaacaactcttttcctcttaatgactttttctctatcactcaagtatttttgactttgtggatcctcaccaaggcagattgtgccatattttatccctattttacaagctgatatgttgggctcggtagggataaattgtgacatacctgcatcatatatattgcaaagccaaatatacagactcaggaagattattagtcatacttctagatcaagggtctttatttgaggtggtaaaaagaaaagttaaatattttgtgtaatggtggaatagaaatggttctcctttttcctatactttcttctccacttttccttgcataaatatggaaggggcatggctactgttttttttcatcatgctcaatgttttgagggcaagctttatttctctctttttttatagccatgcctttccctcctttttttcattttctttcttttgccaaggttttttaggagaagaaagcatagtctgaataggagtttatttgaatgatttttttttgggaagccaacttccaatgtagaagcttagcttgattatatatatggaaatgaaaatgaaagtggaaatggcctcttgatcatgagagtatgaaggatatctaacacgagtcatataaatttgacaaagctgcaatcatatgcgtaataaggtttatcattgatatacttgcatatggccttgataggtataagatgaagtcaattagaggaatgagcattgaaaaagaatttttattttgaaaaacaaattcccaaaagtcatggcaaatgtagcaagattttctttcatctttaaccatctctcatataacaattacttagatgcataaggttccctaacatggatggttgttcacaagtaacaagtttagctaagaataaaatatatacaagattaatcataggaagaatttcattagttggaaattttatcttttcaattttgcttgaaccaaatattttctaaattcccagcccttgtactatgcaatggtggagatatataggcagtagacgtgctcacttgcttacctgtgaaaaatgagagtgattggggccagtgtgggttcggccgaacaactctagtgcccaatcactctgcaattttctgcagagtccagtgcacatcaggtgttcagatattcagtctcattttttgaatttgcatgtcaaaaagccgaggtatctcccccacttttatttgaaacctaaactttattaatcatgaaacaaaaacaacttggcaaacattggtgttaaaaccaatgagccacattatttgagaacaaaagaccaagcacctactactactttattcatgagaaaggagacatctatttagcaaaatacttattctccttctccatctctatgaatgcacgctttatctaagcgcacaaaccgcgactaagggtatctacattattcctaagctcagcaagctctacctctagctccgcgttgctgtccctaagctcaatattctccttgcgaagtttgttcacttgagcagcgagcttatggaccgagggctcctgcgattttacttcattatcttcgaattgcccgggcgccctcatgataggaggaggcatcgaatgacgcttcaccttcataggtggagggctacgggactctgctgccccctccttctccgatgtcgtcaaaggccagagtaagctattgccatacccaccgccgggacttcgcactccccaattgcaaaaacagtcccccttagtggtggatggagtggcggtgggtgtggtatacttgtggagcacctcatcccctaccttagtgtaaagagtgcccacataccgctcagcggaaggcggagcggccttctcgtcgtcttggaaaagacgtctcgccttcaaaagactgagctcgcccatcgtcggccatcgtgcaggcgaatcaccccgcacttttgtctttgtgacatggagggggggagagggagcgcactgccgaacggggggccaaacgaggccgtgatgggttcggccaaaccgagggagctcatcgacgggctccaaatttgctggggagcccggcaccgtcgcaaggggttgagcccagagtgcgttcactccttcgatcgtgtagtttttcaccaggatcaattgattcacccgtgttggctctcctttaaggttataggtgtagtttaaggtggagccaatgtatggcatgagagatttgccagctatgaatggcacaagttgatggatcaaaggattgggttgagaggagattgagcaaattggtggaaaaacttttgcaaaggaggaggaagaagaactaactctgatgcgtgatccgatcgttctacctctaaacgcgcatctaaacgaactaaaagtgagcgggggaaacgatcatttgaaaatgggaccaaacgggcgccgccgtggtttggccgaaccctggtgggtccggctggccgccaattttctcctgggcccagacaaacctaagctaagcacaaaaatgacaactatacaggaaattaagcatgttttagatgagatcatcatggttcataatcaattagttcaataatacccacttcatctaaagtttcattcggctcaagaaaaatctttaaacgttgaccgtttaccttaattatgttacctgagtcgtcgcggagtgtgattgcttcgtgcgaagaggtgtcgatgacgtcgaacggtccttcccatttgctttgtagttttctatggccgaatagcttaaccctggagttgaacatcagtaccttgtctcctggcttgaatttcttgttctttattcgtttatcatgccagcgctttgtccgctctttgtatatcttggagttgtgatatgctttttctctccattcttctagttcagctaactgcattttcctccattctcctactccctcaaaatccatgttccaatttctgatggcccagtaggctctgtgctcaagttctacggggagtcggcatgacttcccgtagacgatctgatagggagacattccaatgggtgtcttgtatgttgtccggtatgcccacagtgcgtccgacaatttctccttccatcccgttcccattttgttgaccgtcttctgcagaatgttcatgatttgtttgttcgatgtttctgcttgactgctggtctgtggatggtaaggtatagcaacattgtgtttggctcccatgtctcgtaggaggtctcggaaggttttgtcgatgaagtgtgatcctccgtcacttatgaccatccttggggtaccaaaccttgggaagatgatttctatgaacatcttcttagcatgattcgcatccgtggcactgcacggcatagcctcaacccacttggagacataatcaactgctaccaaaatatactcgcaattacgggatttgggaacaggtcccgtaaagtcaatactccatacatcgaatatctcaacttataggttgtatgtaagaggcattgcatcatgagcagtaattcctccttgccgctggcagcttgggtatcttctaacaaattcctttgaatcctcatacattgttggccagtagaaaccatattgccaattctctgcctggtgcggaatgcaccataatggccaccataaggcgaggcatgacatcgttctatgatcttaagtcgctcttcagttggcacgcatcttcttaataaaccttcagagcagaccctgtataggtatggctcatcctatatatgacggtagctctcggatttcagttttctttgattttctcccggtggtatgtactttgagaccatgtagtttactatgttggcataccacggagttggagtcgcgcaccgtcattagcatgtcatcttttagaaaatcatttatcggttgttcccgcatgttaataatttgcagcctagacaaatgatctgctactaaattttctacttcctttttatagttaatttctatgtcaaattattggagtagcaaaatccatcgcaagaggcgtggtttagcatctttcttagcgagcaggtattttagagcagcatgatcagtgtaaattatcacctttgctcccaccaagtaagatctaaacttatcgatagcaaaaacaaccgcgagcagctccatttcagtagttgcataattcaacagagctcaggttagagttttgctagcataacagattgcatgatgctttttatccttggtttggtccaaaaccgcaccaacagcaaagtcgcttgcatcacacataatcttgaagggtaatgtccaatcgagaggttggatgattggagcagagacgagtgcctttttgagtatttcaaaggattttaggcacgcatcgtcgaactcaaagggagcatccttagctagcaggttggtcagtgctcaggcaattgtagagaagtccttgatgaaccttctataaaagtcggcgtctcccaagaagttatggatcgccttgatgttcacagcaggaggaagttgatcaatcatatcgattttagcacgatcaacttcgattcctcgctaggacactcgatgaccaagaacaatcccttcacggaccataaagtgacacttttcccaattgagtaccaggtctttttcttggcatcgtagcaataccttgtccaaattctatagacaatgaccgaaggtctttccatagacagagaagtcatccatgaagacttccataatgtccttaatcatgtctgaaaaaatggacatcatacatctttgaaaagatgaaggagcgttgcacagtctgaaggacatcctacgataagcataggtgccgtatggacatgtgaacgtggtcttactctggtccttcgaatggatgggaatttgatggtacctagaatacccatcaaggaaacaaaataatgaacaatttgctaaccgttccaacatttcgtcaatgaagggtagcgaaaaatgatcctattttgtagccttgttgagcttcctgtagtctatgcacatcctccatccggttatggtttgttgcgggataagtttattttgagcatttgcaacgaccgtcattcgtcccatcttcggcccaacctggactgtgctgacccactcactgtatggaacggtataaataatcccggcatgcaggagttttaggacctctttctttacgacttctcgcattgcattattaagccgtcattgaggttccctggagggaatactctcaggcttaatagggatacgatgagtgcaaagtgcgggattaatccctctgagatcctggagggaatagccaagaatggcacgatgcttttctaacatagatagaagacgttgagtcttgtcttcagaaagcttgtcacttatgatgacaggagcttctttgtcgttgtggaggaaagcacagcgcatgccttgaggcagatatttaagctcaatcggaggtcgaggcggcggttccatgattggaagctcgagtctctttgggttccgcttcattttccagaagggtctcgggagactcgtgaggggcaactgccgtaacctcctccgcatactcattctctaggagtgagtcggtcaaggcgaaccttgctcgtgataatggaactggaaattcgttccctcccaaagttatcttgaggctatctgatcggggcatgtttatgatgagttgctcaatcggcagctcaatcagaatgtcaaagtcttggatttcaaagacatagaaatccaagactgcctccctatcttcaaagtagacagttatgtcttgtacaatcccgaatccttctacgaatggcttgaaaaatttccattcgggtgcttcaaattttgtttgtcggggttattgctttatcgcttaggtaagtgaatgcaaatgcgtcgaagacgagattaaccccgacagttgggctgtaaaggatactgacatcgttcccttctagatgacaaggaataactcggggagcggtatttatcagaattacttcggatgaaagctctgcctcccttagccattcgtcactcattatggatgtcagctcccggacagtttcccttaagaacccaagttccaaaggatcggtaggtggcaaaggaacgatcggcttctttttactgaaataattcagggtgttgccgtaatcttcatcaaaaccatccctgaacggaattgcggcacgatccggagtctgaatttctttattctcaacgaatggcggctcgggaacttcttcatcagtcgagtcggtcgatgtggaaggttcagggtgtgattcgactgttaaaggctcctctatcttagacacggatgcctctagtggaggttcatcgcatggcgtcataaaggaagtattttctataatgcggtccagaattacttttccttctgacggcgttttatgcatgaatgatcctccggcggttatgtccagatagaatgtagacaccttacctaaacccgtatgaaaatgttgtaaaagcacatactcaggtatagataaggttggtccagactaaactaaattgaagggctgtttttgtgtgtcttctgcttcggctgatggaaggccatatgcttgatagtgtggaactcctgttgcgcaaaaaacctggtccttttccttttgtctgtcttttttagtctttatgctgtctcttattgtctttcttctctgaaccttgtaagctactatggcctggtttagttcccaaaaatttttcaaaaaacatcacatcaaatctgtgtacacctgtatggagcattaaatatagattaaaaaaaataattgcacaattagaggggaaatcgtgagacgaatcttttaagcctaattagtctataattagccataagtgctacagtaacccaaatatgctaatgatggattaattaggcttaaaagattcgtctcgtgctttccatacgagttatgaaattagttttctctttcatgttcgagaaccccttccgacatccggtcaaacatctgatataacatctaaaaaattttcttttcgcgaactaacatgccctaagtttcatttctggtaatagaaataggggcaatcgcccttgctaaaaaaatatacaagatttatgtagtatcagatatgaaattcaaagtgtaaaatatatgttacgaaatctactattttgaaagaatatcactccagttttggtaggcccgtaaactgtatccgatatcgatcgttaattagttatgggcggtgaagatgcatggcacccacataccgcggtcacgcatattattcgcgcggtggtgtggacgggatgacatgcgcaggcttgggcgtgctcaagaattgcggtgaggaggaagcgcgcggtggcggtggcgcgccatcccgcagcatatgcttgcaggcgacgagccaacagtggcgcacggcagccaggaggttggagccattttttgggtcagggcaatattgatggacgtctgcctgcggaatgaattctctgccggtgatccgtcggcatctacggcgacgtcgccgtaggcacgcgagacgcgaccgttcatcattcccagtatttatcgtcgactgctgactttgcaactaccacatgctaattatttgcttttctttgaaactccatactacaagggcatacagattacgtactccatattatatacatgcacgcgagtgccattttattctcttcacacatactcgaataaatagagaatagagaaaccagtgagctctcaaaatttctgtttcaaagtatacgtgtaattattggcagcgttttaatacgcagccccgtacgaaacttcccgtttgcgactggaaggggatgatgatgattaccgtcgatactgttgcataaatgagcctgatatatatacgtggggactccaggcggcatcaatgcgggactatgaccgaatggactggtaactaattgattgtcagctgatatctgcggaatcaagacttctgtttttcatccgacttccgagcacatgcagcactcagacccggtttagatgggactgttttagttttaagtcccctatcacatcggatgtttgaacattaattataaatattaaacgtaaactattaataaaactcataattttggactaattcgcgagacgaatctattgagcctaattaattcatgattagcctatgtgatgctacaataaacattctctaattatagattaattaggcttaaaaaatttgtctcgcaaattagcttttatttatgtaattagttttataagtagtctatatttaatactctaaattagtgtctaaatacagagactaaagttaaatccctggatccaaacaccacctcaaattccacatctaagcacgccatgatatgaattctatttgtaaccaacatggccaagcccaagtaaccagtcaatccggtttgtctgcgctgctcaacaaaataaatgtactgtctgcttaactaatgtcctagagattaatgtacggtagtatcgaaaattgagtggtgttggttttcctttcctggtgaacgtgaagctgatgcaccactgctatggaaaacaaataaagacttgtcgcactaacaatgattatcgtaccggatgagttaggatatacaattccaattcgcaaaatgaaagccaatatctgtattcaagtaatatttttcgctaggatcagcgcttagggtagcatgatgagaagatgaatattcaaggtttgatggcaacactactaaaagaaaaaggctttatgcatgtgttgatgtaaaaacatgaggccttggagatctgcttaaatccagtgcaggtccaaaagcttgcctttaggtgtacgagcgtgccagttgatttgatcctgcaatcgacaagaaacaaagacaaagaaaccgcggttaaatccataaacgatagccgatcggctagttgccgatgacatatcatattatctttgagccgatgtcatatgtgagtcgatcggcaatcatgaataagtaaaaaagaactaaatctactcgatcggatgtagatattaacaatatataatccttatgtcgatatatacttaaatcaagtgattgggatagatcagtcgccatgccgagacagtataaatcacttggatcgaaatatatattaacaacaagactatatatgttcgtagcataaccgatcagatagatctagcatgtatcagctaatactccgatactactatatattaagatattaaagcaagtagaatataccaaaccgaagcctaatatatttaaatgcaacaagatcttaacataaagggcagatttaacatgtcaattaagcacacaagataaatattagttaaatcaggtaagattggctgaaaccccgatgctaccctaatcggcaaccaaaggcaggctagagattgagattctaatcacgcctcataagatcaaactcaactgatgcagctataaatatgaaaagaaagacaatatctacataatcaagctgttgaatgtttcatagagtggtagatatcttatataatataagtcaacgttaatatataacctaaccggctaccttctagtaacagacgctagccgattgaaggttagatagcaatattgccaaagattatgtaagatatatgataactcaatgaattacataaacaatattagagtatcataaaaatagaagcactaatcccgagaacgcaagccgccataacaaattttacctcttgttgaagatcgaaaccgatgcagctcaaccccaaagcaataactcgtcgaaacaaaacgaaagtaaaagggtggcgatgcgccgagattgtatagaacgtgtgttagattgattacatggggctcagggtctatttatacccgagattacaaaatatgtccatatcggacacgactcctatctctaacaaactttaagataccaaaagtctttgcggcagaattttgcccaaacatatctctaaggaaattacatgaaatatcctaattaatagatacaattgccttcctagtaccctaaccatgcgtggcatcctcaagaagtacatcaacccaacccgacaatgtatgtcgtgtcatattgtcagattcgaatcaatcggctaaccttgtcctactcggactatgccgatcctgattgcagccgattcggactccagccgatccttactctgtttccggaacgatctccatcttgaactccgtttcaattccttcttcatctccgatacttggattaccaaatttggtcattaacaatgtgccagttgtcaaccctagataggcagcaggcagcatctttgagttctctcaaaggtgttggtttagttttagtttaagaaccagcacctttgaggtcctaggaatgaaaataaaaggccggctcgatgtatcggctcgattcgagccaatgcatcgagtaactcctattcaccccaaccagattttgtcacattggtaattgcatattttgtaatctagggtataaatagattacttcggaagccaattaccaattactcgattcgagccaatgcatcgagtaactcctattcaccccaaccagattttgtcacattggtaattgcatattttttatattggtaattagcaaaatatttagcccggcggcgactccctccccttcgccagatctggtgggaggagaagcggcggcggcggcccagctgtgctctcccctcccgtccccttgcttgtgttgttgatgttcttgtatgcttaatactcttgcatatcttcttcttctgctggttacccctcctcgtagttgtggattcacggcttggtgttaggcagtcttgtgcctaggctgtgcgagggaaatccattgaggtggagtgctatctctgcagtaaaatgagacatctaagggcattcacagtgcgtcacacaagtctgaggagcctcacaatgccacatagaccaatgctacgagtctaaaatctagattcttcacagtgcaagtggctctatgagtggcttaattttatatttcagcccctaacacctttttttagttctattttttttttctatttgaatagagatacaaaatttacaccgaacaccctaaaatctagaaaaaaaaataaaccacccactccccctccccctctctcctctatcccttatcctctccctcacgagaaaccgtgcgtctccccccttctttgccaggcgcgcgtcccctcctcttgctccggccgtcgccacctcccctcctcctccagccaacgctgcctcccctcctcctactccggctgccgctcctttttcgtcatcggcagcgccgctcctttccccggcggtgggatcctgcggcggagcgtggccggcaagcttctgtcataggatggggtggcgcgtgtagggtgacgagctcggggggagatctcgtggcatcgactgtacccccacccccaccagcgtcccctccatgcaaatcgaggcggcaggccgacgtgctcccctgcggcggcgcaaatcgactgtagccggcacggagactatctcactctccagatccggccagacgtaaggtggtggcgatggcggtggcagccttgttggcaatgccttcctctctctttccgtggatgtgggattaatcggggtgagggcgtgagaggaagaagagcacgggaaaggaaaagatggtgttgggggtgttccctcgctgaagacacaccacacgaggctccgtcctccacaacgtggttgcacacattcctccatgcttcacaagccctcaggcgaggtgaagaacgagtgtctagttttggctcccagaacttcgtttggctccgcggattgttgatgtggcgccgaatattcggttttctgccgtggggtggaaccgcacgtccttacactatgaatgccctaagagaaagttaaattctctctctcgctttacctttatcggttccttatagctgcatgtgacgtcattaactcctctcctagcctagttagcggatcccaccttttcttgggggcttgtgtgcagcccagctgctaaatagtcactcgcttgtcctttctcttagagcaggtacaatagcaaggtattagccggctataaacatattttaatgagataaacaatgagagaggagaacagcaggctatagatctgtaccaagctgtagcacgaactccaagacacaatgtgtgtatgatatgtgggattatatattaatagtcccggttggcaacaccaaccgggactaaagatctatttgtagtccc

SEQ ID NO: 11108 - DNA, 16117 bp, Oryza sativa
ttttcttttcttttttggagaatctgagattgttgtgggatgtatttgatttgtgtgtgatctgaatatgtgataaattttgtagaagttgtgatgtaatttttttaagattttgtgatgtatttgagtatttgagactatagatttgtggatttggaggcaatttgaggatgattgatttgggattttgggaacgggatggggtgaaatcaatatatttaaaaacaatgaagaaaagaaaagaataaagtggaactggaaagagcaaccggatctagcctgtttagtactaaccaggacttaaaaaatgctttatctttagtcccggttggtaacaccaaccgggacttaaaaatggatttttactcccgattttttttacccggaactaaagataatgatctttaggaaaagcgggactacaggggttacaaaccgggagtaaaatccccttctccaccaatggcaggcctttcagccctgtagcatgcaattggcccatagtatccaccagttggcatttatcaacttgcctgcttcataaggattaacgtgatacgctcaatcatcaagcatacgaatcgtccatattataataaaactatcttgttttttcatgtacatgcatattattttttttcttcaagcagtaataaaatgagcgtatagatatattacatatatggatggcagttttatttaggcttgcctaggccaaattcaagctccactcctacctcctctcaaacgtagccaaaaacccgtgagttattggacttgggggtggagcccaatggacaagggggttcccagctggcacctggctcaatttacgtttttactgtttaaccccatgttttgaccttatgggaacactctctaggcatctcttggaaacgctcttagtgtatcccttgcgagaaaaagaccaaggtgaggggggtgtcgaaacaagatttcggcaataataaaagggtgtggctattacgctggaaaagtggatgggtttagagacaaggaattttatacaggttcagaccttcttaataagaagtaatatcctactcctgtccgaggattgatccgccgagtgcattgttgatcgtatgatctgggagcaaaaatcgtaccccaaggggcacccggacccctccttatataggggaagaggtccatattacaaagtacaacccatatccctaacggaataggtagttacagaaaaaatataatcgtaaccgactagaatctcgggtatttccttggcatacaagtttggaatttaacccgagtccttttaaagatattctatctatacatggcctcccatacccagtcggatatacatgccgtgtaggtatggggtatccataatctctacaggggggtggccggcccaaatgctgaggcgcgtggtcaacgaggtagggcagcggctgcgtcgattggattgtcgattcctagctccccccacgacttatgaagcgttgcccgtcctgttccattctttccctttttccctcttcctcatcggaaccgcttgaatcactcgtgtcaatcgcctactgtggagattatgggtaccccatacccacacggcatggttatccgactagtcataggggatagtttatatctatggaatatgtaaccgatcatgacttgggtattacgtttccttttatattatggagcggcctaaagtcctgatttgataatattgtaaaatagatttaggaaaccgataccgtattggttaagatttctatcttgtaatcctgccccccatcctatataaggtgggaaggaggccctctagggggcatgacacaaactgatcgtcagatcaatatacacccggtggattcaaatccccaaacaggagtagggtattacttatcattgagagggcatgaacctgtctaaattatttgtctccgcatccatccatttttaggtctcgtgcgctacccccttttattattgccaaattcatgtttcgacagttggtgcgccaggtaggggtgcatcgagtttcccgtcgatgagtgcgatggaactaatctccggcgttgccagattcgtcaagcatgtccttttcgtctcggatttgttggaattaatgaatgggccttagcccactcgaagattaattctttggaaaatcacaaaagcccacctcatgggatggcatgcatgtggagttttgtaccaccttgcttattctaggagagggagacctccttaaaaggggggatgccctcctagccacttgaagcatgtgtggtggagagaagaggggaaatacacgcgcgcgctcgctcgcctcgcctggcctggcctggcagggcagggcagggcaggcggcgcgcgtgcacgacgtatgcgtcgaatggtccaaaaaattggctcctcacccttgcgcagatgcagcctccttttgcagttttgttttgctgcaaattcggattcgtttttgttttgaaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgaccgccgtcttcacgcaatatatgcgaaaatcaatctagggtttgcctcctagactactccatcccgctcgccggcgtgcatcagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgttccttcgtagacacctgcgaaaagtttcgaccaagcagccggtcttttcgtcacctcggtacgtgttcaatatgttgcgcatttttgatctgttaatgttattctgcgtagtttacatgtgtagatctaatgatgcgttcatgctagttttcatctgtaatgtcatgatttatttatggaataaattaaatcattatatgctgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcattcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagttgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctctgctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaacaaggacaaaacaccatatgagatatagattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggtttgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcattcatcaaatggacgttaagacagcttttcttaatggagagctggatgaggagatctatatggatcaacctgatgggtttgtacttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtttcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtagaattggggcttcactatactaggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggttgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatacacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtccatgaagattttgggtgaatcttctaggaagcttactaaagacctaggagtatgacttatacgctccacccgaggggtagtctacagacggtctagtaccagataagactttgagtgaaacttgcttgcacaagatttgcaattcaaggcgtttgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcagggcaggcggcgcgcgtgcacgacgtacgcgtctaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgaccgccgtcttcacgcaatatatgcgaaaatcaatctagggtttgcctcctagactactccatcccgctcgccggcgtgcatcagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgttccttcgtagacacctgcgaaaagtttcgaccaagcagccggtcttttcgtcacctcggtacgtgttcaatatgttgcgcatttttgatctgttcatgttattctgcgtagtttacatgtgtagatctaatgatgcgttcatgctagttttcatctgtaatgtcatgatttatttatggaataaattaaatcattatatgctgcccataatctcaacaggattcagtccagccaaagggattagtctcggcgatttcatcgatttaatctttaatatcactggctttgccgtttcagtagtcagattgttttctaacggcagattaatttcctgttattctcttgattttgcatgccgactgagatcaagatcaatggctgtcatctcggtgtgtctgcccaacacctcgggatccccaatgcaccatgtacagatgccgatgtaatccgacacgggagtggcgcggaacaataggcagtgcttacagctcgcacacgattgagatcgccagccaccagatccacatgcatgtgttgaccaatcaacatgcaaattttgatcatccaggacacctcgccggaatcatgcatcaattaattcatcaagcatgctttttatgttccagatatacacacgcgggcttatatatatatatatatatatatatatatatatatatatatatatatatatatatatatatatatatatatatatatttatttatttatttatttatgcttgtggtactaatcagattaatctattaattgatctattttgcatgtatctggaccggttgattcggctgctgccgactggtgttcccgcctacacggttggttggttggtcgcaccaacgtggttaggcattcatgtcttcaccaactggctggacttcgccaccgccgactggtgtttccgcttgcacggccggcttattatgccgccgttgtcgggtgtctacgacttcaccgccggcctgccttcgtcgccgccgactggtgccctcacccaaacggttggttggtcacaccaccgttcatgggcgtccacgtcttcaccgaccggctggcctttgccgccgccgactggtgtttccgcctgcacggctggcctattatgccgccgttgtcgggtgtctacgacttcaccgccggcctgcctccgtcgccgccgactggtgccctcgcctaaacggttggttggtcacaccaccgttcatgggcgtccacgtcttcaccgactggctggccttcgccgccgccgactggtgttttcgcctgcatggctggcctattatgctgctgttgttgggcgtatacgacttcaccgccggactgcctccgtcgccgccgactggtgtccttgcctatacggttggttggtcacaccactgttcatgggcgtccacgtcttcaccgaccggctggccttcgccgccgtcgactagtgtttccgcctgcacggctagcctattatgccaccgctgttgggcgtctacgacttcaccgccggcttgcttctgccgccactaactggtgttttcgcctatacggttggcggactccgccgccgttaatgggcttcatcatctacaccactggcttggttccactagcgccgactggtgtttttgtcaccattgatggactgcttcattcccacatcggctactcctgctgtcaccgagggaatactacaaagctaagttgtcgcgtcccaaaacgactctaaaatacatcctcaaaattatgcatagaataagtaaaatccatgtgaaagcctccaacaattaaaatgtgcaaagttaaaagtcaaataaggcttagaggatttttgtatatttcctaaaagcctaaaatgcgtaaataaattttagtggaattttcagagcacaaataataattattaagaaataaacaaagttaaaaaggttttataaaaagaaaaaccctaaaaagtccttttttccccctcatccggcctctctctccccctcccgaccctatataaacgctccccgtgcctccctccaccgtttccgccactcgccgctctctctccccgtcggaatcgagctcgcgccgtcgcccctctctctccgccgtcgccgccgagctccggtccgccgccgtcgtcgccccggaccttctcccgcttcggcgtcgccttcttcgggttcgccgcaacctcgccgacctcgtccacctctccgtttcggtcgccgaccgccggaacgccgccgtcctcgtctacccgagccgcgccgccgccttcctccgctccggtcgccgtttccgccgtcgccatcgaaccggggtgagccgtggaccgcccatttcgtttccccctcccctcccctctctcggccgccgctccgccgtgcctatggccgccgccggcgaccatagaggcgcgggcgcgccgcctcccgtcggctgtgccggcgaggccgccttcgggcgcgccccgcggctgccatgtgggacccggccgtcagccgcccgagccctcgggtgcggctgacgcgtgggacccacggcgccggccggtgtgagccgcgtgcacccggtccaccgtggaccgagaggctgccgcgtgggccccactcccgtggacccggtccgcgcgctcctcccctcggctgacgcaataaatccgattttaaattaaaatttaaatgaagaaattcgcaaatatccatttaaagagcatataaacttcaaatggccataacatggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcatggaagttgaagccggtgtttgggaaagcgagcaaggcaagtcacatcatctttgaacatattgaatcctagtttataaaattatgttgatttaaattattgcattatcgctttatttaaattcccgcgttatcactgttttatttagccatgcctatttacctttgttacgaccttattattattgttattgttattatttccttgttcaccctagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggctattgtaaaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttgaaaactatgtcacgtctttcgtctatataccgtggtggtatgtggcacgtggttacacgtgaggaagatgtgtcttgtgggtaaagatgtacacctctgatcagagtataatctattcgaatagctgcaccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcatgtgggttcacggccttgattaataattgtatagttctagaatcgtgtttacaaaatagctttgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggattaatgcacgcacgtaaggaacgtccgttgggttatttccggtcgtgacataagtcatcatttattttattctttatatgatattttgccttttcctttgcctcactacatcaactggttcgccgttgactagtgagtcgggggctatagatgttatattgtattttttcaacaattttcatcatatttatcttgattgctcgcgacataatctgagtacaaaagtgcctatcgagttatggagttccatcttcctatgcttttcgtttggtttgtcgatggaaagttgcctttgggccgattcctagcacccggggactcattggacggaccgagtaacgcaaggtgctaagtattattcagaataaatcaaaagcatagagataagataaatttattttctgctctttacaattgcaaaagtacccgagtagtaaattctgattcgtgaaactttgttccattgatgacgaactcatgtcactcatatgcatgtttgggaagtgcctaggcccactcccgatgcttgggggctatgactagttggacagagtgtttaaacgtacggagtcatctgctcgggaaaatcaaaattgacaagaggagaaatacatatttataaatattttaaaatacttgaatttttctcgagtattatatttatatcagatactactcatcctatatgtttgttctgcaggattcagatccagatatgcataaaagggattcatggctttaagcttatctcttacgctccaggaatggatcagtcagaacatcaccaccgacttgcctcgtccgccgccgactggtgtttccgcctgcacggctggcctattatgccgccgttgttgggcgtttacgtcttcaccaaccagccgcctcgtccgccgctgactggtgtttccgcctgcacggctggcctattatgccgatgttgttgggcgtctacgtcttcaccgaccggccgcttcaccgaccggccgcctcatccgccgccgactggtgtcaccgccgtcacggctggcctgttatgacgccaattgatgctatcttcttcacggctggctacatcgccgtcgccgctaacaggcgtcagcatcttcaacacaagctgcctacgtctgctgccgactggtttcttttcttccatggctgcatgattctgctagtgttgattggccttatcgtcttcatcgccggtcgtctcgtgtgctgctgactagtgccctcgcctctacgtctggtttatacagctaccactactgatggacatcatcgtcttccgtcgccgactggtgcttttatcttcacaattgtgcgtcttcactaccggtttgcttctattgccgctgactcgtgttcacttcataacggctatgcaactttgtcaccatggtggagcaacttcatttttattatcttcggcatcggcaaactctattgcctctacttcgcaagctttgctacttcaccaatcatgacaactacaagagtttcgacaccttggcatacgtcaccaaatatgatgccgtgttattttattacaacaagtggtgttccaatcttcaatatttatcttcactcaagcaatgactactcgacgacaagaagttacagttctcgactctatgttcagttgtttcccaactaaccaaagagtcgggggctacacaaatacaagactctcaaaattcgacaagctttatgtcaagatgaagcaatcaatcaaccaacaagtcaactcggggagttattatcttcgtcttcgcttcagagccgacatttaatttcagcaactccaattattacaccggcaattttggcttcttcatgccgctacaatctactccaaatttctcaagtttgagatttaatatacatgtctgggagtttgaagtcatcaaccaatcaactcagatcagattcaatgagttgaccaacagcatatactttcctctaagtgaagcatctgcaacagctatagcaccaagttctacagccatcttcataaatcaaggggcgttgcatcagtcttcattatgcacacgctcgtatcaagaaaattattcgagcttcgatatcttctcaacagtttgatggattattgtcattgacttcatcaccagcacctctacctcatcggccctaacatctctgccgttgttaatggatgactacatcttctcctccggttgcttccgtcattgccgacttgttatttcgccctcacggttgacctactttgcaaatgctgatgagcgtcttcgtcattatcatcggttgctacactgctattgactgcatcaccgacatcgtcatcttcatcaatatcctgtcaagcctcttcaacatagccctattctactgctatttgatgggcaacttcgtcatcatagtcgatcatctatgattgctgcttatcatcattactgtccattgcgtttgtcatcgccgactattttctttatcttcatgattgatggattttgtcatcgcctttgatgcgtgtctacatcttcaccgtcggcttgcttttgtcaccaccaaccggtatcctcgccttcacggatggcttattatgtcgccactaatgggcatcttcatcttcttcaccagctgcctcgtctgtcactgactgtttatttcgctgccatggctacacaactttatcgttgggcgccttcatcttcattgctcgctgacctgactgctgccgactggtttcttcgccttcatagttgtgcaacttcatcacttttgattggtatcactatcttcactaccaccaatatttttgccacttctggtgggcaatattatctctatattggtcgtcttgtctctatgccaactacgtcagctattattaatggaccattgtaactacaacagaaggacaagctatatgctcaggggcttactagctcaaacacaagtatcataccttcaatttggacttgtttcggatacattcaacatggatttatagtcatgagtttattttctatgctcaaagactagaccaattattattccccgtaaggactatcaactgaatacttgcgccagtcgggatttaaatattatatctattttggattatcccataagggataatcattcagatcagaagctattcatatgagctacatttggtctacattacctagaagatttattactcgggagcatgttacatgcgtcatcctttaaagggtgtcgaaggcatattttttggcctagcctaatatgtctgcagcccatattttcaggtgtggcctgtcacgttcttttagggacttaggcactttttgcttaggccaaagtgcgcgtgatctagtgcccaatactttaaaatccttttatccctcagttactcaactttttaggagt

SEQ ID NO: 11109 - DNA, 6659 bp, Oryza sativa
gggtcgggttgccagttcggtctgagatcatcgtaggccttgggttaaggcaggttcatgtgggttcacggccttgattaataattgtatagttctagaatcgtgtttacaaaatagctttgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggggttcctggaggatgaaggctttggtgtctagctcgtgcctgccgtcaagtgcctgtggtcgtcgccctagtcttccgttgtttctcgtttgtctttgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaagttggtatcagagcccccttgaccctaggacaagccgtagatcccaagccttagcagtattttcgaaataaaaatcctctgttatttgtgaaaaccctctagtctttctctgtcttgctgcttcatttatctccaaaatctgacctttttaaagtgttgcttttctttttgtttgtagatggccggcagcgtcacccgtcgtggtttggacatgactggtttcgtcttggagctgcggggcatgtgcgttgtcctggggtatccacatggggtggactaccagggcaggccgcttccggagcaggagggtgacgatgcagagccccacgctgcttgggaggtcactgcagtgatcctcgctggctctcccgagcggacttcgttggcagtcaccgcgggtggagattctttccccgccacttgccagagcgccgctctcctcgccatcggcactcttcaccagcgctacccggacgagttgcagcactcgcccttccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctagcgtggacttgcttcgtcgagacccctcgtgccgagcccgcgcccgtggttccccaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttggagttgtgtggggcatggttatgccggtgtgtggcataactgtgtcggagcctgtctttattttatttgactaagcaacttgaactttaatgaaccaatttaatagcagtaataaattcaagaattatggtagtcgtgggtggttagctttaattgtcagctctctctgtttgctggttctgtgtggggttttcagatggtgacgaccaggagaagtgctgccaccggtgatggcaaccaacccgaaggcagcaaccaccaccaccagggcagcccacctccacctcctcctccgcctccaccaccaccaccagacaccaacgccattctcagccaaatcctcgcccagcaggccaacatgatgactgctttcctccaccacctccaaaatccgccacaacataatgctccaccaccacctccccaacactctaaactcgccgagttcctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgcaggggcccgcatctttatggtgggaccatttccaggctacgcagccagaggggcaacctattacttgggctcgcttcactgccgctttccggagaacccatgtgcccgccggagtcatggcccttaagaaaagggaattccgagagttgaagcaaggcaaccgctccgtgatggagtatttgcatgagttcaacaacctggcccgttacgccccggaggatgtgcgggaagatgaggagaagcaagagaagttcttggcaggaatggaccctgagctgtccgtccgtctagtctccggggactatccggatttccaacgtctggtggacaagagcatccgcttggaagccaagcacaaggaactggagtcgcacaagtgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacgctcaaggtccgcagcgtctgtgcttcaactgcttcgagcccgggcactttgcggataaatgcccaaagccgaggcgtcagcaaggccaagcgcctccccgctccaacaacggtgggaaggatgtcattcggggtcgggtgaaccacgtgacggccgaggacgtgctgacaactccagacgtcatcgttggtacgttcctcattcattccatccctgctaccattctgttcgactctggagcttcccactcgtttatatctgtgccattcgtggggagaaatcagttgggggtagaaaggcttaggaaccctgtgctcatcaccacccctggaggggttatgacagcaaagtattatagccctgccgtccccatagaaattcaggggattccttttccctcggatctgattctgctagacaccaagaacttggatgtgatccttgggatgaattggttggctcaattccaaggagtagtggattgtgcgagacgcactgtcactctgtaccgagggccggaacaaccggttgttttctttgcacccccaacctctgtcagtagttccgaacttcatcagataggactgtcagaaatccccatcgtcagagagttcggagacgtgtttccggaagaactacccggtatgccgcccaaacgagagattaagttccggatagatcttgctccaggaaccactcctctgtacaagcgaccctaccgtatggcagcaaatgaactggctgaagttaacaaacagttagaagagttgtaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagatcgatcttcgttccggatatcaccaattacgtattcgtgatgaagatattccgaagaccgcattcaccacgcgatacggactgtatgaattcacggtgatgtcgttcggtttaaccaatgcacctgcctttttcatgaacttaatgaacaaagtgttcatggaatacttggataaatttgttgtggttttcattgatgacattctggtatattcataatcagaggaagaccatcagcaccatctccgtctggtattgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcactgattggaagcaacccaagacagtcactcaagtccgcagtttcttaggtttggcaggatactaccggaggttcatcgagaacttctccaaaatcgctcgacccatgacacagttgttgaagaaagaagagaaatttgtgtggagcccgcaatgcgagaaggcgttcaaaactctcaaagaaaggctggtttcctcgccagtgttaatcttgccggatactcgcaaggacttcatggtgtattgtgacgcttcgcgccaaggattggggtgcgtgctcatgcaggatggtcatgtggtggcctatgcctcacgccagctacggcctcatgaaggcaactaccctacccatgatttggagttagctgcggtggttcatgctctaaaaatctggtggcactatctcattgggaatcgctgtgaaatatatactgatcataagagtttgaaatacatcttcactcagtcggacctgaatcttcggcaaaggagatggttagaactcatcaaggattacgatgtgggaattcactatcatcctggtaaggccaacgtggtcgctgacgccctaagtcgaaagagccattgcaacactcttaacgtccgcggcattccacccgaacttaatcaacagatggaagccctgaacctaagcatagttggtcgcggattcttggctgcgttggaagccaagcttaccttgctcgatcgaatccgcgaggctcagaagaacgatccggacatgcatggactcctcaagaatatgaaacagggtaaagccgttggtttcacagaggatgaacacggaaccctatggaacggaaatcgagtatgcgttccagataacagagaacttaaacagctgatatttcaggaagcccacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggattttatcaccggacttccaaagacccaaggtggatatgattctatatgggtagtggtggatcgattaaccaaggtagctcgattcattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcataccacccgcagacagatgggcagaccgagcgtctaaatcagatccaagaagatatgcttcgcgcatgtgtcctggatttcgggaagacctgggataagagtctcccctatgccgagttctcctacaataacagctatcaagccagcatacaaatggcaccttatgaagcgttgtatgggcgcaaatgccggacaccgctcttgtgggatcaagttggggaaagccaagtattcgggactgatatcctgagagaagctgaagctaaagtcagaaccattcgggataatctaaaggtggcacagtcccggcagaaagttatgcagataaccgacgccgtaacctggaattcgcagtggacgattttgtgtaccttcgggtcacgccattgcggggtgtacacaggtttcagacaaaagggaagctcgcacctcggtatgtgggtcctttccgtatcgttgcccgacgcggagaagtcgcttaccaattggagctgcccgcctccttgggcaacatgcatgatgtgttccatgtgtcgcaactcaagaaatgccttcgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccagtggagcaaccacgccgaagaagaagctacctgggagcgtgaagacgagctgaaggcagcccatcctgatctcttcgccagttcttccgaatcttggggtcgagattccgtttaaggggggtaggtttgtcgcgtcccaaaacgactcgaaaatacatcctcaaaattatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaaccctaaaaagtccttttttccccctcatccggcctctctctccccctcccgaccctatacaaacgctacccgtgcctccctccaccgtttccgacactcgccactctctct

SEQ ID NO: 11110 - DNA, 1116 bp, Oryza sativa
ttcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacg

SEQ ID NO: 11111 - DNA, 49259 bp, Oryza sativa
cagtaaacatgtgaaagtgcggaacttcctccacaactgctactctaaaaaagaaaaaggttttttttttctctggttgcagtaatattacataatgttttctccagctatcctccgttttgactacatgtgttgactcaattatctgtaataaaaccctcgaagttactaagttggaaattatgcagaacatttataaacatgattagataatgaattttaatatttgttgatgacaaaatttttaggtgttttagtttctacgagttacagacccttctgaactttctgtacatctaattgaattcttaaatatgtagcccaaaatgtaaactcttgcttgacattgaatttaaaattttccaatatttgaatgtaaagttttccaaatttaatatcctcagctgaatatggtatatgttttagcgctacttttatgaaatttagatttcattctactgtgagtacttactatgagagtgtacatcataccaataagctcttttgatataaatattggcactgcagattgttttaattgtagacatattttttgctactattaaattttcctttttctagtttaataaccttttggagtactatgccttttttaaatatattttgcttctctatcatcttttccttaatccttctttatttggccagacactatattcgttttcaggagcagtaaatgtacttttcatattactatcaaaattgtagtatattagcacagaatgatgggttgcttgtagcttagcttctataaaattaggcagtgaggtatttgggacttggaagattacatttgacataccctgagttcatgttcaatcggacagttaaatcccacacatattgctgggcttgatcatacatgtgtattttgcatcgctatcaatgaggcatgttacagtgggttatagctgaactcttagacaatggtccaactaatgtactgcctgtactatctttacagagctacatatgcataaatcactgatttggtcatcttttttccttgtttcaaaacctggtgatagatatagtgttgagttgccacctgaactctgcagaattatcatgtcaccagtgtccgccaataatttgcacatcttctcatatgttccttccataatgttccgcatccagtgcatgcttctttctgtgaaattaaaggtccaattaggcccaacagtgcagcagtttgacgtaccggttttgaaggttgattttctcatcaatagtttcctatttatgaattattgaagtacctagatcaactagatgtcgtcatataagaaaactcatatttcccttattttttgaagaatttaaaataaaaatggatataagtgcattcttgggcacaccagtaggtgttgtaggaagagtgatgacatttgacagtgaaaactaaaggttctgatttttttagttgtttaatgcagcaacagtgccttagtaagaatatgtccagcacttcgaagtgactatctattaatgaggcaaacataagttttggttccttctacttgcaaacatgacaggtcttaagtcatgtataatgcaagatatttcggggacacttagcaaaaaaataattccttttgttgccatgtagaagttggttatttttgtagcaattgatgaggcagtggtacttaataacttcttatgcatataaataccttcaattaatgcgtaatgtaactatataagcacatacaaaaagctgtctgcattattcattaacactccaatggaggtgcttgatggtgtgttgtactctatagaaccatgtatggattgatggtcctattttgtaaaaataagatataagaatatttgaatccgtggagtattttatggttctaattaatattttggatgccccactgttaacaatgtacatgtcaatctgaattttcttacctgttacctgaataaattacttcccctatgcatatttcttacatgtgtatttctctgcatttttttcatgagttgcagatcctggaagcattaacaacaaagaaatgccaagaagaattttcacaggaatcattagaaacacttggggattctttcctcaaatatgttacaactcggcacctttttagtgaatacaggcttcaacatgaaggcatattaacaaaaatgaagaaaaacttgatctccaatgcagctctgtgccagctggcctgcagcagtaatcttgtggtactctagatcctgttgctaactgtatttttcttattgagctaggcatgtagaaattttttttatcgaacacgcaggacagctgcatatcattgcgttaaagaagggtaaaaggaccttagaaacacacacctacacactacagaactgattacatgcacatccttgctaattttatgcaatattaatagtcctacatctcccagtatctttcataccatgtcagcctatttcaattcttttgtgcaactgctatatcacaattaggcaatgttccacatatttcctttttaggaaaatgggaactctattgttgcattgaattgtttgccaagttgccaatatagactattgtaggtgaccaaaaccttgtggtgctgaccctaagttaatacaaggctgtggctcagaccatattactccttgttgggccaacacctagccctcaggtcacatggcacctgtagtcagatctgaggttggcttgacgtggtctgctttcatgaccgttgaagcagcggtactttgcctggcaagcaagaatggcgggaagaatggtagcatctgcctatccttgaaacggattctatcttcggcgtgtgcagtgagatagtaaatagctttctttaatccgctcaaccgacttgtaatcctttcagccaatcaattttaaaggtctaatttttgtttctggtgctatgtggctagggctatgtcatgaaataaaataatgctttgcatacaaatttgttcatcacaaaatgaattgtgttatttttcaagtaccagaaaatatttctattcaccttttcatgtttcaaagaagacttatctgtcttttatcactggtactagatgatactcttgccctttatgtttggttggcagggttacattcatgctgaggagtttaatccaagagattggatcatcccttgcttggactatgatgagcgtgataacaaaaaaatttcctttctggcacccaatggtatgtacagccaaaggaaaatgtctattaaaagtaagaggattgcggattcagttgaggccttaattggggcttacctcagtactgctggggaaaaggcagcatttcttttgatgaaatcattagggatgaatatagaatttcacactgaaattccagttgaaaggaaaatttcaatgaaagctgaagagttcattaatgtgaggagcttagagggaatgcttggttacaagttcaatgattctttattattgctcgaagcattgacacatggctcatatcagacttctggccctacttcatgctatcaggttgatataaaagcatctatcatctctatttagtatgtgtcacggctttattatgccttttgatctttactcaacaaagtgcaaatgattaaacagtattgcaacaacattttttttctatgttagcaatcctctatatgtttcatttccttttgagtttaacttgctgtagaattatctgaaacctgaaaactgaaggactagcctcgctccttcagcgactcgggcggcgcttccagccgccggccctaccccacctccttccttcccaccccttgccgccgctggagctggctgccggaaaccgtgtggcggcgggcctcctttccttgggctctcgcacggacgatggatggcagctagatctaagcgtgacgttggttgctacggcagcggtgggacggctttggatggtagccaaagccggcagcgctaggagaggctgcaacagtggctggcaccggttaggcaggatgcggggcttctgggttggatccgccggaacgctgtggtgattgctcgagtgcagtcggcggagcggctgcatgggcgtttggcggtcgtcctagtcgcaaaagtgggccgcgtgggcggtggttgaggctgtgttcctggctattcaagttggcatcaacggcgaccgcagccctgccgtggtgagcgactggatctggtgcgtcctcgctaggggtagggatccgagccacggggcgtgctagcatccgagcagcgagaggactcctcccaaccgcttggacgttttggagctccttgtggtgcatggatggtggcaacagggtggaggtgcgaggtacgacaacgaccaaagctgggcatctgcgatgatcaagaagcagctgggtagtggtgacggcgtgtcttccgtttttgccggccaagcatcttcctcttcttggagctcctccccttctatggctggagactgtagttttggtcatggggagctttgattggagggtggaagttgtggctatcatcaggagatgtcgatggagtggccggaaacagggtagtcctatgagcatgcctgagctgtcgggctatggcatgggcatggttgctagagggatggtgtggtgatccggcgactgccgttgtgctgcggattggttgtgtgggctggatggagaatcaactggtgaaaaccttgtcgagccattggctggttgaatgacagcgtcacctttgggcactgttcccctccttggaggcgccgttatggtgtagttccacctagcccatactgatctccaggtgaaaaccttgcttcagcttacgccgagtggtggtggcgtttacacgtcacatcctccatgggtgcgctgctgctttggagaaccttcgtcatactgcggtgaccgttgatggcctcatgcatcggcttgaagctctgaaggcttaggatttttgatgaggcctttgcctttttgtctagcttcttttttatctgaatcaaacttctcaagtagctgttgttagtttgggatcttttttgagttgaatgacaagtttgtgtcccttgcagaggctcgagtttcttggagatgctattttggatcatcttttcactgaatattactacagcaaataccctgactgtactccagaattgttgacagatcttagatctgcctctgtgaacaacaattgttacgcgcatgcagctgttaaatcaggattaaacaagcatatccttcactcatcatcagaactgcataggaagatgagctactaccttgaggaatttgggcagtcatttacaggtccatcttatggctgggaagcgggcattggtctaccaaaggtgtgtattctctacggtgtaattggtgtaggtggctatattgcatatattctgaaagtctgatagcagagtttgtttctccttttctgcaaaagaaaatgcacctagctggtatggtaaaatttgatcagttaatttgtttgtcttttattttaaatcttattagtcattactcagtattcctaggtctaccattacctcggatacattatagtctatgccatatagtgatgacatcaaaatttaaccaggcatcagatccattatttctagtttggattaaagagttgctagagaatttataaaaagaactaaagatagtcttaactaggttccgatgcatagtgcatcacagcatgacgaccacaaaatgtctttagtctgactgtaaactggaataggagaattatatgtttggactaacctatttttgtgcacttctgtaatattttccatcgaatagcttaagctggatctattgctttacttgcaaacaaacaggttctcggggatgtgattgaatcaatagctggtgccatttatctcgacagcaagtgtgacaaggaggttgtttggagaagcatgaagcggctattggaacctcttgccacccccgaaaccatcgagcctgacccggtgaaagggctgcaagaattttgtgatcgtagatcattcaaaataacctacgaaaaaaaccatgttgatggagtctcatcggtcattgctcgggtgaaggctggagagactacatactccgcaacaaaatcaggtccctgcaagttggtggcgaaaaagttggcatcaaaggctgtgcttaaagatctgattgctggtcacaaagatacagaggctgctgcagtatagtgatacttaactatttaagcgtgcaacagtagctaacaattgatatagatagttgcgcacaatagaaaagttttggttggattcatacatgtaatttggaaatgctcctttttgtgtgctcgcaaacgatgcgtgtgaacggcctcatgaattctggtaggttttcatgcttcaaacttacaagtatcgcaattttgtaaattacaaatacgggcatagcacacctgcccatgccatgcagtagttttttttttcctcgaaatagtagcattagttgtatattactcatagcatcagattgtacagaaagcatgccagcaaaaacgaaaaaatgtacagacagcattttgttcgcatcaagggaaaacttgttttaagatgttctgtctgatgatgagcaagctgtttgtttgctagcgtctatagaatactgtgtaaattgtaaccaccccaaaatattgtataggttttgctccttgcttgcgttgtcgatcatataaggttcaatgcaagacggttgatttcactgaaaaggggtttcaaagatcaaaagaatagctaccaaaattgcatagctcataatctcgtcaacagttgatccagtgcaaggtaatttcgttctgattgcctttggcagttgctacacatcttatatgtttaatttatctttgcaaaaaggttacacctgcagagctgcagctacaaattgtacaatatatacaagcccaaaatgatgaaggtaaagggcagcttggctggctataccgttcgctatattgaattgtcctgtagaagaggcaatgaattttgggtgttagaacgaacgataacatgtctgacagaatgaatttttaattaaactgttccatacattggaagcatttgatgtggatgcgtcctcggagttccttgcttcagatttctcgttggagtaactgccaaacaagaaatgaagaactcttgttataagaaatgaagaactctttttatctttcgcgatttaatcaggctgccgtagtaataaagtgaaattgacatgtttgggcttacgttgacagtattgtaacccagattaactccacgcagtcaacccacagaagtctttgttcaacaggaactaggccatatgtaaccaagtgtgcaaaaggccacaacttccagccggcctataataataattgaaacccagcataaggtctctgttagcagtaaaacactgtaaaaaccgttttgaaattaagaaataattcagtgattatagaaagattatggatggaattattagaagggaaaattgaataattatttgaacattaaaaagttcaaaatttgaatgacttctcatagctttgttgtaattgtatactagtttaattcaataatagtggcttctagacctaaaactttgagaaaatagatgtggcaagaataattggaggacaaaatgttaatattaacctaaaaaatttacttgtatacagagcaatgaattcatcgaatcccttcaacaaattaaggatcatagtaccaaaaaccatgaccacaggcaatggttttgctgtcaagaacactgaagacaacaaatcaactgcacaactacagctttttcataaactttcaattcttaaaaaaaaaagaagaatatagaatatgggaactcaattaaggcattattataacaaaggaaatatcagtgcttacagtaagcatgggccaaaacgtggatttgagctcactggaaatagtggccggtgattccaaacgaaggaaccccaagaccacgaagtagatactgttccatatcgcagaccaggccgtctgatcgaacacaacctttgcgggaacaacccaccaatccttgaatggaaacagtgcctgagccaagaaaaacagttggcttcatatcattcaccatatatgaacatgacacaaagctttaggcagtagagcatggaagaccacgatgtttacctcgcagaaatggtagtagtaatgtgaaagggacccgtgaagcgtgaacccgacgaggccagaccggaacatccgagcacggtcgaactcgaagatcggcttgccttcgtagcactgcaagcatcaacagcaacagaatcagcaaatatgcaagcgcagctgcataaaagctattactctaaataagaggaaaattaaagcgtttgcacacctgcgcaatccagtcgccgagggagtagacgacgccactaatcatcatcttggcaagcaccgggttggtcttgagggcctcctcgtaagccgaccagttgtgctcgggcatgtaccgcaagatctcaaagatcgtccatccctgcacccaatccaatcatgaacaacagcccgcccggaacgatgttagcttcgaatcgaatcaaatcaagaacagcacagagaagagaagacaaaatggaacaaaacgatttggggggaatcgacgaaggttcccgtacatgccagtagtcgtggtcgacggtgaggagcttggtgagggcgtaggtgctggcgccgagcacgatggccgtgttgatgccgcggtcgagcatcttgttgccgtccccgccgccggccccggcgcccccgctcccgccggcgaaccctcctccgcccatgtcgccctggaaggcgagcccgccgatgtcgacctggctgcccccgatcggcccctcgggttgctcctccagcctcccgcccgtcgccatctccccctcggccccaggcccggggagcacgtgggcctcctccgccgccgccggggcgcgcagccgtagcctccgcgacgacctggtcaggcggagcagcgacggcgccgagcacgacgggggcgggtggtggccccggaggaggcgggtgaaggcgggggagggggagggggacgaggccacggccgccgccatcgccgccatcaacccccactctctcgctgctcctcccaactctccaaagcagccaaggcaaccaccacagcaacacaaacacacacggtgcctcgtggttttttaaccgcggcgcttgtggatgcgagggcgtggacgtgagcgcgccgcgagatcgtgtgctcgcctgagaatctcgcgtcccaactccaattttctcccagtattttgatcggatggatgggtggattggatatattattgtggatggggtgggcgtgtggaactcgggcgacggctcagcgccacatgttcacgtcgtctcaggcggctgggccagtgcggcacgggagtggggacgagacttctgaagcgccgcggagcgggggacggagattccggtggtgcccaggtgtgcatctgcgggattatttcttctccgtctcataaaatgaatgttatttagaataaaattggtgattgttaaatcttgaattttctttctgtagatgaatccagtcactgttccacctgtgctccatcctcctcttatagcgcagataagcacatcagcctgccagccagcggactgattccaatcattatatgcataatatccatgcttatatttcctaaaacgtccacgttaatcgaataaaattgagtaaatctggccatttgtccaaggagaccaaggctgcgttcaaatgtctcctttctcaacttctgctctcaagtttttggctgtacactttccagctaaacgatgtgtttttatacatcttttaggaaagttgttttgaaaaattatatttaagttgttttaatacaattaatcatgtgctaacaacctatctcatttttcatgttggagaaataggttccgaaccgacacattcgaacacaacataaaaataaatgaagattccatctcacactatcagtaatgtaaatattgaacatgaaaaagaaaatccaaactctagtaaatggtaactaccccttcatccaagaaaaaacaaacttcttaaaatgaatcatttgttaaaatcatatcctagaaactttttttatgtatatattggttctaacatcatctgttcaaaaatataaacacttatcacattttaaatttatcaaatataaacaattctaatactgttcggattactatttattccatcaatcatctatcatttaaatttctttccagcttacctttaaataccctctcaccccaaccattcatgaggggcatcaaagtattttgtattaaaccttaatttctattaaacaaattagacatgcttgtattttgaaatagagggagtattttaaaaacagccaataaaacaataatagttattaagactccacatgacaatcttgtattgagtaattccaaaaaaatcaaatccacaatatataatataataaaaaacattaagatatattttgtgtgtaacttagaagcaaagtacatacgtctaagaattctaattttcatatctattaataagcttaaattcaatttattccaaacttctgaatactaaactagtgattagaagtgcgaaaagttcttttgcacgataacaagtatggaaatgagaactgttcaataatccctccgtccaaaaaagacaaacttaggttttcatatccaacgtttgaccgtccgtcttatatgaaaaaaattaaaaaaacaagtcacacataaagtattaatcatgttttatcatctaacaacaataaaaatactaattataaaataatttcatataagacgaacagttaaacgttggacacggaaacctaggatttgtctttttttttttaagaactgagagaatattgaactagttaaaagggcagaaagacgtacttagacttgggtaagctgtcacaaacgcgtgtcatgcatacaagcgtcggctttcgcgaaggagagagtcgcggcgcgaaaaaacctgtacggttacgagagactcagtagtatcttataggtcctgggtttaactttccatggtagcaaattttctaggatttatcggcgttgtgctttcagtggtaggcgacgtacctgtcgatagcgagatgtctgtagtgacttcgtcaatcttaaggatttgatggtctagtcttcaaagatactcataggggtaggttttacgtgtatgtgtttataaaggtgagtgcgcgtgtattgtgagtgtctctgttgtagttgtgtaattttttttttaaaaaaaggagagagtcgcggcctggcaggtagtacatgtgtaccgcacttgagtagtactagtacttcacagttggctcccctccgatccactcgttgtcgcggcgggcgattttactgctctgctcgcgtgtacgtggacgaggctgcacgtcgtgtcccggccaagtaaacgcattcccattccctctctctctctccccccggatttgaccgcgcccatggatggagtttcatcgctgcacagtgcacactggccctggccggcattactgaaatcgacaggctactccggcgctcccacaaattaaacccaagtcacaatggatttgtataatcttccttctgccttccattttgggcttccatttgcttcttttggctgttccgttcgcctaaatagacgaggacgtaagcatatggcacacacgtaccacacgttggcaacttcaagcaataaatccatactaacggtatttagatgtcacctacgtcttaaaatataataacctaaatttaaataaaacattttctatagatacatattcatagtaatagaaaatatatcattcggtactagatttttatattttaaaatggagaaagtagcataactaagtttgattttacaaggaagacaacagttcagttgaattatcgagagatagaagtataattaattcacttgagcacgttaacccttgtgtttttcccaagccgttaagaccaagctagattttacacctacctctcacccctatcgatccatagctatgctccattccttcaccaccggccatccttcgtaggcacgtggccactgctgcaccgacaccccccgtcagtcagtctcagcatgccttgtggcacacaccaccatcattggactccctgtcatcactgtgttgacctccatgccatcagtcaggccagcttctttgccgttggcgcgtgcgtcgaccttcacgccatcagtcaggctggcttctttgtcgttgtcgcgccaacctcccgacgccgtccacgccagccttctgctaccgctggtgccacccgcatcgacctgcctgcatcgacctcttgcatcgccacgccgcgttggacttccatagtcctaccaccgtcaggtgggcttcctagcagcaccacgccagcctaccgccgccactggccactcctagctggtgccccacttcctcccttctccaccgatcgcaccgcgcgggcatgccctccatcgatggcgcgtcgtcgcgccctttctacctcactctgccacctccacgtccgcgccgtcacctctccgctggtggtggcttgagggtcagcctccagcgccggacaagccggatccgaacgagagggggctagatttggcaaccgcaccccgcggcctccactatcgcctctagatctagtatgaatgtatttcttgcatatacctatctttagcaaatttttcttgaatttagagaatatgtaagtatggctttcatgggttttcatttatttgatgatttccactaaatatttccttgtgttatgcaaaatctctaaacaactcaatgtgccccaagtgctcttcacattaaatgtatctttcatatgacggacgatcatttttagcacatccattcttctatgtgtccttttcagtcgcaactgacaaataaaacgtgtccgaaaaaggagtcaatactctgcgattttgagacatacatgcaattccagtgttctgtttgcttgttcaaattattggaaccttcggcaggcttcttttcaagtgaaaactatgatggacctaactagcatttgccgggtgctgcctggagtggagtatttcagagacgcaaatgatttttcagaaaggttaggcctacacctgcaccgatcgagatgattttggaacgtagttcatgcaatgagggaacgagaattgcattactcgctgctctgtatttgcatgtaccaacgagggtccaaagaaagcaagaactcatgccgccgaactttactcgcagagagagatttaccaatactattccctccatctacttacatctacttttgatagtcatattttatcttgtcacaatgaccaaggaaaaataattctatttatcatccatttaaacatgctactagttattcctcgtaaacaaacgattcattaatatttacatttctcgatgcccatgtagccaatcttgtgtggaagaatggagagtcacgcattaaatcatagaaagtcattaataggataggtgattgaattgaaatatgcctatcaaaagtaaatttttcagatttggaaatatgtctatcaaaagtagatggagggagtactattttagttgggttgtttaaatagctcaactcggaatgcctttatattagatcaaccacatggtacgacaatggatggggctgttgaagaagtccccacacttgaagcattgacgatggatggaagccacggccaaagtctgaaactgtcccattttgatttgacagtgtataagcgtaatggactgtttggttgagtatttctatttatgcaaggttgacacaatgttttgaccaacttgcctaatgtgtggctaacaaaattggagccacactttagctagcatgagacactcttgtcacactcttttatctcaatgacatgtgaggtctacatgatggataaggaatctcgtcacaagtgtggttatgaaccaaaacaagcatcgaaatctcagtctaaagagcgacatagatattgaatgaggagaacagtgcaagacgagaaatacattttgtgaaatcaattgaaactagggcaaatcggtccctttgacaaaccaaggcgaacctccattccgtggtgcatgtctggagcatggaagctgtcagaatcttggggcactgcaacatgatccaaggtaaaaagaaaattaacacaaggctaagtaacatttccaacaacaggaagaacactcagcgagtgtaaataagaaaaaaaatgttcccagggcagaagtgggactgaaatatatatagtctatagaggctgtatttctggtgatacatctcatcactgaaaatggtgatgagatgtatgttttgccatgcaaagtaaggccaaccaagcttggatgacaaagcaaaatatgtaatttgctgttaatatatcatatcatgaggacagaataaaataaccactttgtgataattattatacattcctccaagtatatcctaatagcaaaattttatcaagatgtaccgactagaagtatgaaaaatgaaaaacaagtatcatttcatgacccttggtttcccaagaacttctaaactcccaaggaatcataagactacatggttttgttctactaaaataaaaaaactagaattaatataaaggtaatgagaacttgatagcactggattccataattccaatgaagaacataagcatcaaacatgcagctaataaatcagcaaaagttggtgagcaaatagttgcacgtaaatgtgaaaggccagcaagaagattcataggaaatcaaaggacaacaagccttacagttgagataatcttcaaacccgaaatcatccaaggaaccagtcagcgcctcgtatcctagcatagatgatggcaatgcaccagggggcctttggaacctgcaaacagataaatcatcaaccaaaacatcttgaatgttagcctgggcatgagttgcgcacgctgtttttcccttatttgcacagttgcgctgatgtgctagttgttagttgttactacatcggagagacggagagacaaacaagagcaacctcaagatatgattgtgtattcaaccagaccaaggaatccagacattccatccatgttagcatactcaaagcattaatacattcttagcagtcctaatatttgatttgtggaaatgctcttgaagaaacaggacctaattaaacaccttaaaaacagtgctcaaaatactgcacatagccacgagaacaaatttcagaaataacttgcaaactactacctccattccaaaatatacggcacaactactttttttcacgtttcattatacaaggtgtacatgcatgcattgaaattaggacccccatcgttttgcttattgacagaataagtgaaatggcatatttgcaaacagaaaataatttgcaaataaattttttatatccgtgtttttagcgatctaaaagacaaaggctggaaaataaactatgatgaaaaaaccccaaaatcaattccaaatttaaggttgaaaattcaatttttggcttataaacataagcataagccaaaagatgaggctgttaactagcacctcctctccactaaattattatttcttaaatccttcaccctcaagatctctaattctatagggtgcatgcattagtatttattatgatgattcaaacaatgaggtgattattgttttttggtctttaggttaaaggtggttgtgacttaaattttagaatggagggagtaacagttagcagaataccgctgatgaccactaaacataacatcactgacacttgatgcatacgacaataagagcaaaatagttgcagtaaatgcaaagagctaacggatttacaactagacacacaaaacaggggtggatccaacgttatagcagtggtgtcacatgataccaatggctttggcctgttccaagtgctctattctattctctcatgggtgacgccagagaaccttgtcttttgacaccaatactcagacataattggtccattatttgctctcttgctcaacccataaacaacatccgagtacccgacacaacagcagctaacatgcctgttatcgcaacctgaaactaacttgtttgttggtttgtctctttgccttgtactgtcctcgggtagacgcacaaacacagcaagtgcgatggctggtgtctcatgagaagcaacaatgagccagcgagcgatcgggtgagattattttccctaacccacgaaatcccctaatttcccgtttgatttgcatgctaatgattacgtaacgtctggttgtttggggtttttcatttgtacatatttaatttgatccttcgagaccttgagtttattttttaattgaagcctacagaaaattatgtaaatgcgaggttttttttttatgtactgcgagggttatctaacagacaaacacagggggaatacatgccatcatcaaattcaaagaaacatatctcgtcccacaataaggccatttgagtgtgaggaattccacccaaaattgtcattgaccctaacaattccaatatatgctatgtaataccgacacagttatctaatgttaacatgaaccgcaagtgattatttactcgaacaaatcgttttcccagcgaaatcatatggggggataggatagtgaaattacttggagaggatttgggcatcgagatccttgcggatgttgaaagcggatccgtagatggcttccgccccgaacctcttcttatccgcccagaacttggcctcctgcgcgcgggcaagccccaccaccaatcacccggattcagcgcgttagggttttcgagggggcgaggagaggggaatcagcgacgggtaccttgtggacggtggcctggatcgggtgctgcggcgcgaggtcgcccttgacgctgttgttgacgccgaagaggagcacgtcgtggttctcgccgacctccttcttcacgatgctgccgctcgccatcgtcgccaagctcttcctcttcttgtgcttctttggggagaagaaaggggcgcgattgacttgtggtgggccaaataaaaacaaaacgaaaatcaaaggaccgaacctaaatatcggttttttttcttcggtgttcgattcggtttatcttggacccctttttattagcctagttgtacaatgcaccagggatttaccaatcttttcacttaacaccatctaactttatcaaaatatagcagtttggaccaggggcagtgcgttagtattgcttgagttgctatcactatcatcatgaatagcattttgggctatcgatgggaggaggatgtggtgagcacaagaggataagtgcttgattaatgccaatagctcctagtcctatccgaggggagtttagcagcaacgcacagctgattcgcactgcggcgcacttctccgttcagccgacggcaggttagctctaggccatgagggccattttggcttgctagatcacgtccctctcagctgccgtgttgtcgagatgcactacgccagccgtcgacgagggcgaggccggcgagctcatggcggatcggcgacaacagcgaggtgaggcaagggaatcgattcaaatagcaactagtaatttgttgatgcttacattagggacagaggcaacacaaatgcatggtttgagttgttctaattttaatgatgttgcatcaatttttgttgcttcagtgaacggaagccatgttccattgcccatttggttgtaggtgtaacttggctggccggctgggattgtggagcatggagcaaccaagctaatgtgttgtgatcaaatcaaataagcgcatcagtaaccgccgctgccgccaacgcttgttcggatgagcacgttggtgatgggttatcgcctgttggactcggagaagatgagcggctatggtccaggatgaaacaaatggttatattaagtggtccaaggtgaaaaactcagctaaaacctagcccaagctgcaacatgggtaaaaatatatggcccaaaataaaatttactcacataaaaagaaacaaaaaaaataaataaattcaattgtaaatggaatcaacttatgatgatagtatgaaatgttttatccctcgatgtgtctcaacttaataaattgatttatttctcacaattcttctggttacttgatcttatttactttttttttattctatttatggaattgtccggccgaaaacgaggaagagcctctactgtcgtagatgcctcgtcgagtgctcccactctacctaattcagaagatggtaataagcggaaaaaaaatgggacgccaacaggccgatgaactcaagctaaaagaagactttcacggaagtctcgaaaatgcttcgtttagtgaattgattgtgaatggatggtgcaaatttttgtactctgatgcaaaggatcccaatccttccccatgaacttatctcattctaggcctacatattattctcatagttttacctactaaagtagttgaactctactccctccgtctcaatacaagtgaaaccttgtacaaatatggtatattctatagttataaatctgagcatacagtcacatcaatacaaagttatatttatattaggattgagagagtattgtacttcatcaacatattaaattgtaaaacgatgggctgctcaagatatatatatatacgagcaattgtacgacgtagtataaacacacgcttctacatattggcaatatctgatctactggcacaactgctgggctgacaatggccagctagttaacttatccagtttttaacgttgatgaaggtcatcattgaatttgacttgttaatacttaaccctcgcacgatagagcgccctgattactcattacacgtttaatgtcttgaaaagtgaacgtcaactcattgttctggacagcgacaactgttcattcctatacacactagccaacacattaaacctagactttggatgatagcacaagtcccggtccgtgctgccgtctccagccgttcggcccacggatttgccacgctcatttctgtcattgttacgtaggagtacttacggtgttaccaacaccgcagattggtggatgcctccagtgggtctctgctgttcccacctccaaaaccgagtggtcgtctccgctttcgtgtgcagcccgtggcaacttgcactctgttttcgcgcggaaacagaggcatgacgcgccgcatagttgaggagaaaaccgccagcccagctcagcgagacagaaggagtgagagcttacaaacggagttctgtgtcatcaaatttttcatgaaaaaggtatcagcatgtatttatattgtaatggcaacaacaatgtatatatcaaaatagtccatatagataggacagagacaaataatactccctctgtactcataaaggaagtcgtttttggacagcgacacagtctccaaaatacaactttgacttattatttttataaaaatatttattaaaaagtgatatatgtatacttttatgaaagtatttttcaagacaaatctattcatatattttttacattttcaaactcaacaacttgagagttattcatgatttatattcccaatgtttgacttaaacattatcctaaacgacttcctttacgagtatggaaggtagcccatatgcttatatgcttatgggtagtttttgttatttctttgctatggactagttccacaatattgctaggtggctgaaacaaatattgtattgcttatggaccacttttagactatattgtggatgccctaagaagctaaattacatatatattatttctgttttttaatagaagacgccgctgactttttgccatacatttatcattcgtcttaataaaaaaattacataattataatttattatgttgcgagttattttatcattgaaagtattttaaacattatttatatcttatacatttgcataaattttttaataagacgaattgattaaacatatcttcaaaagtcaacgatgtgatctattaaaaacatagttagtatgtaattacactatatttatactataattacatttaacatatttttacctaaaaatctctcgccataacccactataaaagcctccgtttcgcgcgcaccgagccgcgcacacgcacaaccgcagacggggtgatgtgggcgcgtttccggtattcccaaccggccgagatggcacggccggcagcgttcgtacccccaccgcctcagtatgtaccccctgaagagccttcagctttcgcgaggctctatgacgtggtggatcgcgccaaggccgccctggtgaccatcaccggtggaccgacgacggtgcatggtgtcgtcgtcatctcctccggccacgggcagagagcacgccgtgccgtgaccgagatcatcacgacggccccggcgtccgacccggcacccgcggcaccccagacgggctcgccctcgttcttgaattccgtggccgtcaaagtggccgctggggttgtcggtctggttttgggcttgtgcgtgctcgcgctctggatccggcgatggaggcggcggcggcggcggcaacaggcccagccgcttccgctaccaccgccaatgttatacaaccccaacccctactacaaaggtgcgcgcatcttgtgattcttgtcacgttcgacgtcgtgtacgtacgtacgtccatgtcgtcgtcgtcgtcggagatatccaccacactttggtgcttgcaggtgaccagccgccgctgccattcgtcttcatgcagcagcaccaccaccacccgacggcgccgcagaccagcggcggcacgttctccgacgccggctccgagcgcccgcactccatctccatcgacggcggctcgctctcgtacgaccagctggccgccgcgacgggcgggttctcccccgacaacgtcatcgggcagggcggattcgggtgcgtgtacagggggaggctgcaggacggcaccgaggtggcgatcaagaagctcaagacggagagcaagcagggcgaccgcgagttccgcgccgaggcggacatcatcacacgcgtgcaccacaggaacctcgtctccctcgtcggatactgcatctccggcaacgacaggctgctggtttacgagttcgtccccaacaagacgctcgacacgcatttacacggtataaaacctatgtctacatctaaaatgaataaaaaaaataatggtttacatatttgttttttcttctgtcaaatgcatccgttgactgtttagtcaatgtttttttagtcttggttttttactctgatctgatcatgttactgttgaacttaattcaggggacaagtggccacctctggattggcagcaaagatggaaaattgctgtgggatctgcaaggggtttggcctatctacacgatgactgttagttctactccacccatccatttcgcgttatacacttatattcagtttcgtatctagtgttgaactgtgatttaatacgaaaaagtccgtttatactattcaggttctcctaaaattatacatcgtgatgtcaaggcatccaatattcttctggatcatggttttgagcccaaggtactctctctgcacatattattcaacgtttcaagaagatctggttttcccaggacaagttttttttttgaagcaatcccaggacaagtttgaattgcaaacaatatgccattatattgcacagtcctatactcagtatgtcttgatcctttgcaggttgcagattttggtctagcaaagtatcaaccaggaaaccacacccatgtttccacaagaataatgggcacatttgggtcagtacttctcttcagcattccctatgtattccgagtttgttcattctaatttctgaacatgaatatctatagcacaagtatatattatccctcattgtattcatagcaaatcctcttttctgcaggtacattgctccagagttcctgtctagcgggaaacttactgacaaagccgatgtctttgcttttggtgtcgtcctcttggaactgataactggaaggctgccggttcagtcatctgagtcttacatggacagcacgttagttggttgggtcagtttctaacaaaaagaagttcttgaatcttgacaaaattcattccttgacatctaatacatttccttcactccaataaatgtagttctaagaggaactttgatgtctagcctgatagaacatttctgaatttgcttcttcaggcaaaacccttgatttcagaagctatggaggaaggcaactttgatatccttgttgatccggatattggagatgattatgatgaaaacaaaatgatgcgaatgatggagtgtgccgccgctgccgtgcgccaatcagcacatctgcgtccatccatggttcaggttcgtttccttccctgaaaagttttgagtttgaaacatcgaaactgctaaaccttcagtacaactgtacaagtagtggtagtgccttgttccagaataaaatagaacaataactacataaccaaataactgatatttgatactcctatatgtgacaagaagttccttttctcctttcagatcctgaagcacttgcaaggacaaacgcatggagaagatctaaactctatatttaggactacgtacgcagaagatacctacagttccatcatggaatcgggtgagtccatcgggccacgatcaagaagagcgccggggagtcagggaaacactagcagcgattacagcagcgatcgaccaagctcttacagacaaagccaaccgaagcctcgctaaaggcaggtgaactgaagatgttgtttaattaggttttttttctttattattattattatttggagattgaacagatgttgctggtgaagaagacatgaatagaatggttgtgttgtgaatttagatacttttttgtatcctccgaagtccgaactggccaacgctccaggctaactctctctgaccagcatcccacggttcatccggaggaagcttgatactttctccgtttcacaatgtaagtcattctaacatttttcatattcatattgatgttaatgaatatatatatatatatatatatgtatgtatatatatatatatatatatatatatatatatatatatatatgtctagattctttaacattaatatgaatgtggaaaatgctagaatgacttacattgtgaaacggagagagtagtagagaccggaccgctatcgatcatagcggccggactcccgagtctggagaccttatgtgaaaatttttgatcattacaggcttaccgcgttctgatcttttcacaaaacaaccgaataactaccgataagtagtgtaaatataaaacaatcgttatatgaaaaaatagacgtatgaaatttctccacattatcgtgagtaaaatttatactcttaataaaaaaattacaaatagtgaaaaatttactaagagtgatgtgaataaatcttatatgtccaatttttatccaatgttagtttctaagtttgtacactatataaactttacagtatatattttcgaagagttttttccgaagaacagatccgatataggacttcttcgcaaaatacccccatccttcctgcaaacagatgggacaggattgccatagctagagcaaagaggaaccacagtactaaggcgatggccagcggcgatgcgggaagatggcccctcggccagcaagaggaccctcattaccggcgacacctgcagctagggtttgaaatttcgttaattttgccctcccaccggcaagctcatatctcgcccgaaattttcgtttttttacaatttttttgtcaatttgtcaatttgtattcaaattcattcaaaatcagttaaacttttaaataatttcggtcaaaaaaattcgaaatttctaaaatttcagtgtcctcgacagaaatagcaatttcgaaatttaaaaccctgccggcggcatcggatactcaccccaacacacttatccccttctcgctggctagggagacctccgccgcggagccttctgttgcttctacgatcaacgcggggaattcatgcgcaggcgtgcggtggtggacgagctggcggcgctgggggcggccgtgcatacctgctccaggaacgaggccgagctgggcgagcgcctcagggagtgggagggcagggggttccgcgtcaccggctcagtccgcgacgtctccgtccgggaccagccggaacgcatgctccgcgaggtcgccagcctctacggtggcaagctcgacatccttgtaaaacacttcacagcttctcttcccccatcttcaattcaactccttgcttcccctcctaggtgtggccatgattgaagaactttgccactccctacattttatttataagacctattatgcaatgcaagtaaaatccaaaatttttttattttgggttagaaaggaaaaatgtttaaattattcacaaagtttcatataggcacaagttatattagactcacctaggtctttagttggaaaattttggtatttctaatttatgaaaatcattttcaacattttagatgcaaaataattttgcatctaaatgtaaaactgttactatcatactctgtttcaactatctcaaaaattaattcatcgtcgtcatccgacgaagactcatcgtctagtagcatttgaaggaagttgtttcgacgactcatattcctatttttttagcagaacgagggcaagtaggcaggggcggactcacaattggggggggggggatcttgagaccccactaccgcccccgggacagtgcagacccccttaagcccccactatttttttccatagattcataagatgtggggactggagatttgatttatgatgatgtagtttattcagcccccactattatttatttctagatccgtccctgcaagtagggagaggtggggcagcaacagtggggaatagaggggagagggaaagaacaactgacatgggatggtgtggtgggggaaattggcgttggggagggagatcagcgttgatctttgatggaatgggagatttctattggtagtttaaaagaatggtccatttttagtttttatttaggctttctcttaaagagatgagttcactttctattttcagtttaagaaaccaaaacaaaattttggggtggattatatacattatgttggtgatgctttaatcctttggcgatttgtattaccaggtgatgatcatcatgtatgcgaagtctattcttcttttttttttcttttgaagctgaggtttttgggcttgtttggttccttaccctatcaattcattggtaatatcacactctaggtaaattttggcactaccaaaatattgatagggtaaaattatttagctaacatttggattgctaccaatataaagtaatattattatagtttagtgaagaaacttctaaaatataaccaaataggatagaggcactaccaaatatttgacctcaatctaaactaacacacaaactatttacatttgccaataaattagtagggcatgtttttggtatcaaaccaaaatggcccttcgttaaccatcactacagagtcctctttgacacaactttatttcaagattttttgaagctgggtattcctacaattacgtggataatatttaaataatcttaatatagataaaaaatttaaaatcttaaatcactgtaatttaatatagaaacatcaaattcaccgtgtatacagagactaactccaggtgaatccctgaagacacgatcagatacaaagttgggtgcctgtactcatgcgagtcagcagacatgattccatatgcagcaaaactatgtgctacacaaagggggtgtttagattaggggtgtaaagttttgacatgccacatcggatattgtataggatgtcacatagagtgtttgggcactaataaaaaaactaattatatataagcctaattaattcatcattaacaaatgtttactgtaacacaacattgtcaaatcatagagcaattaggtttaaaagattcatctcgcaaattattcacaatatatgcaattagttatttttagcctatatttaatattttatacaggtgttcaaacgttcgatataacatgatgtaaaattttaggtggaatctaaacattggccaagtttacaagaccgaggacagtactaggaagcagtacatggcgcaaagggcatgcgcgcagacaagaattcagcatccgtttccaaaattacattagtcattcgcagctgatcgagcagctcgcgttcgaaccccggaacagaaagcagctagcgtgcagtgcatttgcaaaatcaagcgggtagtagtacagacagcctgtttggtagagctcaaatttttaaatttagctataagagttggtttgaagtggagttgtacagctgtctaaatctagcttcacatctctagttcattttatgataaagctctacctaactccgttctcattttaggtggagctgaaactgtttagttgagctctaactttaaaagagatggagctgtgctaaacaggcactgacctacaaatctcagcttcactccacattttctcgtcacagcatttgccatagtaagcgtgatactaaaattgagttattaggatataaagcagacggtttaaagaaaaaaattgaggggttattacggtgtacaagttttgtttttccacttagtataagggtgatactataaggtgattgctatacttgtgcttgcgcctcataaaggctctcagcctcggcgattttattgtacacgtcggagcaaaataataacaggtaatcataactaatagcactgaaatatatgctgaaaggacacccgatggaaattgcagtatgaaccattattcgaacaaaagcacctgctcatcgcaattatgcatcacttaacacgaataacaccaaacaagaagcttggcagccaccaagaatgactaggcgcttggcaccagcccagccacctaggaaaacaagcacatcttataggcaaaaaaaaaaaagtaacaagatatcatcttgctaggaagctgtttgagaataggaggttcataaagcatcaattaactgtcggtaacaatgaacaaagatgcgtcttaaccacaaatatttcagcaatcttaacaacatagcaaacagttcaccacaaggcatcatgaaagtaagtgagcaagttgtatttgggtgcatggagtcatgcacaaataaaaaagttcgagacaaacatatagttgtaccacttaaagttactcttaactctttaagttgtgacactgcctacaaattaaagtaaggaggtactaatggatcaagacaacaaggcttttaaattaaggaggttagtacatcaagaccacaaggcttaaattactgaggtattaataataaagaccacaaggcttaaatttaaggaggtagtaatgcattaagaacacacaaggtttaaattaaggaggttggtactaataatacttcctccgtttcacaatgtaagtcattctagcatttcccatattcatattgatgttaatgaatctagatatatataaatgtgaaaaatgttagaatgacttacattgtgaaaaggagggagtacataaataccacaagaggtaaaatcataatgaagataacaagacgtacatattatactataatctaataaaatccatttgaactcatgattttacacataataatttattacgagggtggtgacgaggaggacatatggtcagactgttgattctccttggctcgagcctcacacaccccaaacaatgtggataaaagacaaactaaagaaagattgtttgcccaacagttgtcaaaccaaatgtccccacggagtgatctgcaacgcaaaccaagatcaatttttagttcatcatacgtatcatcatttttattatgcatatctaacctatatatacttaaaaaaattcgtatttttccaattgccacagattttccgtccgtcgtttctctgagcttcatccgcatccgattcctatcatgacatcacgtcctctgctgccagcgccacccctacccgcgcaccagtcacctaatcccctccccctcccagcgcctctcccgcccttcttcttcccccatccccctcccgtcatctagcggataacacttgccgaaatctatgggatatcagatatgtactgaaactaaattctgttgaattatgattgcagaatatgcatacacaatgaggttggcgatggctgccagtatttatagttttggagacaacttgctggagcttttgactgggaaaccatcggtcagtgatggcatctgctacacgaagtgaaaaccggtgctaagagcaggatattcttatctatgagagaaaactgcttggcccacggccacgatgttaggcaagcaggctcttggtctttcaggcagcccctgatcagatggggcagtcgttcggtctccagaaattcagttgctatccacagcagattttgtcggtcctgaaacatcgctctctcttgtgttgcgttctctcaagatgctcgaccgaaaatgcaccgcttgttgaggacgctattcaacagaaaatgatcaacgttgtctgttttgctggcttaggttcagaaaggagtttgatcattttacttagtttgtaaatgtcagcgatcagtactagcatacacctatatagcggtccttgaccagcgccataattcaaggtagaatagtagtagattatgctaatgactgatcagtttatctattattcaggtttctattttggaatcaatcacaaatgggtttcatctatgctgtcgatcatttgaacctgttgcttcggtgagtgagtcattaaagcttatttttattactccatccgtcccaaaatataagaacctataatcaaataagatatttctcagtacagatttgtagtacaaataaatatctcatccgtttctaggatttattctttgggacggagggagtattattatttcttttgggtcagattagtaacttcctacataatatcgcacggaagattgatgtttatcttaacccatgtcaagaaatttcgttgacgccatccccttttcctcgataaaatctcgggcagggtgctagtaatctaaagtcaacggcgttaaatatttaggaatagagagagtattagtatattttaagaaataaataaatccttgcggttcggaaggactagcaccgatcctgatcatgctgattttgtgctcgatatctagagcgatgtgcacccgcgtcgaaggatccaactgccgtggcacccgggaaagattcttcgcctttgccacctcataaagggagctgatcacctagcgatcaattcaattaatcaactgatgagcagcaaccaaagatcgatcgatccccaaaaccaaccaaacaaacagacgatctcaacctgcgattcttccgcgatgtcggtgagggggccggacggaggctgggagtggaaggcgcgccgggccgccgcggccatcatccttgttccggcgaacgacatcgacttggacatggacatggacatggatggatttcggattttcagttagggttccatctgacgcatatatctctctctccctctctctgccacaggcccaggctcagcacggcccatcttacccgtctccctcttcgtttctagtagcaatttaattctctctcacaaaagaataataacaaaacaaatatggagtactactactaattactccctcagtaaaaaaaaaattaagatgtggtgtgacatattctaatacaacgaggttgacacattgtgctaaatatatctcatttcattataggttgggttttttttggacggagagagtacactagtactacataatggctagccctccctcaaatagcccaaataacccaaaaagaaccaaaaggatgagctatttgagggctatttggaaataacccacccaaaaaatatcccacccaagaggtgctaattggggctattttgggtgggcccgctaaaaaaatatcttttctctatatctctccatggaaaggtacattaaaggtcaaatagctctcaaaataacccttgaatccaaacaacttactaatatagctcagtttctaatagcggttgtaccactggaaaatgtttttaactgttgcaacgcacgggcattttttctagtataaaaaaattgtactaatatatcagtgagcaagtatataatttatttccacgagtttttttttaatctttactattataaaaattaaagatatttttgccagaattttggtacgtcatccgtgttggattaggtatcgagttaggtttttaattttttttatctactcccgcccattgtccgactggcgaacacgccacaatcacagcttctgtttatttcggtctgtttgttttgtttcggtttctatcttttcttttgttgcagcttttttttcccgatcccaactgatatctattgcaccgctttattttgtccatttatttttcaatttccgtctggttttttttggtccatttttttttcagtttctgtctgggtttttttttgaccgttttattccccgatctattccaccgcgccatccgcgcacctcctgccgctgctcgggccgaaccctagcgccatgccgccttcatgtcgattgcgcattatctactctaattgattaaaaaatcgattccccgctcttctctcatcattttctacatgatttccccttttgatgcgacttttaatttaccagatttaatctccgactatagacgatcttccccggttgtttttatcgtgagttttacctctgattttggaagacggaaagagtagatcgagtggatcgaaagccctcaaccaattttgggagatcgagcaaaattcagtcagatttgatgggaaagatctgctccgacgtcgtatgggcattggtctatctttgggaggttaaaagacaatagtcttctgagcctgcggctctacttgttggctggttcaaagggaggcagcctgagtggaggttacataatggcctagggatttaaaggaatgaacgagtgagttttcggtttaaaacgaaggaatgattttcattaaatttttaattataatggatagcaatatcagtgttaggattttcattaaattttttaatcataaagtatagtgatcgcaatgtttcaatcactaagaaaacgtatttacccgttgcaacgcacagataattttctagtaattaataatatagcagtaatacattaaatatataggataggacagtacagctgtttgttagtactcctattagggacgggaaacggataagtgtttttatatatttttttatttaatttaaagaagagataaagggaaaaaaaggaaaagaaacaaatagtactatatcctcccgttcttcttccgcacgatcgaaaccctagccttgttcttcctctacgagacgagagacagagagagaggtggattccctgatgtcgctccgccacgccgtgctgatgcagtcgcggatgcttctccgcagccgtcgacccttctccaccatcagcgccacggacgaggtaactgcaatgctgcccctgcctccagttcatccttgtgtggttcgatcgagggagattcatctctttaatctccctctctctcggctatctttctcttctcttcggctgcactaattgggggagtcgaatcgatctgttttattttctgcgtttgctttgtttggagattatattataatatggagacaatagcgaggtggtccatctatatgtaataggtcaattaaataggtggtccactatacttttttattatattaaattaattagctggcaatgttgaggagtaaatgcatatcactgagagcaagtttaatagtatagcccactactagctccaaatcatgtatagccaatataatagtcaattcatacaatagttgcttactatactattaatacatggtcacacctatcatacacacattacgtcttggagtccgtgctgcagctgactatagatctgcagcccgctgctcttctctatcttattttttctctttaaaatatatttatagttggcttatagcctgctattgtacctgctctaacaacattagcaatgctgatgactttccgtcctctgataccatgagtaattgatcattcttgtcttaatttgtgttcaaacatgtgaatcctaatcacgtcaaaaaggccaacatcctcaaagaacttgatgaattgaagacgaagacgaagaaggcaattattgaagatgtggagaaggtaaaaaggctggagaatgaagatagaaatgcgctcaaccggtatgtggttgctcacaattactatcatctttgttttccatctcggtttcagcttcacatatgttttgtcattcacacaggctgttgacttcctgcgggatgcccaggggtgcatttcgagataagctagtgtttggatgtcatgtagttgagttatttgctgcattcagtgcagttgggatatggaaagctggaagagatgctccacataaggatgcaaagtttgctactgatgcttctatttagttgtggaaagcaaaccgttgctgtcagggacaaaaaaatatacctgcacttgacacaactctttgtgatgactcgtgtttctgactatcatgtcatgtagctaaaatattatctttatgttttatgcatgtgcatttgtaatagtggctaaaatattgtgtttatggtttattatgcgtttgagttggttgtttgatgtggtggtgcactagtactacctctctcccaaaatataagttcaacctaggaccggatgggagggcgagtgccggcttgtttggctgggcggcactagccaccaccagtctaggctgcagtcctggccccgcaacacccctattgtctcaccgccaccgtcaccgtgtggaggggagaacgttttgggcgagcgtgggcaatggagatagggggaggaggggtagtatgctggcggctggggcaaggataggcggtggtggagaacggtagaaggcgggggcggcggaagaggaggacaggagattagatttggatgattttttgcaaaagacccttgtgcttcttagtattatatcgccacctttaaaaacggaatttgctcttcttcatattacatttctcaaaagtatataggatttctacaaaatttataacagggtgaaagctagcagtggaaggggttgcttcgtgttatttcacagtattatggtttttatgaaaaaaaagttgattaaaaatctgacaccgtgcgatcacgtacacaagcatgtgcaactagccagtcagcttttctgtgtcttccacagcagtacatataagttacaacacagttgcacagttgcgatgtagttataggcaacatatcctatgcacacaggccctcacgtgtacacacgtgtacaccaactaaaaaatgtcaccaaaaaatctagaaaaaattattcctatactttcaattgtattacacctagggttaaaatcttaacgtcaaattcattatattttagccgtaacaaaaaaaacaaaaaatctgacagttttaaggttgtaattttgtcagaattttatcttttttgttattctctatgtagaatgaatttgaagatgcgattttgcacgtagatgtaatattattgaaagtacatgtatgaattttcctagaattttttgtgataatttttagttggtgtacacggtgtgtacacgcgagggcctgtgtacataggatacgctcccgtagttataatacaattacaatatagttacactccaattatattatatttatatctgaaagttttccacttaaaaaacttgcgacaacttttttttatcggaatggctaccacattgtccttagtgcaacatgaggcaacatgaggcaacgtatactatgatttgttattacttcgaccatttcaggttataagacgtttcaactttggtcaaaatcaaactgttttaaatttgattaagtttatagtcaaatacagtaatatttataatactaaattagtttcatcaaatcaataattgaatatattttcataataaatttgtcttgggttaaaaatgttactattttttctacaaacttgatcaaacttaaaacagtttgactttgattaaagttaaaatgtcttatgacatgaaacggtgggagtaattgatgatttgttattgcgtactatgattgtgccgtgcttctctcgattttagtactacatactcaacggaaatgatgtctgtatgctgggctttttcaatcatcaccatcaagttgtttgtatctctaacgtcaaaatatgctcttctcggcagcgtcaggccgccggtgcatgcaagcttgtaaaagaaaaataatgagacgaacaagtaaatgattaggaacgttttctccgaagagattaggagaagcacacacgaatactgaacactgaagaagttctgaagatatttctgataaaagtagcgtggttccatttgcacacaaaaaagtgcagtgacgttagtttcagttttctttcgtcttccttgacagaatagtccaaggaatgccttcaacttggaaccacatgatatctctcatctggttttataaatgttactaatattttatcagataaaaaaataacaaaaataaaagttatatatcttgatgagttatacaactttttttgttaatgactttttagttgaaatcatttattatttgaaaatattattttgaagttgtcatattttcaaattcaaattcaaactgttcaaaaaaaaagttatatagaaaaatgaccaaactaaaagttgtaaatcttgataagttatacaactttgttgttgacaatttttccatttgaaatcatttagtatttgaaaatgttgttttgaagttgccatattttcaaattcaaattcaaactgttaaaaaaaacttatatagaaaaatgaccaaactaaaagttgtaaatcttgataagttatacaacttttgtttttgacaatttttcgatttgaaatcatttactatccgaaaaattattttgactaataaaatgaattattatattgcagttaattattttactacatgtcaacttataaatataaatatttcatataaaaatactcatcggtgacgggcattagttaaaacccgatagagattaagttatctcaatcgggtattagtatagagcctgtcacggatgagtcacctgtgacaggcctagttgttatctcaattggcccccaagttggcgcccgtcacggatgatggtcatccgtgacggatatctcaatcaggcctaaactacggcccgttacggatagatgtcatctgtgacgggcttgagttttgcacccatctaacatgtaacatgtctgtatgaccatatttcaatcggacgttttttcgaattgagatgactttcttgtgacggcccgttaattccaaacatattagaggccatcacagatggtggaaggatatgtactagtgtgtatacatacctctgttgctcatcagtacagtatatatggatgtggctccagaaccaagcattgctacttaatttgcaagaagtacagtaccctgcatgcaagggcaccaacatattcttacatagttacatgtctataacaaagctttgggtgttcatattgttcaaacacaaatgctcacaatcactataaacaaacaacaaacttatagacgggaattaaaaatctttggaacaattataaattcttaaggattctcttcatgctgctcagcaaaacaaagatgctcacaagttagtcaaagaaatagtagactgaaatcaaatccacagattaattttgctctcatcattaagaaagctgaactgagtactactaaaaagatggacatgattaatttgccatcagatgtcttaagagaaaatattaagcatgcatgcataccattaccaggtgactgaatgtacaggttttcaaaaaggataccagcagccaatatcatcataatccttctccaactaaggatgctcgaacattatttatttggatagcaattggaacccctattggggtgtggctaatgggcgatcgatcgcgagcgatccccatgccccctttacacacctctcctctcatccccttcttctctttctactacactataaattaaaaaaaaacaaagttgaaaaaatttatgtatagaaatactatatatgaaaaatatttgaattcaaatttaaatttgaaacgggtatgtaaacttttgacttataaactttgggtctataaacaatatttgaattcaaattcaaatttgaattgtgtacgtaaacttttgacttataaactttgggtctataaacctaaacaactttaggtgtataaactttagatgtatagaaatactatatataaaaaatatttgaattcaaattcaaatttgaatcggatataattcaaattcaaatttgaatcaggtatataaacttttgacttataaactttaggtgtataaactttagatgtatagaaatactatgtataaaatatatttgaattcaaattcaaacttgaatcggatataattcaaattcaaatttgaatcgggtatataaacttttgatttataaactttaggtgtataaactttagatgtatagaaatattatatataaaaatatttgaattcaaattcaaatttgaatcggatatataaacttttgggtttgtaaactttagatgtgtaaacttgaggtgtataaactttgggtgcataaatttactaaaataggaaagtaatacggtgctaaaaaaggaaaccacgtggaggagaggaaaacccgatcgctcctgaccgtcaatcgccttaggagtttcgcccctatcgtgtattcggatggcacgcttacgaataaacgaattgtagtggcatttatctgaatcgatacagcagttgtaatggtatggatttaattagcccaagaaaaaaaaggaacccaaacaaaatccggagggagaccgtcgggtcgggtcgggaatcggggatcagggaagaagggaaaagagagcgagagctaaccctagcaagcaggcgatgccgacgcgagcgagagcggatcgaatcgaaggagcaaaaaaaccgcagtgatcatggcagcggcgatgatccgaagagcgcagctgatggggatggccggcgagggtgctcccggtcaccgcaactacagtgcatgggtgagagcttttggctcttcaactcctctcttcatcttcgaatttcttcttcttcttcttctcctccttttgtcgtcaacacccacacatccgatctttgtttcggtctcgataggttgtttaaagagcaccttatactttgtaccccaaaagcgcacaacgcaacatggctgtctgcacttaatttttttttattttgcttggaatttgcagcagccgatttatataggctgtgtttagatctaaagtttggatccaaacttcagtctttttccattgcatcaatctgtcatacacacacaacttttcagtcacatcatctccaatttcaagcaaaatccaaactttgcgctgaactaaacacagccatatatgctttatgttagtgaaacctctacggcttgtttggtaactcgagggaagaggattgggagtttacatgagggaattgatgatgagattaagatggaaatttgatttttaatcccaatatcttgtttggtagaggtgatggaaattgatagggaatttagttggagattaggtcattaataaaaatagatggagatttgcttaaacaaagtaaaggaggaattccctctcaattacctgcccctacccaggtattgaaaaggagggagttccttcctcaattccccatcctcatcccaccaaaattcccatgtctttcaactaaacaaaactcttaatagcctcatccttctaaactcccaatccctcctaaaaactccctccaaccaaacgggccgcttgggaaaagagctatattttgatcccaaaagtcaattgctttgtgatgaagcggtaatacttactatcatcacttttgtagggctgtgtttatttcacactaaaattggaagtttggttgaatttggaacaatgtgatggaaaagttggaagcctgtgtttgtagaaaagttttaatgtgatagaaaagttggaagtttgaagaattattttggaactaaacacggcctaggttgttgactggatctcacacaacatctttatttctgttttaataaaatcaataaaattggttgactgccaaagtgccaagtgagccaaattcatccaggtggcaggtaatcacaagtcaccattgccacctcctgtgctaaggaagttgcatttgcagtcgagtcagggtagtccaggaagccctcactgccattgattcccacaaagctgcctggcaccggcaccgacaccaccaccgcgctaggatctctctcttctcccttggggccctattgaagggaatctattctacacctatcgtagatttgtggtgtggaatttattccctctttaatcccttcaatccgaacaaggctttgggaagtttggaggatgcgtctcatcggtgctgggtttgcattgtgttagactgctagctaggctgggttgggttagttggttcttgaccaccttgcaaacagtttaggtccttctctttaatcgggttaaccatgtaacacagacctaagcccgtgctggagctgtttttgcttataaattgatgcatatttcattgatgcttataaattgacagacctaagcaagattataaattgatgcatatttcatggggccttgattttgctttccctgcaaaaagagtaatggacagatggaaggcatgatacatataaaaaaacaattccacacaataaaaatttactgctcagacattcaaagatggcatttactcgtgcaaagctggacagcgtgcaacttcaagtatatagatattgtagtatgaggagtcacaacttgggaaaagaagtaaagaacatgtgtttttaccgatatctggaaatatatattagctgaacaattgtgtatttcaataattagcaagaattttgagcaacgatatatagaaaagaagtgaatgtgttttcgcacacagaagactaccccgcgtcctctcgcgtgggcggctcggggggcgaaaaccctagccgcccgtgcctcctccccctctcccccgcctcgccgccgccggagctcgccggcggcaaagccagcagcgagcatggaaggcggcggcgaggtccttcttcctcttggcagctccctcccggcgcgacgtggacggggcgacgccgatgaggtaccccaccgctgggagaagtggaggcggtggggcggtgtggggtggcggtggatccggcacccccatggccggatctggcgcggcagcgcagcccgcggtggtgcgcggctgggggtggcgacggtggcccggcggcgcaatgcggctgggggcagcggcggcggcccggtggctgggagcagcacctggcaaggcggcggcggctccggaggcgccccgctcggatccggcgtccccgcggccggatccgactcccggatggccagggtcgtgatggccggcgtcgccggcgacaggaggacggcgcgtgcggaaggacggcgcatgcgcgacgagaggacgccgacgtcgaggtcgatgcgtgcggcgccgtgcagcgggctgacgtggcagtggctggcaccggcgatgcttgccgccggacctcatggatgaccaccggtgggggctgctgccagatggatggctgcgttgtgggggacccgactgggacgccggcttgcatgtcggcggcggggtcgttgcgcgtcgcccgtgtggcagcgctgcaggtgttggccggtggagatgccgccggatctagggtcgagctcggattcagccgcacagcactgccatcacgaccggcgatgacgaggggacgtgtcacgcccagaaattcccaaatagaattccaagtagaatgtgcattaaaatccccgtccaggaccggccggggtgttgacattcagatccacgtcttacaaacatcataaaagtcttacataaatgcagcggaaaaacgaaagataactggagctaagccttgacttgatctgcagtgggaacaccactccacaggcatcctcgacggcacggacgaagcctactcctcggagaaaccaccatctgacacatactcgtactctggggttggggaaaatagagcaagactgagtactacccactgtactcagcaagtcatactggaataggggtatgatgcagggatttatcaaaggagagctagagtagttcatttgcctaaagcgagcatttataaacagaagttgaaagaagtaaacagttgtaataattaatcaatattaatcatccgctgtccaacgctatcccacgttgcaacaggcccaaccatccacctaaactatccaatttcattagactaaactagggtgagactaatcacggtgaatctggttgaccgcccataaccgcgggcacggctattcgaatagttttactcagatcagaggtgtacaactgtacccacaagacacagccccacgacacgtttccgtgcgccgacatgccaccacgacataccggaaagaggtcgtgacaggacccttcgcataaccccctctaaccaagcacaccacacctcagatttcacccccactcctcgcaaggcagcgggcagtcccctctcgtgcctaggtgaatccggaagcgacagaggccgtcgtagggcccgcctcgctccatcacgcccacccttgcctggatgcgtcagctagaggaaagctacactacaagcccagccgttgcccacgctggcttgtggtaagtacgataagttcttccagggcatcccgcgaaccagtccttaactgccatgggtgcgaccaacaaaaccatgcacccacagcccaccatgtgatttattttaattaaccaacaccgaagcggtgtcactaatccaacattaccattagaacctacagtctaaacattaataggatctccctcattgtgtgctagttgaactaagcatggctaagcaatccctagtccaatctctagtcatgttatatcccaagctaacaaaggaacatggtacaaaatagtacgactatgacagtaggtaaacatcccatagtaacattataaaacaatgcagtatttaaagaaaaacaatagagcatttgtaatataggatcaacatgttcaagtgacaagcatgacttgccttgctctactactggaagaacctcagcgactatctcgaagtacaccggagcgtcggaagaaccggaatctaagcgacatacaaagcaaacaatacaaacaggctataagactactgaaacagagaacaaaaccatttttaatggattctacacatttttcttgatttactgagacttgaacgggcttaaacggagctcggatgaattagttatgaattttagaagattcactatgtttattactataacaaaaagcccttaaatcatttattgcgcaataaatcccagggctgacgtcatcaagggggtggcgccgacaggcggggcccgcatgtcagtggcgcacggggtggccggtctaccgtggaccggaaccacgcgggtggtccacagccggtccacgggatcgacggcccagattggcccggggccgatcggacggtgcagcggcgacctggctcggctctgctcggcacaaagccgaccggccagccatggcaagggcggcggcacgcgtgcgtccaccggcgacggcaagcggcggcgcgggcggcggcagcggacggcaccccggcggcggcgacgaccgaaggcgatggcgagcgcgggtggcggaggcgcacggggaaacggggaaggaaaggaaaggggagggagtcctcaccggagggggcggcgacgaccggcgacgaggagcgacggagggaggtcgacaagcggtggacggggtccgggacgacctaaagaacgaaaaggaaaagattagagagggagagaggggccatagaaggcgggaatgccggccgaaggcggtggacatggcggctctcaccatcgctcggcgggaatggcgctccggcggcgaacctcgacggaggaggggtgaacggggtggatctcggccactcgaacccaacgtcggcgacggcgcggtgtggcggcgagcctagcggcggctagaggcggccggagtggcgggaaaggcggcggcgggtggatgcacggtgcgggagcgatggagagctcgggagagttcggcgagatggggaaaaagagagagggggtggcggtggagcttaaataggggagggggaactcggacgtggccggtaggggcgggaatcgccggccgacgtggggagtaggggaggcgagagaggcgggattcggaattcgaatcccggccatctcgggcgcgggcgcgagcggtagagaggggggagtgggtgcgggagactcggcacatgcacgggcgtggcctacgtggcccggagcaggcggggacgtgggcgcggtggcggtttcggcggtggtggcgacgtagggcgggcgaccggaggaaggggacgaccctgacaagtggggcccacctgtcggcgtcccggggagagagggaggggcggcttgggccggcccacaaggaggagggcgcgcacggcggcggggtggactgggccgacggcccaagaagaggaaaaggagggaaaagaaaaagaaaaggaggaaaagattttccctgggatttaaaattgcatgtgctcaattttaattggttaaaattatttcgagggctctgaaaattccactaaaaatcttgttagcgaatttcgacgtgtagaactcaagaaaaattccacatgccaattccgattattatttgcattaatttattaaggtttactcttgctttacactggtattttcttgagaccatttataacttcaatttaggcttgggaaagaacttcggggtgtgacaagacgccatgtgggtgccttctcatctccttggagctcctccccttcttgaccgcctggtcgtggggagctcctttgcgagacggtgaaggtggcagcaaggttgccccaggttgttatcgatagtgatgggcggtggcgggcactctctttggaggtgacggcatgggaggaaggctagctggtcgccgaagtgcagcggtggtttggtcgtgctcgttccaacgtgtagctatgggggtcgcgctggcagcaggttaggtcgcttggagtccagccgacggaggggcattgttgctgtagaggccacgtgttgacattgcctgggagtcggtgaggtagcggcaagaggggcattggcaggtgctaggcgaaagccggcccaattcttggacagcaacggcgacgtctttgggcattccaaccctcttgagggcgttgttgaggtgcttccctccccctcttcaaggatcctctaggtgaaaacctcatcctttcgggatgggcgatggcggcgttttgaatgtcgtgaccttcttgaaggcatcgttttggaggtggccgtgtgttcctctcggtgtggtggtgtgtaggcacgtggcggggtatgttttctcttgtccggttcccctgtcccctgcagtttttgcctttggttgtaaatgtctgttttactcctcttaatgcaaaaatacgcttctagcgtattcccgaaaaatgtgttttcgcacattatccaccataagagacaacaggtactttcactaaggtgctgaataaactatatagaagcactctagaaataatcacccaaccagaagaacttgtaggagactattgacaatgcaaaaaattccattttcatagcagtgtaacaggtctggttgtcaatattttcaagagtaatatgtttgaagagcatattttgaatttcccttgtaatgtgccacacgttaatggaaaaagccattccatttatcttgtttctaaaagtctgtggacttttttaaatcaatagggcctaatatctcagcacataatcagcctagcaaaaacataactctgctcagttatcacatctaagttctgaagtctgaacatatctgttctctctgaattagtcctctcaattctgaacttgtccatttctttgaagtacagatggttatgactgatctacttgtttgaagtgttacctgcggcttggcgaatttacgtaggtcggctagcgagaagctcttcctgctgcagctcagttcagtctttcccaaggacagcatgtagtcactgtaaaaactgtggcgaggaaaacggacgccaccgcccaccaggttcaggacagctgaagtgaattccactcagcaatgtagcagcacaactgaaacaaatcatcgcaagccacatgaaatgctgctgcacatttgcttcattcgaccattagatgaattagatgaacatgagattgcgaaggatgatatttcgtgtgcaaaagaatgcacatgacagcatcgacagtttgcttgtacaacctaagcacattatctcgtgcaacatcagatccttgagaggcaaagaagctcaccctccacaaaataacctacaattcagaccataagttcagaaggatcaccatggtaaacaatgtgcaaaacccaaaaccaatgtttgctggtcataccaaaagcaaacaggccactgaagaaagattcaatattaccttgttcataaataaatttcgtccattaataactgaagcaggacaattatgctataatatttagaggagagtacactcaacttcttttaggtgtacgacggacaaaagaacaaaatcggaaaccgatacaaaatccaatcggataatcatctatattcaatataaaaagcactagtttatcaaatacctctctctcctgacccttagatctattcatccaacggctcatattaaaagttagatcaacccctgcaattagcgatcccacctggagtaatcagcagttagcgaaaaagaaccaatagcagcgaaaaaaaaaaacgtcgcccaccacagaccgcgcccgcccaccacaccgcccgcgcctctccgccgcaggcactcgccctccaccccgcccgcacatccccgccgctggcgcccgcctgcgcccttgcctcctcacctcccgcgcctgccctctccatccagctcgcgcctcccctaccgccggcgcgctgaacctagatcttctctcttcgtctgaaccgccacttccgtaatctccatcgtgcagtctcctcttcctggccacgctcctctccgttgtcgtcacgatggtgggggccgaggggtggaggcggctgaggaggtgcagttcctaccgcggctgctcgtcatcgaccaacggtggaggagggcgaggtgttggcggatgtgtggttcgttaattggagccaggcgggtgaggtgaacaacctagcaccatataaatccatgtctgaggattcgccgactatgtgcgggagttcctcaccggcctggcctattgttcgaggtccttgcgcagaaagcgaccgcctacgcgcgggtcacacgtgtcggggacgacggcatggatgagacgctgctctccaacctcccctacaactccgactacggatacaggtcagtatttgttgcttatctccacaaatcccaaatggcaatcgaaatttctagaggaaattgcaaaatcgttgggcgtgtgtttgattttttaatcgagatactcacattagtatattgtaggaaatatcagatatgtagaaaaaaattggcatcaaaacttgaggtgaagggtcctgatttgctgatttcaagttgaacctgcagcagtggcggcaatagctgttctacaagcgagcggctggcacggccggctgtacaagtgagcagggccggtcaggcacctgccaaaggtgctcaatgaacgagttttacagtatttggtattttggttcaaaaaactgtagagcttggctgtatttggtattttggttcaacaaccatcgcccacgctgtctgtgcaaaggcatacttgaacattattcttcaagtgctcgcctaaccttgttggtaattggtttttagcttcttggtcagtaatgaaaagattagacagacaagataaatcaatatagattctaactacactgctgccttcaaaaaaaatgtttcataaaatatttttgcttttgcagcttgcggtccgaatctagctgcaagaaattggcttggatttactggggctataccaagtttcttgactgtatatgtttgcaagatcaattccaaatatctctcaggtgacgtacgtcttgccctctcagaatactgccaaaaattaaaatttaacattgttgtcttgtgttttttgagattgagatgagtttggtagtagctatgtgcttttgtctggagaatgagactgtaattgtgtaatgtgtatatgctgttaagtaagtttgttactgattcataatggttgaaccaatgaattgatgcccccgctggttcaattaccggtccagtcctgaaaagtatggttggaggacttccgtatgcttagctttttatgcttctgctacgagaaattctcatctgaaattgttttcattgctcatatatgttttagccatatagcagcagactgcttgagtgacaaagaaatttcgatctcacttctagaatgctaaaattatttttttttacagggctttcatcaaacaaaaagatggttggaaaagaaacaacaggtcaaatagctttggatgatattacaccaatggatatggctttgtaaggatcttgtgcttggtactcaccattttcagatcctataattgacatgggttctatcttctccttataaatgtcaaaacttttgatgggttataaataaggaaatgtttggtttaaattatatactagattataacatgcactgcatgtgcatggttattgtatatatacattaaatgtcatgttatgtatgggcctaatgacttccattgcttcttgatacggtacttgacaaacataagaacataggtgttgaagtcagtgttgctgttagatgatatttttgttttctgaagtggaaattaaattcctaaatgtttttctacttttcttgtactattctcttactttaatctgattgtgccaggaagttagatatatatgtgaatatgtgatgtggacaagtgatcttcaagattgatggaaggattaaaaaaaagcttcaatcttctaagctattgtccagctactgttatcataaaaggctaaactgattgaagaaacaaatggaatggaattctgaacttgctatgtttgctcttatttcagaaattatccctttagtcctacgatcttggttacacaacatattttgtttaatattgcttatgggcgttgcataccctgtagtaccatgtagtttccccgtagtaccaatacgttgtaccttgtccaacatgagttcactacatcttgttcaataataagaattacctatgtttccttgttttgctctaagatgcatgcattcaataattaatttctgtttgattaagcactattctaatctaacaaccttttgaatgtgttattatgtgtttctatctaatctccctcgagcaacggcgaagacaggggggcctggcctcaatgtgtgtctgttgtaggacctactactaagtaatccttaaattaggtgattatgttaagcactttggtgtgttgggctagatttgcagtccaaaacaagctggaggtataaccctacatgtcttttgtcatggtagttggctcggcattccatggtctctgcaatgctagaactttagagcaaatcaagcaggcaacaatttaacatgttagaatgcaaggacagttagaaaggtcagctcttccaatggtcacgtatcgttgttgactgctaatgtcttttacctcgtaagctctaatttttaatttaccgctccactttaatataaaagcactaaaataataaaaaaaatatgtatgtaacgaataataaataatatgtatgaaaatattcttctgtatggtcaaaaaatataggtatatttatatgattgattattcacgtaaaatgcttcgattttacttgaaatttgatgtattttttttcacaatcctggtacttagcttaatttgccccctcccctcgagtatagatcctggctccaccactgtcctcaagaatttagatttggcactattgaagttgttggattgcttgtttctcttaaagggctcttttatatggattggggttcttgaaagtgtactttatggattgcgttgggttgatcatgttccttgaattgataacttatcagtctgattccccttgtaggacatgaaccgtaaagatgcaaaccatctacataaaggttgatcccataggcagcttatcaaatacatcaattgtttggatacatttgggtactgtttttcattatggggagtaatttaggtaaattcaagtggtttatgaaaccctgcttttacgtcaacttatatggagtagactgcataaaaaaggttagatcaagtggcgcgagcattgcagctgctcattgtttttttccagttgtaatcggcacaccgatgacacagggatatgtgcttaaggaagggttgttgctggcacaacccctgttgcttcattttgagcatgatggtgaccgtgtaactataatattttatcaaatcaatatgt

SEQ ID NO: 11112 - DNA, 23140 bp, Oryza sativa
atcaacgtgccttgcacgtgcacgctctatagttacttagaaaagggaaaacaaggaaagaaaaaaaatcacacaaatccaaaagtccagccaaccttaataggatcacattgccagtgtctcctaagcctcgatttatatcacaaaacagaaagaagctcaattcgagtcggctctgtccaaatcacatattgatacccaaatcaatacccacagcatgcccagatgcatacctaaataaaaaaaaacatttaaaactaaataaaaaagaaaatatgtgaaccattcaggtctcagtgacaaccaaagaaattaaaatcaccaacatgctgaggtcaccaatgccgccgtacctagttgcttgctcgaggctgaggacgaggacgccaccactcctgctacctgccgaggccgaggcctgaactcactggggtcgccactgcctgtgccgaggccgttgcctctcctgccgcacaacaatgccaaagtcgctactcactggggccgttgcttatcggtgccgaggttgtcgcctctcctgctgctcaatgagaccgagatcgttactcgccaaggccactgcttgccgttgggccgaggccgttgcttctctcactactcgatgagcctgaggtcgttgctcgtcggacggggttgccgccaccatcgttgtcggcttgtggttgctcgtaggggccgaggccgctgcgttgctcatgtgtggcttgtaggagagatcgagggagaagcttatgtgtggtcgtgggaaagagaagaaagagataagagacaggagaaagagataaggctgtgacatgtcacatgtgagcgggatatgtatttttatccctcgaggggatgttttctcattggttatatgtcatttaaatagttataaaaaattaaaaaaaacttgacaacatagattaatatgaaacattatgacgtattgaaacatcacataatgctttgaataggcaaaaaaacaccattaaaaagcccactacatcattttgttctaactaatgaaacatcctaatttgctgagctgaaacatctaaattaaaaaaaaaggcggaatagatctatttctttatttcttcatgctctctggtagtagtctacaattccgcttacatgcaaggtgtgaagaatataacagcccgccctccagaaccatgcaaccctgccattcaagacaagcggacctacttacacaaagcaccccatttacacatttatcctcacttcgtgtaaaagggttgacacaaaagtagtatgattggaaggacaaggccttatagtgacaccctcaaccacttcgagtttcatgatgtgatgcgttgcgtcctgctggtcatcaggtatggtctcaacaattcgtctcttagccgctctggtggctatgggaagaagagggaaaaatgagtgggtagtattgatcattggggagaaaaaagtgggggagaagggttaggtgggatctactaaatggagcgtctgatattttgtcgtgcactggatgtgcgaggtaaatcgttttctaatattttgtagagtgatacatttatgctgtatggatgttgttaatttttttctaactactcccttcatttcaaattgcttatcatttatttttttttctaaatcaaacattcctaacttttactatcattttctataaattatgtagtgcaacaacatgtaaattatatattatgaaaacatttcttatggtgaatcggaaaccaaaaatcttaggatgttaaactatgtagtaattattttagaaactaatggttataaagttagaaatatttgactttaaataaaattaacaagtaacttaaaagagaagaatgtttggattttattgtttgaactttgaacagggaatacatcctccggttccctgaaccaatgggtcgagcaatgacatatctgtcaatgttccttaatttgtcagcaacctacatcgacgagacgacaatggatcatggatgatggtgacctcttcatttttgggagggaccgggtgattgactcccgtgccgctcgctctaggtgacacgggaggcgatagcctgagcgcgcggggcctcggccgcgttccacttgcgtcgcagccgccgacgaggccgccggcgacggtggtgccagctatggcagtgtctccctccctccccttcttcctcctctcttttctccctttcttcctcctctcttctctccttcccttcttatctccagatctggggcgtcccggcgccggcggactccgtcctcggaccggcgccagcagcctcatcccagcccagcggcgaagtttttacggggatggctggatctggtcacgtaggcctagatccggcggctccccgcgtcctggcgtgacgccagtgcggaccaacgacgttggagtccaggtggcgccagcgagctcagctggtccgtcgtggtggctatgcaggtcatcaacggtgtgcaggtggttgtgtgcatagaacatgtacattcagtgtgcaggtggcatttggtagcttccgtttgcggttgctttgtttggatgggacttcgaggtgaaaacctttgctcggctttaccgatgcgcaacggcgacgctctcaggcgccgttcaccttcttaaaggagttgctattggagctttcattcaactccatatcaagaggttctccgggtgaaaacctagatttgtaggatcgggcgatgtcgctgttcagtcgacgtgtccttcttgaaggcatcgttttataagttttcccttgatggacggctgtacttagttattaggttcaatctgtcgataccagggttttcgccagtttttcacaaattaaccgtgccgtttaaggtttttaggtccgatttcctttataaattggatcaattctcttcttctataatgataatgaattgcaagagaaactccctgttccctcaaaaattatatatcaacgtatagtatggcagtatggcaccgcaatgggatgccgaccgaccaccgtgaaaactgtaacatcgggctccaccgatcctggctcgacgcctgccggccgcccgaccggccaaccgccgcgcatctccatatcacaggtcgcaggtaaaacaagaacagaacacacgtgattcagagggggatgaatgttaaacaaagtgacacacaatggctaccttccattccaatcatccaatctatggtacggcaataattgccacgaattacagagcaaggttagcgagacgctaactgagagagcaagagaacattggacatcggaaatggtgggcggctacaggaagatgaagcactccatggccaccgaggggttgatcggtcccagcgcgccgccctccgccgtctgcttctcttgctcgtgcccttcctcctccaatgccgactcgtcggagccgtctcttccctcttccggtgaccggccaccgccgccgccgccgtggcattgcggcttggtttgctcgagggtggtgtcgtccttcgcggtcttgcgcgtggcgccgccgttgaggctctgctgccgggagatggcgccgttcgctgccggcgaggcgggcgggatgtgcttggatgttggggagtccggccgccgcccggatcgctcgccggggtcccgtttggctgcgcctcctccgtaggcgccgccattgccgttgagggaccgcttggcggctgccggcgtccgggaagaatgcggcagcatcatgtcggcctccctggcggagttggttcgcctgacggcgctctcggcggccctcctcgccgcggacggagagaacctgccgcttcggcacccgatgccggacaccaccgcgggctgctcccgccgtggccgcgtcggcggcgccaggtgttcgccgccgccatacctcctctgcgccgacgcgggcgacggcgacctcgccctcccgttgcctgcagcctccttgggcctcctctgctccggcgtcctcctcctcgccctccccttctccatcccgccaatcgccttcttctccacctcctgctcaccctcaccccctcccttcgccttggccttctccgccgtggccgacgccaccgacgcgctctccgaaacttcctcctcctcctcctccttccgcttcaccacctccttctccggctccggcggcggcctgggccgcgacacgggcacggccgtctcggacagcacctctttcacctcctcctcctccaccaccacgggcggcggcagagcgacgacctccttctcaggcgggagcggcgccgccgcctccttatcggccacggcgccggcgcgtgcggaggcggccttcttgctcacgcagctccccattatcgctcgacggcgagagtgcagtggcgcgcaccggcgggaaggatggtcagcgagaatgcatgagctgcgtgaggtggagggatcggaacatggatgccaataaatcgctagggtcaactgctgctggctgcctgcctggaatatactccttagttccatattttgagtttttacttataacatttgaccactcgtcttatttaaatttttttaaaattattatttattttatttgtgacttactttattatttataatactttaagtataacttttcgttttttatattttaaaaaaaattgaatacattgtaaaaaaaactaaaaattattatggtacggatcgagtagtacgtctaggctcgttttcatttctcaaagacgcacgcagagatcgacagcgaatggtggcgtgctcattaaaatcgggtcaatttgagcccgagctggcgccatcactgctctaactccaagtagctggagctgccattactactgccatctactgctactgtggagcgtaagcgtagtgcgtttgtcaccatggcctgatgagcgaccgatggccatagacgaactaggtttttgtacgttaaggctgtgtttagttcggccaaaaatttgttagtatatggactttttaaagtataaggatacacatttaaagtgttaaacatagactaataataaaataaattacagattccgcctataaattgcgagacaaatttattaaacctacttaattcgttattagcaaatgtttactgtaccatcacattgtcaaatcatagcgcaattaggcttaaaagattcgttttgcaatttacatacaaactgtgtaattgtttttttttcacatttattgctctatgtatgcgtccaaatatttgatgtgatattttttactaaaattttttgggatctaaacacaccctaagtcgttaagtgaaagagtgagagtgaaagagtgactatggctgcgttcgaatcagcgaatgatgtgaaatttttgtggcacgttaaatgaagttgggttaacacacgattaattaagtattaattattatagacttaaaaatatattgaaattgctaaatgtcattcgacggaaatttagggttagagtcttgcaaatatattatcttaggatttgtttcgcaatttgtgttccggtaacccactatccttctcccaccagctccaacgaccacttcaacatcatcgtgacctcgacgaagacaatgcagttaggatttagggtctcgggttgggatgggtgtggggcaaggggtgagggtttgggtaagaataccggacttagagggatggccatcagagacggtgagacaccggagccatggggtcgagaagggtggtggaccggcgttggtgatgggggcaaaacgagtttgtggttaggaggccgcggctgttggtggcgtatccgatggcagaccgagggcacctcccgtggcgccagcttgaggaggaggagggagtgaagggtggagaagccaaaccaggggagagggggctcgccggtgccattgatgtcttccagccaaccggcgaggctgagcggtggcgtggtggcaattttggcatcgagtgctcgagccttcatcatggctgtgctgagaggaagaggaagggtgggttaggtttaagtgggtgtgcactaaagcaatctgacagtagaaaaatttcaagatcttttgtgggcttttctgtcaaatatgtaaaatatatttatttgatttttgaatgaaactttcatattatttttttacgaaacacatcatttagcagttcagtaagtgtgctcacgataaacgagcaagtggccgagtgtataagctgagaagaactaacccttacaagtaatacgtaacccttacatgtctaactttatgggtatttcggtcccaaggcctttcatttgaatgaagaaaactaaatatgtaaaaaaaatcaaagtgtttatgtggctacttctataggacagattgaatattagagatttgttagacaaaaggcattgtgcccctgacgatgcgtatctacattgtgcttggtgtaaaggtccaagaataaactttgatacatttgttcttcatgtgtccctttagcaagagttgttgggatcgtcttggaattaggtggaatactaatttggaaatgcgccatatgttggtgttgataagacttcagtttagaaaaggttttcttgagatcatgtctttttgcatgttggcaaatttgaaaacaacgaaatgagaaagtttttgatagtttattgtgtgatgaagatcattggttcgctgcctttaggaatgagatttttctttatgtttgtaggatgaattaggccctcagctcttctgtgcatagctggttacaacttttataattcctgttttgtgttggaaataatactcttttatattaatatattactattgggcaagccggcaaggcctagtagtactttaaataaaaaaagcaatccctctattgttttctaaccatcttcatattggagagagagaattaatagttctcaggtgaccaaattcttagtcatatcacattgctccctagaatccaacggctagggaatcgtctttaatctctgaccaaaggagaggtagaagactcaccagccacgatagcgagagcagtagtgacttcctattggtggtggcagcagtgacatcctgctggtggtgacgatgttaaaactccgacagagaaacttggatgggagtcaatttggagaggatttaagttgggtgaagaggggtttcccaagacttagagggatggccggcagacggtggtcgaactagcaatgggcagaggacataggcatgcgacaagatggtggagccactaatggagttgtggggttgaaagggagggttaggcgttaggcgaaattgacagtggggcgttagatctggagtggttaggaggcatagatgacggtgggatctaccctgagggaaacgtatggagagaacaacatggtaagggtactcgccactgtgtgtatgacttaggaaggaatgtaggagaggagggacaaccgggggtcctcaccaaagctgttggttccttctggcactagcgaggccgagcagtgagaggagagtggcactggaggaggtgaactagcacctcgcctcacacatgtggtgtaccggggaaggcgctacgggtggggtagggggttgctctactttcacgaatcttagcgcgatctaaagactcaagtaacttaaaaaaatgggtattttgatcagctactgaaaaatggagtaagttggattggagggtactgaaggattcagagaaaagtttctacatttctactaaagtgtgacatatattttagcgaccagcaaatttgtggttttcgttttacttctacatcggttgttctagcatgaaaccatgtaggtatgtacaagtatatatgcttgatgcttgcatggttgttataacctgaatgtaatggtgagatcaagtatcgggtccaaaggctattgttttctaaatgatgtggacaagtttttatttctactatatagattacatgaaaaatccaattattatcgggtgcattttcgaatcaatcgaagttccgccttcactgaaactttttgatttgtttttggctataactttagtcaggtgactaataatctggacaagtccccaagctagaaagagctactcctttcgtttccgttttatattgtatgacgttttgactttattttaagtcaaacttttataaatttaactaaatttaaagaaaatatagcaactcctatggaaccaaattagttccactaaatttaacgtttaatatattttgatattatgcatgtttgatgttattgctatgtttctataaatttaactaaactttaaactttaagttagaaaaatatcgcgtaagtcttgtaatgaaatggcgggagtaaatttttttaaataggacagacggtcaaacgttggacaccgaaacatacaactgcacttagaacaagtttaataatatagccaactactaactccaaatcatctctaatcaatttaaaaattagttaattcatacaatagttacctataaacatatactacactgttaatacctggtcctacctatcatacacacattggatcttgtagtctgtgctacatctagctacaaatctgtagcccactgctcttctctatactcttttatcttatcgaaatatatttatagttggttagtctattattatacctgttgttacattgagatagagatagggcctgtttagttccaaaaacttttccaaaaacatcacatcgaatctttagacatatgtatggagcattaaatatagataaaacgaaaaactaattgcacagtttacatgtaaatcgcgagacaaatcttttgagcctaattagtcaataattagccataagtgctagagtaacccacatgtgctaatgacggattaattaggctcaaaagattcgtctcgtggtttccagacaagttatgaaattagttttttcattcgtgtctgaaaactattttcgacatccggtcaaacgtccaatgtgacacccaaaaattttcatttcatcaactaaacaggtccatagtactccctccatctcataatacaaggcgtgcacgtattcaagattcaacttttaaaacatttgaccaacatttaatgtaatatgaaatgaattttatttgttaaaaattatatcattagattgacatttaaatttacttttatatgattataattttgttgctacaaaccttatagcatatgaaaaattataagttaaagattagttttggagaccgtgtaacttttaccatatcttatattatactctctctccatctaatctattttttatagtcatatttcatcttggcgtacagaccaaggataagtgattctacttatcatccatttaaacatgctactagtcattcctcgtaaacaagcgattcattaatatttacatttctcgatgaccatgtagccaatcttgtgtggaagaataaagagtcacgcattaaatcaaaaaagtcattgtgaggtgagtcaactgcatgcattagtttactagatagtatttcttttttcaaatccgatcgaggccatactttatgcttctatactttgcgatcatagggcggttaattaacagccggtacagctagcaattgttgtcagtacgttgtgcagatccgaggtaggcaatgatttgtaggtaaatgcagctggtgcagtgtactcctcctgccttaaaaatcaacctaatactgaatatatgtgacacattttagtattataaatctataattatctctatttagatttattatattaaaatatgtcacatctaatttagatttatttttcgtggcctcttaggggagtgtccgactgtactctacccggagtccagctagctgctacactgtgaaaagataaatgagcgccatgcatgattccatggggagttggacagcagcaactcaagcctttaaaactcgctaccaatgcagttgtccccatttatagctccccggccggaccctgttaatttgcatatgcatccatgtgcatgctagcattttcatttattcatagtttggctctcatccgactgaactggtcatgatgctcctaccgaggccatattcccaaatcccaatggctttttgcaaattaggtacagtacgtcgtttagggcactccaaacgtggtggcgaagtttcagagatgttcttcgatcctagatgctgaataaagcactactactaaactcttcatagatgtcagctcataggtcccggtttatttaaaaccggcatttataaaccttttcccatgtccgccgtaatgaaaaaacatacaaccaacacttttaaatattataggtatcggttgtaaagaaaaatcgattctaatactctaggtgtcaatttttaaaagaaccgaggtacccgttttttccctagaaccgacacttataatataaatataggagccacgccgcccctcctcctcgccgtctccgagccgtgtcgcgccggatccagccaccacgcgcggcagcagctcctccttcggcggtagctacgaccgccctctcctctcccctccacttgtcttcggtggccgccggcggatccagcagtgtggaggtcggtggccaccggatctagttggcatggaggtgggggccatcggaaacggtggcacaacggcacaggggagcgcggtgctagcggcggtggcactgagtgttgatggtcgttatagaccaattcaatataaataaaagagtaaagtccatcaccgatccctaaacttgtatcgttgtgtcatcccggtccctaaactcgcaaattgaccgtttaggtcctcaaacttgttcgactgtatcatcccggtccctaaacttgtagatcactcgtttaggttctccaacttgttcagttgtgttaccccggtccctaaacttggatttgaatatcatctaggtcaaataggacggtctaaaaactttatatttaaaaataattcataacttttccatgtgaactctaatgaagacaaactttatatcaaacttgtagccctcgacgcgatatacaactttgtagttgaaattcttttttattttaagtcattttttgtcccaaaatgtaattttaaaattaaaatttcaaaatttataaagatgcaacaatattttgggaccctaaatagatttaattcaaaaacttttcaactacaaagttgtaggtcgcgtcgagggctacaattttgatataaagtttgtcttcattaaagttcacataaaaaagttatgaattattttttgatataaagtttttagaccgtcctgtttaggaaagtttagggaccgaaatgatacagtcgaacaagtttgagaacctgaacggtcgatttgcgagtttaaggaccggtataacacatcggtacaagtttagggaccggtgatggactatcacagcctgaatttcatttcaggatttataaattatttaataaattattaatagaatttatattaaatattcattaatttacaagcgaagttaaatgtgggaaataaaatttcctaaatataaatcatggttggatttaatttttattaaattatccatgattaattatactccctgaaattttcttggatttttcagagctcaattattaattttaataatacaaagaatatttcagtaattattcacatattaaattaatcattaaatgagctggttttaatttttttaaatacttagagtgtccaagtatgttcaagaattttcttggaattatttgagcattggaagtatttttaacaactgaaagatcatttcagtgattaatttaattgggaaaagtaattaaaatccccttttccttttcgggccgaaacaggaaaagttcacctttagttctcggcccattcttccttctattcggccggccttatcccttcccgaagtctagtttgtatctctccttctatcgggctgtgcaatagaagcccaaccaaaagtctgtttttctccctgcgccactgttcatcttccagctcaggcagagccgagccagcagtgctcgtgtcctgttgccgccgcctcctccttccaaatccgacctccccgttgctcctctttccaaagtagttacgggaatggaatcctctcaatctcctcttcaatttccccaagaaatccccaaaactttatatggaaatcctttccaatttcgcggatcaatctttcctttttccggcgaatatcctaaactttcccggagtttcactcgtcgatttgggcccggacccgagctcccgtgcctatataaaggaccccctagccgtcctctacctagagccgcctccgcgcaagcccgtgagccgccgacgccgccgtgtctctagcagcccagcgccgtcgctgtggtcgtcgccttcggtcgccgctgccgtcgttgggtttgcgaggaggaggagaagatcgtcctccacttccccgaagctgaaatccactggagctccatcgtcgccgtcaacccgaagtttgccgtcgcgttttgatctccggcgaggccctgctgctccttccgtcatcgccaagcttcaccgccacctccgttggattcgcaactgcaagcagaagaccgtccaccacctcttctccgccaaagatcgccggaaagtcatcgccaccgtcgatcagtaccccgtcgccactccaacctcgccgccgtcgtcatccgtcgtcgtttgctgtcgttcaagtcatcggtgagctcccctcgtcgtgctctttcctccggttcagatcaatctaagccattcgatcttagtcgactcggtcaaaattaatcttaatataagtcgtgctatctcttttcagtggcatattatttctttttaatatatgtcatctaccaaatatgatctaatcttttccggaggttgttttaatcttttatctccgttataaatcatttgtaaattgtttaattaatttggaatagtcttttctttaataggtttaattggaattaaatcttgtaaaattcgtaaataattcatatgaagtcggaatgaggccgttcgagtctctaaattcatcaaaaatcatgatctatatgtttgcttactttatatgtgtttatttggagtttcttagtctttttcctcgttttgcgtgttagcttgtcgttcatgtcgtttcgaaagttcgcgcgtgcgtcggaagtattccagagacttattgaagaccgattattgcaagacaagtcacacatatcccaaacacaattcttttgagcattttgatcctatatttaaattctctatttatttctattgtacatttattttcgaatgtcacagggtggtgtgaaactattcctttgttatggccactttgcattgattactctatcctttgataccttgggttacaatttgactagttgtacttatataatggttcaactagatgtattagagataattgcttagccatgcttagaaacattagcactcaattgggataactaatgtttcactattacctaatgatagatattcaatggtagctcacgatgggcaatcgtgattggttaattaataattggtcaactaaaacttgataatggtgggttgtgagcacatggttttgatggtcgtgctcatgacaattaaggaccggttcacgagtttcagttgtgaaacattaaccgtgccaaccataagccagcatgggcaacggctttaccttttgtataacatggttcattgcggggcaccagactgagaagtggcggagataagcccacgggggtcgctggggagtccatgccttgtttataagagggtgattatgatccaggaacaatgcgttgtggtggattgtgttatgcgaggggtactgtcacagctccttttcgaggtaccgtggtggtattgaggcgcatggtgacatgtcgtggggctgtgtcttgtaggtacagtggtacacctctggccagagtaaaactattcgaatagccgtgcccgcgattatgggcgggtctaacaatgtctttcgtgattagtctcacacttctcaccataataaatgatgctataactggtaataatttgattagctcctggtttggaatggtacattcctggtttggagatagatctgtacagccgggtatggttgttcaggatggttaggcctgtgcagcatgggtgtgctgtttagtgttgattaatattgatgattaattactctactgttttgcaattctcaaatgtttactaaatgctgcttttgcaaatgagccctatattatgccattctttggtatccttgtgcacttgcatatttgctgtgtggcttgtggagtattccatgtactcaccttgcaataatcaattaaacctcagttgaagacaagttgcaaatgagaagacgtttggcttataccccagttgagttgcctgtgggagtggagccggagcttcgctagaccgtaattccgctgctgttttcttttcttttgtaagtatgtaaagttattattttgatgaatctgtatattatattgtcagtttgtgtacctcggctgatttctggacaaggatttaatgcacaaattagtttggaaattacttgtgaatttctaggcgtgacatggactttactctaaataaaataaaggagaactagctatgcttgcaatgcatatatttttcagaataatatagttccacttgtacctggagtattatttatttgtggagattaatacataaatggagaagaaatgatgaaacttcactcctaaggctgtgttcgttttggatggttgggaaccaaactcctccccatggcaaacggagcagttcattagcgtgtgattaattaagtattagctatttttttcaaaaatggatcaatattattttttaagaaactttcatatagaaactttttttaaaaaacacaccgtttagtagtttgaaaagcgtgcgcgtgaaaaacgaaaatgaggagttgggaacaaggggaaacgaacacaacctaagtaagtttaaggataagatgggcccacatgtcaggtgtaaccgtcccagaaaccgccataactgccataaccgccttaaggacccacctgtcagtgaccttgggaagtttggaggcttgttgggccggcccaggttcggccgaaccaggggttcagccgaaccctagcgagctcctctcatcccggccttccacgtggacgctcctcttcaatggcggttacagggcaatttggacaattcacatagtgtaaccgtcattacctacctataaaaggaggaggcctcattcacttcaaggcacactcaagcaagctcaacatttctctctatactttagtttagtattctagtgctaagtggagtagaatagaataactctcggagtccttggagtcttcggaggaattagggtatggctctagtagcttttctttattcttttgtaagactttcggaattaatgggatattattctttatatactctcggtactttagtttatctcagtatcggctttactttatacatgtatcgatatagttgtgtagctagcttaccagagaggtgcaatggtgttggtttaatatccgactattcggttgctctatgttatctcgggggatatagcgtagtatttaatattgtagacgtggtgtctcgattattaagtatcattatttgggcatatatgttgcgggacggtcgaggtgtactgctgatggtgacaactcagtacgggtactcctccatatgtagccctagttggacggccatgacaggttgttataaggaacatgacaacccggggtggtctctcgaaacaccaggagggcactgttagggggtataggccacataattgtatactagcagatgtaaactaagattgagtgtatactagaagtatagggattgattgcttttctatttcttcttacacatggcgtagaattgattaatgagagatatgagttattttctttgtgtcactctactctttatgaatacattaacccctgcttagactctgatcatacaagtggcatatatatatatatatatatatatatatatatatatatatatatatatatatatatatatatatatatatatatatatattagcataattctctcttacaatcttccattgggatttggattaaataaataccataccttggaatactttcgggtgaaatgctacaatggtatatccatgcgtttgcggattccttctgtaaccatatatatactaggaccatttctgtcgccattgctgggaattcatatttctagtaatgtcgttaaaaaataccaacactgagtagcaggcacgagatgtcgacggtggggctggggatgtggcggatggaatcctccgccatctgcggccttatccacaccgccgtccacatcggctaccaccactttgactgccccgacatgaacaacccaactagctactgctagcttgccttcccttctcctcccacctattacactgatcgagccgaactgaagttgttacaagttggacggttccgggattgccaatctgcaataatttactaccaattgtaggatggttgtgtgcttgtgtgtcactggaaaaattggcaatcgtttggtcttgtgttgtttgaagatgtaaacaaatcaggttcattgaagtttgtcttggataagtagcggattgtattctttattttacattaattgttgctcgtacagaaatcatccttgacttggactgtgagttgtgagatttggatttggatttgaggcaaccggaacacctcatatgcactggattaattgagccgtcgaggctttttttttgtttcgcatatacctcataggtgtcagttgttagtggtgaaccagcacctgtaatccctaaaaccgacacctataatctcgggaataggtgccgacaaattggtgtcagctagaaaacggcaccaatggttgtttctgcagtagtgaaatgtgagaaagtacaatctcacatacagtctaagtatccatcgatgtttcctatctatccgatacttgtttacggagtataacctcaatgacaacctaagtcaataaggattactacttaaaagttggttttcaattatacctatataaaaatgaagaaagtagcgtaatgatttataatagcatccttgatgggtacgctcaaaccattttttctgttgctgtggcatgtcttcaacaaatcaatggcagtgaactaagcatctttgtatttctcttgcttctaaattgaggtgtaaagaggtggtaccgttatttataaaatggtaacagttttggaactagtcctgttaaacatagtttgttaagtttcctatcagcacattccaatggactaagtagctccgagaccctatgcagtggtgcagcatgactcgtacacgatttcttttgtttatcaagcacttggatggcatataacaggacatttaagatcaaatggactaagtatgccattatttgtaggacaagatttagaaatgtacaatattatttcataccttatatgctctagggtcaactgcagcgttaccagtcgtcattcctcatatgtcatatgagccattggtgaggtggtacgcgatgctggtaccagtctcaagacacattggcctttaccatctttcctcggaaaaatgttaggctaatctgcaatgatgagttgagaatcttttatgccatgactaaaaagattaaaatctctcctgtcaaagccatgataaaacaatggttagaacaactcaagatgataggaccaatagattgcaattctttaatcactcgtattgttgttaaagtcgaagctttggagaatggtgcaatcatagacattccccaacctcactccatcattaacgaggattatcttgtgcaagggcaggcattgaaacatggtccaaatgcctctatgttgttttccttccctagatacacaaatgagatttcgttaactaacccaaaatttcatttgtataagtgccaggcgctaaccattcctctcgtaccacaagagggggcttgaaggagcaatgtttctggcaggacaactcgaaacatgtctaggaatgccgtcgcgaagtagcagcaacaacagttgcaatacccgctcttagattggagccagcctgggtatacacttggctggaaccaaccgctgccaacatatggagtagggagctcggcgtgggcaagtgcgagtagtggtcagtgggaacatcccatcaacagactctagggaaatattcccaatgaagaccagtccaccagctccagtggaatgcccccacagtccaatgcacgtgactttttcatgtcccaaaattttcgtgacttcgggttgaggtgcagatgtcactcggcaactgggagagttgaatctccggaccagcgagatgcacaacatgctaaaccagcatgtccaggagacccacacatgacagtagcacatcaacgaccaattagcgaacatcaacaccaccatgcagcaaggttgggcttccaccatatagctacacactttgcacacttgatcaagattgtatgatttgctttctcctagcttggatcctctctttgattttgcaatatatgtgatacgtattaccaacatcttttgtctctactttgagctccacatagaaacctttagaagtaggatgataaagaggcaacaccatgccttggtgaggagtatcatacacattgaatgatcgagagtatcatttgaggaactttggctttaattgcaaaagttcttgaaaacctccagaaagaaaagttgaacaaaagagtaagtgattgatgctctacgattcgctctatctctcaaccacccaagatgaggagaagctacaagtcccataggtaataaaggtaaaagtattattgccaacttattcaaattctaggtagaaggatacgttgtatgcattgtactaatgagaaataaaacatgatagcaacacatgatcaacaacctaagttttatctttactcaggaggagcaaagttcagcttgaggctattgttgatgaccgttaagtaccaattttgaccaccaattatcataataaataaagggagaactagcacttcttacacgtagttcaataataaataatgtagttccactatacttggagaattaacatagatgcagagaataaacatgcaaagaaacacacctgtggtgaatcacgtgcaagcacacggattaatgggcccagaagtcagctcaaactgacttaattggaggctaatccaccatgcaccgtgcaagcctatgggagatggtcagtagcaagaggcggtgccactagttcggctgaatcaggccaagcccacctcgccatctccttacacgtttcaactctccattggctcctaatgatgatatgggtgtttaaccaacattgcaaccatcattaccagctataaaaggaggagccctctcacttcacaagtcacacctcaaggagctattctctgtactctattgtatcttctataatattagtgaaagtaggcttagagtatcttcggtcctatagtcttctcggagattctggtatgttttactattttgctcttcttgtaagactatagtcgaattaatagaattatcttctttaccttcttgtgttcataattgatatattgttttagtatttatatgctttatgaatatgatgtacttcatttatatgcttcacttgattaggttagtcgatctatgctacggtaacgctccaagggccttgataagttgctagctctaacttgtccatccgaagggtgggagccccttgggagttagtaatattatttattggcataagcatgctgcttaggttagataaatgttgttggatgcgggtggcctagcctcacgaaaagtgaggtaggcggcgggtgctgatagccatgtatgtcctttgtattcctccatgtttagatatgacgtaagagtgcataaatgccataagcacgctggtagaccagtagagagtgatctctcggtagtattgggtgtctagaactaagtcctagcctgaacatgtatgtattaagtatatacaaaacatgattaatatagaagcacagttgtattctagttctcttatgccctttccactatagtaattaatcaaaggcgaatctcctgtgtgtgtcacactaccccttgatcatattcatcttaacccctgtttagactatgataatttaattatggattgattaatgatgtataaactatatctttacaccgttgccttccctgcggaaatataaatataatacccttgggaatactcaagggtgaaatgatacaacgctatctgtgcacttgcggatttaactatgaatgtaaggaataccaatagggcccatcttgcagtacatatcaaaaaatgttatgtccatggaactccctccttcaaccagcactcacggaacttcacacccaaaaatacccgtcgtgataacgcatgggtcttggtgagcaacaaagatccccttcgcatcctcggggtcaaaagaaattggggtgttacagtattgcggcaccttggttttggggtttgcagcaatatgaatcatcgcctggtcatgtacgtctttttgcctcgttggtgtgaatccttcggcatatccgctcgtgatgactgctatgattatttgtggccatctgcggttccttcaatttgtattggccttcgggctctctcggttgatcaccctcttcagcccattggcggttcaggggaggagactatccttggctcagctgctgcaaatttcggcacttatccattgagtgtgtgaatttatcgtgctacaagcaatatttatctatgctgcactttttcttcttggcgggagcctgttcgcttcatttccttgcatgaaagttcatgcgcgaggcttggacctccttgaccgtcatcacttgcttccccttgtcattctgaaatttcttccatgacagttgtggcagagtttatcgtggtgggttaactggtgcgactattttagtgactcaggcttccgtcctgccttgtggctcggtcatacttggcttgaatttcacttctgtgctttgtatcttctttccctcatgcataatcctcagtaatgcgaaagaggtagtcaagcattttcttctccttcctcatgattttctcagtgatcggccttgtgcgaagccttgtcgaatccgcgttgatgaccgaagttacgatggtgttttgaacttgcaccttgcatatgagaaccttcggacaaattcacaagctgactagcttggcttctgccagatgccgaagagctctttttacattttttttatcctttattagttcctctaaagttggtgatgggaacgcccctcgattgttcccatgagtaaatgctgcttgggggaaggttgagctaccatgacctagcaaaaccgtctagaaccaggtgaatcaccttcgccttggtgttctcatcaccgtgtgttgcttcaaacgtcaactcataaaatgacaagaatttacttgagtcaaagttgccagtgtacatggcaatcgttgggttctatgaattaaggtggtatggggttgttgtgtaatctccaactcagaggtaacatctttttgttgtctatgcttgagcgaaagcctagggcatcaggcggcacgaacggttatgtcggtacttgtgcttgtacttgagcttggacaaaggcaaccgctggcggtggcatcatggattgtggttgtgtgtgggggtgatttcggccaaagctacttacaccgctggggtggctggctagagcacaacgtatgcacggtgaagatggggcgaagcgatcaccactgccaccagtggccaattttcgtatttcttacaataacaaataaatctgcaggcacacgaaatactgttgtaacacttacccttagagtattccaagggtattgaacacgaggaacgtgtgtgtattatctacgatcaggattcaatccaagaacaacagcctaggataaattggctagagaggattcgtatgtcttttagttagttaattaagtaaaatgtaaaactctatcgaatgctttgggcatcagcccccctaggactgccaagctgagtccaccctttagctctatgatgtacccgaatgtggagaaatacgaaggcctgatagggctgtcaccacctgccacctacctcactttccgtggagcacacaataaacaaaggtaatttctaacctagacaccaagcctaagttattaattactactctagtcttgcgcagaaacttccttcttcatccagagtcctagtactagagcatttagttgcacactaagtgacgaacccacaccgatgagaatatatcttacttaaataaactaattaaataacataaagaaacttgaacacttactttgataaaggaagcatccgctgaggtacaagtgagagaggaaggttgacaatcttggctttctccggaactccgttgggagaatgtcgacactctggcactcctccgtaaaattctctgaggaactacgaaattgcggggcactccttctggagcatcccttcacagactaaatatgaaactacaagtgaatagtactctacttgagcccaaagttgtgtgttcttccaagtgagtgaggacctccttttatagtgtgtcaatgacggctgtaggcggttggaaaagtcggtaacaccccttaatcgtcattgaggaccaatggggaactgccacgtgcaaggtgggagccgggggctccaaggctggttcgaccgaaccaggcaagtgtaacgccccaattttcggacgggattaaaaatcaattaataatgcattttctagaaattaaataaaagttaaagtaacttaatcaagtgaaataatgggagaattaaaattttcccttaaaaaaaatcattggccgaaaatattttgtaatattttttgggccctaaatattctctgaaattttcccgtgaagtttcggagctcaagaagtaattttaaagtcac

SEQ ID NO: 11113 - DNA, 3771 bp, Oryza sativa
agtcacaaagttcattaaactcatttaaaggaaaagaaaaacccaatttaaatccctttcctccctttttaggctcggcccaactccctccctcctctttcccggccaggccagcctctctttcccctccctcggcccgctcggcctccctcctatcctccctcgcaaaaagtctgctttgcatcccttcctctctcccttcgccgacaggtgggaccggcggccccacctgtcatccccttcctccggctccaaccgccgccatggccacccgagcctccccacgacgccgccgtttccgccctccttctccaccccgcgcgcgagtccactggccgtgggaccccgccgccccacgtcctcctcatcgcccatctctcccctccaaaaccgccacccacaccccacgatgccgcccacgccgccggcggttgccgccccgactccgcctctcccgggctcggtccgacctaccctcccctataaaaacattccccgcacctccctctccattttcccctctctcccgagccctcccatgcacgaaaaccacaacgccaccgtcgcacctctcgccgccgctcgccggcgatcctccagcctgccgccaccgctgctcctgccgccgccgctccgcgcgaccgccaccagcggcttcgccgcgtcgtgccataccccagcatcccctccgcttccccattgtgtcaccgaaaccacctccccacggcgctccctctccccaccactcaccggcgtgctccagccgccgtctcccgccgcactagccaccaccaagccgcgtcgacaccaccatcggcatcgccgtgtcgatctccaccctgacccctactccattttcccattccacctccggaacgccgccgccacgtgcaccacctctctccgtcgccattgccacctccagccgcgtcgcaacgccgcttcggtccatgccgacccacgccgtcacctccctctgctccacaaggacgaggagaacctcggccacctcttcccatcgccggaaactcactggacgtccgttttcccgtgtgccggtgagcccttcctcccttcctttccgctccggcaggccatgtcgccgccccgtcctccctaacacctcccctcccatcctaggatgcagctgctgctcgtccgcctcttcccgagcgccgcccgtcaccggagcatcgtcgtcttcgtccgccccgagctccgccgtcgccgcctcccgttgccatctcgccgacggccacctccttccgccgtgtgctactccccctcccctttcccgccgctctctcgcacatgccgccgtgccggtggaagccgccggtgaccatcgggccgcacgccgccgcttcccggccggccggtcggcgagccggctcccgcctgcctgtggccgcctgattcaccccgggtgaatctgggtcgtccacatggccgttcggcgccgccccgcatcggtgccctcgtggcgccacgtcgacaccacctttgccgcctgtccaccgtggccgccacatggccgtccacgtggtgcgcccgcgcctgtgccacggtggaccgagtccaccgtgggccgctcctcttgcgccgctgactcatggggccctcctgtcggcgccgacctctttgatgacgtcagcgacggcctttttcctttgaaagaataattaacaattgcgtcataaatcgtatttaattctagaaattcatttaaatggctcaaaacttcgaaaattcataactaattcattcgaactctgaattgagccgttcaacttgcaaaattcatctaaaattgatctctacttgtttgtttactttttatgtaatgtttgcttggtgtttattagagtttttcctcattttgcatgccagcgtgtagaatctgtcgtttcggaagtccgcggttgcgaggaaaagagttcagaagattgtttgaagaagcaaggcaagtcacacattccccttgagcatgttgatcccaatttataaatgttttattgtttgcaaataaatatgcatcgtttcgctaattacatgggaatagggtttacctatctgctcgtgtgtgccatgtttatttgatatatgtcctttgtcaaccttgggtgataaatcgactagcttgtgttactttgatgacctagctagaactatatgcttagccatgcttaattaccactagctcagttgatgggataattgcagtattagacctttttagcatcagaacgagctgcgtgctcgagacacccggccatgtttcagtggtcgtaattatccaactaaaatgcgactgaattgtgggctgtgggtgcatggttttgctagtcgcacccatggcagttaaggaccggttcgcgggaaaccctgaagatttcctcgtactttccacaagccagcgtgggcaacggctgggcttgtagtgtagctttcctctagctgacgcatccaagcaagggtgggcgtgatggagtttggatgggccctgcgacggcctatgcggcttccggattcacctaggtacgagaggggattgcccgctgccttgcgaggagtgggggtgaaacctgaggtgtggtgtgcttggttagagggggttatgcgaagggtcctgtcacggcctctttccgatatgtcatggtggcatgtcggcacacggaaacgtgtcgtggggctgtgtcttgtgggtacagttgtacacctctggccagagtaaaactatttgaatagccgtgcccacggttatgggcggtcgaccagattcaccgtgattagtcccaccttaataaatcgactcaatgcactgtagttcatgtgggttggttgggcctgttcaacgtggtgtagcgttgatcagtggagatttaatgttactttaattactcaacacttttactgttttgctcaataaaatattttacaaccgcctttatgcaaatagccacaaaccgtccttgtatccccttgcacgtctgcatcattggtgtggcttgctgagtacggtggttgtactctgccttgctattatttccctttttcagaagtgtagtgcttctgagctgaagacgaagttagaaggccaaggctcagaccccagttgagttttgcctgtggagtggagctgaagccccgctaggatcgcctttttccgctgctgtcgttctctttcggtgtgaggactaagcgcctcttctgtaagtattttacgcttttatttacgttggaactgtatattacttgttgttttgtgtaccctggctggtcctggacaaggatttaatacacaaaatagtctagaaatttgggctaaatttctgggcatgacagcaagcctcccctagccaccacctttctaaagtctctgataggtgggcccctattgcagttgaggatggtttggtcaaactttaagtcggttatgaatgacttgtgggccctccaatccttgtatgtgtggtgtattttctccttaaataacatgcatacatatatttaccaaaactagtggaagttgttagtagtaaactcctaccactaagttttgctagtacatttgatatcttttatgcaggaattgatggttaaagtttatacttaatgactgtcaattgccatgccaccagccattgagttgctcctccaacaattggcataaacataggtgttgctgcctgtggtggtacttgagtattctatggaagactaacattcatttgctggagaaagacttggaattgtgcatggagtgtagac

SEQ ID NO: 11114 - DNA, 347 bp, Oryza sativa
tttttcttttccctccttttcctcttcttgggccgtcggcccagtccaccccgccgccgtgcgcgccctcctccttgtgggccggcccaagccgcccctccctctctccccgggacgccgacaggtgggccccacttgtcagggtcgtccccttcctccggtcgcccgccctacgtcgccaccaccgccgaaaccgccgccgcgcccacgtccccgcctcctccgggccacgtcggccacgcccgtgcatgtgccgcgtctcccgcacccactcccccctctctcccgctcgcgcccgcgcccgagatggccgggattcgaattccgaatcccgcctactctcgcct

SEQ ID NO: 11115 - DNA, 21189 bp, Oryza sativa
  unsure (1)..(21189): unsure at all n locations
gtaaatttgaacaaactacgttcgttttgggacaggcatcatgacatgtatgtatccactagaccagtaaattatcaagtccatgaaaactatcaagtataaatcagtaatgcacgaaacacatttcctattgtaccttcagatataaccttacccaccatgcatcaagttttccttaaaacacatggtaaataattacttgcaaagtgtaaattgagtttaaaattttgatagcacgtgtaaaatacttttacttatgtgttactgcattatcataactcgcacaataaactgctccctgaataatcaattggaataaaatatataaattgcaacaactggaacaaattgaattaaactgcttagctgaataaccataccgatgtcaggttcttcatcacatggaacatctaattctggtaaaagagaatctgtgagtgcaccaatggcatgtagttcttggcaggccttaagacaaactgtctccttgagaatagaaccttctccttctacattaactgtctgcacaggactgctcttaggaagatgcagagtgcatgtgccagatgccttgtctatatcgaatcttggtagaggattaaaatatctagcaagtcaaaatttgacccccatcataaacttgaagcaattgtggcagataattctgcgcaatataaagtaaacgaaactattaagtgtgaaacagaaaactaactcatccgatggaagctttgagcagaaaaaatgaattaatggaacgctggagtttagtgtcacaattgctctagttgactcgacacggtaataggtatcctcgcacaaggtgttctcaagtggttgacaagaaattgatcccaatctcagagattcctcccgcattatttgcccacttgcgagaaacttctctgcattagtttgagcttccacatcccccctgatgcagaaacgtgtataatgcacagtaataaaatgcaaaataggtcaagtaacgatgacaacaaaaggaggttatcgtgtcatctaaaatcagaaagatgacggataaatccacagcaagtgcctacaatagtcataggatctgaccaggtccaccatccaagagaattttggcagttccatactaaaaattcaaacaattatttcagttgaaacttattaccaggatgatacaccagttacctctggttctggaaaataccatcaggaaccataagtcaattttataataaaaaaaagctttataaactgctattactccctagtataatccagcttggatttaagagtcaacgttaatatttagtgccactatggatgatttgattcactacaaaaaccaactgatgaaatgggaaaagcaatcactaatataggtaaccactaacaatttcctggcactaaccagggattcttttttttatccagtgcatgcaactcttttgatgaaatgtgaaaacagtgaacagagtccatggaagacacaaacaattcactaaagatggaacagttaacaaatttgcacagagaacaaacaaagcaacaaaattgaaaacgtgccttccgacaagtaaaagatagtcagagttttccatcctagctcgaccacgggactgtataaagctgcatactgttgctgatggatcaaagcgaattaccaagttacaacttggcacatctaaaccctcctccaaaatttgtgtggcaataattatatgtacctgcataaccatcattctctcatcagagaactatcatactatgacttaacagaatgcctatagcatacttaacagaatgcctatagcataaaatacaagtaccaatatcgaacctttccttttcgaaaagattcaacaatttctgtatgatttttcctgctctgagatagcaaaccaggacggcttcctgccatgtgcttaacattccacccagacatttgatgaatagatgaaagtaggtgctctaatactatgcttgtgataactctctcaacaaacacaatgcatcttaagtcttgcatatgcctgagagagagagagagagagagagagagagagagaaagagaggtgttacttattgaatgatcaaaagaacaaaaagttttagtacaagaaagtagaagcataagcatctcttacaatcaccaagttacttattgaatgtcgttttgcccgcgcggtttggtctttaatccagtttgcttcgaatattagtttacctaatagtacaactcatatgtttgggcattggataagaagacaaccacacaatttgagatctttggtcttattaggggcaactaccactatttggtctatttggctttgcagaaatgatgtggtttttgaaaggaaaaacatatcttcccctttgcaggttatcttttttattacacattggctctgctcatgggctatccttcagaaggtcaatttgcggggtactatcattgcggcttgtcaacacttggagctagtggccatggagttttctaccccggcgcatgggtggcgttctaggctacggttagagggctcctgaagttctttttgtccctgctattttggatgatgagtttatcttttgtttctttcttgttggctgtgtgcactctttgggtgcagaagccagaggtgctctcagaataattgtatcacttgatagaatttactgagattaataaagcttccattatctaaaaaaaaaactttagaacacatttttcacactggctggtatgtgattatctattccatggaacttacttacacttcaatatccatctaagaactaacctataaaagccagtaatagggaatggaagtagaaggtgaaattcaagaaaaaactgtatgcagcaggaaaataatagtggtactggaatgtatcatttctgtactacttatatgagttggtggtgatgggttgtgctctacacccccaatccttcaatcaacctttggtgaaacaatcagcatagacgtgtgtcattttactcatttgtacttctattgaaccaatatatagatgatttaattatgttcatatgtatgtggttgtcagttgatccaagttaaatattttaaatgtggggatttttttttggcatttgagtaagccaacttatgcgtgtttatctgagatttgttacaagagatgggcaaatatgctagttctcccagaaaaaataaacttttttttcttgggaactcttctttatttttttattcagattttcaaatgtaatccatggggcatgtacaaaaggcacatgcatattgtagaagctaatggctctttctctgtactggtcatccatgatttttcctattttctgattatgtaaaaccatgcatatcacttgatattaactcacagcagacaaaattcaaaagttgattaaaaaagaatgaaagaatacaccactatcgtccaccctatacagaacctttggtaccatttagtcgatgcagtctcaaagggagagaatgagaaatattaccaatactactataagaatagccaaatgaatgcaatctcaaaggatgtggctgtgaaatattatcaaaagaaaatatcagaagagtattttagcacctgtactgcagaagagttcgaataaggcaatgaactttgggtgtcaatatcccatcttgagaatcagctggaaatttttcaccaatatgacctgaaaaaaaaaagcaaagaatgaaataaacatggtatgacctataaattggaatttcggcaagtggatgccatctatggtttaatattcagttagtatcgcatgtatcataagtgaaattatgttaaaaatatcatagtattcataagtgaaattataaacatttttctagtatccagatagcaattcatgcagacaacagactagacaacattttatttggtaattgagaattccagaaagcaaatgctgtcatgcaggtaaccaagaaaagaacataaaaagcgcaacatgctagagaaggtatgtttgtaaaagccagagctgtgtagtatgtaccattcttcaagaaacatgaaagttctctatgtacttcttcgctgtagtttctaatgaagccctcaacatttttatccaatgtttcaccccagaaggataggctgttttcctcgtatgattgtacctcagcagcctgaaaatacaatgttaaagataaattgggattccagaaagtactataaatgtgcagtgaaatctttattcatacctttgctgccagccatactcctagattatataaacaatatacaaatgtatgatgcaattttgatatcctttgcttagcgttttccagagatgaaccatgtagttttctgtccagagcttctatatgctaagagaatgaaacaaaattgcattggtatctggtaacatatatacacaggatttgttaaaagaagttacttaaagcattacaaaaagaatgtcaatgcatctcaataaaaaaaaacctcctgcttaaaatattgaatgtcatattcagcccaagcacaagaagccatgaataacaggtccatggcatgcaatactaaaggtctggcacatgctctaactaaaaaaagaagtctaacaacaggcttaacagtctctgagactgataaatcatcactaaaaactgtctttttgacctaaaccgcattttagaattcacatacttctgtagaacactggctgtgctactgtaataaaccctaacttttttattcttcatttatattctgaaagatgccattgataggtcccacgttttggcatgcaggggatatcatttggctatctgggcctgtttggcagagcttcagagcatcctggctataaaattgttagaggtcaagctagcggtagactggggtgttggtgcgccatcctgtttacatttcagcatagaccaatttattttagcctaagaactccatatttacaaaaatacaagagttggagctcaatccagctcagcatattatgcttcaaaattcttgaagctggaacctaaaagtaggtagacaggagtgtttaggtgagtcatcttctttacattttggactaaaagtaggtacttaaaccactttgttttagcctacaaaactatattctgcaacaacataggagttgggagctctccagaatagacccttactaggcttcctctcatttcacatttattctaagtttctaacacttctccccaactcaatctctgttcccttctgtaggcatgccgaaagtgccaacctctcccttgtatcttaccccaaattggccgccatgcctagtcttaccactcaacttcatgcagtacagtaagcaacttgtcggcaagcaacatgtaactgaacaatagaaagcactgtttaccaaaagggcaaacaaaatgtagaagaatgatagtacctttttattcaatctattcaaacaactgagaatattggcatgcagctcagatgaaatgttggaatcgtcaaagtccactatttttgtagaagcaaatggtatgtactccgacaaagctgattcactatcaacagtgtacaccttgaacaacaaatgcatcaatgcttatttcccaaagacacatacaggtaactaaattaggaagaatgattatcgtaactgcagggatcacgtaattaactgaaaattacatggcctgaccttggaattcatgagattctcaatctcagaaatttgctttgaataattgtgcggattcaaatctatagaaggaacagtgtgacagattagatgatcagagagcctgtgcataaaacataagggatgatcgtttcgcccttaccttttgaataaatgagcgaagcagacatcccaaatatccttggcagagggtctgacgcactagaattcaactgggggtgataaaattcctgcaagcgtcgaatgatttgtctaaattggtgatacagatcagcaggggaagggagacatcaaagattctgactgaaatagtaaatgtggcaaaaccaacgctgcatgttccaattatattggcactagtatgtaagttagagcataggtgttcctatgttgatgagacgaaaatggaaaatgagagctactccactactaaccccacccgatcaataaatgtgaagggaaaatacgaaagggcgcaatacggcggcgggtgtaaacttttgtaccttgaaaatgcaggcgtacggcgtattgcccctggcgtggtgacactcgtcgaagatgagcagcgcgatgtcctggaggcggaagaagctgtggcggaggttgtcgagcaggatctgcggcgtcatgacgagcacctcgccgtcctccagttgggatcgccaggtggcggcgtcccagaagtcgacccccatctcgccgcagaactgcttgacgacgaggtcggtgtgctgctcgacgacgcgcgcctgctggcccacgaggacgacggtggggacgaggaagacggcgaagcggcgcgagtccggcctccgcacgcggtgcgcgtacgcccggagcagcatcaccgcgatgagcgtcttcccgctcccggtctccaggaacgccagggtgttcccccgcaccgcccgctccagcgcctccagctggtacctgcacgccacgcgcaatcacaaacccccaccaccaccattagcatccaaaggggaggggaggacggcgaatcgcgatccgtcaggcgcgcactggacaccccccgggcctcaccatctggccattgtcttcgggtcgggcggcggcggaggccggagcggttccaccgccttggcgcccccatctcctcgacctccggcggcggtgagggggcccacccatggcgacggcggcggcggcggaggaggaggaggggtttgggggaggaatcgggggaggcggcgggatgggggtgggagagtgaggtggcgcccacgcttggggccgcttccgcctccgcctccttcggtgcacgcacgaatccgaaccgaattcctacgagtcgcgcgcgcgtgtgttgggctcgaacaatgacgagagataaatgatcttatgggggggaagcgggaggaggagggatgggaccaattggtagtgggaggcttcggggcgaaggattcgcccccgccggttcgttcgagtgcgccttttgagttgacgaggacccgaggagaggcgaccgggaccgcgggggaatgggcgcggccgtttggcgtcagatggaggggagggaatcacaggtggggtactgggggtatgtggaaggtcggggggcggtgacgtccttttgggttttggcttttgcaatggattaaatattttttagatgtcatgtcacatgtcacatcggatatttgatacgaattaaaataattaaacgtagactattgataaaacacattttataactctggattaattcgcgagatgaatcttttgaatctaattaatcattgattagcctatgtgatgctatagtaacaatgtgctaattgtggattaattaggcttaaaaaattgtcacgtgaattagctctcatttatgtaattagttctgtacgtagtctgtgtttaatactctaaattagtgtccaaacatctaatgtgacagggactaaagtttaaagtctagtccctggattcaaacaccccctcattgcaggtaataaaatctcgacaattccatgtgcattgctctttcaataaaaaagttcaatgctggtttgttttctaggatttgggttccttaggccatcaccaatgcgtactctcaagtgtgtccctgctcacagccgtcgccagtccatcagtttgccgtccctagcagaggggcgcgtcttcctccgctcctcagtcgcttttcgtcgagccacggagctaggggacacgttgggcgacgtcgtggcttgaggacacggctcccgcacctgatttttctccttccacccttggcctcttcgctgagaggcccatgtgttgataaaaaaacacacactggcctgggaggtctgcttaactccagtgcaggtcctaaatcttgctttcgggtttcgctgggaggagacagagttggcgacgacgaccggcgatgaccctgtgacggagacggctcggcgaccccgcgcgctgctgccctccgccaccgcgcccgtccccgcgccgcttgtcgtccgccaccgcggctggtgagagagaaggagaaaggtgacgatgagtggcgcaagagagagaggagagaggcgacggcgacgaccagatccgaccaccgtgcgctgcggcagccggcgaggacggagggcttcctcgtgcagcggtggcgaccagatctggcgcaggctgtcggcgcagtggctggggatggcgaggagggaggcgacgtcggtggcttgggaggtgacggcggtggctggggaaggcgaggagggaggcggcagtgagcggcgtgggagaaaatggcgagcgggcaagagagaggggagattggcgatgcgcgcgagagagaggagaagcgtcggtggggaaaaaaagtcatcggtgggctatggagagaggagggtagtataggaaaatacccaccgtgggctttttggttgggacacccattgtgagcttgagtgccttcacccagttatcttatattttgaggagcccatccaggggtatctctcattgtgagctgagtttctctacgagtgtcctcaattagtgaggacactctaggaatagctcacattgtagatacccttacagtaatatgttgtgtccaactcatacgacttctcattatctgtgttcgttccggtgacattgagggagaaaacccatcgttttccacgcgcacgcttctaaatatccaaaaattatgtcacatcaaatatttggacatatgcatggagcattaaatgtggaaaaaaaatccaatttcacagtttgcatgtaaaatgcgagacaaatcttttgagcctaattataccatgatttggtaacgtggtgctacagtaaacatttgctaatgacggattaattaggctattcatctcgcagtttactggcggaatttgtaatttgatttgttattagactacgtttaatacttcaaatgtgtatccgtatacgtcaaagtttttaaacctaaacaattaaacacggccaaagtgtcaaactttactagaagcagctgtgcagtggctatggtagaaattatatgttgctactgtagctactaactgccatctagtcataccgaacacgaatcacgtgtacactttttaaccgttaaaagataaatatattttatagaaatatactaagactagttgggtgcccgtgcgttgcaacgggaaaatatgtatcatttgaaacatacaatctatgccatatagaaatatgcacaaatcaatgaggaatcatttccttgatctgaacaaaacgaaattgtaatgaatctgattcatttgccaagttattatgctatatattaagaagtaaaacttgtagatcttcgaattcagcaaagaggaatatggacatgtgcacccacgtcaattctatgctttttttatataaacatggtttaatcacattccgtagcacacaaagaaaaatagtatgcatgcatatcaaaaggatcgtgtgaaaaatgagaaaaggagaggctacagaacatgggtactaacaattaactgatgaagcatgaatttgtgatattttcaaaccatgccaaaatgttaccatgcatttcttcaatcaccaaatccgcatacagagctagaatgagcatctctgaacaaatataattttcatcaaggaaattcgagttcaacaatcagataattctaattacaaactaagagagataacaaagaatgatttctatatcagtctatctttctggtcaatggtagcccgacacattagtgtctcaaacacgataaaatgcccaaacatagataaaataatgaaaacaaatccatttagttgttctcatgcccaaggtgcatgcaaagttttatatgggcatggtatcttaaataaagtttttaaggggttattgaccaaatggaaggactactgaacaaaaggacaatattaggtacctcaaatgatgtgtaccgtcagaacatttaaaacaaacttgcatggattcaaaaccttaagctgcttttcatctggcaaaataactggaatattcataaatgaacagcaacaaactgaatttcacgatcttagaggacacaaataattgaaggtgtaaagtattcagttaaaaatatattgtgctgaaaggttgaagccttcttttttcagagcaatacatgcttaaaacatgacaattcaagagcaaatgacatccgatgactttggttctaatttaagcagttactgattctgtttgaataagctgaacaatctactacagactctggtgcataaatcatgtaaatgtgcacgtgaaacccacgtcaataataagataaaacagagaataagcacataatattttcacgtctctaataagatgaaacagaaaataagctcctatacaacaatttaataattccacgtctctaataagataaaacagataataagctcccatacaataatttaatgaccatacaatactttgtatagataatctttccgatagaaagagcactgctacagaccaaaggatgaactgccccaaacgggcatagcatgagtacagcagacccattacatataacgttaaataaaaaatacataaatgaccgtcttcctattttactgccaaatgatgccttagaaggctcatagatggaggaagggttatataggcctcagtcctcagaagtacctttccatgaacccgagttaaatacaatagaggtgaccaacatcagttaaaagaaacacatgtagtagagagaataaactttatgcaatgtaaattatgaactaatgctcacggaatcagtgtcagctaaaaaaatgtgtggttatgtattaatgtgatctaaattagagttcgtaagtactgcagcctattctctgcaacgttaaatggatacggaaattgatggggcaaggcaaaccggcaaagtgttctctcgtactgcattccagataatcaaatgtgcagtaaacaatagtttacagcgatatgcaataatattaacaaccttccttttctatactcattaagcttaattgaaggaaatgattctgccaagatgcattgatagcagtaagatgactgcattggtaaggaagataatatacaggtaaagaaactaaccgtgtgagcatagatgatgcaatttactccatgactgaatcagggattagtgtattttctgctcgcatattgactaaatttcattgagtggagggcttctctcacatttatagaattaaggtgtgggtttatcatcatgaattcaggtgtggtttatcaccatgaattcccatcagcaattgcgctgatcatcagaacttaacatgagacacttaccatgaggaagtatatatataatcacatccaaaattttatgtctaatgtgagcacctagccagtaaaacaactaccaggatcatgaccaaacagtatgttaataccataggagaagtcgttatagtgatgagtgtgcaccacatgtaaatgcggcatcacagataaataaattgacagacacaacatagatcaacgatatttccattgcatgttaaaaaattgatatcgcagaaattaatcaagtaaaaacaggacaaacagaagaaactggtcttactttcacagtagggaagagtacccgggtgatgaagaaacctgacgtcctgaagaaaagtgagcttgtgtccagtggtaagatttcacttcagatctacgccgtttgtgagataataatttaaataccatgggtaggtacaggatcaatactcttttttcgctggtagtactctcgcatcttttgaagcctagcttccttgtcgccagcactaagagcagcataccgctccctagcacgcttccgcgtaaattaaatcggagttaaattagtgatgccgccaagtgtacctgcagaaacttgtacagaaatcatttcacaacatagcaacagtacgaagcagcgagacgaaaagggagaaaacagataatgtccacaaatcagatacacattgtagatataccttcaacaggaaactgtttcttttacttaaaacgaaattgtctaacaggaaactgtttcttttacttaaaacgaaattgtctaagtgatactttcacatacattttgattacagctcgaacaaagcagtacagtgctaaaatcactttgaaaagtgaattggtttctggacatttgctcaacatatttatgaactttagttgatttgtaacttttctagatgggggatgtctagcaatcgaatgccatataagaaattttgtttaccttttgtagatgggaatgtccctcagtgatggaggggagacgggcgagtactgcatccacctgccgacagcatccagcgacgaccggaggactggcggccagcttccggtgcggcgcgaaagggaccgtggtggagatcgacggagaggagcggatccagtcgcgagatgtggcgtaggcgacggacttttggcgtggacgtgggctgcgcacggggaagcggagtcgacgacgaaggccgccgcgggatgggggtggtggtctagtgggaggccgggatgtggggggttgatgcagccggcctgcggaggtgaggtcgatgatgaatccggcttgtagacctgggaggtcgtgggcttgtggggcgtggattccacggtgatttggggacgtgggatcggcgatgggagaggagcgaggcggcgcggtggttgggcggggtggggaagtggcgtggtgaggacttccggcggcagggatcggtcgagggtgcgcctacgtgatgaggcaggaggagacggcggcgatgggggcgtcggcggtggaggcgtggtgcggcgactggggaggaggatggggcgttggtggcggtggcgctggcagtgggggcgccgcgggaggagccacctgatgacgacaatctggagccgatggcgacgcggaggagtaggcatcgaccgcggggggagccggggaggaggagtaggcgttggcagcggggaggaggaggagtaagagtcggcccggcggggggatctgaagcggactcgacggcgggggattcggcatcggttgcgggtgggtggtggattcggcgtcggtggtgggtggacggaggagtaggtgttggtggcggtggcggtggcgttggcggcgggtgatggggaggaggaggacgcggcggtggacaggacggcgtgactggcgttgggggcagtgtctagggtttcggagtccgccgcaaggagtcctccctgcgccagcgatggtttgacgaaggcggtggcggcggcgaggcgagcagtgggggagggagctggtggaggacggcggggaggagcgaaggcggcggcggcacgggacggttaggggacggcgatggagctgtcggcgacgcgatggaggaggacggcgatggcggcggggaggatcgaaggcgacggtggcacaggacggttagggtacggcgatggagccggtggatgcgggcatgcgggagcgatggagcggtggatgcaggagggataaggtgaggagctgggtggggatcggtgcaccgttggatttagcaatctgacggctcacattccgcgtgtctgtcagagctggagtcaccgccaccactatagaattttaaattagtagagattatttgaaaaatcgtattaatatttttaaaatttttaagatataatacttaattaatgatgaactaattcaccatgttgctatatttgccgggagtgaagatttctgaacctataccttcaaaagcacccaagcagtgttgtgtaccggcggtgtagtcggctgtaaatacgacacaatagcaaaatcgttctgttaatgtgacaagggctactattattattcattagtatttatgaacgtcaaaattccatttttaacgattaatcggccactttttttaataatccgggtaatcatttgcatattgcacttgacgatcttttagagtaacaaatttatttttttacgatcttgttttgtttagtgttgtttagtactacctccatttttaatggtaaattttgctacaggacatcgcgacttcgtggaattagctccaggacacctcacgaagtgagttttggggaagacacattctcaaaacatggctatttgtcataggacaccgcgcccatttgtttggtatattcgtgctgactaggcttgagcaggcccacatttttacgtgaccaggccaaattgccctaccacatattctttaggcccacacagattactataaaaaaaagaatattgggttgtactccagctccacacagttagtgggaagcaaccaagtcagctccatggctgccgccgcccacctggatgggcttcctcggcctcctcagcttccgctgcagcgccaccgccgtcgcctcctttggccacgcgcaggacgacgagctgcatgtcctccacaccctccaagcccacgtcgccaaccgccttgccgcggttgttaacaaccaaatttggtaacatcagcgtcggagagaagattagatcgaatcaaagtcggaagcggagatcgagtttgaaaacagggcaggaatcggctgaagtccagatcggctatgacaagatcggctgggtctgagtcaggttaggtaagccgatgtggccgattccgacaatacgacttgtacacggcatcaggttcaagttaatgtacttcaagatgattgccacgcatggatagagtcctgggaaggcaattgtatatattaattaggatattttatgtaaattccttatagataaatgtgggcaaaagtctgccgcaaagacttatgatatcttagagtttgttagagataatggtcatgtctggtatgggcatatcttataatcctcgagtataagtagaccccgagccctatgtaatttttaacgacagacgttcaacacaatttcggcgcatcgccaccctttttacttcagttttgtttagacgagttcttgttttcgggttgagctgcatcgatttcgatcttcaacaagaggtaaaattcattatgatggattgcgttcttaggattagtgcttccatctttatgatactctaatcccgtttatcccgtttatgtaattcatcgagttatcatatgtcttacataatctctagcaatatcatcatctaacctgccatcggttagtatctgttaatagagggtagccgattaggttaaatattaatattgatctagattatatgagacatctaccattctatgaaacttctagcgacttgattatctagatatcgttcttcttttcatacttaatgctgcatcagttgagtttgatctattaagtcgtgcttagaatattgatctttagcctgccctctagttgccgattagaatagcatcggagtttcagccgatcgtatctgatttaacttcatttgttatatatgccttattgatatgttaaatctgccctttatgttaagatattgttgtatctaagtatgttaggcttttgctcaatatattattcttgctttaatatcttgatatagagtagtatcggagtattagccgatacatgctagatctatctgatcggctatgttataaacatatatagtcttgttattgacatatatttcgatctaagtgatttatactgtctcggcatgatgaccgatctatcccaatcacttgatttaagtatacatcgatatgaggagtatatattgttaatatctacagccaatcgagtagatttagtccttctttacttattcatgactgccgatcgatgcacagatgacatcggctcaaagataaatgatatgtcatcggcatctagccgatcggctatcatttatggatttaaccacggtttctttgcttctatttcttgttgattacaggatcaaatcaactggcacgctaatacatccgaaggcgagctttggacctacactggagttaagtagatctcccaggccacgtgttttctgtcaacagcggtctcccatcagccaccgctcctctccctcgccttcctctccaagctgctcgacgtggtgctctcctcatccgacgccttccgcgacatcctcggcatcggccccgtcgccgcgcgctctgcaggccgcctgcctcactggtgacctcctcgaccacaccgttaagacactcgacatacttaaagccgtctccctaatgctcgcttcgctccggggctcgcaccgcaccgtgctcaccgccatgtcgtgcctcctcgccccgtcgctacaccacgcccactttggccgcgcatgccaggccatctccaggcaattccccgatgccgccaagctcgctgccgcgccaggctgtccttcagcgtctctaggaacaggtcctccggccgccacgtccacgccatggcggcgcacttcgcaccgccgccacagtagtcgcccacgtttgcctcccccggcgcaggttgcgggctggggctggcgctctacaccatgagctcggtgctcgtccgctgaagcatctaggcctccggtgttaattttggtaattgttggcgatatggcatgaggcccttcgaccaaacatgctgaaagcatgcacccgatgaggattcaagcccgagacatcaaggttagtcaaggcgaaccctccccatgtcgaagactatggagcaaggacgacgagaggcagggaatcgcagccgagctggaggcctcctggccgaagggcgcaaggcgaagagcgtacgccgaagggggacgacttcgccgtagcaggttcggccccgggaaggccgaagaagctatcctggcccatcaagcccaggggttaattgggtcgactataaccagtcggcccgctaagggcccatgaacctcaattacgctatgtacccatgtaaatatccctttcataagggcaaccatgtaaattcccctgcataaccaaagccctagtagtaagacctgtaatgggggctataaatagccccatagggccatgtaatagggggatccaagaaaaattctctaatcaatacactttactttttttctcaaccactgttgagtaaccacgtctttcgacgtatgcagttgtcgtttcgacaacagctggtgccgaccgtggggacctccgagcgaaaccactgagagtgaatgccaccgaagaaggtcgtaaaggaaaaggttacaaggcgaaaggaaagcgacgccggggcggatatggccaccgaagagggagcagagccttcggcgcctgtcgctgaagatggaggagcgccatctgcttccgcacctgcgccatcactaccgccttcagcccttgctacctctgtgcaggtgccgaacgcagctgacatggcgaaggcagctgcggcggcgagggcactccagaccagggcggagatcctttcgacaagccaactgctggtgccccaagccactccgtcacagccagcagcggccccaactacgctcgctgctgtgcaagtccaagtcaaccctgaccccgagacacaaaccgaagccgacatggaaggcatacgacagaacatgacacgactccaagacatgcttcgccaaatgcaaggacagcaacaagcgtacgaggcggcaaggcggtccaaggtcgcctcggcaccaatcctctagtattcggcaggctatgtcccaccccaagtctatccacaagtgccgacccagccccttccaccacaagtcgcgcgagcgccaatgtacttcgccgggcagccatcgaccgcagcagcgcatccggcccctcacgtgcaactgcaagctcaaccggtcgctgcccaagtacatcctcaaccgcctagccaagtgccacaaacaatggcagaaggggcttcagctctgcaggcgcagctccaagctttccttcagcagctcagccaaccccacaacatttcaagtacagccccttcggccctcccggaggggaatacaagtcaagatgcgcctagttggttgccttcaaatcaaccaggtctgggggcttcgccgtggagtcaaggaccgcaattcgactccatcaatgctgctcaggcgccaaccgttcggccgcaagcaccaacgctaggcttcagagcaaaccaagcaccaaaccagatcaccatgacatggtcacagccaactttcgacccattcatggcggctcagcaagcatcaccaatcggggctgtgtagccgagtgccatggcccaatctcacgcgcaagccgtgatttcacccttcgccacgccgtacccgcagcaaggtgctgtgaacagggcagggggcgaaaaggggcaaccgctgagtgggggaatcaagacccgcacaatcccaccccagtgcaagttcccacccgtcccacgctactcaggcgaaactgacccaaaggaattcctctaaattgacgagtccgcgatcgaagcggctcatggcaacgaaaataccaaggcaaaggtaatacatctcgctctagacggcatcgcccgttcgtggtatttcaatttgctagccaatagcatttactcatgggagcaattgcgcgatgtctttgtccttaactttcgatgtacatatgaggagccgaagatgcagcaacatctgctcggcattcgccagaggctgggggagtcgataagggagtacatgcgtcgcttctcgcaagctcgatgccaagttcaagacataaccgaggcgtctgtcataaacgccgcttcggctagtctgctcgagagcgaactcacaagaaaaatcgccaacaaggagctacagacacttgaacacctacttcacatcattgacgggttcgtaaggggcgaggaggattccaagcgacggcaagctatgcaagctgagtatgataaggcttccgtcgccgctgctcaagcccaagcgcaagttcaaattgccgaaccacctcctctcactgttcgccagccccagccggcgatacaaggacaaccgtcaaggcaaggtcaagcccctatgacctggaggaagttcagaaccgaccgtgcgggcaaggctgtgatgactgtcgaagaagtgcaagccctccgcaaggagttcgacgctcaggaagcaagcaaccatcagcagcctgcccgcaagaaggcccgaaaagacctctactgcgccttccacagacgctcttcgcacaccacggagcaatgccgaaacattcggcaacgtggtaacgagcaagattcaaggccacagcagggagcagcagtcgaagcacctcgcgaagtagctcaagaacaagcacccccggccgaacaacgccaagatgcacaacgcagagtaatccaagtgattacaagggccgacccgccaatccaactgtcgaagcgacaaaagaagatgcagctgcgaacgatccacaatataacttcagcaggcgaagggtctccgcaatatctgaaccagcaaatctcttttgggccagaagacgccgaaggagtaatgttcccgcaccaagatcctctggtgatctcagccgagatagctagtttcgaagtccggcgaatcctggtggacgaagggagttcggccgatgtcattttcgccgaagcataggccaagatggggttgactacccaagcccttaccccagcaccagcattgctcacaggcttcggcggagaagcagttcaagttaatgatagccttcggctcgggggaaaatagacgcgaagagcaagtattgttcgacgttgtcgacatcccgtacagctataacgccatcttcggccgtgcaaccttgaacaagttcgaagccatttcccatcacaattatctcaagctcaagatgcccggcccgaaaggagtgatcgtggtcaaggggcttcagctttcgcctgcttcaaaatgcgttttggccataatcaagagagcagtacgcaatgttgaggccgaaccgcatgaccgggcgaaacatgcgtcaaagcccgcacctcacggcaagatagtcaagatgcagattgatgatgccgaccccacaaaactcgtatcactagggggcgacatgggcgaagaagaagctaagaacatcctagaggtacttaaaaagaacattgatatcttcgcctggggccccgatgaagtaggaggtgtttcggcagatctcatcatgcatcacctggcagtcaagccggacgccaagccaaggaaacagaagctatgcaagatgtccgctgatcgctaggaggcagcaaaagccgaagtccaaaaattgcttaaggcaggggtcattcaagagatcgatcatcctgagtggctggcgaatccagtgctggtgcggaaatcaaatggcaaatgacgcatgtgtgttgatttcacagacttaaacaaagcatgtccgaaggacaatttccccttgccacgaatcgaccagctcgtggatttgatagccggttgcaactcatgagcttcctagatgcatattccggctattaccagattcgcatgaacccggccgacatccccaagacagccatcatcacaccgttcggcaccttttgtcacctcaggatgcctttcggtctgagaaatgccggagcgaccttcgctaggctggtgtacaaggtacttttcaagcagttggggcgaaatgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11116 - DNA, 5414 bp, Oryza sativa
  unsure (1)..(5414): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgctagttcttcaatcagttcctaaattaattatattggattatgtaattaactagagggtgatacgtacttttgcaatcttatctctgattaaattattaaattcgttacagggcttcaagtcaaggattgaggatgtgagagaagaaatattgaggaagaggagggcaggaaagttgcctggggacaccaccaccatactcaagcaatggtggcagcaacactccaagtggccataccccacggtgagtacattgtacctatcaagcatgcttgcaagagtgcaactaactagctactagtcgagatagcccttcttagctgttctccaacttgttgatcaatatatcttgatgtgctaactttacaattaatatttatatataatatagcaagaagcaataatatttattaattagctaatcagatatgcacgaagaattgcatggatataatacagttggttgagtggcatatatattttcttggtacaggaggatgataaggcaaagcttgttgaagagactggcctgcagctcaagcaaatcaacaactggttcatcaatcagagaaagcgtaactggcacaacaactcacagacatcaacccttaaatcaaagcgtaaaaggtaaacaaaccgttatccaagtattttatccacagtaatacaatgttgatgtttcagtaattaacaactgaattataacacaaacttcttttttctatatgtaatacaggtaaagggcagaaaaaaatgtatacctgacgtactcgctaatcaaatcaaaagaagacatggtgactcataagtaataagatcatcttaaattgtatatctagttattaattagtcagaggtgacaaattcatgacatacatactagtctgaccactggcatatgcgttgtaatttttgagcagatatgctcaagcaaattcttcttgttggtatagtttttaattttgttgtcgtgggtgtacctgcatgcatacataaccccaagactaattcatttgctgtgcatatacattgaccattctataaccttctgctagtcaaataatcaaaaagcgcacgccattgcaatccagcattaattcaactgcgtttatggatggaacggaatctctatctatatttgtgggccttgtatcaagtagtagcaggtatgccaaactggagttggactattggtgattaattggacaattaggcctaaccaacaccacaagacaaattaaggctggcactagcctctcatgataatcccgaaaatttccggcgtatatgcgagagcccttccagcaagccagcagggacacaagaccaaccatatatatattcacgtttctgttttttagtgtgtggttagtgatagttttgcatcgtcttcctcattagtatgtggcttaacatcttccagataatcgctgtgctgattgtcaaatattccaatcaattaaggctggagctagtgcacggctagctacgtctcaaccagaacggacaactccgttgagacctcactgtctcggaagacgctgcacgttggttccctgaagattggcagcgaaaaacagcacccataatccatatagaggttgctatccagctactcatgtccaaaatctataaagcaaccaaacatatactgatcgtaaattcaaagttctggtgaaaaaaaaaaagtatctgatgcgtcaatctgtgttgctctcagacgtaatattcagagattcagacataacacgggtcacatacaagctccagttgttgattgttcgttgtagacaagcaacaatctacacaggcaatgttatcaccaaattctgataaaaagttccaaatctaagttgacatttcatggcgatcctttattcagagaagaacgtattcaagaatgatcatcacggggagctgataatttctacgaaacgggttcacagtataccacacccggaggaatccaaattatgtttgcagtttaccacccagaccagtcacagatcgattaatatatcgacatcacctataataacactacaaccaccctaatgtttacattgttcacaatataccgatttcgtcacaaagacatatctccaatttctgcatttcctttacttgccgtagtaaccttgtggaggagggtaggagccctgaggcgggtaggaaccaggtgggggataagagccagggggagggtatgcaccaccctgggggtaacctgccggagggtaagcagctggtggataaccttgagcaggcggagcaggaggatagccaccataaggctgaccgtatgctggctgttgtggtgtgtacccaacaggaggtggaataggctgatcgatgcgcgacatttgctgcattggaggcactgccatgggctgtgggccgaacttcccatctctattgtccatttcaattttgtgttgggtctgcacatgcatttcagtggataagatggatacgcaaaggttaagaagagtgagtaaataatcaccaaagatattatgtatgtttacctgcatacaggcgcaaaccttgcaaaaaaaaaatggtgcacaggtcacaagattatcaacattgggggacttaactatggagaagagaaaataacagagttatgagagcttacgagcagtagaccatatcagacaagcaggaaaggatttgggaagcctctgaaagctcttcactaccaacaatagcggcaactatagagaagatacaagcaatttgttggaggcagaacatgaagccctacaggaaaagagtgatcttctgcagtgttatagtctcatagaaagggaacataggaattatacctaaaagttagtaaaacaaacaacaagaggacagtgacagtacaatgatgcagttatcgcatttagttgtctgtatgttgaattcatcttggagcaagaagcgggttgaagcaactgaattaccaaagcacagaaacacctgaaaaataaagtactagttagttctaaggtaagcacaaaaatagcataattaaaggaatagtgacagtattggagattactccattcaagacaagcattacatgttcccgttctaatctgagatatatacgattgatcaaacaagataacaacaaaatacagccaaattatccttaccccagaatcattgaccctggtgctctttcattgaaaaaagaagaacagaaaaaatattgtcatactgaactgtatttcagactatcagaaataccatgaaaagcatgctttttgagcacaacaaatatgtgaaatccagaaatcagtagaaaatataggtaatcaaatattacagaaggaaccatcaatactccttttctttagcaaggggtggccaccactttccccccccccccaaaaaaaaaaataaataaataaataaataatcatattacccggaaatggaacagtctttacaggctgattacaaagccagatagcaaagaaaagaaatataaaaaccatcaatactcatagccacatgagaactgttacatgtgacatgctgcctataaattcagcctaatcagtcatcaaaaggttatcagcaaaaaagggaatggatcttgtacctcagtagcaagacagaactctgggcatcggctttcaccacacttcccactgcatggcatgtacccagcacagcagacatatctacaagacagaggtgcaggggaatggattcagggaggtctaacacaatgttcgtatctaaccatagcaagtagaagaaaatagaagaaaccccaccttgacatgtcattatacagagcccttttgcgaagcatgtatgacacacatggtccactgaacagaaaggggggaatgtaaaagatcaaatactgggtaaaaaattaacatttctaaatgctaattctgcctactcaaagacaccacagaatatcattgtacagattaatgaaacacgactccgtttaaatgcaatgcctgtggaaaagcagagtacccagaagactaaaatcttttttgtggatagctattgatgataaggtgacatggtccagaatgagcttgagggcgggaacttaaacaagaaatagaactagacaaatgaaaggactaccatatatgctctcaacgcattttattgcaattcttatggaatgtacaaacactggcaccaatgtggattcaaaagatatctttcttttagggcctgcaggtactgaatgggctttgtggatccatcacgctgatagtatcttatcgaatatcccgtattaccccatatgggtcattgcgatagagacaaaatgcctttgccttgcggctgcagaggaaagtaatgctggtcgaggaggtgactagggaaatcaggaaagcattgcatgaaaatcaaagaacctatgcggtgactgctcattgacgctgctgatgcttgaagctaatggagctgtctttaaaacgacaaacttcagtttagttcctatccaggaaccgttttacttttgccattatgagaactttgaagcgtaatgttgaacaaaatatattacatgaaacagtaatgtgtcatcctggatctgattcctgaggccaatctaaattccgcggtcctttcagtaataaagaataaaaggaactgacaaaggtgcaacgcgtcccttaatgtcgcaatgtattcctcgcacctaaaatccgatcaaatttaagaatgcaaacaagcgcataataaacaggcattaagaatctaggcaatctccacggctgcgagtgattgaacaactcaatgcggaatcacacattgtccttatgctcatcagacttagaattccttaaaccctagtttaattcagaaataaaaagacagattcgcccagatctagaagaaaaggggggcgtcgaatatatcaggtcggggtaaaaaaaaatggagccggggagatcgacgaggatcgcttaccaccagagcgcgaggcagcaatctgcatcagcagcagcaacaacgacagggagaacccatcagaacgaaatctcgccatgggaaggcgcagtattagcattcgcagagaggggggaaaaagaaaagttgacatacatgggaagtcggcctggatggtgctggtgagatcggagtgccagaggttgcggtagctctggcggagctgcatcttgtcgaggttggcctgcgacgacgccatcgccttctactactcctccccgccgccggcggcctgcacgaggggatggatcggccgtggactctgcgggagatgtg

SEQ ID NO: 11117 - DNA, 14963 bp, Oryza sativa
gcacttgcaccaagccactatccttctctctctctctttttggggcgcgggggaggaggggaaaagaggggaggaaaacgacggtgtttcggtggggtttcggccgttggatcgggtccgatttgtgcggcctcgttaactgatggccatggcccgccggtcaacgaggcggagtcgtccaaagtttttccccaattttcttttcttttttttcccttggttgtagagtgttttggacgtgatcgaccgaggtaatggacggcacgaacgacgacggcttgcacagacggcgggtgaccggccccggcgacaacgatgcgagtccatttggttcgtcgccactcgccaagccagcaaggtgcaggcgtgcagctagagcggatctgcggagacggggtggggtttacggaacacgacgagcgacccaacgatccaaaagtgacaaaacgtggaatgtaagactgggcctcatagtctatcagctgggctagatggtagtgggccttgatgggttccatgctgttggtatgtcgtaaggcggaataagtccacatggcaaccctcacctttacgctgagtttaatttacaaaccctatccgtaatgccagaaatattaaactttcagcttgcaaacccgattaaattagatccttcactcgcgctgttgatgggtggtttcgctgacgtggcaagttgacccggtttactcgtgctgactagctgtttacgtgacaaaacaaaagtgggtctcacatgtctccattcttatctctccctcctcatcctccccacccctactctcctacggcattggcagtgacggtggctggtccctcggacgcatttctccatcctctgcaacgacaccacccccgctcactaagaaccctatcctcgtcaaggtctaccaatggtagcgacaagcaacatatataccacggaataagtccactttaacttccttaactagcaatcgaatctgttttgtatccctaaaccataataccgaatatctcgaccaccccccaactattaaaaccagtgtaatttgattccctcggcggagtccatgccttctactttaccctacgatggagtccatgggtggcgatgacacgacaaggttggcgcagcctggttgcgaagtcatcggggagctggagatctcccctccgaccctctccctcatcttgttgttgcccaccacggcgccacccctgtcactcgtccatcgagaggcccttcatgtgacggagcatagggggataagagcggggagagatggcgtcggcatcgacctcgtcgaccatgtctctaccgcttccttcgtgatcaccgttgtgggctccccttcaccgcttcgaccctcacttgcctgtcaccgccgctgctccagccaaaaggaaagagaaagggaagagaaaagagaaagagagaagggagagagggatgaggaagaaaggatgtgggcccacatatcagtgggtcccacaaatgttttttttgtgtgaatgataaatgggtcccacgtatatgtttttaattctagtgccacataaacgctacgtgggactaagacagatcgacactgtcacgtaggagccacgtcagtgaaaccgccgagagtgtatcaggaattgtggtttaagaatgcgaatcagatttagccattagttaagggagtcagagtgaacttcttcctatactccacaaatgtgcctccgctttcccttcgtctcctgacatcggactgaacatttgatggtcctgttaaactgagcacaaggcacgatccagtccagtgaggatttaaattgattatcctttatttcctgggccaggcttatcttacaggatggaaagacgaggaacttttttattttatttttattaaaatatttataaaaatgttttattttacatatttaaattgatcatggtgtgcttcctccattaggtcctgtttagctctcaccccaaatttttttcaccatgtcacatcgaacgtttaacactttaagaagtattaaatatatgcttaaaaaataactaattgcacatattacgactgatttgcaagacgaatcttttaagcctaattgctccatgatttaataatatggtgctacagtaaacatgtgttaatgatggattaattaggcttaataaattcgtctcgcggtttaccgacggattctgtaattagtttttttacagtgtccgaacaccttatgcaacaccatatataatacctgatgtgacacgccaaaactttacaccctggatctaaacaccccctaaataggaaaccctagccaccagagtgctagcaatgtagagtttaatccagcccaggatatacttgatggtgcaataaaaaaggggggcctccgatgcaaaggtggattctcgatctcgaccgtacataagagatcgaacggatagtcaagcacgttgtatggacgattcgcaggggaataggggatacggcagatcaattcgtaaggagatcgactctgatcgaaggcggtacataacagtactgtagtcatacgaacggaatgtgcgaactatggaagaaacgatggggaaatacacggccatatggcggccatggtcgctgtcgtatgatcgagctgagctcacgcgagggaggaaatcgtacgggcggccatggcggcatcggcatgtgacctcatcacctgaaacggccgagctccgcctctactcactgcatgccgcgaaatatcaaagcagtgacgtcgctgctcgcaccgcaataatttggaattgttgccaacttttttcccatggctgatcccgtcattcaaatctgtacaatatgatattatgatttgcttgcaggatacagtacgtctttctggtgtcatatctaattaatcacacgtgatcggagagatgtgtactcgacaattcaaatgcataacacaaattgatatgttgctgccatctttggcttgacaggatcatgtgctcaatagcttgcagtggtgatgaacaaaccagctgctggccgttaattcggtttggggcacacgtgagaattggttgggggtaggcaagcaacagaggtgctgtcaggagaaaggggattaacgataagaagctagattcggattaatcctaatcacaatctttcaagggctacaattaaaggccctgctttacacggaaaaggagtcttctggttaactcatgccggagatttgagtggtaagtggattagcccgtgacgatgaggagatcaggagaagtcaaaaggcaaagagataaagatgtgacacaaggcgcactggttttagaatttaagttggggtgacgtgggattgtcttatcctctaatcaccctccaattggactcatacaaagcaaatatctggcctaccctgtaaaaataaaaaccctctcttcttttttttttgagcatttagctagcctatcctgtattttcaacttgcttatataaaaacaaacttgagtgcatcattggcacgtggaacggccggtttgtatgtagtggtactctacgaatttacaacagctgggttcagagtttgcagcatttattatagacagcgtggcatccatacaatccacaattgacacctatttgcagttgtcccgtgctcaaagatatgatgaactcacaaacaacagcaggttgtacaattaacagcgagtgttgcaattagctcaacctagaagctccagctcttgcacgtgaatatatttgcatagagtccaaattttgaccggagaaaaagtaatgcgtgaaggaaagaccagcaatactagtagtggggtaggttctgattactgaaaggccctaaacgagtaaacgacagctcccggtcaaactcaaaccaacaacgaaggagagagaacgaaaaaaactcccgttgtgatcatcagcggaaacttctccatggtttgtcaaacaagaaacatgatcagatcaccatcagaagcttcttggcgttttgtcaaacaagcaacagttgctcgtgattccgtcaccaagattctcttaaatattcagtcgtcacctgatcgaaatccatcgttctgatttctgaaaccagaatgccagaaacacgcagagggcacacgcaacaaacaaacccaaggttaattcgagaagaataccctgatattgcaattaaccgagatgctcccgggccaagcgattcagagtttcagacgcaggcagcagtgctgctacctggcagaaagctcgccttggaagtgttgatctggtcagcagctatactcaactcagccagacaagccgtccaagactctccaaggggtcaggtcccagcactcaaaacccgtgagaatcctcgtaaaaaatgtgggggaacgggacggccggtcgcttaataatccacgacgatctgcagggcggctagccatggaggaccgagttttttttttaggcctttggactcgtggctatcacgagggcggccgttaacggttaccgcatgcgcgcgccgccccgcggcttcccaactccaccacaagggatcgggacgttggcgccgctgcgaaattgtagcggaaatcacggcatgtggagagggggagtaccggtggtggtgtgcgtcgaaatcgatcgcggccatgtggttttcaacctgggatgttttgaactgccccgatcgcgttttgagtcacatggctgccatgtgttgtgtccaaaagcacgggtttttttagtcgtgtgtactgctatcagcctgtcgtttttttccgtttggtcattacacgatcggttttctgataaacgttgcaaacgagagacaggtggataacagggatcgcgctgacaaattgcacttccttctagaagtagtacgtcgctccatttggctcatgaataagcaatgaacaactcatggcagccggtcctatgattctgagggccctaagcgaactcatcgcgatgggccctctaaactatatatataaaattttatgatatagagataataattttacttgcaaaacgataacaaatacaccatatattaaatttaacatgtctggtaattatgaagaaataaaaataacaatatatttgtaacttggaactaatatcattattcattaacttaatgaagaacaaaaccccatcatatccgttgctcccatgaaaagatacttcttcgggcatttcttgatgcaaaatcatcaataacggtattaaaatcaatagtgttcaagatatccttctcaattgagcacatagccaagccatttaacctttttttgacatagttaatctcaaatagttcttcaaaacttcaagtttgagaaacttctttcagctgaagctaccgtcataggtacagttaatagatttcgataggcaactaaaacatttggatagcaatctgcatccataacgaacttaagaatctcaggcgcaaacatcgaagaatcacacatttaattctgaataaaaaaacattgatctcaacatcggatgaggtactagactactagtattaggtgttggcccctccaccatcatgggctccggcggtcgcctcggctgcatagggccagggccggccctgcatggcagttgttagtaataaaagattttgttaactagtcctgaaaggcatagccgccgtaattcgtactacacggcagcacaaagtgttcccaggaatttccatccaccggtttctttttctcccctgaatttatctacgtgttcatgtactgctacaatcgccataattctctagtttcgtacacctgaaaccgcgatgaaaactcgttgagaaatacgcaagccgcaagcgcgggggaaggttctcaacgaagcccacgcagatgctgacgcagcgcaggcgtggcgactaagggcagccacggggcccaccaggtgagcccgtggccgtggggtcgggtactcgcgtgggcccacctggccggtcaaatcttgttccttcctccctttactacccgtcgtcgtcgtcatcttcttcttcctggtattcgctattcatctctgaccctgcggcgcaccaaaacccccgtttccgtctcgcgttcttcgatcgcctccgcttaaaaagctcgccgcctccgaccgaatccactccccccccatcaatcccgcaaccctaccgaaaccggtaaaccactggaagaaagcgggttcgatcgatcgatcttgctagtgcggctatatctgctagtaggtgaattggtcgctcgacgttggtgatcatggtggagaagacgaagctgcagctgccgctggtgcacaacgagcggctgtgggcgcggccgtggcggtgggccaagacggtgttcttcctcgtctccatgctcgcctcgctgctgctcgtctgcgcgccgccgctgctcatcgtcgtcctcgacctgctactcccgcccgcgctcctctccaacttccaccgcgccgcgaaccaccccacctcgctcatcgaccaggccaggggcttccacttccggtcatcgctcgtcgacctccccgccgtctccgccgcgcgctccctcctcatcctctgtgagtaaccccaccacgcaatcggtatcaagcgtatgtgcgattcgatgcgatccccttaatctttttttctgcgtgttcatcgatctcatgtcgtcatggtggtttggctgacgagcacttggtgggcgttgttgtgcaggcgcgtacacggcgtgcgggggaggcgcggcctacctgtgggtggccgtggcgtgcagcgtcggctcggtgtgctacgtcgtcgccaaggcggccgtggtgttcggcgcggcgcccgacagggccgtgctggggctgcagggcaagggccagctcgtcgccgtggaggccatgttcctcatgtcgctcgcgctcgccgccgcgcacatcgccatggcctaccgcgccagctgccgcgagcgacgccgcctgctcgtctacagaatcgacgtcgaagctgtaagtgatcgattccctttctttgctcgtatcgtatcaattgtttcttttaccgagtccatgtcacgcccgcacaaaacagagaaacaaacgattccgcctagctgtagcttgtagtgtggattggaaacatattaaacccaaaatatgcaagctttccagattccaatccgtgttttagagagattctgtagaacaatacgcttgccgggtgtatcctgtattgcccatttgcgcaaacgctttcggccaaatgtgatataggtaacgcgtcgacatagtcaaatagcgccatggaatctgctttagcccttgccgaccaagccgtgtactcccttcgtccaaaagaaaaaaaaaaagacaaaccttgggtttccgtgccaacgtttgactgtccgtcttatataaattttttttataattagtatttttattattgttagatgataaaacataattaatactttatgcgtgacttatttttttaatttttttcataattttttcaaataagactgactatcaattattggatacggaaaccagcgtttatctttttttttttggacggagtacctgtgagcaactgtgcgaaggaggtcctcgcgatttctgcattggagattcctgattcctcacgcacaaactagccccaccaaacttcttacctccacctgaaatttcagatagctacgagtaattactgcagtaatggtttactagctgaattgttcccacggtttaactggtaactgttgctctggaatgctgttaattagcgatttagtactggttcagtttttttcacatttatcattaaaaaatagactgtcaaatcactccaaaccgattagaatttgaaggaaaacccgcatgaagaagattagtctaacataatggcctgagcatattttccatgcgttggatgtcacagcctagtggaccgatcaggacagttctctagaaatatctggaaaatgcagccatccgtgtacaatgagctcaattgacatcacaactgcaattgtttaccctgtcactatccctcacatccgtgacagtttctagcgtgatattcatggccagggaatctacacgaccctgtcaaattttaactgtcacagtattgaacagggagaaaccccaactattatcttgaagtttctaacgattatttacccacaaaagaactgcattgaattgtattagttgccggaaataaaacagtttccaatagcatcttgctaatgaactctttgctggatcatgcaggtaaggctaaagggaggccaaacgcccaagtccctgaagcagcagttcgccgtatgacactcgctgcctggccgttgcagtcggacacaaactgaatgccacggcatggcagggccctgcagggttcgttcctccggtctcaatttttggttcaagtagatgtgtacaacacgaccgttcactgtacctcaagtgaaaaatagtgtaaagaagatgtaaatacgaaacatttgtgcttcggcctcctgcagtcaatgcaaaaataggatgagccgttcggcagatgcatgcttgtcatttttggtgggtttcccatttgtgagctgtgagacggagggggtggtttcgtcgtgtgaatttccacaggtgcgcatcggtgacgatgcacatgattggatcaattcgaatcatctggctatcaggtcgatatctctcccctgtgagagtggcacgtttgagttgagtccgtttcaaagaacgcgtctcaatcttaactgttttctgtttaaaataagtactaattatcttaattttttaaaaaagtactcctatctgaagcatttttgagccatctccaaactctattgcttaaacagagtaacagcgtatcttcgtttggaagatgaagatatcctaatacaatcagtcctacctcagtcctcagaccagcgttttgctattcataaatctataaaaattgaccagcaccggatctcatcaaaattataaaactatacaatactaatatacggtgacaaaaaaaaaagttactacaaggaactgctttgtataattctctgaattcgcaaggtcctcacatgatcatgtgaatggtcattaaccgtggtcaaatcaaacacaaatatatcgaaatttatcaggtagctccatatgaaagacgctgaagatttcttccatgtttcacctaactgatggaaaaaaaattctgctaaccgtagaaaattcagaccaatgatcaatgacgcacctgatgataatttaaaagtagcactgcccaattgaatcgatgctagcaagtcttctaaacggccaataagcttggcaatctagacccttgaccaaaggggtaaagaagactttgatttgcatacagcttctagaagtcccagtcagccttttccactagaggggccggttgaacggaaaccacaagtttgtgtctgggctactactaataattgtcaaatgtattaggaaaaatggaagatgcacaatgtgaaaaggatctgctggatttctggactcttgggtagcgtacacaccttgtgaataaatggacttggtttaccggcccaataccatagtactaggcccaacaagatgtcaaggttggatagagaaacaggtacagggcaagcaaactcaaaaatgaaattccactcgtactaacaaagatcgtctaaatttaaaagagctaaattgaagtaggcagtccatcattggatggagaaaaaggattaaccaatttaacgtaagagtgtaagacgctctttcatggaacgtcaaatactaacatgttatcagatttcagaaccaaaggtgtctttcgggggaaaaaaggggaattcggaatcaaaggtaacatagttaaatacaagaggggactaccctgtagttaagttaaccctcgcagaaaggggaaaaaaacagcactagcagctagtatcagccgtattaccagtgaggatatacagaggcagcttgaaaaaagcataggcatctgaagttctttccggcgcgaacgatgataatgatgggctgatggcttggaattacaatgctccgcatccacaaagtgatcgagtctaacaaaagcacgcatgctgtatatagccgtcggcagaaagcaagctatacacgcatagattgtgtgagatcgacgacctgcagaaacgcgacgaaatccagctgacaattaccgacatggatacactacttgtggccgaagcagacggttaattgtgaggctgcaggaagacgggtgcatgcatggacagcgtgtgtgcatcgtccacaagatgaaaagactgaagaagtggtcgaaggagatggtgagattgtagcacgaaaaggagcgtgttccccggcgcggcacatacgtcgtgcgagacagatccatcccccgttccaatccaattggcccacccctgtatacatctcctcgccgcggcctctccgacgagggcgacgtcttatctcgatcggtacatgcaccaagctagcttgccaagacttcgtgcaattgtgcatcgatttttagggtttgggtcaagacgttcgtgtttgtggagattatggataccctatatctacatgacagttataatttagtcggatatatggtaccaaatataaatagaatatctctatgaggacttggtagaatatctctatgaggacttgggttagattctaaacttgtatgtcaaggaaatatccgggatcttagtcggttccgattgtattttatctataatcccatattccgttaggatatggactgtactttgtaaagcggattccttcccctatataaggagggtccgtgtgcctctcggggcacgattcttttttccagtttatacaatcaataacacactcggcggaataatccccggacaggagtagggtattacttcttgaataagaaggcctgaacctgtataaaattcttcgtctccaaacccatccgctttcctaacttgatagccacccccttttactattgctgaaatcttgtttcgacagtgttagagatcgatggttgcatatgcgtgcgtttgcggagcaatatgtcaagaatgcgcgtaagccctcggacggagatcaaggcacatcaaagaagaaagatgatgaagacgatgccccgactggttttcaagatcatcgcaaagaactcaatcacatcttcagcggacccctggcttatgaatctaagagaaagcagaagtgtcacgccccgaattagtcccgaccggaactaacccgtgacgctccaaattaacctgttaatcgataccagtcccaggaaacagtgctggtatcacagggagacagaatatcacagcaacagaagtctcttcattatagagtagaagtacagtcatgttgggctgcggacagatcccgagctcacaactgcattacaaaaggaaagcggaagccaggacttggaccaaacaatcacaggcgcgacttgggaactaggctgaaaccctaaaactcatcgtagccggcttgctcctggaagaactccttatcagcaggatccgcttcatcttcttcagcaactggggggggggggaaatatttatatagagcaagggtgagtacgggagtactcagcaagccaggggaaataagtgtttaatgcaggcttcaaggaaaggctgttgttttttttttttgcaattgattttatttggaactcttttctaaaagcaactaagtgagtgcttctcaaacgacacggatgagacagtgcgtctcgtccggtcggagtatgtgcaatgtgtcagtctttagatcttgaaacaaggttggcacccggccaaaagctttttgaacggccacccgggccaactcttttcaaacggccacccgggccaacaacttttaaactgccacccgggcctagctgatcccatcagctgtaggttttccaaacatcgaacccagtttcacaacagcaatttcacaagcagtagtcaaacaaaactacgctaggaatcacctcacatccgcccatgaccgtgggcacggctgttcgaacagtttaatgacctctgcagagggggtacattttacccacacgacattactaacccgggtcacccagcccgtggggatcagccacgtcgggagacctccaagctttcatgacaaggcatttcgaaagccgatgcaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgttccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaagtgtcgggttttccgagtcttttgtaaaactccagttttacccaagttgttactcagattttaagtttgaaggcgaccgtcgatactcgcacagagtgcacgagtatcaaggcgcaactgggtggttacaaggggacatggcatagcaattaacaatggaaggatcaaatgtgacaatttaggtaagtccgccaatctgcttcgcagacgggacaacagattaagtgtgatcctatcaatgcataatattttgcaagcaacatacttaaatttcaaatataggctcaagatgttcaaaggtggcttgccttgctcgagatctggagcttgatcctcgaaatcctcgcactgcgggtcttcgggctccgaaactacatgcgaaacggggcaactcaacaaacagcgaaaataaagccctattaatgacctctaagcgtgccactagatagatctcgagatttgatgaattttggaatttgaacggaatcaaacggagttacggttgggaagatattgaatttctaagattattggattttggtctaaaggaaaaaggattaaattaaatcctttttttttggaaaaagaaaaagaaagaagggagggagggaatatagacttttctcgggcggttagggcgcggcccaaaagatttggggcggctcggccgagcttaacaggccggccggcccaagacggcccaagcgcgcgcgcgcgtgggggggggggagaggagacagagaccggtggaccgggctcaccactgctcggtcccgggtgggacccgcttgttagcggctcggctcaccgtgcggagggagcacgcggcgcacgcgcgcgggcgggaaggaacgcggtgtacgcgcgcggtttgcggtggacgcggatgcgacgggcccacgcgcagcctcacggctcgcggtggaacgcgcgcacggggagggaccgaccggggtcggctcgacccggtctaggctgagctggcgccgacgtggcgcctacgtggctgccacgcaggccggcggaaggtagacgacgacccggccacgaatggacggcgggcggcggcggcgagcggcggagcgaaccacggtgatacgggcaaaagcgagcacaccgggcggttgttcgcgacagggggaggcgagccaacggctcggattcgccggaggttgctcgacggcggcggattacggcggcggcaaccggcggcgggagaagagggaaacggcgacgaggctacgaggggtcgattcccgtcggtgagagcatctacgcggcttcgggaactcgacgctagcgtcggattgggcggaactacgccgagcgaggccggcgacgagcgggtgctacggagctcgggcggcgacggcggcgagcacacggcgagcgaaggcgacggttggggcggcgccggctagctacggggggtctactcgagctactaccgaaagctagggagaggagacggagcgaggagggagaacagagagagacatcaccgggaagaggaggggcgctgtgacgagaggccgacggcgcgggagtaatctctccggcctcgggccggggaaggggaaggagagggcgcggccgaagtccccttccgcgtcctcgaatgcaccggctctcccggcgctcggcggaggacggcggaggcgagacagagcacggggcggcggcaacggcgcggagacgaatggaagaggaggggtaaggggaggccgggggggtttaaaggggacggcaatgtcggtttgagaaccgacttgcgcggtcaaggcgcgagctggcgctccggctagcggccaaattggtgacaggggggatgacgccggcgggaggaaaagggaaaaaggagggggagaaagggggcttgcccctttgccggatcgggaaaaggaggagggagcgggggcgacgcgccagggggaaaggagggctcggcctccgtcccttggcggcttgcgcgcggagtggcgggggccgggcgatgacgacggcgatgacggcggggcggtttggagcggagcggcgacactggcgacaggcgcgggcaggcgctgacgacgccggcgaccgggcggtcggccactcggcacgcgcgcgcgggaaaacaacgggaggcgcggtggtttgaacggcgcggctcgggcgacaggcgcgggctggcgggaccgggcggcatccacgcgggcgcgcgcgagcaactgcacgcggggagcggtagcgagggatggggagacggagagcgagggggcgctcggcgcggcggcacacgcgcacacgcgcgcgcggcgcgcgtgcgggatggagcggagcggagggagaaaggcgctcggggcgactctcgcacgcgcgagcagcgtgcgggcgaggctcaacggggggggggggagcgcgccggggggagacagagagagggagagagagagagagggagagagagatgg

SEQ ID NO: 11118 - DNA, 3266 bp, Oryza sativa
gttaattttcccgctaggcgccacgacggaacgggcgctacaagaagctaacagaacgggagatcaatgcggttcagcctaacacgccccaatacttcggtgtcagagatagcaattaagttcgaccgctcggatcatcccgaccgagtggtccacccggggcgggtaccctctggtactagacccagtggttcgcaatgtcaagctccgacggactctcatcgatggtggcagtgcactcaacatccttttcgctaagaccctggacgatatgcagattcctcgcacggaattaaagccgagtaatgcactcttccatggtgttatcccaggattgtcagctacgccactcggctagatcactcttccagttaccttcggcactcaggagaattttcgcacagaaaacgtttgtttcgaagttgctgatttcgagacagcataccatgctatactcggacgaccggttctggccaaattcatggccgtcccacactacacctacatgatgatgaagatgcctggtcctcgaagggtcatatcactacggagcgacatcaagcaagccgtcacatgtgacaaagaaagttgcgagatgacccaaacccacgagatcactctcgctcgcgaagagatccgactggctgccaccacggcaagcgaaggagaggtgcctccgaccaagctgtcaaagaccgaagaaggcgacgacaagactaagaagatttcactagatccctccaatcctaccaaaactgctgtaataggcgccgagttagattgtaaataggaaagcgcgctcatcacctttcttcaaaataataaagatatttttgcatggaaaccatccgataagccgggtattcctagagaggtgattgagcactctttacatgttaaggaagacgccaaacccatcaagcaacgactccgccgttttgcacaggacaggaaggatgcgatcaaggaggaattaaccaagctgttggcagcgggcttcatcaaggaggtccttcatcccgactggctggctaacccagtcctggttcggaaaaagacggggcaatggcgcatgtgtgtcgattacaccgacctcaacaagtcttgccctaaagacccttttgggttacctcgcattgaccaggtggttgactcaacaaccggctacgagttactcagtttcttggactgctactcgggatatcatcagatccgactaagagaatccgactgcttgaagacctcctttattacgccctttgggacctactgctacatcaccatgctctttggattgaagaacgcaggagcaacttatcaacgcatgattcaaagatgtttttcaactcagataggtcgcaatgttgaagcttatgttgatgatgtagtcgtcaagaccaagcagaaggataacctgatcacggatttagaagaaacttttgcaagcatttgtgctttcaggatgaaactaaaccctgaaaagtgcatcttcggagtaccgtcagggaagttgctcggatttatgatatctcaaagaggcatacaagccaacccggagaaaatcaacgctatcctcaacatgaaaccgccaagctcccaaaaagatgttcaaaagctgactggttgcatggcggcgctcagccggttcgtctcacgactcggcgagcgggggatgccctttttcaagctgctgaagaagactgacaatttccagtggggacccgaagcacaaaaagcctttgaagacttcaagaaacttatcaccactccacctgttttggcctcgccacatccgcaagagccgctactgttatatgtgtcggcgacctcccaggttgtgagcacggtcctggttgtcgagcgtgaagaggaaggccatgttcaaaaagtccaacgaccaatttatttcgttagcgaggttttagccgactccaaaacaagatatcctcaagttcaaaagttattatatggtgtcttaattaccgtcaggaaattatctcactactttcaaagtcactcggccacggtggtcacatcgtttccactcggggatatacttcataaccgcgaagcaaatggacggattgcgaagtgggccttagaattgatgtctttggatatatcgttcaagccacaaacttcgatcaagtcataagctttagctgatttccttgccgagtggaccgagtgccaagaagatatgccagaggaaaatatggaatattggactatgcattttgatgggtcgaagaggcttacaggcactggagctggggtagttttaatctccccgactggagaaagattgagctacgtattgtggatacatttttctgcgtcccataacgtggcggaatacgaggcgctactccacggattaaggattgccatctctctaggcattcgccgattaatcgtccgtggagactctcagttggttgttaatcaagtcatgaaagagtggtcctgtttagatgataatatgactgcttatcgacaagaggtacgcaaattggaagataaattcgatggacttgagctcacccatgtcctctgacataacaatgaggcagccgacagactggccaattttggttcaaagcgggaggcagccccttatgatgtttacgaaccaaccatacccagaaaagaaataattgaagccatggatactcaaggcgtaagcatgatcgaacccgactggagaggccctctcataaaatttttgaccaagcaagaactccctcaagacaaaaatgaagccgagcggatttccattcgtagcagactttacattattcataagactgagttgtacaagaaaagtccatcaggaatactgcagcgttgcgtgtctttggaagaaggaagacaattgttgaaggatatacattctggtatttgtggtaatcatgctgctgcacggactattgtcggcaaagcttaccggtagggtttttttggcctacagctgtgtctgatggtgacaagattgtgcggacatgcgaaggttgtcaattttttgccagacaaattcatctgccagcccaagagttgcaaaccatcccgttgtcctagcagtttgcggtctgggggcttgacatggtcggcccatttaaaagggcagtcggcggttacacgcatctctttgtggctatcgacaaattctccaagtggattgaggctaaaccggtcatcacgatcacagcagataaagctagaaattttttcatcgacattgtgcatcggtttggggtacctaatcg

SEQ ID NO: 11119 - DNA, 36471 bp, Oryza sativa
  unsure (1)..(36471): unsure at all n locations
nnnnnnnnnnnnnnnnnnnnnnnnnnnnnnnnnnnnnnnnnnnnnnnnnnnnaatgtatctgcacgagattttgacttccaactcagactcagagaaagttaatagtgggtacattttttaatcaagccaatgaaaacatagtagtagctttttagggaggaacagtaggggcctagggggcaaacagccaatttgataaagcaataaaagatcataccttgggatttttctgatagtaacatttcgaatgggcacttcatcctcaggttggcaagtaattaagtttttaacctgaaaatgagatggtctttgcttattggtcaaatagtaaataacaaacacatgaaagtaaagtggcaagattggctatttcattgggatataggatgtccaggaagtgacagtaatggaaggatcgggaaagttattgttgttatttttccaaaagtgaattacttataggcaattaaatcttttcccccacttaatgaaattggtcgaccaaatctttcggccgacccggcaaaaatataagcaatcataagggcatgtttagaaaggcttaaatttgtgaatgttgcctcaggttttgaataactaagggcagcttgagtggaagtacacaagactctgccaaattagtcactcatatctgtatttcgttagagtatgtgatcccacaatcaactgaaaacaattattttatgacaattttattaccgacgtgtcatggttgaatgactgctgcaaaggcttcctttaaccagagaactagaatatcattaatgaatttataaaatatatttcatcacaacaaaaacattcttctctaattcaagtatttatctattaaaactgaaatgggctagcagattcagtatcgaatatctgtaatgtgctatcttattcacaataaaaagtgtgactgacacagcagttagaaccggcaactcaagccacaaagattgatcattgacaacatgcatccaagagtaaataacatgaaagtcataagtttctagggaacaggatttttggcaccaaaaaagttaataatacataaagtttagcctaccaatataaggccaataatattgtttggagtcccagagtatattggaacacgactatgccctttggtcattatcatacccattgtgtgcctatcaagaagagaacagtagcatcaatagaatgtgtcattcaaaacacgtacaatagttggaatattcttacaggtccagcttagcgtttatatcaagtgagaaggtttcagatatgggagtcatggcatcttttgcagtcttttgagtcatctccaaagctcctgtaatgatagtggtttcatcatgagtcagctctccacctttgccagcctaagaacaagtgaaccagcagaagtttaatggtattcatatttgtctgaggaaagcaccaatagctattgcaaacacaagtagcccagagaatatatgtatattagagccagaagaaaatattcaaggcatgtagaaatgcccaatcatattgtccatatagcagcaaatattataaccggactcatttaaggtgctataacatgtcataaaaagttgtctagaatctatatagaacatggcctcttgagatcaactcttggacgccgcacacagctgttgcaaccaaaaaaaaccactattgatgcaaactacatagtgtaaagagctacaacttaccagaaatgcataagagaataagaataaaacctacctcattaccatgcatatcgactaaagtctttagctcagctctcctcataagtgcaacatggccctttccgagtacccaatccaacaactggaaagatggacatgaatcaaattaagacatggcattagtggaaaacacaagcatatctatgcatcctctaattatagctaattttgcattagaaacaaggaaatggttagttgaatgcaactcaaaacattcatctgcgacaataagtagttcgctgtgtttcagccccaattaaattctgttcttttttctttgtaaaatatgattcagaaaacaattagtttagcaggaaataattaaactaagaagcgaattgaattgcttcatctaaaattattcaggagcaatcaaacacgcttatgaaggcatttttcctagtctggcaaaggaaaaaagaacactaaaacagggttcttgcttcacggctatgattgcttattctggttcaatggggaatgggacagattacatttactaattaattagtcaccggctacaaagaattttgtagacagatgactaaatgagaatgggacaagtcccttgattggaaaattaattaatgaatcagtaagtaaccgatctgcgtcctagtcgcggtcagccacttgtagtgtcccatccaaatccaaattgtgagcacaccccggccaagtgaccaactacaaggttccaattcctcccccaaattctttgcaagcaaacaagagcaacgaaacaggctaagccagcaggcgcaccttgctgattgggtaggcgaccgggaagaagacgatgaggagtacccggacaacgggcgccgccttggccccgacgctgagcccgtagcgcgtgcagatggcctgcggcatgatctgcgaccacaggagaaaccgaatcagccagccaaaccccaagtgagcaacccatagtccatggacacgcgagatggatcaatgcctcacctcaccgaaggcgaggatgagcgtgacggagatgaggatggcgccgaaggacgggacgagcgagtccagaaatatcggcagcgcctgcgcacacgccgccgccacaaagccatcagctccaatctggatacgtgcatacaggggatcgaaaaacagcaggagagatttgtacctccatggcgagggagttgccgatgaggagggtgcagaggagcaagtgctggttcttgacgaccggcaggatcctggctgcgcgcgcgcgcgcacacgcagcgatcagcagcagcagtagagctagggggggcagagagagagagagagaggaggacgtaccggcgttgtccttgtccgtcggggtgccggccttggcgaggacctcgaggtcgacgaggctgagcgacatgaggccgagggtgagccccgacatgagcccggcgaacatcaccagccccacgcacgacatcaggtacacccagaacatcgccccgcagcacaccgcatgctgcgacatctcccccccgccgccgccgccggcgaatcctcctcggcaaccaccgagctcagatgctcagtacgacacgagtgtgtttgctgtgggagaggagggccagttaatagatctctctctttttaacccgcgcagcacagcagctgcagcagggtggtctcggctgcgtgcgtgcgtgcggcggggggctcgctttattacgggcggggcttgagttggctggttggttaagtggcacggcgtcgacggcgcgcggctcccttttcctcctctcttttcggttgcggtttctcgtatttttcccccgtgggataacgtaacggcctctccccagaggggctgtttggtttgatcctaattcctaaaggttactaaagattaccacaccagtagacaagattgattaagttagtctattgtttggtttatagccacacttatgacaagatttcttctcatctattatgacctcacatgtcattaactccctaaagtgtgacacttgtaagccacaacttaaacaaatgtgacgtaaaaagtatgatgaatgatgataaacttcgtataccatccaaacagcccgagtgcggcgcaaccggggagccgcgcgtctgggtgttgggtgccggtggtggtgactgcggttggtgcgcgcctcgctcgcttcactacacccgttttcccgtggatttacctcccccggtggagtggagcgtggtggaagggatcgatcgatcggtgaatctacgttgcagctaaaccgacgaggcgtttcgggttctcgcgatgcaattcacgcaaggggggttctgtgtgcgatgggggcaggaggatgacacattgttgggtcgatctgccacggcttcttttgctgtcaaaggcacgtactatcaggggtttgagggcaaaacgtgcgggcaaatctcgcctgcccgatctgctgaccgaccggcatcgtgggggcccacgtggcggttgctgtcccgctggtcgtcagcgtgacggtctctgttttttactactctcgacaggttcagtcaaaaggaaagttactttgattattgtggatggtgctacttgaatgagcgcgacaaaagctaaagcgtgaaccctcgttgtggtgaaagcaatatacttgggcacttggcattgcatgatgcatggttaattatatcggtctaataaaagaaaaggatgccccagattgtgtagttttttggtcgatcacgcccaatactctctaatcatgaagtactcctatggacaatgcacagctcctattccgaggaccaagaattgcacgctcatttaggcccatctgagctgggatcggacatgatcaccaccagcacacgtgaacatggatagaatacttctaacagcaggtacaatagcagactataaaccagctataaccacgtatcgagaagaaaagataagagagaaaagaaagcgggttagagcaaggctaagagcaacttcaatagtgtagctaactactgactccaaatcatctattactaatctaatagctcattcatacaatagttaactataaaaatatatcataccattaatacccggtctcatatctcatacacacgtaatgtctttgagtccgtgttgcaactggctataaatctgtagtccgctttcttctctctcttctcttttcttcttgatatgtggttatagattgcttatagcctgctattgtacttgctctaataatacagccgacatgttggctataaggttatttgtagccttctcttagcctgcctatataatagttagctctttacaattaatacagagcccgcttgtctctctcacagagtttcttggttcttgtatccaagccggctgtaagtttacagcccacttctcctctctcttctctctcctccacctcagcatttagccaccttatagcctactattatacttactcttagagcaggtacaatagcaggctataagccagctataaatatattttaaagagataaaggaagagagaagaacagctggctataaatttgtagccagttgcagcacggactccaagacgtaatgtatgtatgacaagtagaatcaggtattaatagtatattaagcaactattgtatgaattggctattacattggctatagatgattttgagcttgtattgagctatactattaaacttgctcttacagatttgtagccagctgcagcacggactccaatacgcaatgtgtgtatgacggataggaccaaatattaatagtgtagtatacatttctagataaccattgtatgaattgactattagattgactatagatgattttaagcttgcagtggactatactattaaatttgctctaatagcaggagctagcatatgactgtcgaaaagatgtctgaactctgaatgattctctcgttgttctcggcattaagaatagtttcatgatgcagcatattctcgagattgcatgggttgcaaggcggagaatccggtggctgctggtggtgaatcaccaggcgcacgcctgcaaaggaatattggccggtagatgctgcgcacaaaagacacccttttgttcatcatcccagccgtttcagaagctacccttggtgtgtaggactcagtctgaccttcgattttctcttaggacagcatgcctgatctttagtttggcctcttctgttggagtggaacgtgggtacttcatcatcgaacgaacaaactaaaaaaaacaagtgttttccttttggcttgttttttacttgatacactactttacctaaaatgagatttggaagggtttcacgaagaaattataagcgtgttgagaattaaatacgaaattttagggttgaaatcacattccacttatcggtgtattactgtattatcgagtgtatctaagatatactaccctactttacctaacttggtcaatatcagagttgagcttggtcagcgattgagtcacgattaacaaatcaggaaacatattaggccatgaaaacaacgtgcatggcccaattccacgttgaagcaggaaagaaatagagggataagtgggtatattaaggttatcacgcacagtgctggtaatggggcatgtcattttccatttgcatatgtgcaaccttttctgtagttagtggtgtctgttcagttatattatcttctcgtgtgttattagccccataacctagcagttagccggaagctttatcttcagctgccaaactaatttgaaaataaaaggcagatgccacttagatttgcactatgagtcaataagtcggtgaatcctttcaacgcgacgcgcgtaagcgtgtcgggaaagtcgtcttgtgtttaattttagactgaccctgttatacttacatatacatcaatacatcatccacattgacagagaagagaacgaatcaggacatgtacatcaagtattcataaatgggtttactgactgtctgcaagcagagaaaattattccctgaaaattcaatgaatgtacgttataggttagcaattaatccttgacaatacattttacaaaccttagcacgcatggttcagattaatcgattcgcatcttatcttctctggaagttgtttgatcgaccaactgtccaaacgttggcagttaagtttagagaaaattattccctggaaaatttctctgaaattttcaaatgtttgattcatcaattttagagacaaatttcccctgaaaattcaatgaatgtacgtcaatacactttacgaacgtttttgcactcatggttcagcttcatcgattcgcaccttatcttctctgtaagttgtttgatgacttgatcgaccaactgtccaacttacatagtatatgccaatctcaccatgttccatggcgattactctctgaataagatcttggctttcgtggagccaatttgcaccaggttttatttggtcccagatatatgccgccattcatccgatcactgaaaatgtcagcatgacggtgcgtatatggaagacttacagatccatggaaaaagacgatccccttttttcttcgcacgattcaaaagacctggaaaatagtagaggatgaaaatgctggcctctctcgtcagcttagccccatgtgctccattttggcaaactagctttttttcacacaattttacacaggaatatacctttaaaattgaatcggagataaacaactcttaactcatgttatatagataaaatatataaaaaagaattaagtttgatatgcagctattagcatgtctttatttagatacaattatacttgtacacctatagagatgaatctataccgttataatatgaactcaccatgatcttacagggtaattttttcttatttttgttctgacatctataggtctttaaagagattgtgatgaatcatctttgacctctcttaataaaagatatattgtggctaatatgaacgctctcaatgtatagttacataaaggaaataactttagctactctctctatctaaaatataacaacttctagcatttaaaatttaccttaaaatattgcaacatcttcacttatactctcttttacggtagcgctattccacgcgctacagcgcggaataataattcgagcgctgcacaccgccttctacttccggttttttcgttttttaccaccccacctttcctccgcatcccaccttttctcgggtcgttttttttcgttttttaacaccccaccttccgtgtttctttttttctcttttccatcttatatgtgcttcatcaatggtccaggtaaaatattaaccatccagatttttctgttattcattccttctctatagtttttctgttttcgcgttttagtaaaatatttaccgtctagtttttctttccgagttttccgtttttctagtatctccgcacgtttgaaaagtaacgaatttactccgtggaatttttcatttactcccagcctcccacatctgctcattctaaagtaacaaatttattctcatgaatgtctccacatcgtatgacgccatacctaaatggtcgtaaaagaattactacaagcttacaacgctagtaattcttttaccaatattatttagattttgtggtctgcgagtaaaacaatttccacattcctctcgatatagccatgatctcatagccaccatgtagtaatatgtttactgatgtgttcaatatacagtataagaataaaaactggtactaagagtattgttgatctgtatcacaaaatagttgtatgaatgaaaaaaattacaggctcaatcacacacaagcgataaaattactcacaggtgaatcaaactagaaaagaaaaaaaatgattcagccaaaaatccatcatggaatcatggaagaatgtagcggtgtggtatagagttgagcttgacgttgcacagtagcagccatccatcatctaacaagcacaaaaaaatgtaaaaatattctcgttcatgtcaatacagatgacgagcaaaagaaaaatagcaaacaatctccatcaccggtggactccaccttaacctctgcggccagctacatggagcacgatgtgcaaatgtaggacctgtgcagcctatcaattgagatcaggtaatattggagattacatgttaatttgatttgcaaaaaaaattagggcttcatgcgtgaagttgaaagagagtatgcagatgcaaattagagtgtcatttccttacttgcttgttctatcaatgtcgccgacgtggagtagccgctggttgttgctattggctcaggtgaacacctccttgctggttatggtgctgcctagcgtccagcagcgaggcctgaagtagtgccttcacctcaaccgccgccggccactgctcgccggccaccgccatcaaccaccacggtgtcgtcgtcgtccttcatggtgtgtcgccgatctgtgggctgggatggtggatcgattcagatccaaaaaaaaggaaaaaacggagtgggggcgagagtggttggttgggtacgggaaaaatagaatatataccggaagcagagaagttgtttttatcgtagtaaatcatttactccgataatggtgggtgcacgatgcgggacatggggtgagatcgaaagcatggaagttgtttttattatcgaagtaaattgtttactcaaataaaggtgggtggtagaggcacccgatcggagtaaacaatttactcggatcggtaggagtgggatgacgggacgtggggtggggtgggcctgggctaacgcatgtttggcgctatgaacaatattccacgctctagcgctcctaatagtagttctactctttttaaccaataataacatttcctaatttaatttctctacctacttcgttttctcaatgaatcacaactttctcttacttaattctacatactttcataatacatgtgctcaatcctaaagttcttatatttttggatgagatgataacttattattggtattctgcctactttcgtaatacatgtatttaatcctaatttttttatattttaggatagatgcagtaactcattgtcgggttgtcagcgggttaaaatttatatggataggcatgcatttatttaggtttattgtttcggcatagcttcatacatattaatttttcatggtgcttttttttaacaaatagcatttttgcacactgtcaagatcttcacatagtcctcatcgctccagtcgtgcaagatatacagcatgaaactgtataagttattcaggattaaaatgttattaaagttattgtgattggtatctctctcaaacaacatctgcttctaattaaggactaaacatggaggttttattgagccactactactccccctgttctcatgtatacatatcattttaactttcatactttgctcctacatacttgttctactacatttactagtgcaggtttgagttttttttttactttacttacatgtgctatacacttcacatttaactgtttatttgcatgtctgcatttattatcatatatactagtgcagtatgtgccatcaaataataatgagggtaactctatctacattaggagggaaaagcctcctgaaaattattacagattaatatgtaaatacattcttataagttaaaatttgtccaaacctcgcaagccccaaaaaagatctttttttaacctaatgccgaactttgttccactgttatacttagaaaaaaaaaaattgacccagtttataaggaaaaccgggcccaaaaaccatacagctgcacggttaattacaggaaaaccagctaaaaccttccgctctacacaactaacaacgacggcggagcctaatcgtaggacgtcactgccaaactaaacacaaaagcgacacaacagctcccacattgcagaagaggtgttaccattgctaagctagccgcccaagcgacctagcagcgccgactccacaactgcagcaacactgaagccacgaaagtcaccaaagcgaaaagtagctccgacatccaacaatggacgtcagccaagccaccgaagagcaacttccttcacacggccagcaccagagctccttggaagagactgcaacatgtcatcattgccgagcgtcgccgcacccccatcagcaagcagcttcgacttcattagcagaaacaaccgaagagcgtgttgcccaccacaagaaagaagcggacccaagaaggcgaaggcctcaccgaacaaaaggtatgaaagcttttgaaccgaaaaagactatcgacagtcgtcgatgcgttagaacttctccgaagtgacgcccccaaggaggacacaacgtgtaacgccaccgccgctcgttcgaaagtcggaaggaggttttcacctagaaatttgtggggatatgaaagaatgccatgacaacgcctccaagaagggaaacggcgcccatgggcgccgtcgtcgtcgaaccggcccaagacccggcaaggctttcgccagcatcttcacatcactcacacaaacacccccacatcgatggccacagaatagtccatgatgtctcgcaagcagttataccttgaccgtaaccaacagcaaagacgggcccttggccaccctcgaaacgccatcaatccgccgaaaaagatcttagatttcgctgtttcacttagccaatttgctcaaggttttcgtacatagatgtcgtcatatatgtcaataattcagttttcagtctgcatctgcatcctcttgaaatgtcagcatgccggttcttgtatcacttatgggaggtcacagcctaatcgatactagaaagagaccgtctccttgtttctttgtacgattcgatacagcaggaaaaaaaacaatggatgatgaaacgccggcctctctcttcagcttaccttgatataccactccatttggacaaattgtggagaatccgaactctcccacgactggtaacagaaaggacaggctactgatcgctgtcggattagcggcaattgtcccttcttaatgatcgagactctgagctagccctgacttgatttagtatctgtctaaggatacggctcctgcacgaatcttatcttgcggtttacttgcaacaatagatcatggatctatcacccctatttacagaaacaaaactcattgcttttaaagaactcacattttcgggtaaccttgttgtcccttgtgggttgtggttgtggcaaggtcctttgaacccaccatctgaattcaagttgcaaacttagtacatatactattttagtgatagacaatctatacgttgataggaaaacgtcggtgatgattttatcaattttaaaatataccggtccaatcctcgaatgcgtttttacctgcacattcgatgagtgcgagaagcttgtggtgactttgtcattattaagacatacttttaaaggtggttatacggatagggtatgtatatatgtatgcatttggtaagtgggctcgtatgtaattgaacgtgcgtggttgtattgtgttttgtttttttcgaaaaaaagaacttatgaatcttgtactattgtctgtcttaattcattaattcattcgtttgacgacaattatgcatatatttgccaacttcgggtggcggttctctaatacaattcaatagttatggcatatttttcttctgttggtgtgtattagtttatgtttgcttagctttgtttgtgctatcgtgaactttctatgtgagttttgttctgtgtgagttctgtaataattggctgtaactctttgagtaaagactggaatgttacattccattatctaaaagaattaattcattcgtataatcgtggtattatctgataataacacaattacacaagacaacgctaagcacaaatgtataggtagaaaatgggccttaaagcccatttggccagtgaaatctaaggcccaaaagatagcaataatgggccgaaacccaaaagttaatgttgactctgtgtgctccattatagtcctccacgaatccatggtcgctggaaaagggtggagaaaccaagagggggcgtcgccggagtcggagtcggagacgtcacggcgagctccgcggcggcgatggagagctccctgggcggctggccgtcctacaacccgcaaaacttcagccaggtcgtccccgctgacccttccgcgcagcccttggtcggtcagcccctttgtgactctgtcccccctcactcgcgatcgatctctgtgcttagctgtcgtgatctcatgcctccgaccgccaagtacaattcagaattaggttgattgtgttgatgatgccatgaattgtgtgcctgatccctcacgccggagctttacctctagtcagtcctattgtgtgtcagagcgtgtgtctgaaattccagtgcgcatgattaacaaaaggtggttagtactatttgtttctaagtcccaatgccaaatagttggatcataatatctcatttgggaggtatttgtgaatcatggattatacatttaggatttggtttctctcatggccaacgccctttaaggtttcagttgtggtgatgaattactagtcggtttttgctccgaatgtcattccaagcagccacttgcattgtaatttgcaaagcatatattcagtttgtcatatttgtgtttctcgtcagagtatcaagctggtaacttattctctggagtccggacatgttgcattggtgcgaaactgccaatacttatccctattttttttgtgtttcagaatgtcgtaccagccacttacattgcaacacacaggacggatccacctcccggtcaaggtatcttgctcccttgtttcttttaccaatgctgatttccctgtgctgctcctcacttctgagtgtgtggttcctaaacgttcaaatgtgtatagttgaatgtgactgctcattcacattgcatcaaattccttttacagtagtactctacatggcatagcagatcctctgagttgtttggtctgagccaaaaagtgactatcttgcctttcatggctggcatatttaactccaatcatctatactgttttcagtaatgcagcctctttagtatcttctgagtgatagatccatgaatagattctgttggactgttagatatgtcttcaaagtcaatattttttgcattccctaggactgtagttttggcttcttgatatgtaactcacatacattatggctaatttgcccagcttactttcaagtagttcccttacgacctttgttctggtacattttttatagcttcaaagcaaacttttctcttggagtatgactttatgagggagagcagaaaaggttgagagtcagagagccagggcctagccggcaaactggaaagaccaactaaacctgatcttacaccttcatagttgagtccccttgaattgatttgataagttaaatgcttttataattttagcaatcaaattttggaataacacatgctagagcaacatctatttggactagaggttggagtttcctaatgatgaatcaacataatttagtattttcgcctcagagactttgctctgacccactatgtgtacctattacaattttgtatgagcattctgttaagtcctttttttcctcctagcctaatcttttggcaggccaggccgaaccaccaaacatcctggttgctttcaggcctgtccactgaactatctccagatttcaggtacaggtattcagtaaaaaattgattgcatgctgcttaccatctccacaaaagaaaaatgaaagaaaactataggcaagctgggcaatttattagtaaggagcaaatgaactggccaaccaaagcaacctctcatattagtcatcttcctctagtgctgccaacatagttttattgaagtgttctgtttatgccatattgccaatatgatttggatggttacatttatagaacacagtttttcttctcgactcattgcccgtgtgcctgttggcagaggccaaagatgtaaaccatttccattatctaaaaaaaaagaacattgtttttagatattctatgtaaacattgtacttcattggtccgttgcaggcatggagctagttccttagtttccagtttattcaggggctgttcagattgatgccattttcaaccatatcattttttggcaaagttgccaaaaatgtgcctacatttggtttgttgccaaattttggtaaatacataagaaatcctgccaaaattttggtaatattgtcaacttgctaaaattttaggtaaggtttattttggcaacaatctgaacagcccctccgtatttttgctgcctattccctcttgaatttcctgtgcatgggatattgcttctgatagtggtgaattcttgagtgctttagttcattagagcaagtttaatagtatagcccactgctaactccaattcatctatagccaatctaatagccaattcatacaatagttgcttactatactattaatatatggtcacacctgtcatacatacattgcgtcttacagtccgcgatgcagctggctacagatatatagcccgctgctcttctctctcatcctttctctcattaaaatatgtttacagcagcctaatagcttgctattgtacctgctcttaaagattttcgtagtcgatcagactcgatagttgctcgctctcttcacctcgttttggttctttctgggctctcgtccattcctaccagaactaccccaactattccaagttttcttttttactgtacagaaatcacctcttttttttttgttgctattttcactatttccctgaccgtttgtgtctggaatcgcagtgataacaacagaccccaagaacatcctgttgaggcatttttatcaaaaatccgaggaaaaggtgcgctgctaagagcctaagactctcacaaaggttacataaatcagtatggaacatctatttatcaacgctttatcttgactgtagttgaggccaaagagagctgcaccagacaacctgaccccacagaacaacggcaaacaaccaagaggccctctctctgatggtggtggtagccaggcaactgcaagtggtagaagctaaaacgcagctgttgttctctccggcatctcttgtgctgctgaactgacagcatgcatgtcatactacctgtatgtatgtgtgtgtgcttgttcaggcatatgcttactagtagtgtcatcatctctcttgtgtgattgatcaaaagagctccccatgcatgtacatacaccctcatcctcagtgtcagtgcggcacctttgatacggaactagcactattgcagtcttttatgccgacactagcacaacttgatgaaaccatttttccctacataattgcctcagcgtcagctttccaaaggctgaaagtgatcattgcctctcttatctcttagcattaccttcttttgtcagattatattagtatggtacatatcaatcatgcaagctcacgcgcgtcgccctttttgtttccctttttttccctatccatctgtgaacgaagacgagtagacgacggcgtcggcgtctcgtgagaaagaccgagttccagtggaacgccgtcgtccgcgcgcgcgtgaggctggcccggcgcgttgtgcgctcgtggcgccgtgctgcgcgacgcgagtcgctgtccatggcagcggagcgtgcacggctcggcgtttgctatccagctaagcagcagcggccgccgcagaggacgtgagagacaccgcgcgtgacgggagccgtaacaacggcagcggccaactgcggatgggctatgggcatatttgagagagtttctggtagctgaaacttctcctaaaacaaaacctttcgaaacaattcagctttttatttgaaatttaagaagttgcaattgcataattaaaaaaaaactagtagattcatatttctataaactgactaccaaccgattgtctttttagaatgttaagcttcatcaaacatgatcgaaatcgatgtaattccggccgtctggtcactaatcggacggtgcatatcgatggctacacaacgtatcagtatagtagcactcacggtgaaggctgggctgctggcagaagaagaatcgaatcgaaccgcgaggtgaacacgacgagttaaaggctggaccagaggccatggggggcgagctagccgcaacagactggcgcccgtgccttcttctagtacgtcgggctggttctattccatgtggcgttgccgccgtcgactggcccaccgggaaaaccccaacggcggcaacccgacaacctggtgccttgtggatattgctcgcgtccatttcggaacagctcaggtgttcacgaggtcgctacgctacaggacggagatcgcctgaagctatgtggacgtagacctcgacaatgcgtgtacctgtaccatggcatatgattgtgcattatcagcttgatgaagcagcagcagctgttcacaagtcatcacaacggcagtggcaggcttagctgcgtctttcaggttgttgagagactttgtgcaataattagactaaggcattaagcattatcaagataggtgaatgtttattcaattattctatcgaataaagtggggaaagggtgaagaacgcgtcagatatcacccaaaaatgtctctgtccaacaagatttagtatttgcggcagcctgtgccggataacctttcgctgtgcttttttttcctcttgtttttttctgccatcggttcatgaatcctccaagccgtttttttggccactagtgtgctgtgtcctgcactactctctcaactcacaagtcataactcaacctttttctaatggaagaatccatctctgaacatttccagggcacagtagctccaagctaaccgttgaaaaatgaaagaaacttctctcatgctattccacttcagtagtacagactgtacagtgtcaaataaatgaatcagcatgatcaaactaatttgtggcatggtatcatgttagtacttgaccattcattgcatacatggtgattgcacagtagttgttcgatcacgtattcacgtgatggtaggatcatcacctgctaattaatcagtactgtcagcggtcaagtttattagcacaagatccagagctggttggctgtaaaaaagaactaatgaatatactagtacgaaaaagtcacagcaactgaacatggaaacgaagattagtatttagatcaagacaaggcgaagcgacaagaactggcgcaaatgctgtgcagctgatcaccagatgcagtatagtggacaaaagcatttgccagcagaatatacaagtcccaagctctgcagccaactactaatggcgatcataaacaaagggttagatgcaggatggaagtgtgagatgagatgagatgcagaaaatggtcatgtgacatcatgtgcaagcaggcaccaaccattaggctacaagaagaaagcattacttctcccagtgcagtaaagcaggcagctggtatcaggagtggactggtaaaagatgcattagagcagacaactgtacttgcattaggtagaatcacattaacactgtaagcattagctggggcatagtcagtctcagtcacaacaccaccctacacttgtgtagtttataagtgtcaagtgtcatagaatgatgctcgagtataatacagtcaaaagagcaaggagagctggttatgagatccaacgagaggggaaaaaattatgtaatgacaacatggttaatattggcaatccctaatggcaatccatacaaactcatgttcaactgtagtgctgggctgttgtcatctgtaccgttggttctcacgcttgctgaagttcccgccatcccttgagctgtgtctgtccgatgtctgaggcgcatctcttccgggtttcttatcctgtatgatgaacaattgcaatcagaaaatgagttaactatactgtttagtaaatggaagaaatcaaaaagttcataagtgagtagaacatacatcgcggcatagtagatcatccatttcgagcatgtgaattacatgtcccattttaggcctcttgtggccatcaggatcgacgcagcgaagggcgaccagaagtgcccgtttcagtgctttgggagaaggcttctcgggcagcttggggtctactacctcctctgctttcctctcagcaaccatggtcttcagccattcaaccaagttcacctgaaaagaagacaatttagctccatcagatgccaacgatcctggaagagattcatgaaagaataggtaggatactgacctctccaggtgccctggtgtaatctactggtgatctacccgttataatctccattataagtactccaaagctataaacatcgctcctctcatttaacatccccgtgctggcgtattcaggtgccacgtaactgcaacatagccaatttcagtcatgataagatgtactaacttttatgtacagtaaaggttgtgtgtggattgtcaatactaacccaaaggttcccataacacgggtagtaacataacttctctctgagcacaatagcttcgcaagaccaaaatctgacactttagcattccattgctggtcaagaaggatattgctagatttgatgtcacgatggacaaccttcggttccagcccctcatgaagataggccagcctagagagcagaagttgggtgtcagtattcatgtgtttccctatcaaacccatcttttaaaagaactgttgatgttgtttaagcaagccactgacaatattgctttcaggcaaagaatattatcggtagagtgcttatcaatgcacatgatgctttaatctagattttaactgtcaaacagggtcacaatgttctagtccgaacgcatgtgcaaggtaagtatttagttatttacatgcagtatcttaaatctctatagagcgaatcaaaacaatctcagactgggtgctttgattaaaataaagcaagctggcaacaggaaagcaattaaaggacgaatgcaagatgagcacatgcaatgtccaagaaattcgacacctttactttggcgtttgtactatttaaatgcacatgaaattctaattgttttctgaacaaccaaatgatgcctaatgctaacaaagaaaaaaacatgttttttttttcgtatctgctaaacatgggttagaatcagctgtctttgggaatatgtgcatgctaaggaacacaacctaacaaacttgagtaaagcacctgaattcctacgacaatcaatttcaccagaattagactctactatcctaactatgatgcatgtctcacaacaaaacaagcctcccatgccagctagcacctgtcttctaaaatctgaatgatcatgacctatatttgcccataatattcataatctttaatgtcgaagtattaaacagaatcaggcaaggcataccaatataacactgttcaaggtacccactttggcaaaattggcgtgcaacagtgagagaagcattaccctttagcagttccaagaattatgttcatcctgacttcccaagttagtgggctcacttcccctacatcaccatgaagccattgatcaagattgccgttgtctacatattcatacacgagcatcctgttcaaccaaaacggcaatgtgagtaaaacatccattaatcagagagggaataataatgcacaaaattgatgaagagatttcattgtacctataagcgccctctacacagtagccgagcaatctaacgagattcttatgccgaacacgcccgatcgcttcaacctccaccttgaactccttctcagcctggcccctggcaaagcaggaaaacaatttgattttttgttgtcataaaacagaacaagaaaatgtgtgagaaaatgaaacggtaatccagtccctagaaagccgtgtaggattaaattgcgtcacagatatcgaggcgaatggggaatggagatgggcgcacagaagaggtaaatgatgacagcaatttgaaacttcttgagccccacgacccaaccgttcaccagcagaccactgcttcatgaataaactgaaacaagttgcacctctatgcacaaaaaatccgatcaaatacactagaaaaaaaaaaggatctttcccttcttcaaatggaaattcacagtttttgacagctcacttcctggtccatcagactgatcatatccaagtccaacaacccattatcgcagaagaagataagattagagatctgcgtatcaattcgatgaacaagaatacaaccggagcaaacagccaaagaaaccgatgaacaagaacacaaacacggttaaacagacgaaatcagtggcatttttacgaacaaacgaaatcacacaccccagtttaaacagaaagggaaaattgatttctttaaaaaataaaaaataaaaacgggtattcctaactatattctccatcctttctactcacccaaggacgaattctaggctatacaaggatggaaaggctggagatgtccaaatcaaatcgaaaagctccaagagaaggcacaggattagtacctattattgagtagattcttgacggcgaccatggcggaattctgcagcgtgcccttgtaaacaatcccgtagccgccttccccgatcacattctcctccgcgagcccgtcggttgcctcctcgagctcccggagagtgaaccaatggccccacccgaggtgcgacactcttcggcccagccgagccgctcgccgtgctcctcggcgtggcgccgtcccgctcgctcccgccgctcgtcgtggccgacatgccgctggccgccgtcgaccgcgtggatcccgccggtagcaccggcggctgcgtccgctgcgcggcggcggagtctttgctttggcgagctgcaccccatgttgcgccgccggtggaggcggctgcgccggcgtcggcgtcggcgtctgctgctgccgctgctgccggcgaacgatctcctgtatgtccttcggcggcgtgggctgctggagatgctgcttgagaatcttggtgtcggccgggtacagattggatgcgaggtcatcgcggcgccggcgccggcgggagaggcagacgaagacgaggaccaggacgagcacgatggcggcgccgacggcgatgccgatgagcacccagaggcggagcccgaacaccgccgtgcgctgcgacagccacccgttgaggtacccggcgctccacaccgacgacggcgcgccctgctggtgccgcgaggggtgcggctggtgcggaggtgcctcggcgagcagcctcctctgagccgccatcgccgccacggggagctgatgaagcagagagagagagagagagagagagagagagagcgctttggcctccttggattctttggtcgctctgctttacataggcatgcgacttgacgacgagagagcggcgtggggagcgttctgggtaacttttgagttttgaggtggtgaggctagcgagtttgttgttaccgatttgagacgctcgtatgacaggtgggcccagtttgtcatgtggacccaccgacagtgagctaagaaaggagtagtgctgtagtagggacgatggtaatttggatatggtgtgcaccacaggtctacagcaccactgaaattcaatctctgagcaagagtgcatgtaaaccatatctatcttttcttttttaaaaaaaaattatacagtacaacacagacactcacaacgcacatgcactcacctctataaacacacgcaaaccctacccctatgagcatctccgaagactgggccggcaaatccattaggattgacgaagtcaccacaggcgtctcgctgtcgacaggtacgtcgcctaccactgaaagcacaataccgttaaatcctgaaaaattcattcccgtggggaatcgaacccaggatctcaggtgttactgagacttatttgacctattgttttctatttaaatactccgtcccaaaatataagacctcatcgattgcacatatatcataataagccaaaaacaacttattagagaatgaaagttaatttataggtaacacttttatatatgtgttattagcgacttaaaacccaatataaaaaactacattgaaaatatcttaaattcaacttaaaaattcaagttctggctttggttttgatttattaggacaaccaatggggctcatagctaccaagttgtcctgatctatagttgtactcctggagtaatagatagctatattttgggattgaggaagtaacaaaattattatattgtaaaactacatataaataaaaatgttcccatatgattgttatgtgtttcaaactaactgtttttagagctattgacggttaaattttcaaagatataaccgaataatctcatatattcaaatatggatagagcaattgtcatgaaaaacataatgatgcaatttctaaaaactacaaaagcaatggtaagagggcaaattctttgcaaccaatattaaagacttttaaaggggtatagatgaatttgaacttatgattgacagtacacgagatacatgacaattgcgcaaccgcccttaatcttccacaacactgagttaaaatatagtaatgactatatcgcgcatcccacgcattgtaatgagattttataacttctttaccgatactcatcagtttaatggctaatacggaggaagtatgatctattggttgacatagttactagatggtatggccaaacgtgagagctcctttctactttctctgttctaaaatattctaaaatatagttatttttatctgaataatatatagctataattattttaacttcaaacgaagggagcagcaattaatacaatgaggagttgaatagaggataagactggaaattatgcgttttgttcaagccgtagctcttccttagtatccgaaagtgactagggagtgtttgaagagaaggggattgaggagattgggaagatacgcaaaacgaggtaagccattagctcatgattaattgagtattaactattttaaatttcaaaaatggattaatatgattttttaaagcaactttcctattgaaattttttgcaaaaaacgcaccgtttagtagtttgaaaagcgtgcgcgcggaaaacgatagacaatctctcctatctccacctaacgaacactcccaagggtatgtgtagttagggaaaagagaatttttgggtgttacatggaacatttgaccggatgtcggaaggggttttcggatacgaatgaaaaaactaatttcagaactcgcctggaaaccgcgagacgaatctcttgagactaattaagccgtcattagcacatgtggttactgtagcacttatggctaatcacggactaattaggcttaaaagattcgtctcgcgatttcctccataactgtgcaattagtttttctttttatatatatttaatgcttatgtatatgtccaaagattcgatgcgatgtttttgggaaaaaattttgggaactaaacggggcctaatatgtggagacaaatcaacaatcagaggataatttccccttgcattactaggacagacggtcaggagtgaggaccaccacctcgttgcaaacttgtgtgtgccggggccccttgtgatttggattctggagaggagttaggtgacgtgcgcttccaagattagcattggctgtcagctagctgcgtgacagctcggcggcacggcgacgtcgagccgtcagtcagtcggccgtccgctttcaaagttgagccgcgcgcaccgcactgcactgcaccaacggaatgtgggggtgtgtgtgctggtcgtgcgcgctctgacgcagacgcatgcagggccaagcaaaaaagagctccacccttttccttctccatttgacatggactcgtggagagatagagagagaaggcttcgaatatttggtagtatcaccttcacactgttctactattgtgttattaaatcatagtagtaattagcagtcgtacccatttgcagattttctcaattggcggccgggctccctgaggatacagtctggctggtgatgttcatgtggctgatagcgtcatcgcgatgagtgggtttctttaagatgtacgcaagctacggctcggaattgccattcaggcattcacacgatagtcatggcaagtctaataccaaaagaatggtacacgacacctggcagcgcctccgttgcgtatgtgcaattacgaggctgtgtactctaatcacgataataatcatggccttcttactagtactgttccagtgcgtcctgctactgtgctacgcagtaatcatcacgccgggccagccaaagcatatatgctccgatcaccattcaggcgatcactgattcgttcacacaatcagacccccggaccccggctcgctccggctgctcgatcggatgccttacgtgcaacgccaaccacggggtgtagcaacgcaacagaaggccattttgtccccatataccccgacgtacaagccgttcacgttccacgacccgacccacgagcgcgtgcgtaaattccttttgcttctcgcggacgacatgacatgaggacgagtaaaactcacgcccccacaacgtcgtacaggtccatgactcgtgtgctccgcccgatacgacgcgatgcgtccggtgatattttttttctttttagcatggcgtcgcgactcgcggcacgcagccacgggcacacgacgtgcgcgcgcgcgctgcaacctgcggctgcggcgttcgctcgattcggcgcaggcgcgcagcgagcgcgagagccgcacgagcacgaggagacgcaggaggatgcggggacggaacggtggctgcgtcgcgtgtttgccaatgttggccgagacgcgcgcggcgcgcggatgagccgagcaaaagagggcaattttttaactgttgacgcatcacatgggaaggacgtacggggaaaaaacggataccgtacctgtcacgacgtaggattattggattatgctttggacaagccttccttcctttttccagtttctaccattattttcgtcttctttgcccaggcggcagcggagaaggaacacactttcttttcacgctgttcatgaccaaagctgctgtaagtagtactaccttcgtctcgcgaccaactttgatcgttcgtcttatttaattttttttataattagcatttttgttgttatgagatgataaaacaagaatagtactttactcgtggcttatgttttcaaattttttcaaaaaattttcagataagacgaacggtcaaagttgggcgcggaaaaccatggctgtacttattttgggacggaggaagtactacctccgtcccaaaaaaagaaaaaccctggtttccgtgttcaacgtttgaccgtccgttttatttgaaagaaattatgaaaaaaattaaaaagacaagtcacacataaaatattaatcatgttttatcatctaacaacaatgaaaatacgaattataaaaaatttcatgtaagacggacagtcaaagttggacacggaaacccagggtttgtcttttttttttttttgacggagggagtacaagttttacaaggtcagaacgtataagtatgacgtcgtcatggtcaagcgacagggctacaggagaacatggcagattatgagaataaagtcaagtcatagacagggttaaagtctggtgccgcagcatcaggggacagggtactttctaggagtatctcaatggccatttaaattttcaagcaacagaaattattccttacgtatggaaggaacaaacagcaaatactctgcttgagaatcacttcacaagaaagaaattttaaatcgacttcataatcacaggtacggccgtgtaattgattagtactccccctaacaaaatactatacccattaaaaaataatagatgaaccaaacaaattaagagaagagtatattgtactccttcaatcccaaaatacaagaagttttagttggatgagacacatcctaatccgtaagactactgttaagattcgtagtattatgacatgtctcattcaaccaaaactctttacattttgggacggaggaattacatagcattgggtagagcatatctttgtttggctttgcaccagctttagtacatattttgacttccatgcaggtatattattctagattgcagcacataattgaaagaaaatcttataaaacacaagtggaatttatggacccattcaaatttagaacatgtttcacaaagttttattcaaattttatataagttagtgaattttctataggtttgatgatgtatcctaacataaagtgaaacttatttcaatattctctccgtcctaatataagtgcacctaagatcggatgtgacatttcatataagtgttctataaaatgtcacacccaatactaagtgcactttttattgagacggagggagtacaactgataaaaactgaaagtatgtgctaaaattagtacaaagcaaaaataggtgcgttttaccagtgtaaagtgcaatttactcttgagaaaacgttgggtggtgaattctagcagcatcagtctcatataggagtacatcgtgtgactgattcataaggtactatgagtaagaatagtaacttcgaagttggaagctgaaggtaaataaattttgtattgaaactgcagctaactatgtccttctgttgttgagcaaaaggcaaaagtataaattacacagggtacaagcctaaaagtcattgtgtcatttacattgatgccagtttggtccagtataattcaaacagttcatagtgcaccgtcaccaccaaatttttatggtagtttgattagcaaatgttgcatataattatagtcattacatggcgggtgacaacagattttatcccatgtattgccagaaaatgaatgtaactattcaattacgatatcacttcaaaataacacagctagttcaaagtacacgtagtgacttgacaaggattaagaaacctttgtatcccacaggaagaagcatactaatctagcagaagaaatcaactgcaccgggaagaactgaaaatttggttggaagaaaaccaaaatgctccccatcagattgcacaaagatgtcagcactaacttccttttctgctacttcaatcgactgaactctgcgacaaaaatattgtcacttagtgaccccaaatagaatacccagttaaacagcctaatagtgatgttagctattttgagaaggcttaacaaacattgaatcctgttttagaactaatgagacacatatcaggaggaaagcaatagaggcatagagctcgaataaatattcctcaacaattttgattgccatcatgtcattgcaaaactaccagtgatgatgctaacaagattaatctgtccggagatctgacctatatgccaaataacaactgaagggttattggatgaaaccaaccagaagtacaacccttaactcagcattgtttaaagtaagtagagcaacactaagattcattagcggagtccccttaccttatcgatgacacaccagtcactgatagatgagttcctccatacaatctatgaagcttgagcaggaaatcatgccatttgaaatcttgaagaataacgacctatgaaatgacacataaattaacaaaggctaacttttcttaatgcttactcaaaactataaagaaaaatgactttttaggcacctcaaggtcacccccgaaaggatcagctgttggagtgatcttcataccaccgccgaagtatttggcatttcctatgcatagtgcagtgactttacgaatggttttccattctccaccatttacctattatatgcactagtaaattcaagaggtgtgggactgataatgacgaaaaaaatcagtaagattgcaactaagcttccttctaaaaccagtgcgatgcaaacctttattctaagatctcgattactatgtccccaaaaggctctgagcgctccaaaaacatagcataagttgccaaatctcttgtacatagaagaaaaataacccgccttagcactcctgcaggtgcagagcaattttttccttttcaaaccatccattgaatttcacaggtcaaatgagccatgcttgacttacaaatggatatcagcaacattaacaaaataatgtgggtttccatctgggccttccatcatacctatatctagttttgatttgactcctgcaaaaatatgcacctgtgagcctcatatgttatgattgcgaattcgtagtagacataaatctagtttttgtatattttcatgaagatggccagtttataatagcaatttcattgttatgcttccaaaaactttatttcaaatcttttaagacaaacccaatcacctggctagtcatatgacaactggtactttaataatgttactgtgcattcatatacatataccaggagatgaatgaccactatgagaccacgagtatggactgacagcacacactataaaagaagaatcaaagaaggaacctctcacaattcgatcaatcgcctcatgaggatcatttgtcctggttgcacaaaagaaagaaacatcagtgaaagtagaggttatctaaacaccatatgtagattatgctggagaaatataccagccaaatgtccttgcaaagtctgaaccagttccaagtggaatgagctgtcagagaaaaacaatccgcttcactaccgaacaaattccagtgcataaacaaacatttcagttcagaatagtctaatgcttaatttaagaggctagaagggtgatctgattggatagaatagctagaaactaagtacactcacaccaagcgctgtggaatgatcaggtccttgatcaagagcatggacaggacttcccttacagaagaagccattgacgacctgcacattccatccacaaatattaccgtatttgaatatcaagtttctggacaaatttagtacaaaggttgtatccatattgcaaaagtcaacacaaataatacctcatgaagtgttccatcaccaccaacagcaatcacggcatcagccccatcctttacagcctacatcatcatcatcatacacacattgtaacaagaaaaccaaaaggggaaattaacaattggatactggcagctataggaagcccatacacacctccctcgtgatatctatggcgtcgaacggggccgaggtgatgcactcacaaatctgatcacgcaataccaacaaatcagaacattccgtagagcccccaaattagcatggggatctgatcccaaatatggtctcatacagcaattgcagcttccggttcaggatgctacgatccagggatctaagagaaatcgaaagtcttacatcgcattggtcagcgaagcgggtgcggaggtgcgggagcagctgcttccactggttgcccgtgcggccattggcgcctgcgacgacgtgaagggcgttgagagcgcgcataggatagggggtaagggtagcggggtggaagaggggggagtaccggaggggttgacgacgaagacgaagttgcggcggcggcgggaggagacggtggcggcggcggcgcggtcggacgcgaggccgacggcggccggctgggagtgggagtgcgacgctcgcggcaggatccgcgacggcctcggcgtcgctggcgcgaccatgaatgacttcgctgcttatcccgaattcccccgaccaatgcgcatcgcctcaagacgccgggccgccgcctaccgctgtgaacgaagctgactatgcgaatgtaaagtgccacgtggcaggtcagtagaaatgtacaatcaccagggtttgtgtatatcttatctggtgaaattaaaacagtactactccctctattccataatataatacaaagctcgatcaaagttgatacggtcttcaaaactaatctttttccttctaacttctcatatattataaccttatgaaagtaaatttaaatatcaatacaacaatattttttttaacaaataaaatatatttttaactagcatgacgaattaatcaggcaaaatcatcagggggtggcaccggtttcagataataacaaaatcaatgtgcaaaaaacatgttctaaaagtagagcgcctctgaacgttggcacaaactagctccaatcatataccacacgctccaaacagaagtataataattgaagatacaccagctaatacaccagctaaggtacaatattgacgtgcattggtattcagaaccggctgccaaacatttgctgtagggaaatgaacgatgaaaatcaaatgtgctcaacagtgtacacacaattagcatctcagccgttcgtaagttttgcaaaatttgaccccccatgcgtgaggggtattacttcttacatctataccgcagagcatactgtgctccgtactttcgtacactcatcagaagcacgaatagcctaatatgaccacaatggcttcatgtcacacccgaacggcttcgtaatttacgatacaagctgaacccgtttgccatcaatattgaattttctgcttccttggagctgcaaaatagacagaaaaaggttaaataaggctattacaccgctgcccagtagcaacatgtagctcaatagagcttctgttctaattcaatgaggtcacgctgatgatacaatggctatggtgaagatcccaacaagttacattgcaaccaaatctgctatctgtttttctttatgcaactacataccataccttctatagtaggtgctccctaattactccataacgaaagagagaaagatcgcaaagcctctgccaaatgaaaaagaaaacccgtaccttcctctttaagaacaatagagcttcacgcctacaagagaagttggagaacatagactctgaatgtgcttcaacagctaccttaagttccttcaatttcatagattgtgctggggcctgggaataatacaagtaaataaacgttgtgattacggcacaacacatgaagccacatacagagagtatgataattaaacaaccatacctgacgaagaattgttttgcaaagtttcttgaccttggttttatgtttttgtttaacatccacgcacatttctttcacagtattcacattggcgtctattagttcattatcgttagcagattcttcctcatcaccatcttcttccaactctgataattcattggattgggttgaattttcctcatcgctatcaccaaaagaagttttgttccctttccaacggtgtccggcaactttaattggcagacccttaatgccaagaccctgctttccagatgtggctttgtcctgcagcagttacaaagaccatttagatggaatggatattattgagaactcagctatatctatatgtttttaaatacatcagatttgttcgataatcaatcaacagaggtctaaattgactttgcaatttcaggccaaactgtaagaaaaatatagaattcaaaggcaagttgcttatatgtggttaaaaagtctctaaaagcacattaagaaatggacagtcttgttataggacattatgggagatctgatagactgttaataccaacctgaacaagattgtataggttttcttggtcttcttccccaaatgtctggcggacatttgaagtaccttttgtagcagaagatttgttcttgcgcgattttgctcctagaaagccgcctgacttgaatccaaatttatgcccccaccagttcacatcatcagcttgcgatactgaacagagagttgtcatgaactattagtaaaatctcaatgatattagtctatggtctcaaaagaagattacatatttagagtaacaaatttatcagaatcatttcaatccaaaccaagcatcagaccatgtgcagtacaaccaatcaggtagtcacaattcaaaccattagtgaagagagaaagattagagagcaaataaaatgtgctttactctggtaagcaattagcaacttagatgctgacatggtagatctcgtctagtagagaaccaaaattaacagtatatgagtataatcagcagagctttaccatttagctgttcagtgacttgtatgcagtgtgtacacattctagttctaaaagtttggcacctcagtcctggctcagaccaagaagcaatgatggggaaactaaacatgcaaattacagacctgtatcttgacagatgatgggatcaggttcatcacagcatgttggttcaacttcctggtccactttgcaattgtcatcacttttgcgaacctgtgcaaacacaatatttcatgcatgtaataaagtaagttacacagtttacacaggtgcacaagaaaaaaattgctcatggatagtaactagattagctaagaaagaaataggcacacataagaataacaactcacaagtatgccttcaagatcttttgctgaataaccgctcacacttttccccctctctcttttcttatatctgaaataagtattgcgtaaactgtaaagagaagaaaaaatagatacagaaatacaaatactgaagctatgggagcaaaccaaccttccttggggtcgggtaactttggtaacttcattgtttgttggtttagcttcctttggtgtactatctggtgaattgcttacatcatcttcaaattctgctacaccaaaaatgttatcaaacaacacctaacaagatgaaaataagaactatacgcacaaacaccgtcaggtaccttttatagcaggagtagcggattgctgccaaagaagatgggagcaacgatcaaatgacaagaaaaagataataggaaacaattaggaactgaaataatgaccaatttatacatagagcaaacaaagtaattgttacacgccataccactttcagtttctttagtatattgtcaaattgggtggtgtcatatacccatttgttatgaggactgtctacaccaacacctgcagaaacgatcagattaggtttaagagagcccacgggtggttaacaaggatatatatccttacaaatagacttctaaagtagaagatctatatagaaacataccaagagtgtcctgcttgtttttcactctaacatgccccttaatgccttgcttatctttaccaaggccttcaccttcttcccacccctaaagcataatgaaaaaaaaaatgctaactacactttaaaatcagtaaaaagagaacaaatctaaattacagaaaaatcagtataatctgacgaaataaacttgtttatggagtgcaaaccaccattccattcacgttactcatttggttcgattagaaatattaactacactaaattcaatctatgtgcagccataactcgtgaagaatgtgaatttcaactcctttccaaaatccaagccaagttcactcgtttgcggcagttcccaaattccactccgtagcattaacaaacgttgctagttacaattcaacaggaacaacaacagcaactccttcagactccatatccgacaggatcaaccgatgttaaccaacataaacctacgtctagcaatagcatactgcatgccccaacgcatgaggaaaactttgaattaggtagtatcacgcaccatttgcttcatgaggcggaaggcggcggactgccgcgcgatcccaacgtagcaggagggtgcctccggggcggccatggcgcctgcgctgcgcggggtcgacgcggccttcgccgccgcctgaacggtgaggctgcgttgccggacggggagagaggggaggaggagagggaaaccctaggatgcacggctcaggggttttgaggcagccgatgattttgcctggagattcccgctcgggttggtgagcctcgataacgggccgtgccgtataggcccggagttgctatacggtgggctctggaaaggtcggtgattggttgcccaggctgggccttagtaatttgcagttgggtgggttttctttcacatgggccatccttgtgatggattgtcttgggccgttcggttcacttattgctaccttccagtatccttcctgattgaaggtgaaatctatagatcgctttctggaaaggaaaatctgtagaaattgttgctcctttgcctaccgatggggtcatggaacgatcagtgcttgagaattggaattcagattgaacttgaagaacacgacaatgacaatgggagggtggaggaaaattactgaagaagcgaatgtctattatcattcagacttagagtaacactgagatctgcccgacaaatgtatatcgcggtttcagcatgccaagctgcaaattttgccctgcgatcaataacaaacagatacggttagctaccggctgcccctgcgtgcaaaaaatgctctggaagtttgttcttgtgctttaaccatattttattcaatatatgatgactaattaaccttgtttaataaagtggctgtagtttagtggtgagaattccacgttgtggccgtggagacctgggctcgaatcccagcagccacacttataaatttttttaaacaagtctggttttgtcctagtattttttatatttaaatttgtcccactactttttaagtatggttttgtcctagtattttttatatttaaatttgtcccactactttttaagtatggttttgtcctagtattttttatattttaaacaagtctggttttgtcctagtatttttatatttaaatttgtcccactactttttaagtatggttttgtcctagtattttttaatttaaatttgtcccacaacatttgtcataatatagtattattaattgtctcatcaattacttatcatttaattttttttctattttacccttaacaaccattcaacttttacctttttttgctacatgtttggtattgtcctagtattactacctccatctcataataattatatttctatgatttaatttttcttacaacatttgtcataataaaatattcttaattgtcccatcatttacttatcattaaaattatttcctattattaatgcgaggcataataatctttcttcacaaatcttaatacatgctaaacaacctagacttatatttgttcggggcggagttagtatatactgcattcgttccaagataagtgtagccatggatattcgtatccaacgtttgtctgtctgtattatttgaaaaaattatgaaaaaaaagactcacgtataaagtactattcatattttatcatttaataataataaaaaaaaaaataaaaaattcaagtaagatgaacagacattgaacatgaatagtgcaaaactatatttattttgagacggatggagtacttaggtggtattagttggcccatgttttatttaatttttctacgacaagtttaatcgctctgtcaaaaaaaattaattctagaaataaatcgggattgcatgcattcagaatccaaatttgtccttagaattggacctttttttttttttgacagaggggta

SEQ ID NO: 11120 - DNA, 23380 bp, Oryza sativa
  unsure (1)..(23380): unsure at all n locations
ttttttctcagctagtacatgtttagttgcttctacttagggtgtgttcggacaccccttttccaacccctctctctcgttttccgcgcgtacgctttttaaactgttaaacggtgcgttttttgaaaaagtttttatacaaaagtttctttaaaaaaatcaaattaatcttttttttaaaaaaaaaaatagctaatacttaattaatcacgcgctaatggatcgctccgttttccgtacggagggttctggttgggaaccttaaatagcgaacacatgtggttcaggtttttttagtacatttattttatgaatgggtaaaagaaatgtgcttctacttcgtacctgttttacttagtgcatgtttagctttttgacttggtagttcatgtttttagcgtgtttagctttactttttttttttgctttgctatattgttttacttggcagtacatgttttagattgtttagctttcatgccaaacaaaaaagattgtttagctttacttagtacatgtttggttcttttatttaatttcatagcttgtttagcttcacttcggcctcgtttattttttcgtttagcaattacaactctttgtcttctataagcatgttttctaaacgactaaatgatttttctaaaaataacttttttatatagaaatttctttaaaagtcaaatgaagttatctttcaagctttgtaataattaatactcaattaattatgttaatggactttgtttcgtacttttattctgttaaaattatgtgttttttattcatctattttttttaatattatatacgtttcaaaggtgcccctagtttttcaaaggtgccgctaaaacatgtactgttggtactatacatgtttagcgtgttaagcatgagtttgagaacttgagtcgcttttttcttcttcttttactaaaaacatgctttagcgcttttagtactgctactctatctctttcaaaatatagcaactttgtactggataggatatattctaatacaataaatctgaacatacaagattgattgttgttatattttaagacggagagagtatatgttttgccgctcttcttttatttttcttgcacatgcttagcgtgtttagtggtatgagctgttgtcaattttcagagaacaatagatgcttcattccttttccttttactccatggagtagaaaccaattagttaactgctcgatcgactgcagctaagcagatagcaaagatatttgtcctcaaagccatcccgatccatcaatcaatccgtagtactccttccgtcctctaatataacgtattttaacttgcttgtactgttttgatcattcgtctcatttaaaaaaatttagaattattatttattttatttgtgacttactttattatctaaagtactttaaacacaattttttattttttatatttgtataatttttttaataaaataaatgattaaatagtacaaacaaaatattaaaatcaaagacggaggagtagtagtcgattgctgtcgtagacaggtgagactgtgagaaacgtggacgacgacccgcacacacacattcggtcatttgcatactccgtatgcgatattgccatattccattatccgtccatttcagggttcacacttcacgctatcaggctaccgcgaaaatggaataggtggcactgttacggcagcttggagatccaaatcatccaaaagtttcccccaattaaaaaactcaccgcgcgtttgaccaccacgtccacctccgaaaaccagttatcctaaatcccccgtcgggtacgtgtcgccgagcgcgagcaaccgcggcgcggccgcccccactacggcgaggctcccgtcgccgtcaggtggcctctcgtggcgcgttgccatcggcaccacgagagcactcgtatattccgtcgtgtttgtaccgaaccaccgatcaccaggtaagcaggtagcgaaacgatgagacttgacttcaccagggcgaaggtaaaagatctagatgtctcttcttgcgagtataatcaagggggatagtagtagggcttcgtaaatagtcatatagcccagtggttatagtgatctgagtagcatctaaggttctgagtaaaagtagtagggttccccttaccgtttttaatacggttaccgaactcccgcggtaagatggttaccgcgcggtaaccgtaagacataccgtggttttaaaaactacaaaggttatcgtgcatggtaatcgtaataaccgtgtgttaatcgtgtggttttgtaaacccctaatagtagatcgttgaggttgaagcggtttggttctttttccatctttttcatggggtgcccaattcacgagtgggaggtgctgagctgctgaagcgtgactgcagcgggaggaaagcgtgggcgtcggcaagtgcggtgggtacatgccagtggccacgtagtggggcggcgagcagcagcattcgccgggcaaacgctcgcgtcgggacgctgccctgacacgtacacaccccttccatggcctacggcgttcgtagggcaggcagccacattcctattctggataagcgaacatgatcaggtggagttcgtactttagaaagatgttctatcctctccaattttttaacgacaaaggaaaggagctatgcctaaaagaagaagtgtggtggtaaaaattattgtgcccagcaagcattggccatggcatgcatggagcagaacgatgatgagctagaacatgaactacatacagatctcagttagggtttacgttttttcacgaaaaccgatagtaaatctcagaatttttgaggtttggatacttgatgaaagtatatgctgaaagagattttgaatagttttcaagaatttagatatataataaacagccaattcccgataagaaaatgatgaaaaatgtcgcacctttataagtcagaccagaatcgagcgctcaatcgaaaggtgaactccgacgcttgagatcaggggtcaggagtaactcgttgtgatggcgacgcagcggaggacggctcgccggcgcggtgtatagctgaccagaagctgcgtgcgcggatgcgttgagacggccacgtggcgaatcaggtgccctgaacctgcaatgtcattttccactgcccctgacgccgcggtagctcaggcaagcggcctcaacctggccaatcacccagcggcaacgagataaccccagcttcaggaaagaccttaatctccaatacaccaattgctgatgatctgagaataattccattccaaaatatgcatgactcagctcgcatccgcatcgtgcattcgtgcctactccctccagaaaaaaaaaacaacctaaaatagaatgtgacatattctaatacaacatatatagacagaggtatatccagatacattgtattataatttataccatcttaaacagagggagtaatgaggggctgtttagatgggactaaaaactttttagtccgtgtcacatcggatgtttggacactaatttggagtgttaaaaatatgctaataaaaaactaatttcataaattagagctaattcgtgagacgaattttttaagtctaattaatctataattataaaaaatttactgtagcatcacattgtcaaatcatgacataattaggctcaaaagatttgtctcgtgaattagtataaggttatataattggttttataattaatctatatttaatactctaaattagtgtcaacgtgaataagtcgctgtttccacatggcccctgatactcctatataaaagccaccgggtccgagccggcgttcctcacgaatttccatgctcacaatcacaagttgactcgtgacgacggcgactccatccgacccacttgtcttggacgacgcctctcgctccccgaggcggacgcggaccgcttcacccgcccaatcaaaaccgtccatccatccccgcgtccgcgttcgcgtaggctgcggctgcggcatccatggccgtcgcgaggctggtggccgcgcgggcccctctcctctcccccgccgcggtggcggcggcacaccgatcgcccccggcgctgctgcggctggcgttcgcgccgctcccggcgcggcggctggccgtccccttgcgcgtggcggtgggtgagccggagccggaggaggatgcgcggagggcggtggcggagcgcgcggcgcggaagcagtcggagcggcggacgtacctggtggcagcggtgatgtccagcctcgggatcacgtccatggccgccgccgccgtctactaccgcttcgcctggcaaatggaggtaggtaacacgccatcgccaaactcccgctcgcatcttaccattacccaattcggcaattccttcgccgcagcactaaaatttctccgcgtgctcgaccagggcagcggcgagatcccggtcacggaaatgttcggcaccttcgcgctatcggtgggcgccgcggtaagcgcacacacacgcaccgtccgcacgacgccgcgcgtcgctcgtgtaaccgtgttggttttgccttgccattttgcgcaggtggggatggagttctgggcgcggtgggcgcaccgggcgctgtggcacgcgtcgctgtggcacatgcacgagtcgcaccaccgcccgcgagacgggccgttcgagctcaacgacgtcttcgccatcaccaacgccgtcccggccatgtccctcctcgcctacggcttcttcacccgcggcctcgtccccggcctctgcttcggcgcggtgagtggtcgatcctcctccatttcaaccaaatccccatcacttctctcaaacacactgtaccaggatttgaccaagcgtgcttaacgtggccgtattaaaatgacaaaagtgcatgatgtagtactatgttcagttgattacattcacattccatggccgcctgccaaaaaaaaatgaatttatctgtcaagagaagccaaagcgtagagcgaactccaaaagatcttgatgtccttgctgcatcggataaacaataaaaaattgaacattcgagatcgagaaaatttagaaaaacggagtggcctggcctccatgagttcccagagaaacctataatggattctaatatctttgagggatgttatctcgtatatttttctctttcaaattcgatacaaatagttatgaatttttttttttaaaaagtaataatgtagagtatagtgagatctatcagtccaccaaaaattatgttcaacttccatatacacaacacgaataaaagaaaagataattcagatgtgaacattacgctactaatcatacattgaatttaattttttatatctcaacgtgtgagttgagtttgaatataagattttatgtagttgcacagatatgttatctgagtgttgtcaaaaaatttcataacctttggatattctgtaagcaaatgagagaacatccctcgaatgattaaatagttccccctataacgtagattgtactaaagcaataggtattgttgtcgcattgcgacggcgccatggtcacccatgcgaggtacccatcaacggtctcaccggaacaagtaaaatacaagcgctagcagcgtttctttttgttcaatttgattgccaaggttgaatttttgtgatctggggctctgggcagagatgatccaagtgctgacgtgtccgttcgccgcaaggactcgggatcacgctgttcgggatggcgtacatgttcgtccacgacggcctggtccaccggcgcttcccggtggggcccatcgccaacgtgccctacttccggcgggtcggcgccggccaccaagtccggcccggtcgctttccacctaactgcagccgaccacgcattcctgtctctgagcttctcttgccgcggttctgaatttatgtgagctgatccatccttgcctgccattcattcttgcagatacatcacatggacaagttcgaaggtgtgccatatgggctgttccttggtcccaaggtgaggagatgtgtctcatgctattcatgctttgcttcctcgtgccccatgctaccatggatgcttgttggcttactcctgctccaacggtgtccatttgtcgagtagtttgcatacttgcagtactcctttattgcaagcatgaatttgtgattgggaagctaatgtagaatttgaactgtgttgatataaaaggactggaaattttgaaatgttctaagatgtattacaaatatttgtgatcgtcggaaaaattgtctgaaatgttctaaaatgtctctgttttatgtggttgacaggagctggaggaggtgggtgggattgaggagctggagaaggagatcaagaggaggattaagaggaaagagaccttagatgcgatccaatgagagctacttatcacacatttttttctttttatttgctgtcatctcttattagtttttgcttcagtggcaattgtagccttgtaatatgcttttctgtcctgttaatagaagaataatttagatagatatttggaagctcatttggacggtggagcacacaggtattagaaatgatgtgctggggctgaatggctgatgcttttgctagtactgctggtaatgatatatattaatcagtaccattctgaatttattagtctggttgagtcgtgctgctgacagtgaggtgttcactgataaaatgtgtactttcttttatattctttatttgccgacattctgtatctcttgttcacgagatgtgccggatgtaaatatgaaagtgatgcatggctgattactttttgaccgtgaagaagaattaatgaagcttatgcacactaggcggttcctccatactgctgaatggctgttcattaaggccctgacaagtgacaaggtcacagactgacagttacttcttgaggtcaaggaggttaatgtagtttatcaggattaggttgcaaactgacaaggaagatattgtccgttgtgtttctactcttggtgtcaagtcgatcctcacaggatcacggtcgtggcattgctggtccttggtagaacaaggtagggcaagcgcaatgttgtgatctgggacctttcaaatcagatcctagtgattgtcccctggttataaagaactgcatgttacggttactgcatgattagttaggcataagcatgtgacgaggatcctcgtcgtgatattccgtccatttttcaatgttgatcaagcgtggcagatctcctgctgatctgccagcaactgttgctaggttcagagtttgcttgatcttgtttaagctcttcatcggcgttttttatgtttgaagtcatcgtttaatggcatactactactatactagtgatgtcctgtagtgcattagaaaatacagaatgggccacatactcaaacactgttaccggttgaccaaaacaaggcatatatcgaaattcacacactgcagacttgcagttgttgactcatgtaactttacccttctcttaggccgtgtttagttcacccccaactcaacggttttgatgggcctaaggcccaaatcaacggttttgatgggcctaaggcctgaaaccatgtcgaacagttcgatgggccgaaccatgacgagaaagcccacctgcgacactggacagcaacggcagccagccacagccaactcgccttatcccgtaatccatccatggcataaagctccctcctcagctcccacctccgtcttcgcgcacgctccaatggcggccacggctgtgaccctgccgtcctcgccggcccccttccccgtcaccaccaccggcttcttcttccgtaacgtccgcttcttctccgctccccgcctcctcgccgagccctccgcgtcgccgcctccgccgcggccgacgcgccacccaagccggcgccgccgccgacctcgccttcgggcatcgtcctcgtcgaccccaccgaggcacagaaggtgcaccgcctcaaggctgtatacgaccagaaggtggtccccctcatcaccgaggagttcggctacaccaatgtccaccaggtgttcgacctctgtctcccttctcgcaattataggatagacatggccatttctttgcggaactcgggaaattcgattgttgttcaataattgagcttagaggagtgtgttttggattctcgattttattcaggtgcccaaggttgagaagattgtagtgaattgcgggttgggggctgaagccggtaactccaaggggctcgaatccgccatgaaggacctcgccatgatcaccggccagtggcccgtcaagacgaaggccaagaagtccgtcgccagtttcaagatccgcgaggggaacaccattggtattgccgttacgctccgcggcagggtgagtcctctgtacctctggctacttgcgatgcagacattgacaaattggggactgcaatgttgtatcaatttgggatttgcatgacagtataatagcctaaagtatgtgtgagaattgcaattactccatccagttccaaattattgtcaccgttggccgtcagtattttacattgaccacaaattttaaatggttggacgaacgaaagtttaatacctatctatgtggagtaacaacctttaataatatggcatatttttaggtatatgcattttattttctaaaaaatataagtgatcaaagttcaaatatgaatagtatccagtgacaagtatttgggaacctagggaatatgtttgatcgatgagcttattttggcttgctgcaggtaatgttcaacttcctggataggctcatcaaccttgggcttcctaggaccatggacttccttggtgtcaaccccaacagctttgatggccatggcaacttcaccataggccttcgtgatcagggcgtgttcccggagatcccgtacgaggtcggtgggaagaagaatggaatggacgtctgcatcgtcaccaccgcgaagaccgacaacgaggctctcaggctgctcaccctccttggcatgccgttcgcggagcacatcaagtcctccgtggtgatccggaagaagaggttgaagcgccaccacttcatgagcaagggcaggggaagacggtgattgcaaaccgctgcctaggcacgttgagctttgcttctcactttgtcaattgtcattgtttttgcaaagtttcgtttagaagtttgatgattttgttatcttgtcacgtgctgtatttactgtcagaagacaaaatgaaaaggctttgctttggtcaggtcattcgcagatgagcactcataaatgaattgggtgtaaagagattatccggcagcattttcaaactgcttaactttactcactaaaccacatcatatatatctctttggtcccaagcatctcatagcccaggccattacccacaccatactatcatcctatatcagtatttcagtagctacacgttggcaattcaggcggaccgatgacgagctcttcttcagggaaggcgcatggcttgcccgccgccccgagctccgggcacggcaccggcgagacgtcggaggcgacacccttgacatcggtgcagttccattgcagcttcttggcgtccggcgcgagctgcgcggtgacgttggacatgcagatgccagtgtaggggtcgttgggaatcccctccatcctgccggccatggtgacgttctccgcgaacacgtcgctgtagttgatgccggtgacctccggcagagcgttggggtcggaggagttgtccgggtgctggccgtagttgccggtcatccagaacacccacttcatggtgtggaggctgaggccgcggacgaacacgtccttgacgtagccgccgcgccccacgccggacttgatcctgacggccgactcggtgtcgatggcgacgttgtccacggcgcgcacgtcgcggatgccgccggacatctcgctgccgagcgcgatcatggcgctcgtcggggagatgcaggtgagcctcctgatgaggatgtgctggctcggcatgttgaacttgatgccgtactggtcccagccgctcttcacggcgatgcagtcgtcgccggacacgatgtagctgtcctcgatcttgacatgggaggaagaatctgcaccatggacaacaagagctcatcacatctagcacaaaccaatgctttcctcatggcagcattgatcaagtgcagtgtgacttgtatgtttatacctgggtcgattccatcggtgttgggcgagttgagaggtgctagaatggtgatgccgctgatggtcacattgctggcgcagcacggaacacaaagaaggtgagcatcatgatctatatctaaccgttcagaaactgaattctggttgcgagtactgatgattcttacgtgcagtaggtgggatggagattccatgacggcgagtcgacgaaggtgacattagagatgatgatattgttagagtagaggagctcgagcaggtaaccgcgagtgtaggtgagttccttggcgtggaacttgtcccaccagacttggccctggccgttgatcgttccattcctacctgaaatgttgctcaatttcagatatccacagctaaacatataccacaatcacagcagttacacgaaaaggttgagaaaatagcaatcttcatcacgcattcattcgtgtaccagtgatgatgacatctgtgagattggatccagcaatgaaattgctgtatcttgggcctggttcgtcccttcctcttccgtaggatggcagaggagctatcagaggccaatcttccaagttctgaagaacgaaatgaacagcttagactgtcaacacttcagataatgagagatgaaccagttacactagtaactgaaaacgggtgaacaaaaacagataagagtagcaggtccacaagttatgtgctgacaaaattcaaagcataaaagtggagcaaccatataacagtagaaatttctgaaatgacatggcagagcttttgtcctaacactcccaatccattctctttctctcagtacggcacggttagcaactgaaacggatcacattaacatcgattgaccttcaatggtccaaactaattaatcagctatctgatcaaaaccggttcatttacatgtattcaatagccaccagctcatccttacaataggcaaccaccgcaattgcaatgacacatcaccgggttcaagctcccaacatacagctcttggcacatatttaagcgccgccttaatacgttgtcctcccatttcttgagagcgacaatcagataaggttgattacgacaaaaaaaaaatacagcatgtaaccgtggcatttagcatgttaatgttcgtattaacagtttgccagtttgagattccatcaagaacagatgggagcctgggaggacagatatgggaccccagaccaaaaaaggcgtttttccctggcaaaaagcatcatctacgccaataaaacggaagtagctagtacccgccaactttagggcggtcgcgtgtgactgtttggtcacaagtgtgacggtaagagaagggacaatagcagactattagctagctacaatatattttaatgagataaaagatgagagagaaaaatagcagactattagctagctacaatatattttaatgagataaaagatgagagagaaaagcagtgagctacagatatgtagtcagctgcagcacggactcgactccaagatacaatgtgtgtatgacatgactatcatataaattggttattagattagctataggtgaattagagctagtagtaggaaccggacatttaacatgcgctactttcgcggcgaaacaccagccgagatagagatagagataatggcgcagttaatcatggtaaatggtaataagagagggggttgatgcatgcaaccgatgttgttggtggctcagatcacctgagacgcgaggatctcggcgccgtggtcgagaaagagggtgaagtggctggtgaggttgaagggccccgtcagccacttccccttcggcaccaccagcgccgcgccgccgtcgccggcgcgcagcgacaggtccgccaccgccttggcgaacgccgccgtgttggacctcctcccgtccccgacgccgccgtactccgtgatcctcgcgacgtgcttccggcaccccgctcccgccggcgacgacggtgacgccgcgacgccgcacgcgcacagcgccaccagcgccaccgcgcaaaccacctgcaaccaaccaaccaaccaaaattccctttcttgattctataagaaaataataatcctaagacgccacgaaaattgatcggattggacggagacggagagcgttacttacctgcagtattgtttttttggccattgcgaaactgtgatgagagagagctgcaggacgcaaatcaggacgagaaatgcaacaagaatcaggacgtgcttacgtatatatagatacagaaagtgcctagaccggtggaggatattacgggtgtgtcctgtatcaatccctgcctatgttaaccccccagtaaatgcgtgctatttattgattgctttctgcctgctatgccaaacttgccgagccaatagacgtggcaataactgcttgcgtgtgctgcgtccatggagcttttaaccggccgagacatctcgctttctgccaatgcccattgccatttgaggtggtgcattgcatggcggttaaggctgtggactcgttctgtccaagcgaaggtttgctgtgcaactcgtgatgtgttttgccttgcaaggtgaatacaacacgagcatgcgaatcttgagccgcagggcgtgatgaaggtgaagagtgcaaggcaacacgtactgtgccactgtggactaatggctggttgctttctttgtgtgagatgatatcttgccattctctgtttggataaggcatgattgccagaagaaaaatctgaccaaacacaacatctctagaaaggaaacagtgaagtactcgtaaattgtacggtctgatccacgagcaggcatgaattgccagaagaaaaatctgaccatatcctactcctaattaattaattgggctggaagcctgacaaaattcagcctgaaaatggtgaaaggaattgacagaagaaaattgctagcgtgggtggcgaatccttcgttttcttttcctcgtggttgcttcttcctcgatcttatgtccatccatgatgccgttgcggactggcgggcctgatggcttgtgtttgattgggagtatatgtttgccacaagggttggaatggtactatttttaagggtttggagggtgtgtcccggatgccaataagagagaaagtgagttagattgatccgtccttttatttaagggatggagccttttatttgaaggaaatattacttttcaggaatcatgatcatctcatctcacctatccctgatccaaacactttaaagaactagttttctccaacccaacccatcatatccctatgaccaaacacatgataaatgcatccttactagtgagtatttattataagagcatccacagtgtgaattttctatacattatagacatctttttagcagtcctaataaaagtattgggcattaagcatagaagctgactcttggggagagagaatatggcccacatgtctatggagttagacattgttcactttgaatgtactaaatttatagtatggtaacaaatttaaaatgatcttgccaatactatcctaacaaaattgagaagtttcaaaaattttatctcgaaaaaacattataaaattttagaagacatcaaattgaacatatccaacggtaccaaaaaatggtagcattaaaacataataaattttgataaaattgatttgacaacaaagtgaacaagctcttaaaaataattttattttgcttacaggtgtttagatgatttttttaattatattttttggatgaagaagagtagtgacttgtaacgaataccgaaagcttgtttggcatgaagtcataggtttggcacggatgacccaggccatcatgaattggagcatgggatgccttcgaaacggtggggaaaatgggtgtaattgtgattgagattgtctacattctgatctttgagccgaggacagaggagttatataaaaaaaaggaagaggaggatgaatagtgtaggctccattacatgggccgtaattgcaacccggtgtttgtttcagaaagcccactaaatgtggcacacccaagcaatccagtacgacttaccagacgggtctaaacgagaaaccccctctcctaccgccgccttccgttactgacttttactagtacgtcccgtcgttcccgttcgtcccccttcttctgcagccttgtggcgcggccctgctactcttgttggacgatgtggcgccgtggcggtgatcagaaattcaggatcctctgcagcaaattgtatcgtgcctgatatgtgaggccgatgatcagtcgactgcagtggatctaaatccccgtggtggatggctacgactacgagcctacaacacagacatccccggcgtgcggagttgctgcagtgttgtgcataccgagagagctcgttcccgccgttctacatgcgagtttgggagatgcggacacgcgccgtcccccgacgagtctgcgacatccccgttctccgccgcccgtgaggccgcgaaggcaattctcgaaactgaaggctgaggcggccattctctccaccggcagcgcaagaggaaggcaacgccggtgcggcggttcgcgtccctcaccatcatcaggcggaattggtagcagagaaaggcaatcgggtcggagtagcaagagcttgcttaatctttaaccacactgtgtgattgataataacaaaactagtgtacaaacaagatgcgaaacgagggagggagaaagaaatgtacatgagtacatccatctaggctatcactttctgaaccatgcttacacttgaaaaccagctgattccaggtacagccgaacaggtaactcgcctaatttcggtatactagctgatagctccatcagaaggggtttctgaccaggatgtggctgctgtggagggctttcaagagcaccgaggcgactgagtgcacggctgccgacacaatcctcgccttgatctgcccacgcctgggcatgtgtctcctgcttgctgctgatccgtgaccatctctgcacggagcagcggaggtggcgccatggttggtcatcttcctgcacttcactcactggatatgcacacgaacagcagctgcagactagtttggaactttggatgcgtgctctctctcagcttttgggctgtctgacgagcatgcgttgctgaccagtgccctatttatactgctactgcaagttgtgatagtggtttcagttgtttagttggagtgtgccactattaaactcggaccaaatattcgttggatgggaataatatcatcttttgagctcgtgctaatcacagtggtggtagctcaaagcctcacacactcacactgcttttctgccgatttgtattaaattgatgctatgcttagtgccggattattgttcacactaggcttagctgtgcggctccctgaagctttacttgctcgcctccatcccggcggcttcgttccctggaaggtagtatgcttgtattgtgctgccgttgtttctgttctgaggagaatgctgatccttcatcattgcctgcggcaagcacatgctccacgatccatttgtgatttttatgtctcgacgccgacggcggctctcaggaataggatcgatatgatgtcaaactattggcaccttttgctctgaagagaggagcttaattaaaacggattatgattgcattagactcgcttaatctctagctctgcattgtgactgggttttggatggagcctttggatttaacccctgattttgattttttgagcagcgttctagatggtctgtgagactgtgagatgacaataaaagctgtgagcttgtggtcacaaggttttggtttgttctggggaacttggccacttgagctggaggcaggacggcagatgtgctgtgtcaagaggtgtcaacacctgctacctgcatgtgcaatggattgacttgtgcttggtgttccgagcattgaccaattaaggggattcgtgagtacgagttcattgtaccgattcaattactagtactacgtgtgtatagtcggttcggcgctgattgtttggtgatagaccgggtgctgacgatgatacgctgccgcctagctggccaggtgcctgctgacagtttcggctggcgtgtacaagttgcccggggcccctgatcgagataacttcaaaaagtaggcgatgggcataggctctgttcagagttcacaccggctgctagctgcagccattcacaactagtgcagccgaacgcaaccataacctggaggattaagtccacttgtactctctcaaaatatactttcaatatgattcatatccctcaaccgtaatactagatatctttaccccttaactatgaaaactagctcaatttagctctctcaactgttttaagagtggttttcaccgacgtgacgtccacgtggcagtccagtcatcaaataaattaaaaaataaacatatgaccgacaagtgataagagggaaaaaatgtggggtccgcacgtcagaaaccatccttatctccctgtttttctttcttttgttgtttcacacgcggagcgaaggcaagctcgcatcggcggagacgcagtcgacgaggccggtgctgacgctatcttcccccgctctcatccccctttgctccgtgcatgaagggccactcggtggacgaggagcgagacggcaggcaacaacagaatgagggagaggggcgcggggatatctccagctcctcgacacattcgccggccaggccacgccaaccccgttgtgtcaccgccacccatgactccattgttgactggggagcacccccaacgccaccactagagggtggccatgcccgctgccggcaccatccttcgagcccccaagtcatcgccaacacgccaccatccatatcccgccttgacctcgccttaggcacagcgatgccctggatccagccctgacgacaagccaccgctttcttggtgccagcgacatccgtttccccataccaccgccatcagggggacggggcccttctcgtcaccctggactactgccatcgggcagcccaccctgtgcgcccaccactataacagccgcagttggcaccccctccgtcgggcccttgccacatggatgtcattgcttctgggatggaaggagccgagaaccctcgggcttcacacgtcgtccccaccgcaacgtcctcgccgccagatgccgccgttgccgctccctgtcgttgtctcgccgcctgtgccgtcagccaccgtgcgccaagaagaaaaaaggagagagagagaggttattagagggatgagatgtcaagggggccccacattttaaaaaatttatttgatgactgggacgccatgtcagtaaaattatcctccgaaaccgccgagagagttaaattgcactggttttaatagtcgagggtgtcaaaatatctggtattatggtttaggaatacaaatcagattcgacccctagttaagaaaagcaaagtagacttattcctaacctggaagagatcatgacaggccaccacttacttgatctgccatgggcagatgggctcacggcccaactcctaatgtttcgatttctccgcgaggagaatggcccgggctgaaccatcttcccatgtttgttccagaaggacgggccgtgtaccgtgtacgtagtagatttcaagcgatacgaaacgctgccaaacacaatccatcatgccaaacctccaaatctcaatcaatctgaaaacgttaggaaaccacaggttttggctcgtccagataaagaaaagcagtgcaaaggagtcaggatcccagccggccgggagagcgacggacgcgggcagcgccaaggcgcgcattaaagccggcgttgtcccgtgcagctacagccccccgcaaccggagcggcgggtagcgcgacgcgagggcctctgatagctcgcttgtccgcttacccccttgccgctcatggcattcacgtgggattgacgtgaactagcgcgcaccggccgcgagcccgcgaccgaccggcacgagagcgatcgatccgtctctacgcgttacatacttacattctctcgcgttgctactagctgatcgctaccgtaggccgtagcgtattgcttcgccttactatttgggccgggagctgtgacggttttgatcaggcagatcgagtagttcgttgcatggtgacaaagacagtttttattttggctttcttctcttatactccatccgaaccaaataaactaatcttgtacgggatatgatacattgtaatagagaaaatctatacatcggtatcccatgaagacggggtactaatccggatcccctcctcctacctcactctccttccctaaatcagatggcacccgaggtgcagccctccccttcgtcgttgccccaccgctcaccggagccggccgccgccgccgccgccgctgccgtagggtaggcggcgaaggtggcgacagcgaggagctcagcggtgggcgcggtgagcgagagggagagcgggagcagggcgcggaggtcaaacacgcgagggaagaggcgaaggaagtggagtgcgcctcgtcggtggagcctgagcgggaggcggtgggcgaggcaggggagcgtgagtggctcggtgggcgacgccgccatgagcgggaggtgcgccgacgcgagcttctcgaaggtgtggtccaggtgccgtgccgccacgtgctgcggcgacgtctctctgcctcaagcgaagtcaagatgcccaggtaccaggcggccgacggtggtgtcttgttcgctctctctctgggtatgatgcctggtacccaggtaccaaggtctgatatctaggtaccagctcgataccagggtaccaggtaccagccggtactcgggtatcaggtttaggaaaaagtcacttaaagtatcccatcctaatgagaattcattctctagnctctctcatttggatactattaaatttagacatagtcatattccatacgaggttaacttattttggagcagatgtggtaggcttatgactggaagtcatcagaaaccgttaaccaagtgtggcagtacgatgacgccgtcgtacgtcaagctttgagcttcctcgcgttgatcggctgatgagctgccgctgttcgtgggcttccaaacgtccaccgtctgcctgctgttaacgaggcaacgctaggtagcttgcgacaagggcaatgtacgtacgtagtacatccgcggtgggcaccgaatcgctgatcgatcgggcagggcaggcaggtgctagtgcagtgcggatcccctcgatcggtcgagccagccgatcgatccccctcatcacccggaccccccctcacgctcccatccacgcgtgcaccacctggtcccgccccgaacacccaactcccgtgcacgtaggcccagctcattccccttgccgccccgctgctcgcgcacgtctcgcctctcttccgcccgcctcgtgacaaaaactactactcatttcggccttactctgctcgaccgctcgttggctgctgttccaaacgcagctgagcgaaccagctcgcgtaggctgttttattaactaattacacaatttacgtgtaaattgctagaggaatcttttaagtctaattacgccatgatctgacaatgtgatgctacagtaaacatttgctaatgacgaattaattaagcttaataaatttgtctcgcagtttacatgcggattatgtaatttattttgttattagtctacgtttaatacttcaaatgtgtatccgtatccgtatacctgatgttagacccgacaatttttttttaccagtggaactaaacacagcctctatcataatatcactatcattatagttactgatacatgaatctcatccttctattatctcacatgttaataactgtaatgatactattattatgtggtaatggatgtgaaccggtccggtctgtgtacgttctgcctcgaaaactagtactatcatctgttgcggcaatacgacaactctgcgagcacgttaattatctgctaactggtactggtcccggccgattcgtatccatgtacggtgctcatcttatcgcatggaccgctacgtttaaattttaaaacgcgatcgatacgaccattttgagacgataaatccactggagtttgacgtatctacgtgcgtatacagatatatctgcatatacacggcatcgcctggaacgcccatggcgtgtacgtgtgcgactgcgtggctttggtacgcctgctgcaaccgtgcattcacgctgatgcaccaaacggctctgcactcactgattctgggtttagccagtcaattcaggtgtgcgtgtctagctagctatgctgatccatcgggaaacaaatgattctgctatattttggcgtgcaattgggcgtgcttgtttaatcatttagcctgtacgaatcacgcgtcgcaatccaatttgcatattgctgcgttcataattaaatcagtttgcattatattgggggttcctttcgtttacttcttcttgcatcctgtttcttaatttaagaaacaatatccctgttcatgaatatatattttacctgcgttgtcgttcaaagcaagcattttttttaagtctatgatactgttactgccctaatttagagttgctttcttgcagagatcatgcatgttgttgctgacgctggcttgtatacagagtctcttttttgagacattctcgtgtaattggacaaggacagcgtgcatgaatttaaattaacaattgtgttgaacatttctgtttctcttgggttggtgggaaaaacgaacaactcctgcccaatcgatcgactgatggtactaatcatatattcatcgacgacgtaatggcccatcctaatggcgcatttaggctttatatttggagatatttgttggtctggttgccgtgtgtacgggacctcaattgattttgcttcgaacaatttatgactctagttatatattattgttgctggtcaaattcgagcttggtaaacaaggatacggacatggaggcattacaaggtactaactgtctaaatcgttgcaatttttatatgtctaatcctatctgcaacacacagtttattatgacgaagttttgcgggttcaaacatgatagcgcgcaacaattaactatgttaggattttgccttttcaatattttgaaattaattaacttgaaaccacgaatttcaagacttcaaaattaaactgcaaattctaagggagattttgaagcaactaatttcaagtagaagattggaaggcctacttagaaaattaattttaaagcagcctgcaagttttgaattttaaatttgtgctaaaattgaacaaagttctgactaaaaatcacaaaattacaactgagtagtcaggatgattttcactaaaaatttgcactttccacacggagaaaaaaaaactcataaaagtgatgtttttgaactttcacatcgatatgatggaaaggataattcaattcatggggatcgaattgttacaaatgaatttcaaaataggcaccactggagcgtcaagttaacagaacgtgctaaatgagtaccagatcagcagtatagtattaccaggatttctttgctgagatctagtacaataatactcccgcggattatgttagagtagggacacgattatgctcggaaaaggcacatgattgagccaacaaatgatctagatgctttaatctaacttatgaatttcttgttagttcacttaattaataacaggaatggtcagaaatgctcaattgattcacatggccaaagacaaacgagaaagacaagaaagggagccatctattacaccctaaacgagctgtttacaaccgttaaacgtactcctcatgcagcttgtcacatgcatatacagtgtataacttatgtggatgtacaacaaaaataatggtggaaaaaacgagaggatcttgagttgagaggccacaagatcagctcatgctcttgcagattgtgaatcctttgttcctggctatatattttgtccctgaaagaaatatgacaagaaactatttgagcaagaactgccattaaatgctaatcaacatctgtgtgaatgtgcatggatgcttgcttgattgtgtttgatggtttcggtgcacttacactggatttcttgcagtagaggatggcgtcatggacggccgtgtcggcaatgccgtggcaccagtcgatgctggacgtggacgcccttgctctcgcgctcgcggggctcgccggcgagaccctcgtcctcggagcacgcagcggcggcagcgccctgaccttccggtagagcggcatgaggaaccgcaggtacctgagcagtatcttccacggcgatgacccgccgccacgcctccccgcggagaacagcggcggcgcgctggcgttcttgctggcgccgctcctcgcgctggacgacgagctcagcgaggccggcgtgctctgcgctgagtggaacagcggcgacgagcccgagagccggggctcgctcagcaagtgcgcgacgcgagcggcatcgccgtcttcttgggcaccgaagcgcccgtcgtcgtcgagctcgtgggaaagtagacggccatcgtggaagatctggctcgcgctgaccagcagcgggatcggagaggcggcatcgtcgtcgccgccgggcaggtcgaagtcgaagtcgaagtcggtgcccggagccgtccaccgcatggagaagaggtcggcggggtccatgtcgatgaagtacctggagcttccgccgacatcgtcgtcgacgaggcgcttgaacgacggcgcctgcgccgcgtgcttgagccaccggtaggagaagctgtcgccgaggtgctgcagcgagccgacctccatgagctcccagcgagtggcgtgcgcgcgcgagacagaagacgagacgaggaggctgtgtggtttggagtgcagtgcagcgtgctgagcaggcaagggactacacggcatggcacggcgcagatatagggggtcgtctcctctccttggccttggaccgttcggtgcaatgtccatgttgcccctgcagtgtct

SEQ ID NO: 11121 - DNA, 22485 bp, Oryza sativa
gttttattctcgctctcttatttgcagaaaaagaggcattttcattgaattttgaaaagcactttctgcacaagagcatctaacaaagacgaaagtgtagaatgattaaggataattccattttgtgctccagcatagtagagagcttttgtacgagaccatcagccaaaaaaaatgtgaggctcataacatgcaaccgtcacatgaacagcaaagatccagatgcaaaggtggaacaacttcgcaaatattggacacaagtggtaaaaataaagagtggcgatagcagcaaatattggacacaagtggtaaaaataaagagtggcgatagcagaccagcggttgtgtggctgtgccctacactggatttaaggttttactacagatcttgattccaacactaaaaacatcaggttaggcagaggaactaggcaccagcatgagccgaccataccttttaatgcaacatcttctggtaatccttttgtggaacattggagtacagtttgcccccactagattatagctttctatgagttgtgatatgcccaccctttactcaaagcactttacttcataattttgggaatacatagggcccagataaatgcatatatacattgaatgatgccaagatgcctttttttaatattgaaacatcatgaacatagtatccccaaatttaagaaattaaacacttaatatagagctgcacagaataaagagcatgcggtttagtaattaagtgggaaatcaaattcttgacattgtaagttaaatggttgaggtattggacagagagagatcatattatacgaaacagaaattctagtcaaattactttccaccaaataaatctctctatagatacctgacaggtgcaaatgaaatcagagcaccctaagaaggggcagggcactggcaggtaacagaaagagcttgatggtttgatgaatttcatagtgaaaccagaggtgtttgacaatggtaatcaaatggtgtcacagtttctccagcttccattttgaaaaaaaaaatagttgaatccagaggtttttgacaatggtaatctaatggtgtcacagtttctccagcttccatttagttttcaaaagataagatttcagatgacatcaagcactaatcaatcagtatgccttgtcaaacggttgttagctggtacaactacacattcctaagggacatgcaagtgcagtttgctttgcacgtttttcttgaaataagcagtgccggtcatattctggcctagtagcttataaagccaagtcaaatgacatttattaactttcgaagacttatggctatgcataacagctactacaacattagtagaaaaaaacaatattaaccaaaccataaaaaccgagagaagactacaagattgttaatactgtctttcctttctataaggtactatgcaaaataatacttggatataatgtttctgcaacatggttatatgggctcagttcaatcgactcgtaagagacacatgcaccaactatcatgcagtgccgccatatggcagagtatttaacatgaaaaatctcttccctaagttattctttcttcaaactatggcatgtgaaacactatcacagcctagtagtcttctagtacaagaaccatgccaaatgaggcataatgtgttgggccagttaggtatgtcaggccattcatatttagatgggccgatccaatttacattgaggggcctaaaataagtagatgattctacaatcctcattaatttggttcaaagatgagagcaacccaacagaagatgctcagcatgcatttcaatgatgcagtaacagattcttcagaaggttctggagattttaacaagggaacgaatgctgctaaatttggggtatgaaaaataattcaaaacatagtccttttaaaatacactaaaaactgatagaaaaactacatttcgattgaaagagaatcaggaaaatgagggaaactgctagatccagagataccacatcactattgatcagaataattttcaggaacaaggagtttagaaaagcacacgacgtgtttaatacactatacagtaccgtgaaagcaaattcacaataaaagccagccacaaaatgatagattccaattaaattttgaagtacaatgactagtgatgatattagaaagtaccaccaatacagttgtcacatcaaccaccaaaacctgttcaaatagggaaattgggacctatgagtgttacagcgttttaggttctttgtggttggcatcagaactaatataagacaattagtcatacaaacccaacaagaattaactattccctaagatgttttttttgcacagtaacagtataggactgaagcaatcccacccgcacaataacaacagtagcccccaaaaaaatgagggcacaaacaatcatcagaaaaaagatcacaataacatcattggatatttggataggggcatatggtagattttcctctgctgatactaatatttcatttggcgctctaacagaggaagatgctagtgtttggatagatgaatgatagtacttactcctgtactacacaaacacaccagaaaagacatcaacaggcagagtaggatggcaaagttctcaggaaggcatcttctttgcattttttttcaaaagaaatatagatgtagaggcggaaataaaagctattaagtatcaaaggatgataattgttgaatcatggcaggttcataagaaaagaagatatgttagaacttataacagaaaggtaaacatatatccctaaacttcggtggagtctaattccaaaatccaaacaattgcacatgtaagattgaagacatgtcacgtatacaaatagataagcaaagcaaagattctgtagaagttgggatctgaaaggaccaaagcagtattatccctcggtatgtctgaactccagaaaataatctggattgaatcaaccaagtttaagaaatttgtgtgattatgtcaaattttagcatgttatttacaagttctcagcagtcaaacaaagatgatctgcagacacttaattgttacagctagcccagattaccaaaagctcttagcgatgaggccatgagggccaaagtaggatgccagggcagccaaaactgtaactgaagtttcttttttcaaaaagaaaaaaaaagtagaaccaagggaaatactactacttcttaattggctttctacaagagcttcccccttgccttaccaagtagaataaagaatagtaaataacactaacattggaaggtagattctatttgccatgatttagccgctatcttcatatcaagaatatgaattatagtaatggcatataacaataaccagtactacaaaagcataaataaactagataaattgcaggcatattcattcaagcatcacaaactggatagagctattaaaagcagtactaatacaaacaaatatcttgagccagatacaacaccacgaccgttttctccattagccaagctcaaataaccgaaaacttaccattaagggagtaaaagtgtaaaactacaatacttacaactgaagtaatgcaatatgtcattacatacaataggtcaacagccacagtttaaagctcctcaaagattatcatctcatgatgttcaatagtctgtcttagcggacacaagttgatatgctctagccagcttcccgtcaccagaatcatttggctgccaagaccaagttgtaccattattcctcagctcagtcctcaacctcaccacaagcattaacaaaaccaacaacaatcccgcaaaaatgaaaccacacagcagtgagcgagtaaattctccgatccccttgctagccacatactccatgcccagagaaactgcaaaatccccatcaataccaccatttgttttgttcatcctcattatctctacagcattaagaataccgctcacttcgtctgatcggctattcttcgagccaccaatggccaatttcagggccccttcatcctcaacatccacaacaaagtcgatgtaatatggataggctaagaatccagtggcaccagagatatcgaaatcctttactgctagctgaccattgacatagatatcaaagtaaagctcatttagagccttgctcacgatgtcacagaagtgcatacgcactaggtacctgctggaagcaggcacgggaaatccccatgtcactttgccctgtgagctcactgacctcgccgagttgtacacgttgtcaggagcaacctcccgtgtcatcaatctgctacccttgggataagcaatccggccaccgaacgaccagaccccgctgttggatgattccgtgctgacgaggaagcgctcgtcgttgacccatgttcgccacagcgtgtcgttgaacggtgtgaccttgcggccggcgacgttgatccgatagagcatctcatagacctgagacgacaatccattggtctggtcagtgccgctgctcgtgacgagggtgccgatgtcgccgacgagctcatcgggggccgagacgagctcgatggcgttgacgaaggcgttagagcccgactcggggacgaaggtgaggacgaggacgtcggagtggacgggtaggatgaactccttcacgacgggggccgacgcggagaagttgtggaggaggaggaatccggcggcgccgacgtggaagcgcgcggacgcgagcgcgggctcgaaggggtagaagtggaggcgcaggacgtggtacccgcggcggcggacggcgaggtcgtaggacgcgcggcaggagaagacccgcgcggcggcgtggagaggggtcggctgcggggccgcgctggaggccgcggacgggagggtaggtgccggggagcggaggcgcgtggaggcgcacccggagtcggggacgaagcgtcggccgtcggggagcacggccggtgccgtcgcgccgcaagcgaggaggtggttgtccgccggggcgaagcgggcggcggaggcggaggcgagcaggcacagcaggagggggacggcgagaacactagccatggcggattggtgtgggggattcggcgaaggggaggaggaagaaatggaggccagctgtggattggcgagcggagttggggaggaatcggtcgatcaatcaattcaccgcgtcgcgtgcgacgagccgaggactcgctggatggtggggcccacgcgtcgtggccgtgccggttggtttaggtattttaatgctctgatcagcgtgggcttttatctttttcgtttgggccgtggatttggttgggcttgcggaggggagagcatctgtacacgttttggcccaagtaccatagccttttgccttgcagtttgggctgtctctttcgccgtggacatatcggttgccacctgaatagggcagtagtgatttctggttgcaacttggaattgtagtcaaaattaaacagtcaaaggataatagataaaaaaaatggtttagattagtcagcagggcagtgtgattacgacggcacggtcagcggtcagcacctgataattaaacgaaaaggaaatagcccaaagaatttggctttacctggttattactcttcctgggcgcatgcatgcgtgccgtccttccagtcaaagcagaagggagacaatcagggggattctgaagaatgcgtgcattgcagctatgcacgtcccagtttggctgagttctaaccacacaattcgtgtatgtcatgatcatcgtagtatgcaaaagcttcggcgagatcgaatttggaaaaaaaaaagttccttttatttttggtttctctaatggccttggcgggacggcggcttttctaggtcagcaatcgtgtgaaccatatattattatgctctaaagccagtagtttaggaatgatcccattaatgaatcttccactaacaagataatcattataatcatcattataatcaaagagttaggcggaacacggtaacgagaatttggcctcatcagggtgacgccagacatgcgtaggagtacaatacaactcaactgtacacaagtctctgtcaaggtcctgcagagaattgttgtttgtactataaaacggccgcccgtggccaattgggaagaaagaacaggcaaaggattttgttctcatctgaacatataaaatgatctgttcatcctgggtcaagtcatttcgtcacgcgctaacatatgaaatgaatccacgatgcagacagcaaggacagaaaaaattgcaacaccaattttgctgcagattacggtattccgttcgtgttcagcaaaatttctgaagacgtatcgttgctgcgacgtgcatgggttttggattcagagaatagatcagcataaaaaaaaagagaggaaaaattatggttacaaacttctctatctgagtctgaccgactgtcggttcactgaccagctgattgatcaacggccatcgccgctgctgagctgcgagaaggccttgctgttggcgatccccgagtcggtcacgctgtcatccatgaggaagctcgtggacgacggcacccagcgcggcacgaccacgtcggcggggaactgcgtggcgacggcgccgctgtcctcgaacgcgtccctgttgacgtgcgtctcctgcagctgaaggcagtactcgaggttccacagcacgtcgcccatggacggccggtccaggccgtagtccgccaggcacttctctgcggtctcggcgaacttgcgcagcgagttgccgttcacctgcccggcgatcctcgggtcggtgatcttggcgagctcccctttctgctgcaggctaaccgcccactcggcgaggttgatctcgtcgcgctcaaggctctggtcgatcaccgtccgcgcgcagagcacctcgaacagcacgacgccgaaggagtagacgtcggaccggtccgtcagctgctgcgtcttgaagtactccgggtcgaggtagccgaagctgcccttcaccgccgtgctcacgtgcgtctccccgaacgacggcccgatccgcgacagcccgaagtcggccaccttggcgatgaacgcgtcgccgaggaggatgttggtcgacttgacgtcgcggtggatgatgttctcggagtagccggtgtgcaggtagtgcaggcccctcgccgcgccgatgcagatctccagccgctgcttccacgacagcggcggctcctccgacccgtagaggtggctcctcagcgtgcccttctccatgtactcgtacaccagtatcatctccgactgctcgttgcagtagccgatgagggagaccaggtggcggtgccggatgcgggacagcacctcgatctccgtctggaactccggcagcccctgcttggaggcgcgcatggcgcgcttcaccgccacgcgggtgccgtcgcggagcacgccgctatacacgttcccgaacccgccgacgccgatgaggttgcgctcgttgaagttctccgtggccgccgtgatgtccgccagcgagatgttgagctgcatgctcatcctgtgcagcccgccggtcatgcccgcgcccgacgcgttcgacatgtcaacccagctggagccatcctgcgtgtgctgcgaccacggcagctgcgtgctctccttctcctccggcgccggagtcggcgcctgtctacgcctgcgcagcacggcgagcaagcagagcagcgcgcacgcaagaacagcgacgccgagcgccgccgagagcgtgccgatgagaatcttcttcctcctgccgtgcgatccggcggagttcaaattatcggcgcgccgcagcttcatgatctccagcccattgagcatgccgcctgcatcgcttttgtccgacttgccgatgctgatggtgaggttcccggtggtcggggccgtggccgcgtagtccaggtaaaaagcctcgttgggctgctccgccgcgtccgccgcgtttcggtcgaggtctttggaagcaagcctctgcgcgacgtagacgtcgaagacgatgcccgttgctacaacggagctcaccagcgagtagtcgcaccagtggaggcggacgaggtagtcggagtcggaccccggtgccggcggcggaagcgcgaaggtccacgttaagttgaaaggccccggagtgaggaacaactgctggctcgccatgttcatggcgcgctgcgtcttgtacacgctgtccggcgccacctccctcgtgtacccgatcgacgtgccgtagatgatcggggtcgaggtcgagttcacctgcgagagccccctggggctggagaagtaggggtcgtcggggagccacgtccgccacagcgtgtcgttcgccgcggtcaccttggatcccccgacgttgaggcggtacaccgtctccagcgcctgctgcggccacgcgttcacgtcgacgctgtcgaccagggcgcccaccggcttcaccgggcgtctccacagcagctccggcggagccgggaacagctcgatggcgctgacgaatgcggtggagccggcgtccggcgtgaacttgacgcggaactcgccggagccgtcccccgggacgaagtactccttgacgacgccgtcgcgcggcggcgagaaggaggagagtagggtgtaggcatcgcgaacagagacggagaagctcgcggacgagaggttcacagaggaggaactggtgaaagggaagaaatggaggcggaggacgcgggacacgttgaccgtggcggtgtccgggtcggcgaagctgtacgagaaccccgagccggccgcgcgcgcggcagcgtagagaggggggatcgtgttggagccggtgctcgtcactgccgggacacggccggcggacgagaggaagggagcgtccgggacgaaggtgcgcgctggggagtcgcctgggaaggagacgttggaggcggcgccgcaggcgaggaagtaggggaaggcggcgagggcggtggacgggagtaacgggaggaggaggaggatgacgatgacggtggccattgaggcggtagtggaggcgtggtcgtggcgccactgccgcgtccacgagagaatgagacggaagcggacgagtgtgcggacggtgcgggtggtggtgttggaagggagagggaaggacgagtgcgatgcggtggagtggtgtgtggagtcgggcacggggaagtggactcggaggaagatgggacaacgaccggagggcagcgcgtggtggaatactggaatagtggaatggacaatggagtggacgctgattgggtcatcacattttcctatgcccccccgcccactgactaccgatttgttcggctcaaaacaaagcatgctgcagattgcaaatttctgctctgttcttctacttgtatggtaggtatgccatcttctcgattttgtttgtgtctctcttttttcataggttgccacttcccagaacctgattgatagctttgctatccctttgctgtagctctataattttccaatttgcatacattattatcttcgcaacatgatttgtgttcactccgtgtgctcataaaccgcactctgccgccggtgcagccgacgaccagatcgccaccgtcggaccacgcgagtagtagaccgatgtttgtgtcgctatcgtttagctttttccctaataaaccgaaacggtttactaaggaataaaaataaaattgtagataaaatttttatatatgcgttattggtgaattaaaagtcaatgctgaaaaagaaactatgttataaatatcttaaaattaaatttaaaaatatgaaatttagttttttctttaactgattagtgcatccgatgggagccgtgagctcttctgccccgctcatttaacgctgtgagtcgtatatgccgcttctctagcaggctgaaaggaactattgggcttgcgcttctatcacttcggcccaagtaggattttgtcaggacatctcgggccgactcggaaaaagaacccaacagaggttgcacccctttcggttagtgtaataagttcactttaggttcctcaatttgtcatcgagtgtgaaattcctccctaaaccgaaagagatctgtaatatatctggtatttcggttcccattatatcccattgtaactcgatgaatttcatactctgcgacaaagtgaacttattcatcagttagttgatacatggcccatgagctttctttttttttttgaaaattgcccatgggctatttgaacactcgtagcctctggtcttcacctgtttgccagattatttgaacacctcgacagtcgacgggctcacaaacaaacaagcctgtcgccgttcgcagcagcactgcccgtacttgtacaacgcccacaagtgcgccacattctcgccggcacagtgttgtatcaaggtgagttcggttacttacatacacctattatctaaggttacagctatcattagccgaagcaagcagtaaccgagcgatccgccgtgcaccgccgcgaggtgggcgcgtcctgctccgataccgtccttgatgcttgatggttttcgccttctgctctcgttttgctgtcctagcaactgatcctagctagcttccctgcgcgaaccaaacgcaacgcgcgcgagctggtgatcagatcaataatgccatatcggaaaattgttaatggaggtggcctacctggctacctcaattctggcgaactcgccgcccctgcagacgccaacatcgatggtcatcttccggtccttcccttgcctgggtgacgacaacaccctgcagcaattcctcctcggagactgcacgcacgccggtttgagagcaccattacaaaaatcaagcttctttgttgtacaaatcaattcaggttttaactacggtgtgtgtttgattacccttttccagaggttggggtcgggcttcttgaggacgatgacgcggtcgagcagcgcggcagggtcagggatgcgccagccgcacttgacgggcgcgacgcggcggcgctcgtactcggtgacggtggtgttgcggcggcggtcgaggcgggactgccgcatgtagtacacctgcggcgtctggcacggctggcgcgccacgggccgcgtgttgaaggcgtacgccgtgtagtcggcgcggcggtaccagttgaggaacgtgcgcatgggcatcttcatcttccgcggggacagcaccccgggcgtcaccaccaccgcgaacccccacgacaccgacaccgttcactgcttgtcgccgtcgtagcacaccgactgctgcgccacgccagccgagtccagccgcgcgggccccttgaacagccgcctcagcgccgccgtccgcgacctcgtcgtcgggaacaccggctgcaggaagtccaggtggtgcagcgtcaccaggggcaccaccgggtgcgcgcccaggaggcccagcacgtcgccccacaggtcgcactggtggaaacccaggtggcgcgtcagcggcacgcccagctccgccacgcacgcgtggatgcggtcgtcgctgccgtagagcgccgggtaccggtcgatgcacccgtcctgcatgtgcgccagctgcgcggccagggcgcggctgatggcgaacccgccgccgccgaacgccatgccgtacgagaagatgaggttctggatgtggctctccgacggattcccgatgtagtacggctgcgtgtggtcgtaccgggacagaacgtccacgaggttgtccgggaagaacaccgtgtcgtcgtcgcccatcacgaaccaccgcgcgccggggaggcccagccggaagctctccgacacgatgcgggtgatccgcagcgccgaccggctgccgcggccgtgcgtgtacgggaacttggtcgtgttcccgctgatcttgattccgggaagccccgtggaagcgttcctcgagtagaactcgtacaccggcttgtccagccacacgaacccgctcatctgctccggccgccaccatgttctgatgtactccctccggctcttccagagctccgaagaggcggcaatgccgaacacaatgtgacccagcccggtcggcgcggcgtcatcagacggcggcgacgagtcgttacgcctgttgccagcatcgccggcggccgcgagatgtgcaacgtcgccactggcaaggctctcctccgggcacgagctacccgagtagaacggcgacacggcgagggcaacgacgtacagggcgagcaccgggaggagaaagtagaggaggaggctgcagaggaagaaggaagccttgcacttgggcgccttgccggcggcgtgcatgacaatggcgtccttgtgatgatgccgatcgccgcctcctcctttcatgccaaataaggcctggaaaaggagatgacgacgacagtggtggccaagatcgatgagcggccaaaagagcacagatcactaatggccacatggtcaaaaatagcgtagtagtggagtgcaccgtgttcgtctgttcgttcgttccagtctacgtgtttgagggcgagtcgctctgtggagcatatagggaacagaaattgtaggccccagttgcaacctggactgattaccccataaatagcatggtcagtggtcaatgatcaagtcgcgtttgtaggatcactggtttctcctctgggcctgacggccatgggctccagcacccagcccaatagcccatgcgttctcgaatgtttttcatttttatttttttaatatttacagaaatattatacagacgaaaatatttacataaatagaccacgcaaccctccttgagaacggtagggtgacgtgtgtgagcagacgccggagaccgctgagcgggtatgtgaattttgcgtgcggcgaaaattgcatttcacccggcaagggacctcaacgcaaaatgcgcacacgacgccgtgtgccacatcaccttgccgctctccacttgtgcggcaggatatatttttgtaaacatttttgccagtataatatttctataaatattaaaacaaaaaatttaaaaatgaaaaaagttcatgcgttctccgcatcctgttttttattttttttccgaaaaaaaaatcgcgcacacagacacgcagctagctgttagcaagagcaaaatcactatagtacgcggccaaaccatatactccctccgttttttaatagatgacgccgttgactttttctcacatgtttgaccattcgttttattcaaaaattttatgcaaatgtataagatataaatcacacttaaaggactatgagtgataaaacaactcataacaaaataaattataattatgtaaattttttaaataagacgaatagttaaacatgtgagaaaaagtcaacggtgtcatctattaaaaaacggaggtagtatccaactctcctagctgagaatctcgcacatttggtgatggacacctcttcttcttagtgatgacagaaatttgctgatgatatgaaagtgacctcccacctgaccaaatcttcgaagttttacacaaatcgttaattatgatctcaactaacgtttcaagtcttgtaattagtatgcttaatgattgccttttgccgtgttatagcaagcaacactcgaatattattgagttgcacggcgatggcggtgcaagcgatttaagcccatattcaccgataagccaaaacggtttattagaaaataaaaattaatttatatgtaaaacttttatatatttgtttatagcaatttaaaaactaatgctaaaagggaattacgttaaaaaaaatcttgaaatcaacttcaaatacaagttcgaaaatttaattaaattttaccttttgcttttacttattagaccaactgatggcgctctaaatttttacgccgtcggattgctgcttaactaatttcccgtgcagttctttttattaaaagaaaaatcacgtatgctagtaccgtttacaaggatatcgacaactaatatgcttttctgcattatatatccacaattgatgcatggactggatttttcccactatttaaagaaatatgttcgaatatctttattttttaaggactcatttgaaactcttgaaaaagtatataaaatacctgattttaatatgaacgcaattgagaaatagaaaattgtctatttccaattaatcatcatataacgttttatagattgttatgaccatgttaaatctatttcctaagtctattcgtcatatgcgtatgagagtaaatagatattagtgcatgcatccatacacataactatgtatgactaacatgcaatgtcttgtgattttattattggttaagagcagagatggtgcatgtatcgagtttgttaccggagtaaatgtagtgtgcgagagttattgacttttcttagtcttagcatattcatgtaatatgataatcaattggaaacaaagagaacatatataagacaaggaaaatacatgaatgattgatcgttcgaatattacatgggagaacacgtgaattgaattagagaaataaacttagggaaaatttttcaagaggttaaaactcttgctaactttccttaaaatttttggattgtctatttcgttcgaatttcaagtgaaagtatagtgtctaacatttttgttttaaaaaaaactcattaggatttttctatagaaataaaatccataattttttatatttttcttacgaatcagagggggtgtaatttgttttgctgaatccaaattagataatttgggtcatgtggctagcatgcttacgggacatatctgtctctcagtttatggtctagcttacttgtgaatcgaaaattgtaaacctaaataaacagatagccccttttttttgtttttttaaacacaagtcattcttacaccgttaaatcattagttaggttggagtagtttgtggcttatttgaagcggacctgtcgcagcactgttgctgttgccgcatacaaatagcgtgcagtcccagttccagcgcagtcacggcggcctaagttgaaccatcaatcaaattccagatttccagtacaaataaaagctgtctccactacacaacacacgaccacacaacccccggcaaccgatgccgggccggtaggctaaaataaactgcccgcttccgaaccacacgaaagcgccatcgacgacgatctactgggctactcccctgctggtgtacgatcgatcgcgagagatatatacgaactgtacctataggtcggtaaaatcaaggaccaccaccaacaaaaacgcttaattcggttgcccaaccaatgcacgccgcagcgccggccgcgcgcgaggatccctacctagtcgccaccgccgcggccgctgccgctgcgacatccaaatcgtctgctagtacagtacacggaatgcatatatatgcgtacgtgcgatgaactgagtagttcgccgcatggatcatccggccaagtcgcggagcaggtggaagccggcgcttaggctccggtaccgctcttgcgcgtgcgaggcggcgtcgccgtccatggccacgccgaactgtccgccgacgacgtggtggccgtgccccggatgcatggcgtcaggcgccatctgctcgcccgggtacaagaacccggcgccgccgtgcgcggaccccggcgccccgaacgcgatgttcacgccgccaccgccgtgggagccgtgctgctgcagcccgagcgtcagcgacacgccgccgaacccgccgtgctgctgctggtggtggctgtcgtcgtacgcgtcgaagtcgaggtggtccatgatgccgaagttctccgcctggtgcagccgggccacgccgcccgcgccggccgcgacgtcgacgttgacgacggaggccagcgacccggcgtcgtggcgaagctgcgccctcgtcggcttctgttcgccgccgtcgccatcgccgacgaccagctgctggccgccgcgcgcctcggaggcgtggctgcaggtaggcttagggtttaggctcccctgtccaccgctgccgtcgccgccgtcctgcctatctcctcgacgtacatctctccaccattggcttcacagccgaaccctcgcattgatgaaccagttggacacctgcatggatcgaattgcagaagaaacgcgcgcgggcaacaacaacacatgtcggtgtaacgggaggtcgatggctaaacaagattcgtttccaaaaaacatttgcaagcacaagaggacatggtaggaccttgacatggcaaccgatcgatgaattgatgtatcatctacgagacggcgatcgaatcagtgggcgcaatatttagtactattcccaaaaatgaacaaactagctactcaaattaaacttgtatgattatttagaaattttatgatatttgaggaggtaacgactacgtacctcctcatatctaaggtattaatatttgatccaagtaacaaattttatactagaaactcccggtgaggaccatatataaaaacactcttaattatttcatggtagggtattagtggatgatttggttcaggctatactactccctcagtccctaaatatttgacgccgttgacgtttttgaacatgtttaaccgttcatcttattcaaaaaatttaagtaattattaattcttttttaatcatttaattcattgttaaatatacttttatgtatacatataattttatatattttataaaagttttggaataagacgaacggtcaaacatgattaaaaaaatcaacggcgtcaaatatttagaaacgggggaaatagtatatatgcatcaatacacgaagaacatgttacctggctacgtgagaggcccgtctgtcgagccaggatgtgcttatccacgtcgcttggatacctgaatgggattgaacatatgaacaccgatgcatatatgaatctgatcgaattgaatcaaaaaaattcaacaactcacgcaaatataatgagatctaaatcgattactggtcatcagtagtataatattccgacaaacaatccatccatgcatctattattaaaacaaggtgaaaatgaattctccaggcctactaattactatcatgctaatcagataaattcacataaccttgatgagtctgtttattcatattttagaacttattgaccgtgtgtttattaattggtagagggccaagatgtgaatcgtgtccattattaaaaaaatgttaatcagaaaataatcatgctaacctgagaaaaatagacgtgcttgaatcattgatcgatatggttcaagcttataataacgtagatatattgtttggatgtatatatattagcacattgcaacaactaatgcacgtgataaatagttgttaatacaaaacctgagagttcataggaaattcgattgcacaaaatatactactttctccgtttcataatataattcattctaacatttttcatatttatattgatgtcaataacttacattgtgaaacggagggagtataatctagctaaataataaatttggaaaaacaaacttaaaaaaaatcaaacatattaccactgacacagacgcaactttaatcatagctagctacttataatgttttgggagtaagtacgtacctacgttgtgcacaaaccacagtcacgagagtacttaaccgttatttttgtcgaaaaaaaaaaggagagcattatattagaccatatgcatggcaaaagaatagtgaggcacacacatgacattacgtgtacgcttaattaagcaggggcgcaatatggcaaaacggccacttgagcatttgatgccaagacaaatgtggtccgggagaacaatgctcgctgcagaataaatttatatatatatatatatatatatatatatatatatatatatatatatatatatataccgcgaaaaagctaattacgaacaaccgtccatagcaaattgtgtgtcacgcgcgataatattactgcaccggccctactaggctattacacctagtcactgacattcttacgttctgtacgtgattgcactaaccaaaagtcaccttaattctactaactagtgactgccacgtgaacagttgaacttagattgctatacattgtagcacactgtgtagtgttcttttctcttgaaaaagaagattaagttttttacgtaaagcgaggtggtattaacgtatgattgattaagttttaattattataaacttgaaaaatagattaatatgatattttagagcaacttttatataaaaatttttcatataaaacacagcatttagcagtttgaaaagcatgccacgaaaatattaatcttcatccaagttttgtcggagaaaagaacgggatctaattaagtatcagtcagctgcattactttaagtgtaatcgatcaagcaagaaatgcattgtgtggagatcgatcaagcatggatggatatgcaaagtagctagatgattgatgcatgcgtgtatatatgtatacgtaatacgtgtatgtacgtataaacaacaatgtaaagtggagtacttacgggtgcaggaagtgctcgaagagccaggcacggaggatggtgacggcgcggtcgggaaggccgcgctgggggcgccacgggtggctgtccatggcggcgacgccctgcagcgacttgtggtgcctgatgcactggtcgatcaccctgagccgcggcgtctgcccccgcgtcgtcccggccgcgctcacgtacttcttcccgagcgcctttctcgccgcctgcagctgcgccacgatcccatccctcaggctccggaagtgcctcgatatcgtcctcgccgccaccgccgtgtacgcccccggcgccctttccccggccaccgcctcgaaccccccgggcaccgccctcatctgctcgcagtacctcctgtacctcctgtccacctgcacaaatacacacgttcatcgatcaatttaattagctcaaattaagaaaccctttacttgatttttcactgtagccatctatctgcacgtctagctaggagtacacgtacagggcactgcaccaagcgtacgtgtatggacgtggtaaagatggagatagccaatgaaacagtgaaacggtaacaactgccagtgcccagtaccgtatcaagctatggctacaaggccacaactctgcaaacgtcgcagcacgcacagtagcaaaaaccggcatgagctagctagccgaggcattgaatgtgcatggcaagggggaaagtatgggcaaaggggtagaggccggtgtcgctgctagcaagcagaagccatggctgaccggccggctaggtacgtaggggaccatatacctaaggctaaagagaggcaagggggaatagaggtttccaaaagctaatggtgaggcccaagaatggggtcgcttccctgccctagtctcaggtgcacccttcgggcaaccatgattgatggaactcctagtactttcctgtgccatttttactactagctcctttccaaagctgcagattccatttgttagattaagagagtggattatattagctccatcgatcgatcgatcgctcatacctcttcgagcatgatgtagagcttgtccttgagcctctgcagctccagggcttccatggcctggatctgcggcgacggggtccacgaggccgacgacgacgacgacccgtcgccgcggccgtcttcttgctgcgtcgctgccttggcgccgttgccgcgcttggtgctgtccacggggaggctgcagaattcttggaggagctgctgcgtcgggaggaggaacctcgagctgcgcaggtgccacgcgccgtgcacttgcggcgccgacgacgacgcgtcgtggtgcgtcatccatggcgccgcgggcgccagttggtgctgcggccgcgccgcgccgccgaggtgcagcacgccgtccgggcggcacagcgacagcgacagcggcgcctggctcggctgttggtgctgctcgctgaggaagcgcatggtggagccgccgccgccgtcgtccccagcgtcggccaccagcgcggcgaccttgcctgccgcgccgggcatcatactcatacccagaccgcgcacgccgagaagctccatcccggcctgcaacccgaacagctccggcgccgcttcgtccatcgccggcatcagcgtcgtgaccgacgacgccgatgcatctgccgccgagaagtaatccgcgaaccccaggttcggatcatgcgccatatcggtgtttcaattcctccgatcgccaaaagcctagcaaaagcaaacacaaacacaaacaatcactaattaccaagctaaacacaataagttataagcagcaatgaaattgagagcgcaggagagctcactttaatttgtgtaaaatagatggtgacagaagcgaaaattcagccagtaatcgagtaactagcgagctagctagctagtagcaccagtgatccatcgatgtagccagatgtgtgatgaagtgacaagacggtgggaaatacaacacgcacacaattaagtcgtcggagagtgaacacgacgatactattactatggtgatgcgtgttgcaagtcgtagcaatcggccgggcaggagaagagagcaggtaggccgaatccttcctcagctaagcctcagaaacacaggaatcttgctttgtcctgggagggcagggaaaagaaggaaaacaagatgaaaagccatggcgatttggacgcacgggtcttaaagaaaccaaccaaaccaaagatctcgtcaggaaagcaagcaagcaggaaacggaaaaaaggtgggatatggcgcaaaaagcatacacatacatgggatcaatggggagggagggagggagagagcgcgagcaggtcgatcgatggcgaggtctgagccgggcggggtggggggtgggtggtggttgccgcgtcaagctttcgcctcgcgccctgtacatgcgcgcgcaggagcagctgcgcgctacttcttaccagcaacttctccttctgccgctgccgctgcaactgctacatcccatccaaatatctgcaggagactagttccagtgcgtcttctcgagctgtagtctgtacatgcggcgtctgcagggcttattgcgtctactcacactctgtgctactcctatcttctaaggtgagggttaaaacccattccttcccgcacaaaaaaagaaacaatcaattaacaattaatgtgattaattaagtattagcttaaaataggttaatatggttttataaaatgttttcttttatgtttttttttaaaaaacacacactaacagtttaagaaatatgtatgcagaaaatagaaatcggtgaatctttgaccataaagaggtggcaacgagtttcctcctatcaaaaatcaaagaagaggctagcctttgggctttagcagaggctaagcggttgcgcgagttaatcccacactatgtatagtgtataactacagttcctcgattttttcttgttgcccctaggggttgtattttctcctgctctattcaatgaaaaggcactctagtgctatttttcgttcaaaaaaaattgtacgcagaaaatgtgagagtagaagatagggccttgtttggatccggagggctaatccctccgaaatcttgttatttaggaatattaaacgtaaattactgacaaaacacatttcataacccctaggctgatttgcgagatgaatctaacgagcctaattaatctatgattcactacagtgatgctacagtaatcattcgctaatcatgaattaatatacctcgttagattcgtcttgcgaattagcccataagttatgaaatgagttttgtcagtaatctacgtttaatatttctaaatagtaaaattttgaagggctaattattagtcctccggatccaaacaaggtctaggaaagagaagaaaacatcacaccttaagtctaactaatcattgccttctctctatagctgtagcttttcttcgtgtcactgcagcgagagcagctagagctagcctgttttacctgatggactgactaatggaagaagcaccatgatcatttcgcgtaggtttgtagaggtcaatatatgtagcacagttgggggtgcaatagtgacaagtgtgcctgtcatcgtctgcttatcagtcacagctagaaattgaattttgaaaaactagagttattggaggtattttcatcatagtttatttcgcaacatcacatatattttattttcacgaatatgtaaaaattttgcacctcattgtattaaaaaaatagtgcttgaatgcaatttaatgtgccggtcaccattgcctggattgcatggctatgtcctttgagtttgtaatcactcgttttttctttcttatgtgattgaattccagtgcaattttactgttcatcatgtacgtgaaggtggcttatggtacgtatatagagatgacaaaaagcatg

SEQ ID NO: 11122 - DNA, 11176 bp, Oryza sativa
tactacagctctcccaacgtcgactcgcgccccacggacatagtggagtacgacgagtttagctctcgctacaacgaaccggatctcgacgacttcgacgaaagcctagatgacaactacacccctctctacttcggcgtcttcatggccgataacgagacggaggagcaacgccaagcccgggagaccgaagcacgtcgcgaggctgagcgtctccgactggaggaggagcgtcaagcacaagaacaagaacggttacggcgtgagcagcaggagcgtgagcggaccgcgaaggaggctgaagatcgacgacagcgagctttggaagcagggcgccgagcgcgtgatctcatcggccaacaagatgttgaagggacaccggttttccgcacccctcagcagaatgcggttgccgcgatcaccctcctcgacaccctcctcaaggaaaacgagctcaatcaatctgatcacgtcgtcaacatcttgaaccagacgaagaccatgattgcggcttcggtcccagttaactccgaaagcgtccacacgccgactggcagccgagttccccacttccgatctcatgactaccgtcatccaagcctcagcatcaccggcgcaggatccaatcgcaggagcaggggtcacgacgggcggttcactcacctcccgaccatcatggggagcgccgagtggaacggcctcgctcaccacctcgtcgccgccccgtcgatcttcgcgacacgatcatacagcgccgagcagctcgaggccatcatcattcgccggaccgccatgacgatgaccttgacggagtagcagccttcaccgacgatctgcgtcgagtggattggccagccggcttcaagccgactggaatagagaagtacgacggtaccactaacccagaatcgtggcttaccgtctacggtctcgcaatccgcgcagcaggaggagacagcaaggccatggcgaactatctaccagtggctttagcggattccgcccgatcttggctccatggattgccccgtggtacaatcggatcttgggccgaattacgcgaccacttcatcgccaacttccaaggcaccttcgagcgtcccggcacacaatacgacctctacaacgttattcagaagtccggagaatcccttagagattacatccggcgattttctgaacaacgtaataagatctccgacatcaccgacgacgttatcatcgccgctttcaccaaagggattcgccacgaagaattggtcggcaagttcgggcgtaaacctcccaggacagtcaagcttatgtttgaaaaagccaacgagtacgccaaagctgaagacgccgtcaccgcatcaaagcagtcgggtcctagttggaagccaaataagggtacgccagctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactacacggaagaactccgacgaagaacaaagcacgtcgaggaagaaggacgacggcgacgccccggcaggatttcaagaccaccgcaaggagctcaaccatatcttcggcggccccttggcttatgagtctaaacggaagcaaaagttgactgaacgggagatcaatgctgttcaacccgacacgccccagtatcttcgatggtcagaaatcgcaatcaagtttgaccgctcggatcatcctgaccgagtggtccacccggggcggtaccccctggtactagacccagtggtccgtaatgtcaagcttcgcagaaccctcatcgacggtggcagtgcgctcaatatcctcttcgccaagaccttggatgacatgcagatccctcgctccgagctaaaaccaagcaatgcgccttttcacggagtaattctaggattatccgcaactccactcggccagatcaccctcccggtcacctttggcactcgggaaaacttccgcacagagaatatcagctttgaagtcgccgattttgagacagcatatcatgccatactcggacgcccggcgttagccaagttcatggccgtcccgcactacacttacatgatgatgaagatgcccggtccccgaggagtcctatccctacggagcgacatcaagcaagccgtcacatgcgacaaggagagttgcgacatggcccaaacccgcgagatgacgtctgtccgagaggatatccgactggctgcagccacggcgagcgaaggagaagtgcccgccaccaagacttcaaaaagtggagaaagcgaagccaagactaagaagattcccctagatccttctgattctactaaaactgctgtaataggcgccgagttagattgtaaataggaaagcgcgctcatcacctttcttcagaacaataaagatatctttgcatggaaaccatctgatatgcccggtattcctagagaggtgattgagcactccttacatgtcaaagaagatgccaagcctatcaaacaacgactccgccgattcgcacaagacaggaaagacgcgatcaaggaggaattaaccaagctgttagcagcaggcttcatcaaagaagtccttcatcccgactggctggcaaacccggttctagttcggaagaaaacagggcaatggcgcatgtgtgttgattatactgacctcaacaaatcctgccctaaagatccttttgggttgcctcgcattgaccaggtagtcgactcgaccgccggctgtgagcttctcagttttttggattgctactcggggtatcatcagatccgactaaaggaatccgactgcttgaagacttcatttatcacgccctttggagcatactgctatgtcaccatgccgtttggactaaaaaacgcaggagcaacttatcaacgtatgattcagagatgcttctcaacacagatcggtcgcaacgttgaggcctatgtggatgatgtagtcgttaagaccaagcaaaaggatgatttgattttggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttattgctatcctcaacatgaaaccgccaagtacccagaaagatgttcagaagctgactggatgcatggcggcgctcagccgatttatttcaaggctcggcgagcgggggatgcccttctttaagctactaaagaaaacagacgacttccagtggggacccgaagcacagaaggccttcgaagatttcaagaagctcctcaccgagccaccagtcttagcctcaccacacccgcaggagccgttgttgctgtatgtatcagccacctcccaggttgtgagcacagtcttggtcgtcgagcgcgaggaagaaggccatctccagaaagtccagcgaccgatttactttgtcagcgaggtcctagccgactccaaaacgaggtaccctcaggttcagaagctgttatatggtattctaattactaccaggacgctatctcactactttcaaggtcactcggtaacggtggtcacatcatttccactcggtgatatactgcacaaccgtgaagcaaacggacggattgctaagtgggctttggagttgatgtctttggacatatcattcaagccccgaatttcgatcaagtcccaagcgttagctgattttgtcgccgaatggaccgagtgccaggaggatacccccgcggagaagatggagcactggaccatgcattttgacgggtcaaaacgactttcgggcactggagcaggagtagttctaatttccccaactggagaaagattaagctatgtgctttggatacatttttcgacgtcccacaacgtcgccgagtatgaggcgctccttcatggactacggattgcaatctccctagggataaagcgtctaatagttcgaggcgattcacagctggtcgtcaaccaggttatgaaagagtggtcctgccttgacgacaacatgatggcatatcgacaagaagtacgcaaattggaagataagttcgatggactcgagctcagtcacgttcttcgacacaacaatgaagctgccgatagactcgccaactttggatccaagcgtgaggcggcaccctccgatgttttcgtcgaacacctttatacgccgacagtacctcacaaagatgctactcaagttgcgggcactcatgacgtagctatggttgaagccgactggcgagagcccctcatacgatttttgacttctcaagaactcccccaagacaaagatgaggccgagcggatttcaaggcggagcaaactttatgttatgcatgaagctgagttgtacaagaaaagcccttcagggattctgcaacgctgcgtatctttagaggaagggagacaattgctgaaagacatacattctgggatatgcggaaaccatgctgctgcacgcaccattgtcggcaaggcttaccggcagggtttcttttggcctactgcagtatccgatgccgacaaaattatacgcacgtgcgaaggttgccagtttttcgccagacaaattcatctaccagctcaagagttgcagaccatcccactgtcttggccgtttgcggtttgggggcttgacatggttggcccgtttaaaaaggcagtcggcggttacacgcatctctttgtggccattgacaaattctccaagtggattgaagctaaaccggttatcacaatcacagcagataacgctcgagacttcttcatcaacattgtgcatagatttggagtgcccaatcggatcatcactgataatggcagacaattcactggcagagtttttaaagacttttgtgaagactttggaattaagatttgctatgcctcagtagcgcatcccatgagcaatggacaggtggagcgagccaatggcatgatacttcaagggattaaggcgcgtgtttttgaccggctaaaaccctatgccggcaaatgggtgaaacagctgccatcagtactttggtctttgcgaactacacccagtcgggccacaggccagtcaccttttttccttgtctatggggcagaagcaatgttgccgagtgaagttgaatttgagtctttgcgctttcgaaatttccgtgaagaacgctacgaagaggaccgagtggatgacttgcaccgattggaagaagtccgcgaagcggctttgattcagtcggctcgatacttacaagggttgcggcgttatcataaccgcaatgttcgatcccgtgccttcctagtcggcgacctggttttgaggaaaattcaaactacacgagatcggcacaagttatctcctctatgggaagggccatttatcatctctgaagtcacccgaccaggttcctatcgactcaagcgcgaagacggtactctcgtcgataactcttggaacattgaacatcttcgtcgtttctatgcttaggcttatcattgtacttccctatcttgactgtcaacattaagttttcttcttgaagttgtcagtcgggggctatcattataataatggagtttgattacttatcaattcaatttgcttacttggtctatcattgccttgtttgttttttctacttagtctgcgaggactgaaagtttttaatagcttctttgggttttaggctcaacaaagcttgataaaagcttttaagaaatcaaagacttggctagaattatcaaacacagcataaatacaccagtattgtacaagttgagcctccatttgttacattcatactcagtcagaatcagttctttcatcatcagagttattgttgctcggctgaaggtcgttgttgcggaattgctctacaacgtcacttgcaatcttgtcagccgcattttgagcattggtgatgagatcaagagcagcttcttcgcttgtcccgtctgcaaagccatcaatggcgtcaatttcaattctcgggtacaatgatttggtcatcgccaatgccatgctagctcccatacttccagctttcttgatgttcttgaaatatacatccggagcaactctcagcttgtcgaaaatttcggttgcgtcgagtgcactcggaccactgttattgaggaacatagcttggacgagtggtgtagcgacattggcgacttcatctcttgctccttcaagcctcttgatcttaccaaccaggacatcaaattgagcttgagatttgattttgcagtctgcaaaacacatttatgataagaatctgctgtatttaaaagagagaagtccagattgttagctggtagtaccttcaacctccttcaaggctgagtccctttgcgcagccagttctactttgtcttttttcaaggcttcaatttgtttctccatttgagccatcctggtggcttgcgctgtttgaaatccaaatgtttgaggatacagttatgacagtacaaattaatgggacagatctagaagattaccttttgatgaaccactcagctcgaagtttgaatcctggagctgggcaattcggtcccttaattccttctctgtctttttggcgtgctccttggcctcgtgtagctggtccctaactgcttccagagttcccaaatgaggaaccagcttttctaaagttgcagtcttggcctcattgcgaagatggattctctgcatgatggttcatggtttagttctgctaaaaagaaaacaaagtcatcaaaggcagtcgcctgaaagatttacattcacaatacgagtggcttccccaagcgccttcttcagctggcacacttcctcatcttctttttgacggtttatgacgatgccggcaacctgtgagttctcgtcccaccatttgagcaagataggaggacgagaatcatcagccgcctttatgcggggaatttcttcttcgccatcgcccggtggtcctgatgtatttccaagacattaggcaaacaaactggagttatttaaatcggtatcacttgagaagatgagttacctgaggatgttcctagctgagcgtgaggtgacccttgttctttatttggagacccaatcattgagtctttactagtctctggtccttgggaagttgtcgtctgcgctccaacttcagggatttcttgatcgggacctgcatccgactggtttccagtcgggggctcttgggttgttgcagtttcagctgctgtcgactggtttccagtcggcggctggtcactcggatcggccttatcacccgaagcatgggcaccagtcggctggctttcggcagttggctcaggatccttggataaatttggctctgtcacggcttgatcaggatcttttccagttggatctatgtcggatggtttcctgcaaagtgttctttcaatatttagtataatttctatgagagaagcatgtcaaagggaaatggtaccgagaggtttatacctggaagatgttctaatctttggcatttgacggccagccagttttttcctgggcatggtacgcttcgagagtttattaggcgagcccttgtccccagatttgttgtcgtcgtcgccttcatcgttgtcaagcaccagttttctcttgcgagaacctgtctgtccagttggattggaggtttgaggttgcgaatctggtctgattattggccctccacctccctgaacggtgtgctggcgaggagaccggcgctgagtgattgggggatcagattttatcaatacatattcctgaataagatgcctccatggttagttaactcaacatgaagacaagatactattttggtcataggttgaagatttcagatacatacctgcggaggtggattgaatgcattatatggcacaactggcagctgatgtgagtagctgacgacaatagcatttgagaagattttatacattctctccttcatgattttaaaatccagagagtctggttcttcgcgattaggatcatgcttgccgtcaaactcaaaagctgtacgggatctttctttaactggcgccagtcggcatttgatgaagtgccgagtgatctgctctccttgtaagccttgttctttgagttttagcatgcggtccatcaactctaaggcttgggctgcttcgtccccaatcggaagagagttccaagtatcttggtacactggaggaagacaagagtactcgggaagagcaggctcaggattctgaacataaaaccagttcgcatgccaccctttgtttgaagtcttgaagggcattgagaagtacttctggctcaaagttcccctcagctgaaatccggctcctccgactacacatggcttgctcttgtttggttggggtttgagaaagaagattcggcgaaacagagcgaagtggggtttaattcccaagaaggcttcacaaacatggatgaaattggcgatgtggactatggaatttgggtttaggtgatgcaagctgattccatagaagcttaatatcccgtggaaaaatttcgaggtcggaagagcgaagccgccataaaagaaatgagagaagaccacaacctcgtgtgtatcgggggacggaaaagcctcaccgcacgctggccgccacccgatgatctccttggcagggagaacgccgtgcgccactatctccttcaggttctcctccgtcacgtcggatggcgcccattggccctcaaagctttctttctcttccgccattgattttacccgaatgcgctgatttgattcgggggatggctagggagaggtgagggattgaggcggtgaattacgggaaggattttgatgaacttttcgaaggtggatttgagtggattggtgaaccctagtttgcctgcgcagctccgtactgtagcagggagtggggaaaatggcgagagttccggcggggaagactaagtggcgcttggatcacgggattttttgttaagggtatcggaggtgcgaatgggcttaggcctgaacagtacctcagcccaatacttttaacagcgtggcccattgtgctccttagggacttaggcattttttgctttggcaacttatgcgcacaatagtgttgtccaatgctgataaaattcttttttacgcggtcatataattcttcggaattattgcaatgcgaattttcaggtgtggcctgtcacgttcttttagggactcaggcacttttcgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctctttgccacgtaagtgtgcgtttttattgaccaatattatggcttaggctgattatatattgtagtcattttttttaggcggttggtaaatcctttatgagtttatttactcggattttacaccacatatgcctgttttcattatggtggatagtcatagcttaggctattagacttattcattaccataatttttataatatttggtgggtaatctttagagttttttattcggatgcctgtcaagtgtgttcattcgtgaaccttttagagtgttaaccattcggattctttttattatggctaaaaagcagtcggctagaatgcctctttatgcgccgcatatgcttttgtcatatgatgcatgattgtgctattattttgttctcaactatatgtttagtttgttaactaatcacatagttgggggctacacctaattaggtgcatctattcgatgcaccatattccttattttttcgccctttacagtcttcgtcttcgctactcggcaggccttggcatgaaaagtttgaagcactcggattattatctttgagaaggctatgatggttgactgcaaaggtctcgggggctactgtggagattatggatatcccatatctacacggcgatgatatttggactggatataggataccgaatatatatagaatatcttatttgtatctcgggttcgtttcttaacttgtacatcaaggaaacaccttgagacttagtcggttacgactgtattttacctgtatctgcatattccgttagggatatagattatcttttgtaacacggactccttcccatatataaggggggtccgggtgcctctaggggcagagatgttgattttctccaaatcatacaatcaataatacactcggcggattcatccccggacaggagtagggtattacttcttgaataagaaggcctgaacctgtataaatcctttgtttccaaacccatacacttttccagcttgatagccacccacttttattattgccgaaatctagtttcgacagttggcgcgccaggtagggggagcgtcaagcttttcgccgatcagtgcaatgggttccgtctccggcatcgacgacctcgtcttcccacccgggcagacgtttcggttcggcagcctcgacttcgtcaccaacaacttcggcaagatctctctccttgactcggtgtcggcccagtcgggagagaaccggctttcagtcccgtttggactcccaaacgcggctgaaagttacttcaagaccatctcaatcgagttggcttcaaaccactcgggcgagatcgcatcttctccaacgacaccagatcaagatgatggggcttacccaccgatcctaatgaagctccccgacgattcggcggccgcctccatcacgacagcgtcttcatcccgtaggcctaggcggaagtcggcttcaacaccgatttcgcctagcttcagggaagtcggcgtcatcctccaaccactcggcacggtttcgacggatcagttggacggctactacagctctcccaccgtcgactcgcgccccaccgacatcgtggagtacgacgag

SEQ ID NO: 11123 - DNA, 12049 bp, Oryza sativa
tttcgaaactgatggagtatattagtgtagtgtaagcctctcctgttgatttgctataaaaaaaatcacaacatttaacttttacatatacgtttgatcattcgtcttaatagctgacaaaatccaatacatggcatcactatcccttttttggggctatgtgtcttttgtttgcttaattagaagttgtttgcaacacttgcttgtgtatggaaattttgatcaagctatgtatggatgtaaagtacgtaagagtataatttgcgcataaaactttttagaagaccaagccttatccattttaagttttcgcccgtacatgcatcttctctcgtcctatttggagtaaaggagtaaggaaattaagttgatgacaatgtttatgaactgtacataaatctttcttaaactttgtagaatataaccattctaaaactactaagaaacttttaaggtgagtttgatgtggctgtctggctaggatttttggtgacacgtcaaaaaggaatttttgtatagaaaatttttacacgatataatgtttaacacttggtgaaatgtacttgcaaagaacgagaaatatgtcgtttagagttatcctttggtaaagaaaaaacactaaaaagcgtatgtgctccaattgtccacaccccacaaaatattccagatgtaggacctggcgccaactgggaaaagggtggtccacatttccaactaattacaattaaaacaagcaaaaaaaaagaacggtgggaccatgcctatttgtgggtccatcaacatctcgtccacctttgctagctttgctttcttatttgtctctcttctatactaccaacggccctgccggatactagctactccttggttccacattccattgcaagtaaacatggttacaatagcgcaagagacaatgttaattaggagaattttctctctttttttgagaactggagattggttatatttaacttactacaaatctacaatgctcagcctgatctagccgtatatttttcgatgatattgagaaaattgcatggtctcaatcttggatgttgtactcattagaaaagaaatggacgaaaccgtacgttcggccggtttctctattagtatatgattgtatcattcctctctcatactgtatgtcacgcagaaaactctgcactcacgtgagctacctgcagtataggttaaggattcacgtcatgctgcagtgtgctgcacaatatatagccatataggctactgtactggtactccatattccctccgtcccgaaaagaaaacctagaagagaatgtgactccggacatcctctcttaggttgatatatgtggatatgagtatgtccacatacattgtcctaagaggggatgtttgattctttttggacaaagggagtactccctatgtctataaaaaacaatctagcactagatttgacacatcataatactacgaatctgaatatgcgtacgactattcaaattcgttgtttcacattaagtcctatgtttgtttcatgtgggacggagggagcatgcactaatgcactatagccaatcaggaaattttctgtgccaaatagtaaagccatacagttctgatatctgggctttgaatggtgctgtgtttgcttcatatcccgtgttactttgaagcataaagccactacttaattgtatccattctcttcagatgagccgtgtgcagtacatactagtcctatgcctaactgtcaaaacagtgcatgcatgcatgcgcaaactagtagacctacaatactcacttcctaggcctctcgtgcaagtagctaggtaagcgatctcaaatactgtacatgtattttgacattaggaaaagcaatactgtagtcgtcgtcggccgggtacgggcacgttgtaaccgaacacgaccggttatctctgaattctgctgttttgcgcagcctacagtgtgcagtagtcgagactacacatacaagtgtcatcttcgcagaggacaagagggacaagatttgttccatagccgatgtacgtatcagtatcactgtccagtgtcgctagcttgctttcatcatcatctatatatactgcatctctttcaaaatgttactacctactatagaatattagacatatcttaatatgacgtgttaatacacctaaatttaacacttcagatgaaaaatagaaaaacatagtcattcaaaaaaaaatagagaaacatgatcagatttgaaaaaaaaaaccctaatttaccatatgtggccagtctgatcgctctcatatagccggtcggaccgatggtgtgggcccagtctgattactctaagtttgatttgttggttcttgggttttcttatttgggcttaaggattcttgagtcctaactgattgttgggacaaaactcaacaagtgcatgtgtattcctctgtatttaatgtgcttaactgtgagcaatgtttacatatttatacaagggtatacaagaagaaatttctttattgcccttggtcctatagtgaatctagagtggctggccccggccagcccttgggctattagtaaaattcccggtgataggagtgaggcgccccataagggagcggcacctattcccgagggtgcgcactattaaccggataaaggcctgctccgggtaatagcgtgcgccgtctggtcatcgtcaatggtgtcaggggtagttagggcgcgtagtgcgcattcattctaacccactagcgcctggtcctcaaactagccttgattccctccgggccacgctgctagctccagaaaccttgccggcatgcgaagccctcgcgaggctccggaagccacagatgctccggagttcttgaccatctccggagccccatgggcagcctccgaagcctcgttgggctctggagctcgaggtggctttcgaagccgtgacagctctccgggatccttggttgtctccggagcgggggctccgttcggagctccaaggtagtattcaccctaggtcatctccctggggagaatggctcctcgaagccctgcaagcccttcgaaggctagccatttcatccggagccattcccccaacactgatctataagcctaataggacgtgaagaaaaactgtggaggcataaccaacccctttctaagagctatgaccagttcaattttaacccccgacctcaatccctacataatcaattgaattttttttacctttactttttagctatgccttctatttttccctagtttagtccatctttatcaattacttcgtaaatcattcgttttcgctgtgagagtgtgatacatctttattggtttgtcccgtaaactttccgattcgcccacgagaccggcggttatcttcaaatcgatataaatcagcctagatgctggtttgatctctaaacaagctccgcttatcggtttaatcttcaaaacccatcttgatgtagaagatggttggtgactctgttaacaccgcaaatatttaggtgaattatgtattggcagaaaaaaaaacaccaacacgactaattaagcgtggctagattcgttgcactatgtagaaaaaaatataacggaggaagctagtgattactgaacttgcaaagcaaggtgctagtactatcagggtattggacgaaagttcagcggtcgagcaggtaggtagcacaagcagaatttttcaagcagcgtatacatgaatcgtcgtcgtggctgcagtaatcagcgaccgggctacgcatgacgagtcggccgcgctccaacaagatgggaacgtacgtagagcgaatagcaggagaccacaattccaaggagtattcttcgtcaatcagggcgggacccggccgtgacgccaaacgtgaagagacgacgcaggcgctaatgcaactgggtgaggaatccgcgacttttattacctagcgcgtattggcctgacctctcgcggcagtctcgcctcaaatttatgcacgattgcgcggttaaaagtgctactcccatgatcccatcctggcctcctagatgccggcatgcaccagctggtgcgacacctgtcctgccacgatgtatttctatgccaagctaacacgcacgccgagtatatatatagattgattaatcgattttatctgcacttgcatagtactccctccgtccaaaaaaaaaagtcaaatcttaggtttccgtgccaacgtttgactgtccgtcttatatgaaatatttttataattagtgttttcattgttgttagatgataaaacatgtttaatactttatgcgtcacttatttttataattttttcaaataaaacggacggtcaaatgttggacatggaaaccagggtttgtcttttttgggacggagggagtactatactctctccgtaaaaaaaatcaacctaaaaccatgtccagatatatcgttataggagaagtcacatcaatcaacctataaccgtgtctagatgcattgttataggagaagacacatctctttctatgttgatttttttaaaacggatatagtatatccttaacaaaacagagttggtgatactatacgagaatgagacaggggacaatatatccatgtccatcaggtcatgtacactagtacgtgaccatgcgttcgatcggaaccagcctcacgttacaaaagctctcacagggtacgtacataggagtagtacgtacaagagcgatgtgagatgtccgtgtcggcaccgacatcgatatgaagaacacacagcgctaacagtgaatcgatccatcaccgtacagcgttattccaggcaagatcgcaacgcaattgctgttctcccgtgcagaattaagaggagccacatagttcaacgaccgtggggcacgcacgcacgcacaaacttattaacattgtctcgatctctgccggtgcgcacgcatatgcaaccatcgatctctaacactgtcgaaacaagatttcggcaatagtaaaaggggtggctatcaagctaggaaagcggatgggtttggagacgaagaattttatacaggttcaggccttcttattcaagaagtaataccctactcctatccggggattattctgccgagtgtgttattgattgtataaactggaaaaaagaatcgtgccccgagaggcacacggaccctccttatataggggaaggaatccgctttacaaagtacagtccatatcctaacggaatatgggattatagataaaatacaatcgtaaccgactaggatcccggatatttccttgacatataagtttagaatctaacccaagtcctcatagagatattctatctatatttggtactatatattcgactaaattataactgtcatgtagatatggggtatccataatctccacagtagcccccgagaccttcgcagttgacaataatagccttctcgaaacaaaaaacagtaatccgagtgcttcaattcaacttgctccagcttgccgagtgctaaaatcaaagactgcgaagggcgaaaataaaacatggtgcatcgagtagatgcacctaattaggtgtagcccccgactatgtgtttagttgaaaaactaaacatataataaagaaccgagtggttttatagcgaagcacgcatggtacttagtaagatacccagccgactgcttctcaacttgaatatatcaaggacaaaaaatacaagaaggaccgagtgataaacactcaaaaggtccaaaaatagacatatttgataggaatccgagtaagaaactcttaaaatgatccaccaaacatgataaaaaaatcatggtaattaatgagtctaatagcctaggctgtgacccttaccataaccaaaataagcatataacatgctaaaagaatgactattaataaaccagtcatctcaaatcaacccaaacagcttttgcagcctaatgaagcttacaaaaacggtataacacctttctgtcgggcaccttttgtttgcatcgtgttaattctaaagaattatcaaaccacattaaaaaagattttaacaacattgggccacatcattgtgagcacaaattgccaaagcaaaaagtccctaagtccctaaggatcacaacgggacacgttggaaataaaattgggctgaagtactgtgcaggcccaggcctgttagcactcccgataccctaatatcaccgaagtgaaaaacgtctcttcgtcttccccgccgagactctcgccattttccccatttcctgctacagtacaaactgcgccggccaaactagggttcatcaaaccactgggtctagtaccagaggataccgccctgggtggaccactcggttgggatgatccgagcggtcgaacttaattgctatctctgaccaccgaaggtattggggcgtgttgggctgaaccgcattgatctcccgttctgttagcttctgctttctcttagattcataagccaggggtccgtcgaagatgtgattgagttctttgcgatgatcttaaaaaccagtcggggcatcgtcttcatcatctttcttctttgatgtgccttgatctccgtctgagggcttacgcgcgttcttgacatattgctccgcaaactgtttgtagacgaagcaatctttggccacgtggttggagttgggatgatgcggacattgggagttcattatcttgtcgaaggtgttgacgcgggaacgttgtcgggaagacggagaggttgtcgccacaagttcttcgggcttacgcttgcgatccttgtggttgttacttccactccctcctgtggtcggcgtatccttctttggcttccaagtggtgcccgactgcttggacgccgtgatagcatcttcggctttggcatactcattggctttttcaaacatctgcttgaccgtcttgggaggtttgcatccaaacttgccgactaggtcctcgtggcgaatgcctttagtaaaggcggcaatgatgacgtcgtccgtgatgtcggagatcttgttgcattgctcagagaagcgtcgaatgtaatcttgatgagactctctagacttctgaatgatgttgtagagatcgaagtgtgtaccaggccgttcaaaagtgccttggaagttggcgatgaagtggtcgcgtagctctgcccatgatccgatcgtgccgcgtggtagcccgtggagccatgaccgggcggaatccgttagggccataggtagataattcgccatggctttgttgtctcctcctgctgcgcggattgcgagaccatagacggtgagccaagactcggggttggtggtgccgtcatatttctcgattccagttggcttaaagccggctggccaatccactcgacgcagatcgcttgtgaaggcagcaactccgtccacatcgtcgtcgtagcgatccggtgaatgatggcctcttgctgcacggcgctggttgatggtgtcgcgaagatcgatggggcgccttcgatgtggggagtgtggtcgttcaactcgacgctccctatatcgttcgggaggcgaacaaacagaccggtcatcatgtcccttgctcctgtgactagatccggcgccggcaatgctgaggcttggctggtgatagtcttgagatcgaagattagggactcggctaccagtcggggtgcgggtgcttgcaagagttggctggaaccgaggcagcgatcatggtcttcgtctggttcaagatgttgacaacatgatcagcttggttgagtgcgtcttccttggggagggtgtcgaggagagtgattgctgcaaccgcgttctgctgggggggtgcgaaagaccgttgttccatcgacgtcttgttgcccaatgagctctctcgctcgccgcccagattccaaggcgcgttgccgtcgatcttcagcctcctttgcaatccgttcgcgatcttgttgctcacgctgtagtcgttctcgctcctattgctgtcgctcttcctccagtcggcgacgttcagcttcttgccgttcgcgatcttggttcgcttctcgggctcgacgctattcctccgtttcgttgtcagccatgaatacgccgaagaagaggggcgtgtagttgtcctcatagccgtcatcgaagttgtcggggtcgccgtggtcgtagtggtagccgaagtcgtcgtagtcgaggatctcggttggtcgagaactgacgccgggggagttgaggtagccatccaattcttcaacaacattgggccacatcattgtgagcacaaattgccaaagcaaaaagtgcctaagtctctaaggatcacaacgggccacgtcggaaataaaattaggctgaagtactgtgcaggcccaggcctgttagcactcccgataccctaatatcaccgaagtgaaaaacgtctcttcgtcttccccaccgaaactctcgccattttccccatttcctgctacagtacaaactgcgccggccaaactagggtttatcaatccgctccaatccatcctcaaaaagttcacggaatttctccccgcgtccaccgctccgattccccatccctttccagccgtatctcggaccaaatcaaaccatccagtccacattcatggcggaaaaaagagaaagcttcgagagtcagtgggcgccctctgatgtgacggaagataatctgaaggagatgttggcgcacggcgttcttctagcaaaggagatcatcgggtggcgaccggcattcggcgaagcattcccgacccctgatacgcatgaaatcgtggtatttgctcatttcttctatggcggtttctcccttccaacctcaagattttttcggggaattttgaatttctacggaatcagcctgcatcatctgaatccaaactccatagtgcatattgccaattttattcacgtctgcgaagcttttctgggcattaggcctcattttgccttgttccgccgtatcttcttccttaagcctcagccaaacaagagcaaaccatgtgttgtcggaggggctggtttccaactcaggggaaccttaagccaaaaatacttctctatgcccttcaaaacctcaaacaaaggctggcatgtgaattggttttattgtcaaaaccctgagcctgctctccccgaatactcctgtcttcctccagtttatcaggatacttggaactcattgccaacgggagatgaagctgcgcaagcagtggaactgatggagaggatgataaagctaaaagaacaaggccttcaaggagaacagatcacccggcactttatcaagtgtcggttagccccaatcaaagagaggtcccgcacagcttttgagtttgacggcaaacatgatccaaatcgtgaagatccagactctcttaactttaaggttatgaaagaaaggatatataagatcttctcaaatgctattgttgccagctattcacacttgttgccagtcttaccgttcaatgcattcaatcctcctccaccggtatgtattcaaacgtccaaccttcctcaaaaacatgatttcatctctcgttaaattgcttgacatttatgctcagaaattcgcattgatgaagtcaaatcctccaatttcccagcaccaatcacctcgccgccaatctggtcagggaagcggaggaccaagaattcggtctgaaactcaactaagtgcttctgatccaatcggccagccagattctcgcaagaggaagctggttctaagtgacgacgaaggcgacactgctagaaagctcagagaccgagaggcaaccaagaaactgctgaagcaggttactccaaggaaaaaaaacatccagtcgtcctgtgccaaagatcaggaagtcttctaggtacaactcatataacgatctcccttgcattgatgcacacccagtgaggaaataatactgataatcaaacttgcaggaaaccatctgatatagatccttctggaaaagattctgagccgaccagcagggaaacgaacttaaaaggaaccgagccaactgccgaggatcagctgagtgacaaccagccagcaaccgataatgtagagtctggtgatcaacccccgaccggaaatgagtcggccgaagctggagccggaattaatcaggagcccccgactgaaaaccagtcggacaccaagccaagccaagagattccagaagttggagctcaagcagatagtcctcgcggtcaagatgccagccacgaccgaaggtctggatctccttcaaaggcatctgagtccactcgtcctcatccagaaattatcacgggtaagcactttgtctgaaaccacgttgatctaactgactttatttgattgtttgatcgttatccatggatacattaggaccaatgattggtgatgaagaagagatcctccggatacaagcagctgaggattcgcgccctcccattctggtcaagtggtgggatgacaacatgcagcctcaaggattcgtaataaataagcaaaaagaagatgaagaggtatgcttgctaaaaaaggcactcagccaagccacccgcattgtaaatgtaggctctttgacgcctgatctcaaccgtctcgtttccatttagtccaggtgctaattaaactgtcttgcagaggattcatcttaggaacgaagctaaaccggcaaccttagagaggttagtccctcatctcgggaccctcgaagccaccaggaatcatctgcacgaaacaaaagagcttgccaagaagaatgaacatgatctgagggatcggattgctgagctccagaaatccaattttgaactgagcggctcatcaaaaggtacacacaaactctgcccaactaacttatgttattatctttgtaatcttgattaactagagtcaatgtagtgcaaactgccaagatatctcaactggagaagcagattcaaactctggaaaatggtaaggcagaactggcaagacagagggactcagctttaaaggaggttgaaggtaccaataatcaataccttaaaagccattatcttctatatgctgattcgttaatgtgaatctgttgatgcagaccgcaagatcaagtcccaggcacagtttgatgtcttagttgacaagatcaataggcttgaaggggccagggataaagtcgctaatgccgctactccactcatccaagccatgttcttcaataacgccggtccgagtacacttgatgctgccgaaatatttgacaagctgagagtcactccggatacttacttcaagaatatcaaagaagctggaagtatgggagcaagtctggcgttggcgatgaccaaatccctttatccaagagtggacattgatgccattgatggctttgcagacgggacgagcgaagaagttgctcttgacctcatcaatgatgcgcaaaaagcagctgacaagattgctgccgacgtggttgagagatttcaagatgtcgaccttcggccgactgggtctgataattctgatgatgaaaaaactgatattgattgatataacaatgattttgatgattaatgatgatggaggctcaatttgtacaatactgatgaatttatgctatgcttggagttccatacttagcttctgatttcttaaaagcctttgtcaagccttattgagcctaaaacccgcaaaagctattaaaaaccttcagtcctcattgactaagccgaaagaccaaacagggcaatgataaatcaagtaagcaaattgaattgataaaaatcatactccattattatcatagtagccccccgactgaaaacttcaaggaaaaacttgaagttagcagtcggagaggaaagatacaaacgaaatgcctaagcataaaatcgacgaaggtgttcaatattccaagaattgttgatgagagtatcatcttcgcgcttgagtcgataagaacctggccgagtgacttcagcaattatgaacggtccttcccataagggagataatttatgccgatcctgtgtggtttgaattttcctcagaaccaggtcgccgactaaaaa

SEQ ID NO: 11124 - DNA, 752 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaaatgtaatcccattcaccagcttctacatttaattaacaagagaactattgtatttatctaacacctggattatctccacctttcatttgatccctatttatagattacgctgcgttgctaacgggccgcacctcctat

SEQ ID NO: 11125 - DNA, 29408 bp, Oryza sativa
atatcctaagaagcaatttaagctagctagcttcgagagattgatattcaacaatggcgtcagctccgaccgcctcttctgcagtgctcgtcatcgtggtccttgtggcgaccctcgccgccggcggcgccaacgcggcgaccttcaccatcaccaaccggtgctcgttcacagtgtggccagcggcacgcagctgagcctgagccagacgtggaccatcagccgccggccgattctgacgtcacggcgctcaccgactccgactgcctggcgctcgccgactttgaccgcccggcacgctcgcttctccgtcacccgccgcgctctgactccgactctgctcgcttgctccgccgcccacccgcgccgttcgtgcccaggaaggagagagagaggggaaaggaagaagagagagaagggagagggaagaagagaggggtgaggctgacatgtggggcccacgtgggcaccaccattttaaaattatttttttgcgtgcatctaatacgtgggggccacgctttttattattttccgagttataattgccacataagcgccacggcaataccacgtgggacggagacatagtcaaacaaaccacgtaggcgccacgtcagccaaaaccgccttcaaaaccgccgagggatctcgtttgcctggttttcgtaagttgggggacgggtcgtatccggttttacggttaagggacaaaaatcggactgggcgacaaatagagggacccaaagtgaacttattcctcttggcactgctcctctgcttcaatctttcggcctttttctagcgagtaaattgcatccactctacaacaacttaagcagatgggcgtaaaaaaacttgaaaattgaacgtctatgtgcaataccttgttaagtggatgcgtttgagtacaaaaacttgataatttagtatttttgtgcataagcttggctaatcatgtggtaggtcaggtttttttttttcacgatgtcaatatttcatcccaaagcaattctatatatcaccttataaaattgaatttagtcttcaagaattacagtgcacatccaatttacatcaccagttaggatttttttcttcaccttctcaaatctcaaccgaaatataatattttctatgtagtaaagtttaatttattgaagttattagaatgaaaatttgaatatgcttatacaaatccgtactagtatattatcaaaataagtactccattcgttccataatataagggattttgagtttttgtttgcactgtttaaccacttgtcttattcaaaaatttttggaattattatttatatttttacttactttattattatccacagtactttaagcacaacttttcgttttttatatttgcacaaattttttgaataagacgagtggtcaaacaatgcaagcaaaaatttaaaatcccttatattatattataggacggatgaagtacttaaaagttaaaatacaattattttatactttcaatacaattattttatactttcacaacctcaacgcggtgattactcaaaaatgtacttcctctgacccataaaaaaccaagtcatgtggatgaatctagagtagttattttgcaacaaatgagatgagccaaaaataaatttattatgggaaggagggaataggtaagaaatattgaagaaataaaactcatcgatttacggtaagggtacgtactaggatataaatgatcttatttagtacaaaagtagcctaaatataaacttattaatttttagtagagaggtagtattacatttttataaaacactgagtaacatagctacacactcaattcactataggaatttggcatccatatagcatatgtagggcttgtttggtacatgcgtacagctccaacttacctagtgtcaaaagaccaaccaaatatcgtaacggaaatatttatcgtctgtaatttttcgtttaacacaaagtctggggcaccagttcgtacaagatccgacaattagtccaccatgtctacactcatcacagcattgcagcgtcaccgtcttaattgtgcctacaaaaaacgtacagcccgaccacattacgtacactgctaccagtagcattctcacacttgttgctctgcttatatatgggtgtgtttagttcacgctaaaattggaagtttgattgaaattggaacgatgtgtcggaaaagttgaaagtttgtgtatgtagaaaagttttgatgtgatgaaaaggttaggagtttaaagaaaaagttgggaactggtttagttcgcgaaaagaaaatttttggatgtcacattggatgtttgatcggatgtcggaagggttttcggacacaaatgaaaaaactaatttcataactcgcctggaaaccgcgagacaaatcttttgagtctaattaatccgccattagcacatgtggttactgtagcacttatggctaatcatggactaattagactcaaaatattcgtctcgcgatttcctccctaactgtgcaattagttttttcatttatctatatttaatgcttcatgcatatgtccaaagattcgatgtgatgtttttgggaaaaatttttgggaactaaacaggcctaaactaggcctatgtagagaacatgagctgaccaagaggacgcatgcatgattagagaaaagactttaggaagttgctcgcagctttctgccgctatatattcacatttttcaactgttcatgaccagcaataataacagaatcacaatctcccgcaatatccttgtgtttggatggtgccctgaaaagctccagcaccaaatccctgcgttcaatgtaccacgcattcaatcagattaggtgcctctcgcatcgtatatatttgtcgaattcggtgtatatatacaaataatgtggaactgctgatgttttgcttattcgttcatattttataatctaatagattatatatatttatactactatcttaactattatagtacaatacgatattagtaaaattcataaattaattgttaagatcacttttacttataatattgatattataatactatcgatgaggagtccttatgtttttgtcctttcctcgggctgaatattttaaggctattttaatttgttatccaaatcaacagtactacaaatttgataatgccaaattctattaggtaagaaatggaagctaatgttttaaactttatcaaattttggtagcattggtactaaaatgtaatatttaaaattattcctataacaaaaacatatagaagtttcaattgatcagtgaagactcatggcataaaaaaatcaatgtgaaattagtttatcgggggaagtacttatttctagaggtagctaggaagaaagtactggaagtacacaaaagcagaaaaaaggctatatttagggcctgtttagttggcaaaatgttatatcggatatacgaacatatatttaaagtattaaatgtaatctaataataaaataaattacatattccgtcaggaaactacgatacaaatttattaagcctaattaatccatcattagtaaatatttattgtagcaccacattatcatttgtcaaatcatggcgcaattaggtttaaaagatccgtctcacaatttcaggacgaactgtgtaattggtctctcgcaatttcgtgacaaaatgtgtaattggttattttatctatatttaatattctatacgtgtgtccaaatatttaatgtgatagcgtgaaaaattttattcaggggactaaataggcccttattggccatcccgaccgaagaaccacgtgtgtgcacgccgcgtttcaccgacaagcagcggagtcaaatacgtatcagatcaaccgatccatccatcctcggtgtggattgcatctgcaatgtcactagttgagtagtagtaggagtaagaaattcggtgatctgcaggtttttggcgtgttctcccacatgtattccgtggggaccactgtcaccagccacgtcgcggcaggaggcatcctatggtcctaaggtgacaatggagaatcaagaatggactcgtctctgctccatccttaatcacagtgagctagaggggtctctttggtagagctccaacatataaattttctaaattcagctcacctctcgaattcatcttacgagaacgctccacttagctccattctcattttaggtggagctgaaattgtttggctgagattcagttccaggagaggtggagctgaagttggagttgtgccaaatagaccttagcttcaattaatagacatacataattcataatttagtgtaaatatattgaagtctagaaatccccttcccaaaatgaattaactgttactctagattcgtttttgaatacaagtagagtttctacaaaagagtttcagagtggattcttaaaatactagccagattcatataaaaaaatgaattttggaacagcgagagtacgatccaaccttcgagattatctttctataattgcaagaaaaatattcatcgttttagaaatgtggttgcagttgtgaggtggcatttacactacaacagaactcctcatcaatgatgaatagtactacctccgtcccaaaataattatatttctaggattgaaaattcatcccaaaataattgtaattctagagtactaattaccccatcaatcatttctcatttaaatttctccctattttaccctcagccatctttccactctcacataaacaccatttaatgaggggcaccatagtatttcttttcaaaccttaatatatgctaaacaatatagaattacaattattttgggacggaggtagtaatattcttgatgggtataagcctccttagtgattattggtcagtgataaaaaaaaactcatgtatgacatgtgaacacctgtcacagatctatgatgttatctgtgacggttcataacatatgggtcgtaatgatgaaccgggttgcaatcacgactttttaatttaaaagacaccaagaagtattttaaattttactaggagtattcaactatagtcacgcatcgcacgccgcaaattcaagattctttatgcaaaatatgcatgaatgcgctaaatggggttcaaatccaagaactcccagtcccactgcatattgaccatttttaccatctcatctatacaccacatattgttaatgtttggatgttatattgattgtttctgtctgaaatgtgaaatattaacttgattctctatacaacgttgaatgagatttcattgaacttcataattttaatatagggtatatctacatccgaggtcatttgaaaattttgaagtttttttttcaaaatagatctcatcattatatgtaaattatcttaaatgtaaatattatcaactagaacattaagtacatcttgtctagatctacgactttgatatatgacacatgaggttgtttgaaattttcatctttgaaaaataagatcccatcaatttataacacatattcaagcatacaaataaactcaaataaaaatactgtcaattataaagttattttttcggacctatacagtgaaggtttaaaatgttgatatagatatctcaactcatggactattgacatatttgactttagagatgcttcacctttttaaggtcatatatacccaatttcagtgtcgcgtttccctttctaaaaggaagaaaagaacgaccacctaacattcgagcaacacccctctctgaagttattgaatcactcggcacaatcattcagcaaaacagaatgattgctgtttgatcccaaatttgttggcaccctgttatataatttggccttttttatgtctttatgaaatctgcagtgcatcacgggttcgattgaagcctcccaacagccgtacgtacgtacgtacatgcatcaagtaaacacgttaacaattaagaaaagaaagaaaacaattctaaatttgtcggacaattagatgtgcctgccgaaattttgacaaactaaccctttaagaaaacttattttgagattgatccatactaaaacataattgcaaaaataagccgtcggctaagcgtcatcgagtttggcgctaagatccaaaatgagctagcaacgaaggttggcgccaaaatctttggtgctgaccccatgtaccggttaataatggaagcaacaattagcaatctgtgatgcaagtgtagcctagtggtgactggtgagagatgagctcttgcatccccctactatgcttttttttctttattttttcattggtgcaagttctctttctgctttcttgaattagcgtcgcatttattttttacaaaaaacaaacaactgagaataatcaatcttatacatgcgacagaataaaaaagaagagagaaaaaagtatagaaaatggcttatacatgcgaccaatgggaatcgaacacaagacctgcagcaagcaactaaaccattataccactaccagttgaagaggcaaaaatcacgttgttaaaagctagtatggggtcagcgccaaagagtttgggttgacccctgacacgagaactcatctaggatctcagcgccaacgataacagcgttgaaccgttatatgttgcgccaaatttgatggcgctgagccgatgatttatttttgcaattagtttttttgcaaggttcaatcttaaaataagttttccacaagggtcaatttgtaaaaacttcataattgaggcatgcctcagcctcacattattgtataggtatatgctgtaattgacatttaactgccctaagacaattaaatcagtactcaattttatcgatcgtcgctacatttgtaacggtacatgcgaactcctttttataaagaatacaaagtatagaatatttgatcgagcggtgcatatcggaagacactataatcatgatggtgaagtcatcatgacttcacttagcaagtttacatattacataatagtgtaaaaattgatctaatacccatttagattattgagtgcattattgtcccagattatctctcattttatgaaataaacttaataaatagcttacaataagtcgtctaagcaatgcagtcaggactaatccccattatttattgtattcacctgaacaccgataaatttttctgtgaaacatactatttatcaatatataatattttatatcctagtggctcctgagtaaaggatttaagttacatgtcttgagttcaactcctagaactgcatccctatcatttttatccttttattttcaatagtttagtaacaatatcttcattttaagtttttagccaaacacatctccaactttcaatattctttttctttttttagctcttctatcttttatcttgaatagcttagtgtaataatatcttgtaagttgtaacagattttacttaggttttgtgtggaatgtgtcgacgggggatacccgcagaccggatatagaaggtattggggtccgttggtacgaggatctacgtagtacgacatcaagcaaacagaagacaagaattatactggttcaggccccttggtaggtaatagccttaatccagttagtatgggattatatgatagaaaccacagattacaaagggaatagcagaattcgatgataccgacgagaccgtagtcgagttggtccgactagatctcccggcgacttggttcctgtgcgctccggctccgtaggttgtggtgggtgtgttggcagtaatattcgatgtcctaggtcctacccagggggtcccttatatatcgcgggtcagttgatctccaagtagaactcggagatatcggacccctcacgatatggtataggcccagtctcgtccgagtaggattccttccatccgtagattctgtttctattacgtgataaatttccttaacgtatacggaaactatccgtatacgcgcgagtataccgtattagtacccagcgtacatccaaggatagagggtataccttatcagtaaccctgacagcatgcatttttttttacttttttcaattcttccacgctttatttcaatagcttagtgtgatagcatatcttctaatgcacgtggcgcccttcctttttccgtgcggaaattgagagtgagagcgactctcgacttatggagagcaagaaaggaggagaaggagattccaattttcgaaaacttatatagggaagctgttagagcaagtctttcacaaaataaatcttaattttagaattggatctcatttagagatactattggtcatgctaaaagtactagagtatagaaattctcaattttataaacactttaaaaatcgtcactagaaaagtacccctacttaatgtttttactaagtgaaagaggtgctcggtttgaagtctcaaatatatttttttatagtttattgtgttgttctaaaattcaaattaataaattccaagttgtaatcagttttgagtctaattatttttacttcaataatatacaaaaaataaattaataattagcaccttgtaaaatgatgagaactcatatactctctccgtcccataatataagggataatgggtggatgtaacatattttagtataataaatttggacagacgatatgtaattatgggacagagggagtaattaacaaagataaggtcgttgtactctggcgcggaattcctaaccaaataaatttgaatttagaaatatcaagcacaaattgccagtcggcttgtagtaacagttttagttttatcaatatttaacatttccaatgttaaaaattgataaaatatgaggttgtatctatatatcttaacgtctcaagattcaaaattagtaaaattgccctcctaattaaagagggtgtttatttgagtgagtactttgccaaacactgtcaaaccttttaaaacttttaaaactgttgtttgtttcgctgtcacaagtgtatatatcatgccacatttttgcagcggactccacacgtgatactctctatttttcttgtcaccttgacttaatatgtggtcaacatattcttgcgcgtcttttaatgatcgccacaccttagctaacacacattttggcaagttggtgtgacttcttttttgacaagaaaagactgtgtggtatttatttgatatgaacatacaagtaggaatgaaaacgactcaaaaaagacgggaaccatatctatcattttcgtttacatttttttattaaaaaatatgaatagaaaacctcgaatatcaaaacagaatagaatattattgaatgtgaaaacaatgatgaatatttattggaaaccgagtttccaatttctttctaaaacaatagataaaaatttaaaattttagcagctaatagtaccactttccactttgtatcataaggataatatcacggttcataaacactttgtcaagttcaaattttcatctttgagacggtaaacattcttcaaaaaaagttttaaattagtttttcagatattctccaagaaagtttttgacctatttcgctttctgacagatagtgctattactgcatccctttttgttttcaagaaaagaattccaaatttgttttcggttttgaaaatttccgtccaatgtttcccgtttacgaaaacagttcggaatccggaaactttctgaaccgttttcaatcatccagaaattttccgaaccattttcaatcgtatgtatggagaatagtgattaaagcaggagtgatcatggtacaaagtaataatttgtgaatgtacaatactcccatttcctatgttatgtttgaagtgggcaagctgtcgaagatgtttttttcatagaagtttgaatcaacagtgaggtttcatcaggcccgtgtatatgggagttcagggttaactacagggctcccaaaattctgggttatccaaaatttaattgtagtaatagtatgatgagttataaggatatgttcaaaggtagatattctagtataggcttttaattagtacgtttaaagactattcagagataatagttgagacgataaaggctctaacaattaatgtacggactacagaacaattttttttattactctttccttttttatcctcctacaacaaaggttccttttataaattttaagagttgatgttaagtcattgttaactttaatatcaatgcttctctcctttctcctctctttcatatcagcaaatttaccttcttaataatcctaacagtgtgcgaaaattgtagctactccatctgtcccccatccgtcccaaaataagttaatttattacaagataagacatatcttagtactacaaatctaactaccaatcaacagcaaatactgcattatgccatcgtcaaatatggttcgctcaaacgccattccatattttgactttgctaaattgctactcagatttggtattcatatattagaatgccatcacaatgaaaatgcctttgaacttccctagtgcatttttgtcgtccgccaaggccttctagctcttaagcactaattaagagtgacaatttagtgaaaccaaaatccaaaatggcaacccatatttgatgatagtaattttctagaatttctcatagctttgcagactgcagctatgtctttcttctcaacagctagtcgattgatttcttgcgccaattcacacacaactcctcaatcaccgtatgtgaaaatcatttcctccccctcacagttttcctcctaccaatgaatccactcctccatctcatctatttttctatgtttttttttctaaactctaattggggttttgaaagtttgcctcgacaatgacaattgatgattttttttctgtgtttcctattattgaaaaaatgcatcagttatataattaagaaaatatatttggttattagcatttaccaaatgttgggattaattttgcattaagcaccaggcctctaatcctatcttactgtaaagttgatacacactaacttttaaaacacagtatgcaagtgtgtcacatcatcacccactagcaattattatctaaagtattttaaatcacatgcaaaagtgccgcattattactcactagcaattatcatctagtgtattttaaatatcatgcaaatatgacatatcatttacaattttattgtatttttagagctcaatatgtaagcaatgtcaaatcattatctccacgtcatttttatattatttaaatatataaatctatcatttgtttaatgtataacatgcatttatcgacatgtcccgctggaaagcgcagggtatcaactagttacgaggtaacttctgcccatgaattgaactcatgttttaatataaatcattatggggctgtttggttctttaccctaccaaatctttggttgtgtcaaaattttggcatgttttggcactaccaattctttggtagggtagagatgcatggtacatatttaaattgctaccaatgtaaagccaaatattgatgatatagagaagaaagttctagattagtgttaaattgttaatgggtattaccaataatttggattcaatcaaaaatacactatcactattcaaaatacaaataaattggtaaggtcacattttagcttcaatctaaaatggccctacaatttggtccagaggcggatggccccatacggtaaagtagtgcgcttggcccagctaccggcggcccggacaccccctacccccgcaggccacagtctgcaagttgggctacatatgctcgatctgctccctggccttgttcccgatctgttcgatacctagccccaacctggcgacctcctctcctagcgtcacctcagtcacccctggtcccctagcttcacgaacttcagtagcgccgtccttcgctgctgtgtcacgcatcgctacttgcctactgcctccgtccaaataagcttagccgtggatatccatatccacgaccgtccgtcttatttaaaaaaaatataattttttttaaaaagatagtcacacatagagtattattcatgttttattatctaataacaataaaaatactaatcataaatttttttaaataaaacgaacgaccaaacattagacattaacagtgtaaaaccacatttattttgggacaaagggagtacttacccgtagcctcggcggccgacgccccatgaaggacgagagaggacatgaggcacaaaggcagcgggattgccggccgcgggcagtgcgcggcggtggcgccagttcagaagttgcagctagcgcctgaggcttcttttttttttaataatagaacatcccggcctttgctcagaagagttacagccaattattataatctagcactctaaaaagagtgtagttaaaataaaaattgaaaacaccaaccaaaaataagaaataaccaatataagataaggagtacacatttattaaagtttatttatgaatctccatcgatagttgataaaaagttatatatccaagtttacgacatgcaacttttataatcggaaaaggtcgaggtgtgtcacccgattgccgcaacactattccaattagaaatagaacggtaagaagagataatgcgcttatttaactgaaagtcgttagtcactagaaattacccattaccatcggtaggttgcaatttagcagattcaacaagagaacaaatcaggagctagaagcagtaatgtgtttaccattttttatcatttttggtaatggattaagaatctgccctacagtaatgtgtttatatttatcttttttttaatggattaagaattggtgtagatttttagagccattttcaagtttaagtgtcagctcaggctcgtcttcacgttcatgtatacatgtgacttcaatatatgccttgtgggtttgacccacctagttttttttggcgtgctcagtcattgatttggtctcacattaggcctggtttagttcccaaaattttttccctaaaacatcacatcgaatctttggacatatgtatataacattaaatataaattaaaaaaactaattgcatagttaggagggaaatcacaagacgaatcttttgaggattaattaggctcaaaagattcgtctcgtggtttccaggcgagttatgaaattagttgtttcattcgtgtccgaaaacccattccgacatctggtcaaatatccgatgtgacttttcgtgaactaaacagacccttaattgatgatcagatttatttactattccctccgtctcataaaaaacgaatctataactagatgtgacatatactaggacgataaatctggacatatgtatgttcagatttgtagtactatgatgtgtcacatctggtattaggttgattttttatggaacggaggaagtacttctcaaactattgcggtaattttctcatggtgccctacagaagcacagataagaaggcccaggaaatagtgattaaaacatgagtgatcaggtacaaaggtagtaactagtactccaattcccaaatgtgcagtactcccatttcttatgtagtattgcttgaagccgcgggcaaattaagctgaaccaaagacgtttctgtcaaacaagttaatttgaatcaatggtgatgttgctgtcttctgccccacgaattgaacgccctaaccacgtaaacaatacgtggagggccaccaacgtacgccctcgaacgacgtctccaaacagtcgtcgtccatctacggggacctcacaagtcacaaacgagcgtgtacatgccattggataagagaggaaggacgaggcctctgggagacgacggcgatgccatgccaaaggggtcaaacgcactgaggcccagttcttttctacaacaaaagttggatgaagattaagatttttatggcacgtttttcaaaatattaaatggtgtgttttgtgcaaaaactttctatataaaaattgctctaaaatatcatattaatctattttttaagtttttaataattaaaactcaatcaatcatacgttaataccacctcgttttacgtaaaaaaacttaatcttcatcttcatcctcatattcaggaaaaaagaacaccacctgaggaggttttggacattctgctattcccaataagtggtttcgctggaatgccactccgccgaatcgattcgctaaaaaaccatccccaagcattgccagcccgctgcagtgtcatattcaccatttcattggattttgacattttttcccagatgagctgactgaaatgcccttgcggtcggtttaaccgagttgaaatggtgcggtgcagcccattcatcctcccgtcctcaccgcgtcgcagtcctcgccgatggaggccgccgctgtgctgaagcaccgtcgtcggcgccagcgagttcttctcgagccatcgttgtcgctgtgctgtggaggtttcctttccgcctccgcccgtatggccgaagcccgccgttcccagctgggaggaaatcctaaccctagagccatgcagcgaagatttggagtggcaagtgaagaaggtagctcctcattacctggtcttattggggcaactcggtatcctataggtcccagtggcctcacccttgttcgttgccctcgttgtggaagtgcagtagtggagtgcagatcttggaggcagggggacgcgttttcttcaaatgcgaggataacgaacaatttgtgagtctttgatttattttgtgcatttgatttgtttttgtttttggtttgaaattggtctgtatgcaattttgtaggtgccaaattgttgtacattcttcaagtggattaagagctataagaagatggtggaagcaatggagcttaattatcctgatgaggccgtgagtgatgttgcaatgcctatggttgcagatattgttgagaagaggccaaattcggttactaatgcaaaaattgaaaagctagctaggtcgatgcaaatattagtgttcatgaaccgcagcacactagtttttgtgctttgtatgtgtgttatggcactgaattgatgtaatccagctgcaatgtatctagttagtagggttaaatggtagtaggcagtatcaagtgactccagttgcaatggcagaactgtgttttatccaatgttttcagtttttgggaatgtcacaatatctaatttctccacctttgtgttataatgtatcctttttttttggaatggtctataatgtatcaattgacatacactgaattaatttggaaacagtggtaaaatgaaaattgtgtcagcattttgtttatgtaatgctcatatattcaagttcaggttcagacatgagacagcacaaaaatggaaggttcaggttcagatagcacaaaatgacagtttcatgtttggcaacaagcaacaagcaacaaattcatacacatatcagatttggcagcaaagaacaagcaacccattcagattcagacagaggtccaaattcagccatatcacaaaaggacacaggttcaggtccaaattcagacattacaggttcagattcagagaggtttagattcagacattacatactaacattcagatattacaggctaaagacatgacagattcagacataacatagtgatagcaaaatgacaacttgcagctgattcccaacatggtcaaatttgaagcttcttctttggcgtcagcttcctccttggctgggagtagctgttagtaggctgggtacttgaagttgtggctgcttgtggctgagaagttgtggctgcttgtcctcccatcatgagcattgctagccggctgcaagcaataataaagttaccttattgtaactctgcaatatgcaaatattggtacttaataaaagacaatgaagctaccttcttgtgactcttcctgggctctcttcaattatttgttgcacacaaggccttttgggactaggaatatcagaactagtcccatattttgtagtgtttcttcttggcttcctcttcctgcaagttacaaggtaaattattgtaacatgttataaaaaatactcaatgcaatgacatttgagttagtgaactagccttgtctttgttccattaagtgaacacttgtagctagtctgagtatgtcccaattctccacagcccttgcaccttctcttgccccttaccaacaccttctttcctggctcagtattggatgtactagctttggatttagatttgccaccttcaagacaacttttgatcctaagcatcctgtttcttcctgctgtcttcttaggtaaaggtgcacctagcacccatggcatctcaacctgtggccagtaagacttgtcaccaagtggctctataactctcttgtaggcattcttgaacatttagactgagtaatatggatttacaaagtcctcaatgttgacatctctgctctgttgtgctgttatcaatgccaatgcatgctgacatggttttccagtgtgctgccattcctcacaagagcaatatttattgtatgccttcacaacatgcttgccattactactgctgttatcaacaacctctgcagttaaggaatcggctttcactactgacaggtgacctaaacccctattcatagccttcagttgttgtgtaactgctggcaggatcttgccagttaatttctctccaatcctcctcctcttattccaaagaaccataactagcaccctatacttgtctgcaaggtcaccaattggtagtgctttatagtccttaatccagttgttgaaaacctctacaatgttgttagttatgtaatcacacttaatctctgggttgaaaccactcctcatccactaggtttcaagccaagggagaacttcactgcaagaaccaataacctccttcatgtgcatttgccaaatttctttcctatatgccctagcagctgggtacatatgtgagtgtacatctcctccaaacctcttcacaaaattcttcatcaaatgccaaaagcactccctctgcttagtatgtttgaaaacagtgtgcacagccttctccaaccccttacatgcatcagtgcatacagctagagggttaacatctcctatggcagcatgaagctgactcatgaaccactcccagttatcctcagtctctaaatctataaacccaatagaaagaggatacatccaattatgcccatctacagctgtagcagatgctaagtggccattccatctgccatttaaagcagtgctgtctatactaatgtatggcctacacccctctaaaaaaaccatcaatacaaggccttaatgcacagaaaaaccttttaaaaaaaactctcctatctacttccacaatgtcaatctctataacactactaggtgatgttctaagtacctctgccctccacctatacagcatgtgaaaactttcctcccatgttccatacagctgatccaaagccttgagtctacccttacatattgtgtcatagttgattgtgcacttttgatcttctactagcctagtctgcaaggctttaggacccatacctggattcttcctaagaattggaattgcctttgcaaccacccatttactagttggtgtagttgttcttcttctgctgctagaagtacatgtatgatggtcagttagcactgtcacctgcaaatcaaatggaagaaactatcagcattaatgcattgtgtgacacatctactgtctaactgaaaagaaaaaaaataataccatcactgtcttctgattaggctgcttatgcccaacaatatgccaagggcagtcatcaaccatacaacctcctatatatcgttcaggatctgttttgatcaaatgcaactcaaattcctcatttatggcatattgcctcacagccaacctaaactccttcatgtttgggtacatggtgccagccttcatgcatggcttgtcagggtcatagggcatcaccaactcccctggtacttcatcagacacaggaattgctgccccagtagtgtcttgagcagcatcacccacaccatcaccagcagcagcagcttcagccccatcaccaccagcagcctgacccccattgccaccagcttgtctagccatctcggcttgctcatcttcagcccttaaacccagcaactcatagaatttgtcgtccccaacaatatctaaccgcccttcatcgtcgtttcgggccagaatgtctaggctttcccaatcaacaatgtcaatagcaacatatgggacatcaagaacaggagacctagctagttccccaacttgttccacgaccccagcaggagaaacaaagaaaacaccaccattatcaccttcaccaccaccaccaccaccaccactgccgccgccaacaccaacatcgggttctaacacacttaagctaagcgcaggctcctccacgagcctgaagaaatcaaatgtggacgaatgttagagaactctctaactgattcgcacctctaactaattcaaaccaatcgtaatcacaaaagcaagccacaaatcggtagaagaacttacccggacactaactcgtgccaggtgcaatccatcaatgccactatgctcctacctcccacgcgctagcaccattggatggcgacggcaccgccggcgacgacgaccaagacagaggagcgactggatctggggatcccctttctctctcagacctaatagcggctcaatccgctttctctcacctcagatagaagaaacatagcacaagggcattttcatcagcccaaatgcgaaaacagcagcaaaagagattaaatggcgaatgtggcaaagaaaatgttgggcaccgcttggggatgattttttagcgaatcgattcagcggagtggcattccagcgaaaccacttattgggaatggcacaatgtccaatttctcccacctgagacacacaaaaatcagagagagagaagcttttgtccatgatgtggttgcagagatttgcagaggagaaaaaaggttttactctgtagcaggagaccccagtaaaagatgtgcctggtccaggcatatatttacagctgttaaaattaagctgtacacgaaggcgctcgatacatcgagagatatcgatcgagcggcgagtgtcacgcctgcggcagagaagccaaagcttcgagttagagcagtttgcttatcagccaagtgcatatgttctctactggttccttactgtacatgtacagccatacacacgatctgaacaaagtaaaatgtactatcccgtaaagctgatcagtataatgcatgcgtactcctctcccgcagaatggaagaaccggctaaggctctgtttagttctcaaaataaaacttttcaccttctcacattaaacgtttaaacacatacataaaatattaaatatagataaaaaaatcaattatacagattacgtgtaaattgcgagacaaatcttttaagtctaattacaccatgatttgacaatatggtgctacagtaaacatttgctaacaacgaattaattaggcttaataaattcgtctcgcagtttccaagatgaaatctgtaatttgttttgttattagacaacatttaacattttaaatatgtgtccatataaacgtggatatcttaaaataaaaaattttgccaactaaactaggcctaagctagatatatcatggagcatgcagtcaaaggccagggtaaagtcaggcaggtcctcatcgtccgagaagcctcgatctacatctcctccggtcctgcaggctgcagctcaggtcaagatcgacctgcaaaccgccaagaggtgaaaccaatcaaaccatcccattcccatttgccagttgccacaagcgcccatggcaagtaccagttgtacaaattaatggagtacaatacatccattcatcatccttccatcttggaatcgatatgatcgacctaattagtataatctagggcagctaagacttaagctctagatttatctcctaaattattattagactagcaaatatacccgtgcgttgcaacatgatctagtaagaggggttaaacattccgttccactgtattatagtatgttttcagttctttctgtgtttcaacttttttccatggttgttttctccgtttgtgtgtatgttcaccgggttttcggaaacttttgtttttaataagcggattgactaaaatctgctttcgcccttcctgcattataggaatttcttggagtgaaaagcttgggcaccacatgctgatcccttgtggtggcggtacaacacaatgattgagaaatccattgaacatatgatggtcgtgcttgtgcgatcaaagcatgggctcatgttctactcctatcgtctcctcaactacatcgcttcctcatcttcatcgaaccacttccactgttgggccttaccaatgcacagcgacaccaaccattttgcctcccattgcgagtatctccacactctacaccgccgccttaaatgtcacgtaggcctatccgacaccacctgcatggcctccgtcagtgtatgggtcaccgtcaatagccacttcaagctgccaggcaccaggcactttctcaagaacatattatttaaattatcagatgtatcatttctcaaattaggtgtttgtttgttcacgagttcacgtaacgaatccatgtgaatattaaaaagagtagacctactttaattaatttttaatttagatttcctagttgttatggccacatgtcatatggattatgaggcttgttactattatatattttattatattaatgactcggttatttcctaattcacgagttggcaatcctttgacatcgttcaaattgtaaacttaccgatagagcagaagcaaaacatgatatgattgatggttgtgtgattggcgtgggaagacaaataggatgtgctgtgtgtggagcctaatggattctaacgcgtggggatgcttgaccatcaacgtggaagcggtgatttttagtttgggagcaatcagactcgcacgcgctgctagggtgctagtgcagaaacatgaaaatcgttgatgtacggtagacaacgacgaataatagaaacactacaaatattttatatatgtaaagataaagataaagataaaatgatatcacgaggaaataaaacacgaacaggagtggtgagacatattttcatcctttatttattatagatcattgtacttttaggaatttaaattgtttgtttattttatagaaaaaaaaagaaaaagaaaaagagatcggaaggggaagaagcgaagcaaccacagggtgtggtggtctttttgcgattagatcttttgtccttttgtgataagaaatttagattgtttatttacattataaaaaaactctcatagagactggtcttataggttccggttcatttaaaaccggcacctatgagccttttccaaccttcgcacgatgaataaaataaaaaaatgacacctttaagcattataagtgccgcttctcaagaaaaaccgacaccaaccgacacctatacttatattataggtgttggttctagcaaaaaactggtacaaatattataggtgtctgttttagcgtaaaacccgatacaaatgttataggtgccggtttttttaaaagaaccaatacctataatataaatgtaggtgtcggttctacttaaagaaaacgtcaccaataaaaaaccgactggtcaacatccttatccactcgcttctctcgatcgcggccattctacctcatccactcgctcctcacacttctcactccatccacttgcacccccctcccctctcgccctctctcgcctcctccttctcctagcagcaacgcgctggcggcgggggtggcggcggcctcttctccaacggaggcggccccttctccaacggaggcggtccccttctctttgaagcggcggtggccccttcttccggcagcggcagcggccacaaggaggcagcggcggcggcccccttctccttgcagcggcagcagccccttcttccggcagcggcagcggctgtaaggaggcatcaacggtggcccccttatccttgcagcgacggcggcccccttcttccggcagcggcagcggccccttctcccagcaatggcagtggcccccttcgccggcagcggcggcggtcccctcatccagatccggtggaggaagcgagaggaggcggtgctatgcacggataatttttgctgtgtaatttttcctcttgtggttgaatatgtgatgaagtatgattgatatgatcaagaggggaggagaagtgaagctagcgcccaggaggagggggtgtgcggcgcttgcttttttccgcgtccgattattttcgctcttttttttcgcgtccgattttttctgctatgacgaaaatcactctattttgtattaaacggacaaggaaaacaacttcaactttttaagtagtagaaattatcttaaaatacagtagaaatttaaagatacaagtttaaccttattttcaaagatttttttggctttgccactgcatcgacgacaatacctactcctaccacattctacgtttcccagcattgtttctaacagaactaatacatttatacatgttatgacggcctagctgttcatggtctgggagcagtagtaactcagcaagtcactgccttctttcatcaggttttgcttgatgtcttgaacaggaagacatcttcccatcaaaagaattaaatttgaaaatatattgtttgttttttcttagaaatattcgggttttaaattgttttgcacaaatatacggttggtatcgctcaacggatgcacgaaaatgacgtgggctgatgatactgacgattgtcgcgtgacaaccgcatgagaccgagcggtctcgcacaaccgagggctgatgatactgacggtgtcgcgtgacaacggcacgagaccgagcggtctcgcacaaccgaaaagctacaacagctgagcgagaccggctatcttgttatctgagctttaatcaatcactaattaggatgattaatcatcaattattaattaactaatatttaatcatgacaactaatcactaattaattatttttcaaaacggtgtcgctgtttggcagtgcgagaccgcgcgatctcgcgttagaccgagcggtcttgctcagttactgcgtgataccatcggtgtcgtcaacccatatcattttcgcatatttgttgagcgataccgatggtatatctgtgccaaataatttgaaacccgaatatttttgagaaagaaacaaataaacagcatattttttaatttaatttcccatcaaaatttctctttgtgcgtgcagggatatatataacaaaattttcgctaacggtcacttaataggtccgctttgcttgtaaaaagacatttatttttacaagcagaccttttaggtgaccgctagcgaaaattgattttcgggggttggtaaccaatccctcttaattatttttgcaagcgtatttttatcaaacctatcaataaaaataaaagggtaacactatgaaacttgatttttctagtagtgagaacccctcgtaaaggtatcctttagcaattagtgagtaaataaaaaattgaagttcgctaaagcactgcattagcactataatctaatcatacctgtgcattaatatttttatttatgatgatgtaagcgcgtttacatcagcgtccgtaatttcatttatgtttagaaaaaaagaaaacctggagaaaccaatgcgatcaggcgttgataggagcaagagaagcggcgggtggactccccgtcctcctcttccccaaagtcccacagcaaacttctcgcgaagaggaggaggaggagccccctttcctttcttcccaacccatacgccatatcgatccatccctggctagcaggagccagatctcgtccctagggaggagggaggaggaagaggttgtggtggcggtgatggatcgccattcgccagacagcagagctccagcgcactgcaacgcagggtggtgggtcgtcgctcggcgaaggcgacgttcgacgaaggcggcggcgggggctagctactactactgtaggatcgaatcataagaactaagccaaccagagggggtgaatggttgagataaacaaaaaccaaaaattttagcggaaataaaagttaccctcgaaatcaatggatcgcggcctgaccgaggtagttgtgccggtctgactgtctaaaagccaccggtctgaccgagattggaactccggtctgaccgcctgatcagctgccgcttgctgtcgccgccgccagtctgactgccattacgccgccggtcggaccgccgcgatgccgccggtctgaccgccgctgagatgccggttagaccgctgaaacccggtgaaacacaaatcgaagaactctcaaagtagatgacaattttattgcttctatccgtgattacaaagtgcaccaacagcactccttacaaaaatctcgaccaaactcgaaaccctaactaaactagctctcaaaagctatacaaaagcgatacaaagcaatacttggaagactcacgctccccctctatttatacatgaggtaggcagcctaaagccacgaaccaaactcatactaagagtcctaaacaccttaggaaaccctctaatataagaaagaaactttacataaccaatcgtaccaaatttgaactccttccaaattctacttcgcatcccatacacacaaaaacaataccaccattgtatgccatatggaatcttcaccaaccacgtgcatcaactctagccttagtatccttcatgatatctgaccaccacggacatcgtcttaccaccaagccgactcccgatccatcaccgcaaatactctcccgaggcatcgagtcacctacacatgaaacaaacaaagaaaccatattccgagaccaagctatctccaacttgactcattagtagcaaacaacagtattacatacgtatagtattcatctagaagccataaccatgaaacaatcacggatatccaaagaaacaactcgaaaccgaaaccgacacagtgtcggccggtcagaccgcgggctggccggtctgaccgcacacatagcaccggtctgaccggcaacctccacccggtcggactggtcacataaaataacagtgaatccgatcatcacctgaaaattgattatctccaaaaccacttcaacgataatctccaaatatcaaaaccaataatcacggataccaattgtttatcacagaataagaatcaaaacacacattgatcttacaatctctcccttgatgaacacattggcaaacctcatcaaaaatgttttggtgtttggaaaaataaaaacaaaagcggtaaaaagcacacttcgtacaaaagtacacatcgtgctcaaaaatccaaaagaaaacttctccccctttttaaaagaaagaaattcccaattgaaccaaaaattttcatattacttctcccccttttaacaatgatttcatcaagcataggaattatgttcattaatgtataagaacttagcatacatatagcatatcaagttatgtgttgcaataaaaagaagatgaacccatctataacagaacaagcatgcattaaagtataaccatgaaccaaagattttacaattaagcttgaatcaacaagcaaaattcatgatttcatacgatttctaatgcaacatcttaacaagcacataggttgaaaaataaacactaaacacatatacctattgcatttatcactctttctcaaataacctttagcacaaaacaacaaagagaattttttttctttttcttttcttgagccttattgctcatatttttctctttattccgggtacgtccctgtcgtcaagactgtttccagggattcggcacccattgttttgctcacatcgaatacgtccttgtcgtcaagactgtttccaacgattcggtattcatattttttttcatatttttttctttttcataatgagcaattaaagctatttgagaaataacaaatcaataaatcatatatataaagcatttatagatcaaaccatatgctagcatcaacattgcatatttgctcaattcaagtagaatttaagtgtcatgcatcatctcccttaaaagcaaaatctaaatctcatgaaaagactagaatacatacaagctatgctagagacaaataaaccttcaaagtattgctagcatgcacaagaaaatactatatgtataaaacaaagctctcgttttgcaatttttttttcattgtcatattattgcttgataaaaccatgaggtacaaactccccctcaaaacatgccaaaaggattcacgaataagcattaactccccctcaatataatctccaattctccccgaacaaaaatcaagaagaaatcaaagattttgaaaaagacatccaattgccaatgatatcactaagattctcatgaattgacatgtatatacttgtattaacaaaaactactacctcaaacactagcattgaaaagctaataattaagaaagtagaacaaaaaatatgtcaatccaaaagtaaattgatgttaccttgaaaagcaatcatcatctcaacattgaacgctcatggggagtatgccgccaaaatacctacgaaagaggagatgtcgaggccttcgtgttggggttagaaataagaaattttggaatccaatactgagtcacacgaccagtagaaccagtaggtacatatgcacttacaaaatcagaatcagacttacctgataaattaccttcttgcttcacaaaagtctgagttgaatttcgcgcaaaattgccccgaggccggtctgaccgtcgttgtacctgcggtctgactggacctggcaaccggtctgaccgccggttcaactgcggtctgaccgctggccggtctgaccggctggccggcggtctgaccgctggccggtctgaccggctggtcagtctcggtctaaccgtggtcctcgaattaaaacccgatttttgccaacatcgttttgcaaaagcaatttctctttcctttttctgtttatgggcaagtctaaaacaaaaaccaaccaaatgtcaatcttttccacaaaaagaacaagtgtacttctcacaacaagtttgtgaagtagatggttttgaaattgatggttttgcaacaacagaaggttttgcattcacatcatttgatttcaaagaagatgcattcaaagaagacatgatgccagcagatttaaacacagtgttcttaggctcagtttcaatcaaaatttcacctctcctagcaacacccaaaacagtaggaggatgtctagtatgatgagcataagaatcaaaacctaaaccacgattgtgtgtgctaactttagattgatcaagaatcatgttgaggttctttttaccatcagaaaatctttgcaaataagaaatctcctgagtaagaatagcacaatttttgcaagcatccaaaagacctttttgttttctacaagttgagcaagaaaacacctcatcttgtttaacaatctcttccatgtgtttaacatgccctaaagcatctttcaacttcaactcattcaaaacacactttgaacaatcttgagaaaacaaaacaccattgttttgttttgccttatttgcacacgaaacattgaccaaagaacttgcacaaaaaacaactttgtatttttttcaaaacgttctttgtcaaaattaactcatcaacaacacgagcatgtaaagcaaatccaagagcaaaagaagattccaactttttagatttttccatctcaaattccaatttcttacaattaacagaattgatatctcgcaaagcattaatttcagaaaataaaacttcacaagattgacaattatcatcattaggaatcaaagattttaatctagcaatttcagcattaagaatctcaatagtatgatccctctcatcaagcacaatagaacatgttcgaaccgttcgagttgatcatcggacatggcattaaataaagcaagaacagaaggcttcgatgaagaagtaccaacatccaaagaagtcgaggaagaaaccaaagcactagacttagaatcaactttacgagcaagaatattcatctcatgagttttcaatattgtgtaaagcgaatccaaagtcaaggtagacatgttaacagactcctgaatagatgtaactttcatttcccaaatagacatgtcaagaccatttaaaaggtggcgagaaatctcagattgtggataattagcatcataagaggaatcaagatcactcaaaattttattaaaccgagaaagatagtcatccaaagcttctccaggtttcatctcaaatttaatgtactcctttttgaaaagatcacgacgaagttctttaatattatttgttccttgatgaaaattactcaaagcagtccaaatctcatgagcagtttgaagatgagcaacacgatcataatccgaacgagaaatcccactcaaaagaatattgcgagctttgcaattttgttcaaactcagtttttgcagcagcagtattaataacttcaggaatcatataaggatgagaaacttttctccaaatatcataattctcagccataatgtaagattgcatcctactacaccaatgagaaaaatccgttccatcgaaaacatggggcttagttgtaaacttattagccatggcaaaaactcaagatcggtaaagatcgaaaagagcaaacgtggctctgataccacttgtaggatcgaatcacaagaactaagccaaccagagggggggtgaatggttgagataccccaaaaccaaaaacttttagcggaaataaaagttaccctcgaaatcgatggatcgagatctgaccgaggtagtcgtgccggtctgaccgtctgaaagccaccggtctgaccgagattggaactccagtctgaccgcctgatcagctgccgcttgctgttgccgccgccggtctgactgcccttacgccgccggtcagaccgccgcaatgccgccggtctgaccgtcgctgagatgccggttagaccgccgaaacccggtgaaacacaaattgaagaactctcaaagtagatgacaaccttattgcttctatctgtgtttacaaagtgcaccaacaactctccttacaaaaatctcgaccaaactcgaaaccctaactaaactagctctcaaaagctatacaa

SEQ ID NO: 11126 - DNA, 9980 bp, Oryza sativa
acccgaaaccgaaaccgacacagcgtcggctgatcagaccgcgggctggccggtctgaccgcacacatagcaccggtctgaccggcaacctccactcggtcggaccggtcacataaaataacagtgaatccgatcatcacctgaaaattgattatctccaaaaccacttcgacgataatctccaaatatcaaaaccaataatcacggatgccaattgtttatcacagaataagaatcaaaacacacattgatcttacaactacgacgacgacgatgacatcttcaggtggcagctgctggacaccagctactcggtgttctcgccgccgacactgctcgacgacgaccacccacacagcaaggtgtagtgacccaccccgatcccgccacgaggaagaccaccttgttcgctgtgtgtattgcatgatgaaattgcatgtttattgtggtgttctaaaattcaaattaataaattccaagttgtgatcagttttaagtctaattattttttcctgcaataattttaaaaaataaattaataattagcaccttgtaaaatgatgagaactcatataattaacaaggataaggtcgttgtactttgagtggaattcctaaccagataaatttgaatttagaaatatcaaggacaaatcaccagccggcttgtagtaacagttttagtttttttcaacatttaacatttccagtgttaaaaattgataaatatacgaggttgtatctatatatcctaacgtctcaagattgaaaattagtaaaattgccctccaaattaaagagggtgttcgtttgagtgagtactactcaaacactgtcagacctttttaaaactgtttgtttgtttcactgtcacaagtattgcagcggactccacacatgatactctatttttctgtctcacctggacttaatatgtggtcaacatattcttgcgcttcctttattgatcgccgcaccttagctaaaggtaggtacaatagcatgttataaaccagctataaacatattttaaagagataaaaaaagctattaaccagctataaacatattttaaagagataaagaaatagagagaagagcagcgggttatggatctatagtcaactgcagcacggactctaagacgtaatgtgtgtatgacaggtgggaccagatactaatattataataagcaactattgtatgaattggctatagatgatttatagtcattagtgggctgcactattaaacttgctctaacaaacattttggcaagttggtgtgactttttttttcgagaaaagacggtgtggtaatgatttgatatgaacgtacaggtaggaatgaaaacgactcaaaaaaagacgggaaccagatctatcattttcgttccatgttttttattaaaaaaatagaaatagaaaatcttgtgtataaaaacggaatagaatattattgaatgtgaaaacatgatgaatatttattggaaaccgagttttcaattttttttctaaaacaatatataaaaatttaaaattttagcagctaatagtaccactttccactttgtatcataaggataacatcacggtttaaacactttatcaagtccaatttttcatctttgagacggtaaacattctttggaaaaagttctaaattagtttttgagatattctctaagaaagtttccgaccgatttctctttctgttagatagtgctatttctgcatccctttttgtttccaagaaaaaaaaatccaaatttgttttcggttttgacactactggaaaaatcgttttttcaagcagccaaaaatagttttcgcaggcagaccgcctgtatgcaaaggcatgcggaaatagatgatttccacatacgggtcgtgggtccgccaggcgacatctccatctttgtaggcagtagattcacccgcctgcaaaaaacatttcagtgaaataaaaaaaaggcgcgccaccgccagcctccccctccggccaacggctctcctcctccatctgcggccatccccacaggcattgatgccgtcgtcgtcgcatcggcgccgttggtcatcgcgcggcgtcgggataggaaggagccaagccgccgcctctcctcctcgtcgccactgcctccactccccttcggaagaccggccggcggtggatccacacgcccggggtgagccggcggtagatccatagatttggtcattttataatccttcaaaactaaaatttttgggtattttacacatttcaaacgataatagcatggtaatggtgtgggaggtatcactaaaatcataagtcacacggtatattgttagcgtaccatgtgtaatggtgtgggttttccgaaacttattggtcgatacgtgcaaacaaaccgtttattatatgtgttttggaatccttcgtgtcgacatgatagacggtgaggaactaattacaataatgccaatatctttaacgttcacttcgtcaccaaatttacttaacctttaaaaatagtaccaagagtaaaagtaaagacacacgacttaataccgacatggaaagctcagctgcagagatgaacccttttcctcccataaggaaagatacagacggtgataagtgagagaacatttattggttgtggtgcggtagtgccaatcaataatgctcaggaagagcaaatatggaccgcattttagtgtcctctagcgcagtttaaaatgagtggtccgcactggacaaacagctgtaactagaagggcctcacactttatcccacttacgaggcatgggccctagcaacttgcaagtggggcgctgacactgcaacaataatttttctgtttccaacccccttctcacactataccgatactccaatatttcttttcctttgcagttttgacaccctgtgggacgtctacccagcgctgtggttgactggcgcgtgggtaggtggggcccaggtgtcggtgaccctggagccgaggtacgtgggcgcgggtaagccgtggcgggcggtgacgatggaattcctggccactgtacagatcgcgtcagcgtgggacccactaggtgacgcaggcctaccctgtccgatatttactgctccacgacgccccgctttccccccatccacacccgcacccacctcgctcgcgcgctcggtaaaaatccccacgatttgggagtcctccttacatggccacgcccagaaccgggagcactcgctcttgtcattcagattgccgctgcttgcaggagccagatctcgtcggtaggaggaggaggaggttggggtgggggtgatggatcggcagaggcagcagagctccaggggcaatgctagtgctactgcaacgcggggtggtggtggtggtggtggtggtaaggggggagggaacgggaaggcggcggcggcggggaagaagccgatcaaggtggtgtacatctccaaccccatgcgggtgaggaccagcgccgccgggttccgcgccctcgtgcaggagctcaccggccgcaacgccgacccttccaagtacagcccccgcgcctccgcgggcgacgacggcggtggcgccacggcgctgcccgacaccggcgcagccagcgacgccgacgccctcgaggcgggcgcggcgccgggtcgtcatccggcggaaacggcgacgttcgacgaaggcggcggcgggggcgggggcggctacgacgacgacgacgacgacgtcttcaggtcgcagctgctggacaccagctactcggtgttctcgccgccgacgctgctctacgacgaccacccgcacagcaaggtgtagtgacccaccccgatccctcccgccatgaggaagaccaccttgttcgctgtgtgtattgcatgatgaaattgcatgtgtgtgctagcttcaattcagtgtgccgctctatcccttagcctagctcatcaccacatgcctcaaatgaaattaaaaaagagagtggattcttatccctcgagcatacatcctctcgttctgtacgtatcgttcaaaaagttataaaaaaattaaaaaatttatcaagatagatcaatagatcaatagatcaatacatgatagtatatctttttcaaatatgcaagttaaaatttgacttatacaattcgaaacaaaaataaaaaaattgatgatgaattgcacgttctattcatagttaaatttgttatttttttctacttgtataagttgaatttgaatttgtatgtttgtgaagtgatatatcatatattgatctatccaactaattttttttcaaatttttttatgacttttaagtgatatgcaaaaaaaataaggggatatccctttaagggatgaattgagttttgcattaaaaaaaatgaaggcaaaatcttagcctgagctgccgctatctgtgttgtgtgtttggtactgtggacgccacacacctggggggataaattcttcttccttttttaatttcccctcgctctcttcttcttctctattgatatcaatggcttggttaattaattgtcgtcttcactgctagctcttaatttgcaactttgcaagtgatgaactgatgatgcaatgctcgtgtcgtcgccatcgatatatatatatgtatatatcatgatgatcggcggccagctacgagctgatgctagtatattaatttccagatctttttttcttcgatccgagacgtttttttgcctactactgttcctctgattttatggtcacctttttcttttctttctgtgcggttttttttttttggcatggttgagcttggagcatcggttcgccgatcacccccagtcaccaccaattcggggtggcgctgcgctgtgctgccatgccatgccactgctagagtggtagcgtgcgaaacagtaaacacactacaccgtctgtccaaaaaaaaaactctaacgattaatccggataaatgcttatccagattcattcccagaagttgattttttatgggacggaggaagtacttcgctgcaacaatactactactgcactcacctggctaaggcagtgtacacatataagggtgtgtttagttctttgggtgtaaagtttttaaggatacgaacacacatttgaagtattaaatatagactaataacaaaacaaattaccgattccacatgtaaattgtaagacgaatttattaagtctaattaatccatcattagcaaatgtttattgtagcatcacattgttagatcatggcgtaattaggctcaaaagattcgtctcacaatttatatgcaaactatacaattggtttttttccccacatttaatgccttatgcatatgttcaaacatttgatgtgatgtttttgccaaaaatttttaagatataaacaaggcctaaatcacagctagatatcgttggcacgcaccatatctatatcttaactcctaatcagcatcaacgtgctaatataatcattaattaattaattaaccagttataaaccagtatgatataaatgtataggatgacgacctcgatcactttaatttcatttcattttcagtctctaattaataatatatataagatcggcttgaaattgaaagaccactttcatcaggaatatagtggatacatgcatatagtcatgaacacatcttatctatctttgcccttcgaattcattagttatatatgcatggcatggacacaagatcaaagaaaagcaagtgttgcgagcatattttagctagctgcaattatcatgcatggccacccttcattttcatggcgaattccactgtactagagggcatcaggaatttcccccttttttgttttacccgtgaagaaactgaagaattcgaattccggtcctacctacttccaacaggagaaattgacataattaaaaacaacccatctctctttgttcttcgatcaccagttaaatgtatatatatatatagcatacacaagattgaagccttgtgacattcaaactctagaactaatattaattgtagtctcatcagctgcgggccagaagacacaatgcaatacacgagggccaggtatatatactgcaacagaagtgtaagaaagcgacaacatcgtgttggcttactagccagctagccccctacagtccagataatgatttcgttaagaacagtacatgtgaatggatttgcctctcgcactttgttagtgcttgttggatggtcaagtttggaaccgcgagttacaacttacaagcagcagcaaccataagtttcactaattttggtcttcaaggtccttaaaacactcatatacagcactaccatccaaccttttgttcatgattcttctggtttcatattttggcttgtttgatgtgttcatttttgttcttccattcttccactactagttatactactatttgctaggcaaagattttttttttttcgtaagcttgatttcagttactttggttaatttgtttttccattcttctatttcatttgtttgacaatatactgcttcatgggtgttgctttgtgctgttctgttcccactttgattcttggtcattgcttatatatattgctcttgttcattgacccattgcacttaagtttacctttcgttttgtttgacattggctgatgactcgatggcccgtgttgtgttattccttgatgttggaatgatccaaaattaaactttctatcttaattactatcctagaacacactcatataggtttaacactatacatgcatacacgcgatgcactgatgcgtgataataaattagcatattaatccagtggaatttagctgtggcttaatttgatcttttctgctcacatacaggttgtagcattgtgatatccatgcatgttgtgctagctagttgatcttttttatatgtactcaatctatttctcttttcccgatatatgttgtcccaacaatctctcatttttcttgaatcaataatgctttcccgttcaatgtttcctcttttgcttccactgtgtgtacaagtcccaatctgtgtactgcatgcttataaaggaccctcttcgatcagcatttacatcctgcagtctgtatatgatttggtctattttccttcctctttaatttacttttgagacagacattatattgtcatggcattatttccttaattctaacatttcggtacatcgtgtttacttcattacttgtctccaaattttatgcaatgtgataaaagaaattagttgcccagatgttatttacaaacacaccatccaatgtctctacttctgactaatagtaacacgctaaggggtagggtgacaccttgttgatttaaacttgttagcacctcaattagtccacagtctttgagcacatgcatgcatgagtccatcaaatacttgcattttcatacatatgtatgcattatatttgaaccaatacttttcttagctagctagctctggtgctttactaattaagatgacacttcacatgcatactattactccatccgtcccaaaatataaacatttttgaacttcgacacagtcttcgagatgcttctttgaccaacaatatctataaaagtaaaatgtttttaaaaaaatgttgcatattatgatagcttgtttaatgataaaactagtaacatcaattttacattgttgatcttgttaatttttttttttgttattaacagtcaaaattaaaaaagtttgactttgcactatgccaaaaatgattatattttgggatggagggagtagaattttagttcatacaaactatcactacataagtaaattaaaaactttttttgcatacatgttttgagcaatcttgggtttctatgcaactctcttaattagttattacttctgaattcattccattgttttcttttggatttcgttactactctcttctagagaggaagttctaaatctgttttactgtctggttctttggtaaaatcctatttgttatgttaattttggtatttcaatcaactaaatattttaacatattttggtatgaatgtttgtgggtgcacttagggttctatccttttttttctttaatacaaaatgtccatgcttttttggtaaaagaaatatattataacattgccatagcaaaagaatgtatatatttatcaaacatgttaggatcacttgtttgcttttttttatttatgttctttctaaaaacaaaattaaaccacataaattcaacaaattatactttctaattattgggtacatatgcatcacatttgatttggtcaaaatagaactactcctctatgttaatcttcatccatctagtttaatttggtactaataacatcgtttctcggtgccaactgttcagatgctttttttgggcaaatatatctggaatgaataaaggagaagaaaaaaaaactaattaaacgttgaaaaggaaaagtttatcacaaacaatcttttgtctgatcaagtgtgctggtaattaatatattcaaacaataaaattaatatgtaggctatttgagcacgtgtttatattgatataataatgttttaagaaattaccaagtatgaaatttcttttttcctaagactggcaaaagttttgtctacgtgtatattgatagaacagggacaaacacacaaggtgcaaacaatatttacagggtatgctgaaaaaaaggcacaccacccaaaaaaaacctaaggaatcttttccaaaggatataactctataattcgatggtcctggcttttgtctaggctcttccctcgactttgatcttcacttaaaaataaatgtcttagccacttatcatcaatcttatattcttccttgtatcttttgaaactctgtctactaggcttttgtctaggctcttccctcgtctttgatcttttttttttcgaaaaagaccctcatttttgatcttcactaaagaaataaatttcttaaccactcatcatcaatcttatattcttacttgtatcttttgaaactctgtctgctagttgtataagtctttttaggcacttcgtccagtcttttgtatggcattgattaagtgataagaaactcctggtcaaaaaaaaaagtgataagaaactagtaatgcaatactcagaatgaagcgatataggtcttgcgaactgtgcatagtatggggtatatatgctgccgatctatgcttggctgcttggctttacttctctagtacatgatgattgtttctgatcaacattactggctttcagtagtcattttatagtactgagaagattgcattttacctgaactctgaaattaccctacaacttgattgtgttttctactaattatcacagcacaatcttctgatcagtgtaactgaaatagcagttctttttttataaactccgcactaacttctagagaagctgaaataccagtctttttttctctttttgtgaacggactatacactgttgaagaaaccatctttggtcagtcgaccaaatttcacaatagtcccgtttccattaaaaaccgggactaaaaacgatttttagtcccggtttaaaaaattttgatctttagtcccggttagtaacaccaatcggggctaaagatgatttgtagtcccggttcatcccctgtcagatgtatgtcaggggttcgagaatctttagtcccggttgatactaccaaccaggactaaagatcgagcgatctttactcccggttggtaataccaaccgggactaaagatcgatctttagtcccagttggagttatcaaccgggagtaaatatttctctcccacatccgatcggttaagtctcagacagatatttagataagattggaacatcccctctattgctcttctcagatccaatcctcttacttcttccctaccctctctttctcccctactcccctttctcttctcctaccctctact

SEQ ID NO: 11127 - DNA, 30763 bp, Oryza sativa
  unsure (1)..(30763): unsure at all n locations
tcgggcaggcggtggccgggccccggcccggttttttttatatatataatttgtgtttcactggatgtataattttttagattttgtgattcattgcatcgcatggatctaagatgtataatttgtataatctgtgatgtatttaatttgtgtgtagtttttaggatttgtgatgtagttgatctgtgtgtaggatttgtgatgtatttgacttgtgtgtataagtaacttaatatttgaaatgttgatttgggatgtgcatctcattcgattcgggagaaaatacatagattaacactagccattagcaaatcaacaacaaaataataataataaaaagatctcgaggaactgtcgcttcccctctttagtcccgattggtaacaccaaccgggactaaatattccccctctttactcccggttggtaacaccaactgggactaaagatcgagttccggttatttgaaccgggactaaagatagcgatctttagtcccggattcgtaatcctgattgaaaaatcgggactacaaagggttctaaaccaaaagtaaagagcatttctccaccagtgatagcaccttaatatgcacattcttggaaattattagttgactaactaaagcacggtgcaaaaatatacatcttctaacacactggtttactgattaccaatttcagctaaattacaatgaaatattataccgtgttcatttctccaacaacggttggattaaattttggatactcgtggcacgtttttcaaaccgctaaaccgtacgtttcgtgcgaaatatttatatatgaaagttgctctaaaatattagattaatctattttttaagtttataataattaaaacttaattaatcacatattattaccacctcattttgtgtgaaacacttaattttcaacttcgtcttcggaatattcaaacatcagtggtagtgtcattattggttaacattgcagttttttcttgaaattgacgtgtacgcacactaacaactgcaatgctgctagttgtagtgaagttgtcgtttactgcctgtgatttatgaagagcaattgatgtgctgaatctgctgatccgacacgctcactacaatgctgctagatgtacgccctccgtcacacaaaaaacgaatttagaattaaatgtgacacattacagtacaacgaatccggacagatacactgttacaaatcatcaaataggtgtcgccactataggtgccagtagtgctaaaaccggcacctataaacctttacccacctccgcggattgaaatcgcaaaaaaaggcacatttaagtaattataggtgtcggttccaaataaaaaccgacacctattatattttgtgtcagttttttttgtaaaaaaggcactacaaaaaccgacacctataaaaaattatatgcgccgattttttaaataaaccgtacccaaatcgagatgagccggcgggccccagcaggacgagataaggataagggtgccgctagtggcttctcgatctctctctcgcccccccccctctggcgtcgtcggcagtggcttctcccacggtggtgggcgaggcagcctcggcggcggccggggtggcgacagcggcggaggggttgcggcggcgaccggggtcggcggtggcgggcggagcggtggcggcggcagatcccacgacggtttcggcaacgtagcggcaacggtgattgtttttatgtaattgttgagggatctgtgatttgtgtaaaacttctgtgatttgctttgagggatatgtcttggatgaatcgatggtgacagtgtgaaacttctgtaattttgttttggatcgatggtcttggggtgacaagtctcggggtgacggggaacggctcgatgcatcggctcgattcccttttttttggattcttgggacctcaaaggtgccggttcctttgaataatcacatcagtgccgtctcctttatgccggttgggaaaaaccggcacctatatagggtttccaaccggcactgttgcggtgtactatggtagtgatatatgtctaactagattgatcatagtactataatatgttatgtccagtactatgttagttttttatgagacgaagggagtagttaacttgtcgtttactgcccgtgcagagcaatttttcttttgagaactcgtacagagcaattcaattgatgcgccgatccgacatgttcattactacaataacgaaaaccatatgtggtcatctctgtggttttcaaatggctgaagtaatgtgactgttggttctgaatcctgtataggagtatactgttttgactgagttctatctcttcacagataaaatagaacctcatttgcgtgatatattgttatcaacttattactccctccatcccattataagtgtagccataagtttctgtacccaacgtttgaccatctatcttatttgaaaaatttatgaaaaaattttagaagttaaatcacgcataaagtactattcatattttatcatctaataacaataaaaatagtaattataaaaatgttttaaataagacggatggtcaaagttagacattgaaactcataactacgcttattatgggacagagagagtattattgttaaaaaactaaagtttattagctaaaatcaaaattgtttctccctttaattaggagttcagcgttgtttctcgtgaagtttttgttgatttcaagatccttaagccattctcaacccaataattagaatggtttctatagcattaaataagttaccatctaaaataaaaaatgatatggcaactgaataaatgaggaaagagaagaaaatcacatcttacataagacatgcatggtttctatacaacatccaaaatatcatatgagataagtatcattagatattagatttaagtataaaaaagtggtgtttgtattgaaagagtagagtctagtactatttcttaacgatgtgaagtttatgaaaactatgtctattgtcttgggttgggattggccttagtactagtgctaacagtgttgttattaaatgttttctgatacatttgtatatgctgttgttggaaactcaaaaacgtatatactgagatgtgcgtgtatacatgagatattggttattgtcagagaacgacattaactcatgaatgttttcagatcagaacgtactgagatgtattatttattttggaatggaaggattacttattatctcgaccgcaaataattcctgtatcttcctgaaacttaactcatgcgaaaggtctgtttgcctcgaatgtgtactattactgttagtcaagcacataattcagataaacctcatagctagattgaagtgctattaacgggagggggtttcccccattttgcatttccttcctcggggcatttgcaaatttgccactggtttttttaattttacaagaatgccacttaatgacagttttagtggcatttttgtaattttctagtgacactcttttaataatgattcaaagcaatagtaaatttgtaattgccccttccttctattgctccagtgatcttggcttatgaatgcttgacattacaccactactacacaaactccagataactttttttctcaccagcggttaaaatctatagcctcatgccacgaagcacgtggcctcctcaggcttgtatgggccacatgtgaaaacatatttttcacggacggtacgttaataaaattatatgtattaatggtcgtatgaatatagactattactttttcttataatggatagcccaatatttactttagttaaaagttatgttacaaaaatttttagcttagcatagaaccatcataatgatcaaaatttgaacattccaacacaaaaaggataaataatcttatttaatcctattggtaaatctacatctgaagtttgcaaatttttactagattctagcatgcgatatacattaattccttattttcatcacatctttgtagctagccctataacctgagatgtcctgaaagtgcctttatataagatttacttggagatttttcaaaaatcatattattcctaagttataatattgcccaacacaaaatagattctctagctagaatgacttgatttttgagtgaatatgactttttagaaacataggacaaacgcatgcgctcacaacatttgcatactcacctctgtaaatacaaacacaaacatcctacctctataaagcacatccgaaagtctaaatcaacatatcttaaaactgatgaaatcactatgggtgtctaaaacaactagttataaatatgaatacatgtatcatacctaggaattgaagttggttggactggtttcaccacaaacaatttaatcacttctttcatagagtgcgcttggtggcccaaacagccgaacgcctagcagcgggccgtaacgcgggtggaggccgaccgttttttgggttctcaccaccatcaacgagtcgatcgatcgatgggtggagacgggaaaggttcatagcgctgcgctgtcttcgcatcggcgattcggagtggcgttcgtttgctacatcctactctacttaaattcaagtttcctaagttaggtcgaataatattgaggtgtgcacgaactgcgagagctgctacgaaaggtatacgttaaaaacatggacagcaattgtagaattaaatttgaaatatacttttttttcataatttacgtttatatacacgggtgataagatttagcaaaaatatacctattccgcgagttagaaatgcgggagcgagatgataccgtagaccggcgacgtgggaacgcggtaccacagcatgggagtgcggtaccggctcggtcgcgcagaccgggggtgcggaaccgagtcggtcccgcacaacagctgtgcacgttgctgtagcctgcgggaccggctgccggcccggccggtctcaggaccgaagcggtcccgcggtaccaagctgcggcaccgagccggtcccgtggggctccggtgccgctttccaaatgcgcgggatcgcaatctctccgcatctctgttgtgcgggaccgcaccgaaagttattttatccgccgaaagttattttgtccccgggctctagctccatgtgacatgttgaggcacaaacaaaggagagagagattctcttctctagtcccagcttttttcacgtgttgcccgccgaaagcttgttgtcgtctggttagagagactactcgtcgagtgcctataaaaggaatattacgaaacgaaaaaggcagactcaagtatagtatataactcatattcgtagagtttatcattagtgtaagcttcaataggttagtgtgctcggcaaatttcacaggccctacttctggtatgaactgagtacgcgatgattcatggtgcgtattagaggcttaccataagataatgtcgtgaattcgccaagcgttcaaacccactgatgtgttatgtaaagaaaaatatttgtaagtattcatgaagaaaaggcaggtaaatatttcgaatttatttatttagaaatttagccgacacattagaaagttttaatacacaatattacatattagttcgaatgagcaaaatataaaatcgttctactcattagcctcatcatcgaaatttcttgatgtcgtagtgccttttttctttccctttcttctagcaccagctgaaggtctgcatcctaacaacgataatctttcgggtgaatgtcgctcgcggacagacctatatatgtgccacctcaacaccgctgaaattaatgtacccgtagtcttgggtcggttgagttattggaggcggttcatcaagctgcgatggtcctatctcgtgttgtgctgttgacgaccccccaccgtagctacatggttctccgtaggacagcgtgctgccggcatatcccatcatttggtcggcagtgtacattcctacaaaacattgaatccaaagttgtaaagtacacacattctggaactaaaatattttgtactaaattataatttgtacctgttatttgtggttgcatgataggtggttgactgaacaaccaatctacttggcctaacatctccaaaaagcttggtccttgtggttgtacgttttcatttatggacatttggtacatccccctacaggtgcagcgctaatttaatatcgcaatataaagatcctcaaaattgaaagacatcatgtacgaaccagtgttgtatgtggaagctccatgccactgatcgttcatacccgttggaaacatgggcatgttatcttgaggtacagctgcaaaaataagcaaatatgtttgtgactcggtaaattacaaaatgatgaacattaacatgcgtgtttattgaactactggtaaacgttgtgtgccctgcacggaattgtgagcttccatcttctgtacgcatcggaggaaccatttggctagatcctgcaaaccgcgcaaaccctccctgccattcactagtggtacttgcatgcagaataaaagggatcactgttgtactacctgcaataatctataggtgaatattgaattcaaaaatagcaccagttttgttcggaaaacaaaaggcaaaaccaccacctaattttggtatattccaaaaattagtccataaaaatagtgcgcattgtacttttaagtccctaaattgaattagcattgggtacaacaattaattctataagttaggccacttgtacttaaaaaaactgtgcatgaaaaagagctaaatttttggacgattttcataataatacgtagagcttttggtttaatttagagaaaggttaccataactataatgattaaaaataattcgtgcacctaatataattcatatgttttcatatacatagcttatagcaggttgattagagtcgtgcgaatgctagactatatacagtagtactagatgagaagttaacaagtcatccgtgtaaaaatattttgtgaaacagtttctacttggtatcaatgttaacccttgatgccactgtgatccacctgttgtaaaaggtttattgcagttgcatgaacatgtgttgttatcctcggttcccaatgttacctcatgagttataatgccaattgaagacccaaatccaccctttgctcgttgcctgttataagtataaaaaacaaatgaaaaacaaatcaaatccctccatcactgttgggctgatttcggcccatttcctacactcatccgctggtgggctgaaaacaaaatgggctaaaatcaccaaagactagagtccaataggtgggctgattttatccactttcctacaccctcctccctacaccctcctcctcaaatgggctgaaatcagcccaatactaattgaggtattttctctgcttttatgttttcaataatttctgaaattattattacactttaaaaattatcaatatagctccaaaaatttcaagaaaattccatagggtattttagttcatggagaatttcaaaaaattaactcgcaccatgatttcttaagaaaattttattcccttgttaatttcattagtttaattgatttgcacatttaatgaatcccttaatcgacttttaatttggtatttcaaaggttaagcaaaaattaaaatattattttaatatatgttcgttggtgtagtatccaaatgtaacaaatggttcacggatacatgttaatgtattcaatatttttacatataattttccgtgcgacatagctctaaatactattcaaatttatccacgtattatgtacaataaaacataatactaaattaattttgctagagatgacagcaaatttaaaaacataatagtaattaccaaatttaaacacataaaaatataaacatgcttacctctatgtctcctatttatttctcgtccttctccgaacttgtaatttctaaatttaatgcaccacgttcactcttataaccttgaaaataatgaagatatgttaataataaatcttgcaaaatccatactatttacaacaattccaaccgtcatgcaaattacctctaaattttgttctatcatttgtcttattcactgtcaaatggtactttgaactaaaaaaattcttaccacattcaattattcgcgtggcgcggctctaattactagttaaatttccccccttataatgtaccctaaaacataatactaaaaccattctatcttcatactaaattaatatattttttactcatttctctatctcattcagatatcgtacacacaactaaagaaatttcgaaatatatacatttctccccatggcctaacacaataaaaaaatttatgcacgtcttttgtacaataaaatataatactaaacccattctatattcaaactacattcatactatatatttattatatttattgacttctaacttaaatggtatctaaaatttctaaacataccatataaccgaactatttacatgtaatatatgcacactatctaaattattacttatccaatacactaataattacatctaatacataaaccatcactaaatatatacttaataatatttatattactaatttacctctatttcttctcttgttgcaagctcatcaaaacattaacatggttcttaaaatcccagataattacctgaagtggacatttttttccccacgaagaatagatgcaggaaggatactaaacgctgtagtcaaaacgtaccaaaccacaaagtcattaccccgttcatttgtcaactcattaactactcttgtgcaagtgaacattgatccatccatttctactgctgtacgaattacatgctccctccgtaaaaaaaaaatatttcctccatcccataatataagacataatcaaacttagcactgtcttcaaaactaattcttgaatttctcatatgctataaggtttattacaacaaaattataaccataaatttaaatgtgaatattccaatgatattaattttagcaaataaattttaatttatattataatagttgttggtcaaatatttttaaatttaaattttagaatattcgcacatcttatattatgagctagaggaagtaatataaacaacgaatttgaacaaccctataagagttcaaatcccatccgatattgcctttttttctaaaaaacggagggagtatcaacatacatctattttttttaaactacggcgggtttgaacactagcctgaactttattcatttggttaaaaaaacactttacaaaggggaggcacagagggagggggaaagaaactaaaaattaattacataaagatttagcgcacaagagtgaagttgttgtttgcctctaaaaaataaagtaactaaaaactctagccaactcccccgattattagctgaaaaacaatgggggtatttgtaaattttgccactaattatttcattttgtatttgggctacagccaggacagcctcctgagccgtccgatcgcgatccggaatcgatccaacggcttcgggggccacccccacatgcgacaatccgcatcttctcctcataaagcggtcagactcgtaatcccggaaaagttttcaccttttccctcccacctcgcctcgccatgctcacctcgccctcgtctccgatccactcctcctcctcctccacccgccgcgccatgagcccgtagcttacgtggcagcagcgagaaaccatgggcaggtcaagaggcaaggatggcggcgggaggtcgttcccgtcgccggcgtcgtcgtcgtcggcgtcgtcgtcggagttcgagttcacggtcacgctgtcgccggcgtcgaagcagaggtcggcggcgcagctgtgcccggcggacgagctgttctacaagggccagctcctgccgctgcagctgtcgccgcgcatctccatggtgcgcacgctgctgctctcgtcggcgtcgacctcctccgcgtcggcctccgactccacctccaactcgtcctcctcccgcgactccaacggcagcacgtcgtcgtccttctccgccgactgcgccgcgctgctgctcccggactctgccgcctcctcctcccgccccagctccgccaccgaggacgaccgccacctcgccccgccgccgccgccgccgggtgtcgctgcctcgttcgccgccaagcgcaccggcaagcagtacctctcgtcgttcgccacccgcttctcctccgtcttccaccgcggcggcgcccccgcccccgccgccgccgccgccaacgccaagaagccgccgtccaagtcgctcgccaaggaggtgatcaagaagtacgccaagaaggtgaagccgctgtacgagaagctctcccagatccccaagaatcagagcaacagcagcggccagccgctgcagcagcagcagcagcaggggttgaagaagccgttcagcttctcgatgcgcaagaagcgcggcgacgacgaccacgccgcagcggccccggccgcggcggccgccgtggccgcggaggtgggcggcggcggcaagtacgcgcactccaactccttctccgggaacctccggttcccgcgccagaagcggtgcgcggcgagctgcccgtcctcgatgcgctcctcgccgagccactccggcctgctcaccttcggcggcgcgggcggcgtcggcttccccgacgtgccagccgccgccgcggcggcgatgtccggcggcattagcgtgggccccgtgtcgctgtccacggcgtcgtcgatggaggagctccagagcgccatcgagggcgccatcgcgcactgcaagagcacaatgggcggcgccgtgaccatgtgctcgcgcaaggcggcggcggccgccgacgagatctgcgcgttctgagcgcacgtaggattcgggcggggacgaagctaagtaaggcggtttaatcgatagcattatgtgttaattttatgtgttttgttaattaattttgtgtcctcctggtaagactattaagtatgattatggtggtaaataagggtagtttcaaggggtaaaatgatatttggagcctttggaattttgatatctccctttattccaaaaatatggaatttgcgtcggcgccctccaaacatatcctctcattgcatcaaggacaaaaatttaagtttatgaggctagcaaactcaactagtcattaattcataaggagaaaattcagttggagatatttccaaatgtcttctgttttggaattaggaggattgatgtgtatgatatcttttgctacataaacaacaattagaacctgcctttgaaagattattatatggctgggaaatggatttcccaattcgagatttgccgattagaatccatgaaagtagctggtccatctagtggagtgtccctacagacttttggagcacaaagctgccaattttctatgatggagtcttcaaaaaaaaaactttctatgattgagggtgttgatgcaggtttcatttcctggaaaagggatttgcaaagttccttaggttaattagatcaggttttggaatctgatgtggcagtctgagcaagtgctgtcattttctttttgttgtgatttttgtctcaactatcaagacaagtgtttattaagctaattctaatataattttggcttttgtactttcacatcacatggtaacttgtatgatcattgtttcaaaataatcccctcatctgccccccaatctttggtgcttcattaaaggaattatgattgttaagcacatatgttcctttattgttcccttgattttgtatgacctctccatttctgtccagtgttcaccttaattggggatcatgtacctttttgtccccagttaattagccactcattttaccttaaatcctacaaaatctgctgctcattgctacaacttaaagtgctcatttccttgcaagttaatactaattctacaatacccgttaggtagattcccctggaactagttggacaccactgcgtgccaacacccacaagaagttagcagtagcagttggaagttggaaaacgattcccttgctagatctggctcacgcaaatgctgtttctttcacatgtcttgccctttggaatgcagtatacatttgctaatcaatggagttaattacaagtccttgtaccactagacatgttgacttgactgtttaaactggggtggtgccatatgaaggggtcattaacttcagcaatcattaataagtgccataatttttctcacctaaattatggcacttatgattgcataaactatattgaatgctagtaagaggggatgtgaggacacacaaggacatgggcaaactactgtatgcatagatcatgttcagagcaaaaatatgtacatgtacttgtgtcagctcctcctgtgattagatacgactaagcgtgatcatgcttagctagctgcaggtcatcatggttgtggttaagactgttacgatggaattaacaagggttttaaggataaacaaatgaggctagccatgttgctgtggctgtgatcgtctgatcgagcagcgagcagagagagattcctgcatctgcataggggaggagacgcggttgccgagggttaggtgccacatgcgagctggtggccgcgcccaagtagcgtgaatagtaaaaggcctagaaatagttaatgctcctctttagatgtgtgttgtgtgttgacgtcttgatatttataaatgggtgagcaacctgtcgagtgttgagagtgatcagtcaacattcaatgttaggagtagtggtggtagatgcaatgcaagcaagcatcaaagtttcccagcacaagcttcctctgcagtagtaggagtacactgcacttcaatttgcaagtaattactccagtactccatatagcactacacctatactgtaaaaaagaaaacaatttcattcattttcagaagtttgttttttcttaggagggagcaggctataatactaatatcattaacctttgttgatgagatgagtaatgagcttaattactctgtccgtacttcaatttgctataataacatgtaatcttaggggcgggggtgataagatggaaaaattaacatttaaccataatcaaaacgaggcttcgttaaaataccactccacgcttaggattcgtcaaatgccatttgcaatcgaggggttcacccaaataccattttgggtcaattatccctttcctcctgtcttttgctgaccaaaacgcctctggttgaatcaattcaagtggagcaaggaggcgaggaagtagcgggcaagcagcagggcagcaacgaaacggcgcgaagcagacaggggcggcacgagcacgaaccctagctcccaggccgctgctgtcctactcgagtaagaagatggggggaattttgatggtttgatcttcttcgattcaactatgagcattttggacaacagaaatgggagaaaagagagaattgaaagaaaatggtatttggacgaaaacctctaattgagagtggtattccgacgaattccaaccgcgaaatggtcttttggtgaagcctcattttaatgatgatggaatgttaattttctctcagatcatggcctcgtggggtttttattcagaaatggaagttttttattcagaaatgaccgatattgacttgatgaatcagtactaatcagcaactttgtagttagggggtgtttaggagagttgggctaaactttagcccctgcctctagagacttatgtttttagagaggggctaaagtttagtccctgcccttagagacttacgtttttagagagaggctaaagtttagctccactttaacccctccaaccaaacatcaccttaatccttcacgaacggttagatcagaagttgtcctgactcctgacaagaacatgtccaatttctccattcattctcctaacctaatcctaatcagcaaagccctgcaacttgtggcaatagctgtatcgccatcagtctatcacacagcctgaatgcctgtgacagaacagtgacattgcgtggctgcgtcagtgcctcacaggcctaactcctagtaacacttttatttaatctcctacagtgatcacctcggtctagctagttaattagcctgcggtaatcaatgtccctgcaagacagagtaccgcactagtgcactgcgttgcaatgctctggctcgaaaaaaccgtagctaaacgcctcgtttttgcagataaactggtagggggccaagccgtgtgtgttcttttgtacgcggcgtcaaaaccaacagatgctgcctcgatgaacaaaggtttttttttctttttttttcctgggctcggagcacgatgggtttgacggtgagctggccggcctcgccgtcgtcgggggcaccaattattggaacgcccgtgtagcccagccgctgccgttgaacacggttgcagttgttggtccgatcgagctgaagggcctctttacttcgcggaaaaaaaattatatgttatatcggatatttgatagaatattggaagtggttttcgaacacgaatagaaaaactaattttcctaacaaccgcaggacgaatcttttgagcttagttaatctatcattaggacttgtaagttaatgtagcacttatggctaattatgaattaattaggcttaaatgatttgtctcgcaatttctttcttatctgtgctactagttttttaatatatatttaatgctctatgtatgtgttaaagatttgatgtgatatttttaggaaaaacaatttaggaactaaattaggcctaagctagccgtggtggttttggaagttggaaaaaggaagacctgttgtgtacttgcattgttcgcgtttgtgttggcaaatgtggttttctggaagttggaaaaggcaatatggaagctactggcatatgaggccttttatcttctttgagcatacaccctctactctagaataaattcattttttacgtgaatttgaacatagccaaatgagtacgcgaatgagcatgtgccgatttgcgggaccaatactgcagcattgccgtggaaagaagaggggcgcgtatgtttggagtctttgaatttgacgtaactcctgtgtagagtggtcagtaaggttcatttgttttgtaaagcccccaagcggtcaagccgtgatggaatgtggagtagtggaccgggtgaatctcaactttgtgatcttctgctgtacgagttccacaatccactactccttccgtaaaaaaaatcaaaattagtaaggatgtaactattcgttcatatccacttaaagtaagttttcttagacagagagagtattgcctataaactcacacttctagggctgcagtattaggccatgtttgattcagcttggaattattataatatggattattaggagtaaactgaaataaacagttattatgatagattattacaatctataagccagattactataatttggtaagtcactttaaaggtgcttttttaattattgagtagctaatagctaacaaataactaataatccagagaaataaacagtagcagcttattctatgtcggcttattataatccaacttatagtaatctagttctatagtctatattacaataatcttaaactgaaacaaacaataccttagtttacattgaatcagttcgaatctttttttttttgagaattagttcgaagcacgtgcttttattaaaatcttaatccaaaccgggaaattggtagagtagcgtctcttctaaatactatatttgagagcaatttcttatttgtcgttcaaagattcatgcgatctccctaatctcacgtgtcaaagtcacaagggtgacaactaagggagtgtttgaggagaaggggattgagaagattgggaagatacgcaaaacgaggtgagccattagctcatgattaattgagtattaactattttaaattttaaaaatggattaatatgattttttaaagcaactttcttatagaatttttttttacgaaaaacgcaccgtttagtagtttgaaaagcgtgcgcgcggaaaacgagagccaatctcccctatcacccctaaacgaacgatgcctaatgagctaggagagcgagcagccaaaaccatggcggagctaccttttgcgcgggcgcgcagagcaacgaggaagccgcgcagcaacacgtgcgcgggcgcagctgagttcgggctgatatgaagaagctactcttctcttttcgtcctaaaataaataaattaaaaatatttaaatttataataatcaaatgtatcatatttttatagattatttattttgagatgtaagaattgtttcttccatctaggatggcaattttacccataggtccggtatacgtgaatacccgacccgatgggcatggacgtgggtgtgattttttatccatgggcacgcccgtccgagacccgaagacgttatgggcaataggcgggtttcattttttacccgtggataacccatgcccgactcgatacatatgtattagctaattttgactcatttattaattcttataccatttctctcggttcatttgcgatgctaactaatattaagttgtgatgtaattcaaattatcattgataaccgataatttggtaaattattgattttatttctctttgttaaattacatatctttcaagttattcatgtgagatccattggatacccgccggacatacccgcgcccgctgggcatgggtacgggcatggagttttgcccgctaactctagtggatagggtttaggcatgcaatgtcgggtatcgggtcgggcatggttttgctctacctatgcccgacccgactcattgccatccctacttccatccataaggatatacgtacacaacagagcatatgcatattgtcgacgtttgatgtctcgactacggtatttggacagtatggggatcgtcggtgctagggtatacgcgagactgaggtaaaagagatggagacagagatttttatacaggttcgggcccctgagctatcaggtaatagccctacatcctgttggccgaagccgatgttgctttttattcaccataatcacaccagtacaatatgtgggatagcctatctaacttttgtagacatggcggtctgaaggtttgactcgtagtcgacaacagggtagccttcctcctcgagctcacgcccgacgaaatcagagaccgtgctagatccctacggccggcctctgaaggtaccggatatggtcgatccaggcatatctctgatatcgatatccggcagcttgtcttggcgtatgtaggcttgtatgttgtggcttctggtgggtgttgattgtctcttcatggtgagtgtgtgtccccctgtccttctagggggcttgtatttataaccataggtgtacccttatccaagtagaactagggaaatcaatatggatacaatccgagtagtacttgtcgtttctatgtagaactctagttgtctttccatatccggaactccctcctatatccgtaggttatttccgtataggacatggtatgtgataggtcctaccgagatttagtcaactaattatgtggtatccataaccatgatacacatacagcggcaagcttacacatgctctcatcgatgatgtcccttctggttctgggactatctgtgcatgtaaaccgcgcgtggtcgacggatccaccgcagctgcccgccgttccttccatccaaattccgaaacccccacgcgtcacgtaccacacatctcaaagcgggtccaatcccaaacaaccaagtagtacaacgtacgatcgagctagcatagccaccaaaccgaaaatccgcctaggatccccccacacggctaggttcgccgctcctcgctcgcaccaccgatcgatccacgacgccgcccacacgcagacgcaggcgccccgcggcgcgcgctgctcgggccacgtcgtcgcgggcgccgagcaccaccaagatgctcgcgatccagccgcatgtgatgcagccacccaccccaacccaagcagcacatgcgacgcgacgcgagcgagccgacgcgcaggcggcgttcgcgcgggggggagggggaggtcggtcgccgggtcgacgggggggcgcggagcgcgtgaccgtgtgacgggaacagcgggagcagcgcgaccagaggtcacatgtgggcgatcggtttttggcctttcctgtccaagaaaggtcagcagctgcggtactagcctggggcgccggctcggatttccgatggatccagcagcgcggctccgtgtcgtcgtcctcctcctactactcctgctgcagagatgctcgtggcaacgtgtggcgttgcagatcatcacagtagtcagaaggagtagtacacgcatctcacacatgtcgtcgagtctgtgccaccccccaataatgcgcatgcgtatagtacctgttgggacttgtggagttgtggttctctgcggcatttgtggccttggttcgtctaccggcccggtgccagatgacatggactgagctggtggtgactagtcgagagatgttgcaggttgaaatgaactcctgccagagttcaggataatgacgatgatggtttcggtctctgactgagcaggggaatctagattcatgcaacctcctttgacaacaatgggggtaggattgcgcatgtttgatgtcaccgtcgcagaattcacggacaagagatgctttacaccttttcctgagagctttgacgataagacaaacaggcctaaaagggtgtaggataagatgatgtgaatttctgtgccaccgtcgcattcgtgggaaagtaagagtaaatcatgagagccacgggtgagtggcatttctttcttgctttgtttctaaaagagaccgactaacctaagactctgttggctagcatttgacatcatgtatgttatggttgatcccaaagacatgatagccttctggtgcacctttctttcagtggataattattgcatttgcactatttttggtctcccaatcattgagtaaatgtataattgtggtgtttagagaaatcaacacctactgaaaggagatcactggtctatgggtacccatgttactagcacagatcttcaaaacagaaactgtcaactaaagtatatggctggaggcccagatcagtaggaaaaatctcacatgtaccataacaccatcatccgcacagtccgattcaaactagccacaatttctatttcgcaagagtacgtatcctaatgtaggttcgcagctacagcaatgtccgcaacggtttacaaaaggtataagctggttacgagccagttgcaccgctggcagcaccatcagatttactcttctctgcgttagcagcatcatcagcattttctttactcctcctctgagttagcagcatcatcagcattttctttactcccctcctttgtgctaccagcatcagcgacattttcgttacccttctttgcgttagcagcatcagcggcatttttgtcaccgttctcctttgagataggagcatcagcggcattttctttacccttctcctttggtcgagctacaggaaaatcctcctcttgttgccgttgccatcggaaatttgcggcctcaatccagcgggggtggaccaaaaacttcttgttactaacagcccagcgagccttctccgttcctagatccaaagcaacaacatgggtgaccgtagaatccacatctgtgcagcaaacggcacccaactgctcggccatcttccagatcatctgatcttgttggcgctgatgtaacgggaatacacgcgtaaacactagtttgcagccttgaagtacttcctgccgtaccctcttgatcacctagagagggatatatacgtacaccaaccagatattagccaacgatttttttttaataaaaaaacagcactaaaggggatatatttagcactctgtagttcataaccatttgaaatattgatctacaccaaaactgaattttgtctatgttaagttcttttcatattgattgtacccctagatcttatcaatcaaaaatagctttacaggtaggaatgaataacgctgtccaagcaatggtaacatcaacttatacagtgtgaaaaaaatctgttgtaatgaataccactgtacaactaaaagatataatgtataataaagagcctgcagggtaattgcaagtcttgtagtctacctgtcttacatcccgtgaagaaagaggtttttgatcatcctacaagtgagatgtacagtagtacttgattagatgagaaaaaagaactttgaccttatatattactcaggtttatgcacaatagataatagaaagttgagattaatagacgataaaactgtgataagaccatgaacttaattagcctaccggatcaaagaaaattgtgtgtatgcgctccaagacatctaaaattgtagctaaagcaccatcattctccctttcgtcctgcattgtctctgacaaagatctggcaccaaaaccaaattggcgacaactagaagcaaaataatgatatctctccattagaatcagattttctttatgtttctgccacacctgaaaagaaaaaaaccatttaggccggatacacgatgtgcatcaatgtaaatgatgaattaattcagcccttcaacatttaaacaatacaggatgaatgtttctactgctgtgtagaagcaaacatagaacagtcagagaccaaaacaaactttcagtggccaaagtaaacattaactagttctaacaaactacagacggtaattactggcagtattatcatataaaatgtttatcaaccatgttcactggattatttgcacttacatactcagtgtcatcaagaatcactgcaacactttcatctccaagaaccacatcaagacctttctggtgtcgctgagtgcaatcagagttcgaaatcacctttgagccaaaatatacattatcagggtcaagaagttttgctatttcaattgcataagccttgtcacccatagtgtatatatacatctcaaacatatcacttgcttcttttaaaaatctacggacaaatggtctcaactttgtaagcatctgcattgtctccaatgtgaacaagcttctgtccggaacaactgcatttaagcatgtttctggttaagtaaaattgtagatgactaattcatggttaggcaacagatttaggaaggatcaaaccacaataaggtaatatggaagaatgcaacctcaccattaattagaatttagtgctaagtaataatgccataacttctatcataatagaagcaactagaattgatgttagttttacttttcagtgtctgcaagaagcaaccttcaccacaaattctaaatgtcataaaaatcacatttacagtgaaagaatatgacaaatagctatgacatttccgcagaattttcatatttcaatgtacattacaggccaacttttcccttttttttaaaatggactccaaacatacaaaaggaacatctagttttggactgaaggtagtatctctgtgctcatgtttacaaaatatcaaagtttgtaaatcaatagctaaaaacttacaaattctccaatttaaatacaaagacgtacacattaccttctttagcagcagattgaattcccaattcgttttcagcagcagaaagatcaaagagtttggttgagttgatcagtgtatgatccaagtccaaaatgagtactagttttctttctcgcaataaattctttaaatcagctccacgcagtctgtcaatttctgttgtacctagcctcaaaccctgcgttgaaataattctgttaaattcagataggacaattggaaataaaaatgtaactgggaaagataagaatatatcaagagatgcaatgcttgcataatactacgtactggaaagagtgtgattttgggaaaggtaaatgcaataaataagcattacaacacttgtattatagtaaggactgatttaagtcaaaggagccttaaaaattcaaagatattttccgcttcctgtttgaccgtaccttatggatgtaaccaaaagcaactcctggaacatcttcctcatcttgtcttttcccacatctatagcaaagtccaccaaaaaacccaggatgtggtgggcattcatcaattttaacatctttagaagaacctgcaacagtgtaccatctgctcatggaaataaaggaagtcttgacagaaggcaactgggactccatctaaaagtagaactgtagaagaaactgaagccaaatgtgaaaaactgatgttcctctctaaagtccagacacagcatggaacctcaacaattaaatgattaaaagcaataacatacacccccccccccaaaaaaaaaaaaaaaaaaaaactcctacgacacacacacaagaatggggacagtaaatctgtaaccacatcaactaaatagtatataaaaagtaaataaatttttgaacgcatttagtagataatcaactaatcaagtgccccccctccccctcctctatgaagccaaatgttagtgggttggaagtgaaacaaattagcataccaacggtatcctcatctgacttcattactactgcttgatgacggtgttggtcctccactctacgccgtttggtactgcatattgcatgccgttgacagcagtcagatccaaaatacaaaatccagaaaacagctcactattagtattttctaaacaaaaggacatggattgcatgttcagccaagctttagcatatccaataaatgaaaggaaaattttctatcataccatcaaataaccatttagttctatactatcggaattaaatttttacagtatgtattaatgacactcaaatagcaccccatttcatttaaacacaaccatcaaaagtgctcttttctgtcatgttgaccattttgccctcatccgcaaaaagaaaatttccctgcattcccacagctggttcttccctccccaactcatttcagtgccaagtcacttcaaactcaccaatgcacccccaagactgtcaatgtttacccaacgaatgtcaaaggcacggaccgcacagaagataagaagccatctccaacccctaatgggtgatagggaaccaagagcagcattgaaatggcaacttaggcatattatgattatattgtagtgtaccacaaaattccagtggtataaaacaagatcagtgatattttggtggtatacaaccaatttttccttaaaactatagcgcatttagttcaccaacatataggattcttactacagcgtaagcatatttggatggccagcttattataggatcaacatatgctaatacgtattgcctgccttcagcatataaagccataggtaggcaattaagctaccacaaatgagaaaattttcataccataccagaactaaggaagttgtggtatctattcaaatcgtagaaagcaatctcatgggatctactatttggatggactgtcattcacaatttcacaattgcagataagcaaatcacttgtaggtataatgaaatgaagtgcaggctacatgaacagtacggacttcaataaaccctagaaaaaatcccccgcgatgatgatcaaattcgttgccatcagcattcgcacaactgaatccagcaaccatcgcaattcaagcggaacaggagcgaagaccctcgagcacccatctaaccggcccaatcaaacagtaaaaccctaacaggttcgaatggggaccaaatctgctcgccgtcaccgaccgtccaacaccgaaagcgcgaggagcacagagcccccgagcgcctcaagccgccgccatacccaactcgaccggctcctcgcccctcgggacgaggtgagagtacggagaggcgcgtacctgctctgctctacgatggcgtcctcttgttccacgaccaccaccacatcctcctcctcctcgtcaccaccttcgtcgtcgtcgtcggtggcggcggaggggtctccggcggaggccgagtcggcggcggaggtcagctcgagctccgcgtcgaggagcgccgcgaagtcgtcgctgccgctcgacgacgacggggaggacggcgacggcgactcggcggcgaggctcatgaccgagggcaaaggggcgagctttggtcggttggggtgggtggatgcgcaagtgttgtgtaataaatcatagggggaagaaaagctggcccgccagaagaaggcctccgtttgggcctcgtttgggccatcatctcaggtgaaacggcccatgatgccgcgagatctcccggcggcgggataagttcaatttgtctctcttaaccagtggccgaatcttatttgtatccttaaatcacaataccaaatatgtagaccctgaactattaaaaccggtgcaatttgactctctcgacggttttggagggtggtttcgttgactacgtggcggtgttaccttttctacgttctacgtgacgttgaccggatgaggcaacgcgcggggcgccgactccaacgcgaggcttcggcttgtgacttcgcggctcccgagcccagacgcgacgcttgcaccggttcctctgcaagctcactgacagcctgcgagaccacccaaactcgtgccagctcggctcggttccgatgtggagttttgagaccacagtccagggtcacgcgttttacatgacctaagttcgaaagcttgctggttcccacgcgattgacgatggattaattaaaaacttactcaaacacggatgacgtatcaaaatcttagcaaaaacatcttaaatttttataatagtagagatttactaataaaaataggaaacatatcctatgcacacaagatttccgtgcacaccaactggcaaatatcacgaaaaattctaaaaaaaatttggacatttactcataatagtactacacatatctgcaaaatctcatatttaaattcattatattttagccgtagcaaaaaagtgaaaaatctgacagatttaaggataaaaatttgtcagaattttatctttttttgttacggttaaaatataatgaatttgaagataagatttcacatgtaggtgtaaaactattggaagtatgtgtccaattttctagaattttctgtgatatttactagttggtgtacacgaagtgtccacgggaagcttgtatgcataggatatgttcccaataaaatatttttacaaaaatttggttttaaagtttttatccttgctaaaattacacccctaacgttatatgggaggctttttatgccgtggcacatatcctttggtatgctgtaataattgagcgattgataggtggtccccttgcagctcttaggagggtggcaaacgagttgcctgtaaaatagcgacatacgatattttgcaaggtcctggctataaatggccaaccctggtcattttataggtggtctctgtaaccctttgggagagcggcaaggagttgcttgcaaaatgaccggttatccttcatcactcgatgtgaccgttacaatgtgtcaatggacgtgtgccacgtcataaaaaatgcattttggaagggagaggagttagggatatagaattgtaaaacttgaaaaccagtttgttttaaaatattttaataagagtaaattgcattggagatacataaacttgttagatgggtacaatttaatgcataaacttgtgaaatgctcgtttcagtacacaaacttgtctagttagtgcgaacgaggaccaaaataacttggcaatattaattttacaaagctgatgttgattaagaattgtgacgtgcatacgtgtagtgagtatgcataaaaaaagcaatatttataaatttggtctctactttatccttcatcatcgaaatgatgaattccatatatcctgattggatttttttatcactgttggatttttttaatctttttctactattactatatcctattcttttttttattgaagatgtgtatgtctagtagcaaccttctctgatatatgtctacatagcatcctaatcaacttctaaatcaataagattagccatgcagtgtccttttcgtcttcccccgcatgcaccagacaagttcatgcaccaaaataaacattttacaagtttgtgcactaaattgcacccacctgacaagttcgtgtaccagcaatgcaatttactcttttaataagtaaaattaaaaattaaaaagggaaatccgagatctcccgacggcggcgcgtgtttcgcctgcgccgatggcggcagttggcgcggacgcccgacacgagatcgccgacgcgatcgcgcattcgcgccgcgcccaccagcagagcagaagtgcaggggagaccgagtggaggagccggttgggcatggagaccagggaggaatcccacgatgccagcgtcagacgagagctttgtcaacgacaacgacaaacgccgacgcgacgcgcgatatccccccagccttaacttaagatcgacgtcacgtcgtcgtcgccgtggagaaaacaatccccagagttggaaggcgtggagttgacctgacgcgggaggttgtgagaaactgagaaccaaccaaccaaccgctgagctgcacgcgtggttgccggagattttgctgctcgattcctgcactaccgctgctgcttccttttcgcgtgcgtcggcagctagcgcgcgcagcagcgagcttgtgctgaatacggcagtattgctcgctgtcgcgtggcgcgcgcactcgcgtagtacaccgtcgcgagcacgcacgcacgcgcattgcctcgatcgatcgagccctctcgacgggagttttctttttgtcgccggtgtgtctctccttttgtttactccctcgtgggctcctgtcaatcgtcatgtgcaaagccggtcagatagatagatagatattcagatgtttcgtcttttctcaggccgggagaggaagacaggaagagacgtcgaattgcacgtgttgtgtgcagccatgcaggtgtcaatacatgtgtgatgtgtctactaccaatcgcatgacctggtcgctcctttcctcgtttgttcaagtttaaccagtaaccacaccgacaccacgcgaggtccaattaagttcaatttcgctttggttttatatcattgatatgtatgcatggctgattgtttcgctttggttttattgagtttatgattaaacaaattaccaacttcaagcagtaccagagctagaggcactatcgaccctaggcgactaatatcgctcctaggtggctaggtgtccgatcacttcttgttgatatcgatggcaccctgcacccgatagagcaatctgcagtggagatgtaatgcgcaaattaagctagcttgggtggccgtccaactatggcctagctacgatacttcaagatttatcagattttgaggggaaaacattaaaattgtggtggttaagtatcatagtatatctattaagtttacttattagggtttaaaattctcgtgcgagtagcctttggatagatatcatgtgaggtccataaaaaaaattattaagcgctatctaatgtgaaaatgcaagtgtcggacgtccaatggacccgagaaaaatcgggcgccgcaccgcccgccgcccacgcgcgtgctccaggcgtccccaccacgctccacgtgtcccccaccacacgcgtccccgttacaacagtcgtccggatataacagaaacaccctattaagggaatccgttttatttttttccaccaacaatatttcagcaagtgaactcgtgatgtttcattatgcatgaataaaatgttgcagtgggttttttatactgtttaatattttccatcttgatggacacgtgggttgttgatatacacggggtttaagtgttgaatggcttcgaatcattcgttgcatacgttgaacaaaattgtttcatctagcgatctgaccgtgtttcacttttttaaagaattgaaacattctttcgctatttgctgaaactttatttttatatagggtaaaagagcgtctgattttttggaacccgttgtttcatatgttgtagcaaaatgtttcatgaggtaatttagttgtgtttcaactttttaaaagactgaaacattttcgatctatttagtgaaacatattctgtcagggttacggataaggtataccctctatccttggatatacgttgtatgctgacacagtatacctgtgcgtatacggatatttcctgtatatattaagaaaatctatcacgagatagaaacggagtccacagatggagggagttctactcggacaagactgggtcgttaccatatcgtgaggggtccgatatctccgagtcccacttggagatcaactgatccgcggtataaaagggaccccccgggcaggacctaagacatcgaatctcactgccaacacatacaccacagcctacgaagccggagcctacaggagccaagtcgccgggtgatctagtcgaaccaacttgactacgatctcgtcggtatcattgagttccattattccctttgtaatatgtgacttccatcatataatcccataccaactggattagggctattacctatcaaggggcctaaaccagtataatccttgtcttctatttgcttgatgtcgtattacgtagatcctcgtaccagcgtaccccaataccctctatatccggtctacgggtatcccccgtcgacatattcgatctttcaaaaatcgggcgctcgatttataggcgcctcctatctattgagcatataaaaaagggtgtatttgtactttgggtttgttggaaccatgccaccctatatttgcaaaatttgagatatgccacccgtatctcaatgacatataggacccacatgaatcgatgacatgtgggtcagggtggcatatcacaaattttgcaaaatttgtgtggcatggttcaaattgtcccttgtacttgtgtgacggtggtgtgcctccttcctgctacaaggaaaaaaagattagattttgagatgagccaagttctttaggacagatcagtatctagcttgtgtgaaatgtcggcatggtccctttcctcatttttcatgtttaaccacagtaatatccacaccacccctaaggtctaaggattttgatgtgcaaggctggttgcgtaacttaacttggtttcattggacttaccctcttcagatcaaattttctaggtggtttaaacatatagagttacgagatgacgatttgacgactccgtgttgatgcgcggagcaattttggacgctaacgtcatgacgtagaaatgatcaattttcagaatgaccttgatttcactaggttgattcacttttgtagaactgaatgaatgatcaatacagtgaatcggtaaagaaagataactattgccctaacctaatgctcggtaggaaaaaagacctaaagaaaggttttgtcagttgtgttgctaactccaatttgctacggaagtgaccctttctatttatttatttatttatagagatgactacactcgcgaaaacaaacactttgcacacgcaaaagtaaccaaagcctaaaactaaagcctgacataattttttgcgtaacttcacatagttgaaaactatataactctatcttcatttagatataaccaaaccaaattatgattaccaattgccttttcacattgtttggtcgtattctcaaatatagcgtgcgctctctctctctctcctataggaggatctctatcacatttaacagtttgttttttgaaactatcaaatacaactatattataattaaaacgtaaccctacatacattgtaattaatttgtaacatttatatacttcattgaaatgtgtatgtgggcaactggttagcagcacgaaccattgtcctacaaagcgggagtttgacttccactagcgtgagtcggataatttttctcggaaaatgctagggatcgggcgcccgccgcttcccgcgcctccgcgcgggcctccgtgccgtccccaccatgcgccccactacatgcgccgttgcaataaattgcctacatattatggaaacgctctattaagggaatccgttttaatttttgttctaccaacaatgtttcagtcagtgtactcgtgatgtttcactatgtatagatcaaatgttgcagtgaattaaaacatcctttcgctatttgttataacattgtttttatatatggtgaaacaacacctgattttttggaaaccgtttgtttcatgcattatagcaaaatgttccaagaggtgatttagttgtgcttcagctttttaaacgattgaaacattttcggtctatatagtgaaacaattctgatctatttggtggaacaacgtccgatttataggcgcctcgatttttctcctgccttgcatgaatctagagagaatacgacggtaaaaaaaaatcaaaagcgttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11128 - DNA, 373 bp, Oryza sativa
ccaccagagctggctcctacacctgcccgctgtgaccaggatattactcaccactggatctccttcagcggtcggcccagctctgtaagcagcagtagcagcacttcctccgaccagaggcttctagatcacatggctccaccgcccgtggctgagcaagcctcacccagggctgtgcgcctccagcccaaggtggttcactgtaagccgctggacctcaaaggcccgacagctccgccagagctagacaagcacttcttgctgtgtgaggcctgtggaaaagtgtaagtgcaaagagtgtgcgtcccctcggacgttaccccttcttgtggggtctgaaaccaggagtgcctgtgctcggctcagacgctgg

SEQ ID NO: 11129 - DNA, 1969 bp, Oryza sativa
ctaacatagccacataattatcaattatattaaataatagtatggttaaaaaatgctcttaatatgaacaggcccttaattaggaaccagatccagaaaccctgaaaggctaagcctagttaagttaattatgtttacacagaaaccaagcagtaggtcattgtcaaatgacaaattaacatggccaaatagatcaacgtcacttcttctgcctgttaaagatcattggttcaattgggatgtaacgtggcagtaactaggtttagttaaggttcacttagtttgacctctttgtcaaagcatccatgatccatgtggctccggcaggaagtacagcaagtgaacaccagttggtacgaaaagatgactacttagttatctaagctcttatttttacaatttaattagcatttgatggaaggcactatccctactggcaatcacgatgagatagaacctttaaactaatcacagagatcacaatcaatcgacgctctggtcaggagttagttatggggaatatagaagtacatgcatatgcagcaaccaattaagagaatcttgtgctttcttaatgctccctcttagacttctttatactctgcttattttttgtgtttttctttttttttctttcgaaacatgacatgttttatgttaaatgaaagagagagaaatattatttggtggccacctttttcaatttagtgctgaacaaaaatactattgtgttcctgataaatcattttcagagtggctgtgttctttgggtgactgtgagtgagtttgtttcgttttccgtatgcacgcttcccgaactactaaacggtgtgtgttttgcaaaaattttctataggaaagttgctttaaaaaatcatattaatctatttttgaagtttaaaatagttaatactcaattaatcatgcgctaatggctcaccttgttttgcgtatcttcccaatcttctctatctccttctcctcaaacacagacgtgtttacttacattaaaattttataaaaaaaaatattctgagttaagcagaaaatatatatttcccctatcactatggtgaaatggtgattaattactgaaaattgtgaaatactcctaccttttagtggatggagtttgaatttgttccatatgcaacaaattaaccaacaaacaaatgtttttagttccggtcttgatcaccctttcataattcagatgagcatccgctccaaagcagtctgagggcgccatcgttttgcagttgctgctgcttttcagcagtactagcctgatgcttataagcatcaacaattatattgttttgcttatggctgattactggatcttctgtgaactgatgcattgcctctgcttgcctacctctgtgtgcgttgtgtgctcgtcagcactgactatagatgcgtggccgtagatagatcccgacatgtatagagcccactaccaatagctgttcgcatttaggccgtaacagcgaaccgatgcgcttctgctgcaaaacagcaaccgcaaaagcgaaccgatggcagcctcacagttagtaagctcaacccttttcttaacaatcctattgtaacatggtcaagaagctttgcaaaattggaaagttctggaataatttcatacaagtagcggtagctgaaacatataaacaaccataacaaaggagcatgatgcaccctgaatttttaaaattctataagctggaaaattctaagcaagaaaaccataataagttaagaagaaaactgcagcagggaacaaaatgcattactcctgttatagggtttagctagtatgggacacagagaaagaaaagtatgaaattaaccccaaaccaacagtattgttagttttaaagacaaacgttgtaataagtaatatatttgatcatgtgactatatataccttcatatttaatagagattattggaaatataagcatttcaccac

SEQ ID NO: 11130 - DNA, 8103 bp, Oryza sativa
atatttaatagagattattggaaatataagcatttcaccacaatatttaactctgagataaacagactaaaccatgatagcgtaaatgtaaatcatgataacgtgaaccatagacggattactctcaataataagaatacacaaaatagacatggtatatgtgtaaaccaaagaaacaaaaatatctaactcatttgcgcataaaaactgaatcaaccgaaagcaacaaaagagaaaaataatatgcggtgttgtaacattatttgcaatggtagtgtaaggagaatttttctgttgccgttcccgccatcagaaccgctaccattgcactcccgttctcgccaacaatagttctcatgaagagaaagtagtcgatgtagtcgttcactggaaccagcgagcagtcgcatgatgtgctccaaaaacctaatccgccgcctcctctcagtgcaatatcaaggagacaagggttcccgaggcctgctttcctagtgctgtgcatacactcatggggataggaagacctagcaacggcattagtttgattcaaaggttttggcgtatccctcgtggtgagtaaacatgatgagtaatcagtccattttataggattactcaagaatatgaggaatagtcaaagagagggaaaacaatggacaattgattactcgcgtaacaatcatccatttctctcctactctaattgagtaacaaccgaaggcgaagggcaatggtcacttcgtttatgtcaacagtagttgtgcaatgtaaaccccatcgtttacttcaaaaccaactgcgtaacttaagctatccatatactagccgtgcaaagcaattatgcattgataacgacttcagtaatatgtctgatagtgttactgtatcttgatatttattggagatattgctatttagtggtaagaatagatgcatatagcaattatgcatactgcttggggtcagaattttttttttgtgaactttagttcctgtacagttgagttctgcatttgagtatgtcatcatatgagttgagtttcttttaatctaaatcgtagtacaatatccatatgaatttgacagaacagtgcatatattgttttttgcatgatgatgactttcttaacgataattaactggaagtttttctttcgatttattgtctatttatgttctttaagattaatcccttgaattattatgtttcactgtgctacatataaatataagtggtcaatcttacataccactaaaggtttcaaaagaaaaaaaaaatgtgactacctcttcatcctaagacattaggccctgttggggcagctcctgatattaaagtttctcccaaaatctccagctccccaaacggtccagatttcagaatttatagttatagaatccaataaataaactagaaacaatccaataaataaactagaaactagattttcactagctaaaaattgaatatcatgctaaaaatttgttacacacccaaaagcacagaaatattaatgccacgtctcatttttatataagagtccatgtcatataattaatttttgcattcaaaatcaacgtagaatacattacacagtttacttacattaatcttttgtaagtattctgagccatgcagtgaaaatttcttttatacgacatggtgattactgaaaattgtgacataacttttaggtaatggaatttgagtttttgtggcatctgcaacaaaacaacaaatgtttttagttgttgtgctgagtcatcatcctgtcacatgttcaactcttctccaaaccaagctaaaaaacaatactccaaagctcaactattttttaacaatcctatcgtgacatggtcgatgaagaagctttgcaatggaaacttctagaattattttgtacaagttagttggtgaagcgtatacatacaaaaaaaaaagcacaaaatgatgcatatttgtatgactttctttttcattttgtcagaggcaagctgaaaagttctagccaggaacaaacatcagaagttaagaagaaaattctagggacaaatgtgccctactactatgaaaaagcagatgaaaggataggaacagatcagaaaggaaagcctaatatccacaaaaacatagaatattatcaatcgtttaagagaaatgaagtaatatatctgacaatttactataccttaagatttatcagagatggtgctatttagtgataagaataatagcataaacgatgcagtcatgcatgtcggcttggattttaggatttttttctgtgtttgtgaaatttagtttccacactatttgattttgcatctgagattggcatgaaaaatacatgttgagtttttttcatctaagttgctgtcaatctccatttgaattcgacattacaatatatatgataattgttctacatgatgttgaataaattggaaacttctttgaactaatattttctagttatatgttcctcaagcaagtcattcatatactatcatggttcattatgtttcatattaaaaacataaaaatactacaaatatacaaaatcaactgaattgtatagacattcaattattctctgactttgcatttgtacataattggtcttacatactgacttatcaaggtcgatcctgagctcctttaatttgtaatgcagggatgcaagattcatgttagaactggttaccagttcaattttctacattccctatttaaactcacacattatgaatcaaaagcatgagattgagcattattaattgtaacaattatttaacatggccgatataagcatcttctgaatagaaagttgttgaaccatactcccgatgcatgacacactatcgacggttgaacctgaaaaaaaaaaagaacaggttgcatgacatctcttcatattaaagctctcatcatagaaaagagacagacagatgaacctccaccggaagcaatgcatacataccaacttgaaaaaaataaataaagagaaagatgaactccaggtagcaaaaaataaaaaatattccctcctcctcccctgccacagctaacaccactcaacaacataaaagaaagaggacagaggaattgaaaaggactagctaagctagggcaagttgggaggaggagagactacttcaggctttggctaatatatggcatcacatgattggatgtcatggtttttattcctcatcttgtgaagcgtcagagaagtttaatagtatagctaactaatagctattatctcatgttatagctaacatatacagtagattaattaacttataaggttggctcaatttaatttttctctcatctttctttctcactacgaatttagcgtaaatatcttaaaacatgtgtatagttagttctatcatgaaaaccaactctcgtcacttttctttatctctctttcatataagtttatagttatcgtatatctcactatatataatcctgcatatgctacctcagcagctagcaaattaaggagagaatagttaaacagccatagggcaggtcagctccaagctaggggcgctgatcgagcagctggtggtggccacgttccggcgcgtgctggcacgggcacctcacgcggcggcgcgagcgctgccacgcagctgtgctgtccaagctcgccgtcgagattggctaggatttcgatggtttgttagagaataaaatatgattaatattttatgtgtgacttgtcattttaatttttttttatatttttttcaaataaaacggacggtcaaacgttgaatagaaaattagggtttgtcgtttttttaatggagagattacgtcacttcaccggccagtttgttttaatttactgccagaatgtatgcggtacggtggctgctgttgcattgcatcaggttaggagatttcatcaggaagataacatataagtatatcgtcagcactcagcaaatggcaaagttgcagccgttgtgctgaccgcggccttcgttcgactctattctcgactgcgttcacccaacttagcgagtgttatctaggggtataaagttttggcgtgtcacattgggtattatatagggtgtcgtatggggtgtttgggcgctaataaaaaaactaattacggaatccgtcggtaaaccgcgagacgaatttattaagcctaattaatccgtcattagcaaatatttactgtagcaccacattgtcaaatcatggagcaataggcttaaaagattcgtctcgcaaattagtcgcactatgtgcaattagttagcatatatttaatacttcatgtaggtgttcaaacgttcgatgcgatatggtgtaaaattttagtgtgggatctaaacacccccttaataaaattcacactggggttttccccatgcctcttcatctaatatctgtgaaatggcatccattggttaccgtgctcaagtagcatcactgaaaaaaaaattcacttgccgatccttataaaaatacgtgtcaaaatttgacctatagaggatgggccctcgtgtaggagcaggggcctaggtttgtggctttactcaaccggtttggttaaaagtttattcttcttaacaaaaagccatggggtggtcatttctccgttggtcgagtttatttctctagcaaattttaaaattgtgcatacaccatatggcaagatgtagtaagtgtgctgcctgcggcccatactcaaatctccataacactcttactctcaataaaattatcgttaggtttctccttttgtacgggtcttttcaagtaaatttcacaaaattgtagattctttaaccaaactatcacaaatatatatagagagagagagaaagatcgaagatattgtatcataaaactatagacttggtattaaatttattagaaaactacgtatttaagatgtctctgtcgatggggaataccctagaccggatgaatagggtattagggtacgttggtatgaggatctacacgatacgacctcaagcaaacaagaagacaaggattatactggtttaagcccctcgtaaggtaatagccctaatccagtttatatgagattaatatggaaagaccatagattacaatagagaactggcgattccgagattaccggcgagatcccttgtcgagatggtttcgacgagatctcccggcgggtaggtttcacgtcctcttgtaggctatggtggttgtgttggcactatgattcgatcccccaaccccttaggaggtgtgccttttataccgtgaatcacctcagtttccaagtagaactcggaaactatggacccgtacgatataatataaacctaaacctaatcctctccgagaaggactatgatattcacttgtctgtgaatataatttccacaatatcttgttaatttccttatcatatatgaaaatcatatcatacgcacgaaggtataccgtatccgtatattccataagtcatatgataggaggtatgccttatccgtaaccatgacagtatcagagaactacagattaagcattaactttataaaaaaattatattattttaaagctaagtatcagaaaactactgaccctagagtataaaactctatcactacttctatgttggagctataaacggtgtaactttacaaactaaacctgtagttttattataactttaatattaaatttgtagttttataatacctcatcttaattaaatatgtatttccgtggtaaattactactaaatgtttagtacaacactttaaacttatttttttgataatttaattcaagtatccgttaattttacgaaatttattttctctctctctcgatcatcagcaagatagtaaggcatgttttgtgcatgcagattcatgctgagcttgatctgacaagagaaccatcgaatacagtatactcgtagtcgcatcagatgttcacatcagtgatggcgagttaaaggttttggatgtgtctgcaggctgcagctctgcatgcgtatgattaactgaacatttaagtatttgacaggctcaaaccatgccaccaatgtgttcaggtaatggtccgacgtgtgatcagttccggcctggccagacatgcacacatatgatgccctttatttctttttcagatgaaaggcatggaaaggtttctctccaggatattgccgggtagaatgtagcatttgcttagagtcattagaaaataaagaaaagtttaatccttaacagtctagggatgaaatatggatgtgctctcaaattaagttcagctcttaatgcatgtgctcgagtcgcacgttcaaaatacatgattaaaaaaatagaggaaagaactcaaatttataacacagaaatgatcattcgattagaccatggaaaaatacaggaattatatgagagatactctaaggggattgtcccagagatttgagctcttattatttttctccaaaatctctatataattgtctatttcataggaatttcaagcaaaatgatagaattcaatccttcgtttccaatatttatatatgattttttcaataggattaaaatcatccaaactccctatgcctttccttttcctgcaaattaaagggaccattatggaaaccaaatcgatttctaggttttccagctgaaaataattggttttctctacttccatcacatctataagattaatctgcatagtcatgtaaatgtgaatcttttctaaaattcgtatccttggcacttgtttgtgcacatgcccgctcaacacagcggcagtatgataaccaagacacatacgcatatcagacaaaaaaaaacagtctatccgtactaaaacagataaacagaccactcaagtctgaaacgaacatttcctaaagattcagaaattctagttctttgtttactcctagcttcctttcatttcactgttctgtcacaaatcacaggaaacaaaatactcatcgccattaacaggaaaatatttctacagtttcctttgcctacagatttctatttgcaagtgttcactgttcagcatacaagttaaagggcatggtggagctacagattacgccagctatgtacaacacatacataggttcccaatgtttgtagccgttagatcagaaagtaattaggtcatcgtttcctagaccgctgcttgacatcaaactagttgtcttcgtcgagctcatcatcaatatcatcaagaattgactggttaatcttctttcttgatacccttctgtgctttttgagttgaagacgaggctctgcttgctttacacccatgacacctgttttgtatctgaagcaagacgtatatgttttcattgttaggaacttaggatagcaagatttagcatatcaatatcccatcttaaatagaaactgtgacacaagatcaatatcaaggtgaaaaatcgtatgcgagttatgtgattttttttctttttcagttaaggccagtacagatcaatatattttctcacaaagtatagattgtggatttgtggagcaccgtcactcttgcataggtggagctagctaggtggcactgtggtccatgaaacatattatgatttgactcaaggttataactatagtatatatattgcctaacatcataaaaagttacatatggaccaccatttgatctggctcattacatctagatggaccacctttgctctaaatccaagctacgccactcttggtggacatagaatttgaaaaccatggcttaaagaacataaacattgtcattggtgtaaaaagtaaatttagcttcataagtcatcaaacctaacaccgtactagtgcaagagaaggcatgaaacatccatcacgaaaaataattaagaaataaatacatcttgatagcatacctgacatcaccctctctttttgttccaaatgttcttaactggaatgattctctgattttgatttcatcaagcaactgtagatagtatggatacctttcccagtcacctttcacaacacatccacgctcaccaaggtgaacacagtcattaaataaacattttgagggctcattctctgcaagcatct

SEQ ID NO: 11131 - DNA, 3687 bp, Oryza sativa
aatgaaacatgacgtgttgtgtgctttcctttaccgcttttcttcgacccggtaccgacccgttgttccccaaaccatttcctattctgaaagcgatgtgcgcaagaaagagacttcagtgtccacatcaagaaaggatttgacactgttagattttacaggaacaacttgcgtcattttataacaatgataggagaagaagatgccaaatctaactgacgtatgatttctaaggtgtcgagaatttctaggatgttcatatcaagtgtgggtcacgttacatcattctgattctttgcacgattagtgcctctccaagccaaacttaacaaataatgtgtgaatccctaacattattgtcagcatttaactattaagaatgactaatcgatcactctgtagtagggagcacatggtttttttttattagccatgcaacatggatggtaaagtgcatgtcccaaaatgcaatatactatctattacttttagttctaaatttatgtgttttactccaatccaagattcagaatttctttcaagaatcatcttcattacaacaagactaagaaggtaaatcgatagcaaatattaactggttatatttgtcaacagcttgtccacttgttgcactcaatctttcagtttgctgcaaaccatcttcgtttttgttgcaatgaagttttagctttgcttcatgaaacatggctatatgggaatgacagtactgggcatatatatatataaatcggttccgactgttgcagtaggaattttctttagtgcatatcataacttcttttattgctggaactatgttttgttgcaatagcatattcacctctttatgtgggagagcccttttttttttcttattgcaactaatatgctatttgttgtggaagaaatttccttattttcttagcctatatgatttgttgttatcattgtccctacatatatttgtcacaattgtatatttggtttacttgtatggcacataaaaaggagtagaaagataaggggaaccttctctgtgataacatgaaaaaaaaatcatatgtaaacatgccaggcccaccaaaaaaaatccatcataatagtggaggcagaaatatcaatgttagacccatcagaaaatgttgaaaacttgtagcagttattcgcccataagaaacctattactgaaagcatgtgcaaaaggaagctcataagaaataacacgaaattttaattgatgaaatatgcagcaagttgctttcgtttttgcacgaaaagaaggctacagcttgcaattctattaacagaaagtgcatactcgttttctctgcgacacatgtgcaccatagataacctatgatgacactacatttgcaagtcaaaattagccctcaattcttaataagatgcaaagtttaataaaattcataatccaataggcaggatcttgtgggtagctaaaatccattaaatgcagtccgaggagctcatcactaattcgttacccaacaaagagcaaagaaacaatcactaaaaatgtaaaaggtcagagtggaagggtaattgttgaaataattgaagcaggtaaaggaaatgaatgacataatagctacctgctcaactagtttatgtatgggatcttcttctgagatgttctggttgcttctcaaagcattgatcagactggactttccaacaccgcttggaccaacaattacagttgtctgtccttccaatgtttcttcaagagcggataatcctgatttctgatcaacacttaaaaatagtggatcgtatccccaactcttcatcctatctctccagtatgatatggtctgcatacagattaatataagtaatgatctgaactatgtaaatatgaagtgaggaaaaacatgagacagcacacaataaatggactatcctgtaaaaaacaagtggaactatgattccatcatgatgatttaaaaaataatggagaaaattatataatgtttaagtaaaaaagatgtactcatgtacaggcatctgagtgttttagtaaacataccagcatcaaacttagcgcccattgttagcatttaccattatcagctaaacacaaagaacataaacactattgtttggtgaatcgaaaggaacatggtccccaggatgtctagattaatgtgtacatgttggatgaatcagggaatcaatattatgtcccaaccatgcttactattggcctgtttggtcttttactcaaaaaggttcccgtagtggcacatttgcataacaaagtatttagttgaaagtcacacgacatccatctgatacagctaaaataacatttctttcattcaacatgagaacaccagagcaacagaaaaaggtggttgctgttcctgatatacttttgtcccttcaatttttcttagagaaatgaatgtccaattctgataaaaaggaagttgaaccagtgatatgtatgctattgtgctgagcatattagtcccactggctcagtgagtcagtgcaaccatcttcaatcttcctaagaagtaaacgcaccaggcgccagggacaacacccaatgtcctattgaaactgaaataagttcttcctctacattttcaagacacctaatgccctattgaaaataagttcttcctctacattttcaagggcagcggtgatcccaaaacggggcacggtgggctcaagcccctcctacagttggtcaatcgagcatataatatatatttcaattgtagacatgtttatgcttgctagagagaaggaaaggtaaacaatgaaaacataatttggttctctaatttttttaacaactactacctctgtttcaggttataagattcattaacatatatataaatgtggacaatgctagaaagtcttataatatgaaacggaggaagtactatatattcccatgtatacttatattagtttacctcgttccattggcaaccccctaaaatttggtcctacgttccccactgttcagggggaaaacatttcatttgtctcttatatattgacgatgtcatggcaaattacgaaatgagcatcagtacatcataatccgtagttcaatcaccaatgcaatgaagaatgaactatacagcgcaacaaagaggtaacaatttagtaagcaattgaaatcgaagaagcaattgttggctaccttgtcgtccacaagctcgaccttgttgaagacgagcacgaaaggtatcccggtggactcggcgtcgacgaggaacctggtgagcgtagcgggctcgggctggggctggtcgagggcgaagaggaggacgaggcggtcgacgttggcgacgggcgggtcggccacctcggcgcggcgctcgaagacgccctcgatcaccccgcggccgccggcccagtcgacggccccgatgagcaccctgtccccgacgaggacgcggcggcggatcttcttgaggagggcgcgcaccacgcacagcaggtccccggccgggcgcgccccctccaccccgcgcggggcggcgccgacgatcacccgcatgaagttggcctgcgacgccgccaccagccccgtcgcctggtccgggagcagctcgtccggggatgacggcggcggggggaggggcgccgccgcccccacggggagcaaccgcaggtggagggggccctggtgggagg

SEQ ID NO: 11132 - DNA, 29470 bp, Oryza sativa
ggaggagcggcatttcgcggcggcgcggcggggggtttttgggtgaggcgcggcgcgcaccgcacgcacgcacgcgacgccggggggcggatttttctggtgacgcggggggtttcgcggggggtcgaggattttcgcgtgatttcgcgtggaattctcgcggtgtgcggtgtgcggatgccgtggggtaaggctggctgacaaccgtggtttaccaaacatttcgaagtaggttaccgtcgcccagcggttcgacggttatcgtaataaccacgtgattactgtaagttataccgtagtttcaaaaactgaaaatattattgtatattttataaaccctggctgatacggaccatgatatcggggtgcagggtgtatcattgatggggcggagctacaactagcaggatttacaggaacgttactagaccgaaagctatctttgcgatggagcataataaagctcctaaaccagatggtttcccagctgaattttaccaaaaattttgggatgttattaagcatgacctgatgaacctttttaatgtattccatactggtagcctcccaattttcggactaaattttggggtacttactctagttccaaaagttaaagaagcaaatcaaatccaacaatacagactcatatgcttcttaaatgtcagctataaaatattcactaaggtggctacaaaccgaattggctcggttgctgactatttagtgaacccgacccaaacagctttcatgcgtggacgaaatattttagatgaagtcgtcattatacatgaaacagttcatgaaatacataggaagaagttgagtggggtgatattcaaaattgacttcgaaaaggcgtatgacaaggttaaatggccttttctgctacaaactctgcgtatgaaaggtttttcgcccaagtggatatcttggattgagtctttcatttccgagggaagcgtggcagtcaaagtcaatgatgacgtcgggccttttttcagactaaaaagggccttcggcaaggagaccctctctccccaatcctattcaactttatcgctgatatgctagccacattgataaacagagccaaaacacaagggcaaattgatggagtcataccacatttgattgacgggggactctccattctacaatatgccgatgacacggtgatgtttatgaatcatgaccttgaaaaagctcataacataaaatcagtgcttctagctttcgagcagttgttgggccttaagatcaattttcataaaagtgaactatattgttttggtgaagcacttgattatagtgatcaatacaaccagctctttggctgccaggtcggcaacttcccattctgttatctgggcattccgatccattataggaagttgagaaatacggaatggaaagaagtggtcgagagatttgagaagaaattgagtagctggaaaggaaaacttctttcgttgggaggacgacttactttgattaactcagtacttagcagtctcccaatgtatatgatgtcattccttgcaattcctagtgaggtacttaaaaaacttgattaccttcgatctaggttttattggcaaggggatggacataagaagaaataccggcttgctaagtgggacattatttgtcgtcccaaagaacaaggggggctaggaattcatgacctcgagataaagaataaagcgttgattagtaagtggttatacaaactacttaccaccgatggaatatggcaacaaccgctacgcaataaatatttgggatcacaacatttatctcaagcctattggaaagcggggggattcacatttttgggctagtcttatgaaggtcaaacatgattttttccgttttggatccttcaagattagggacagctcccaagttaggttctgggaagacaaatggttgggtaatgcctcgttaagagaacagtatccgtgtctctataacatagttaggcataaacagtcgactatcgcacagattttccaaaccaatcccccgtgcttttcatggcgacgggatttaattggtgcaaaactagctgcttggcataacctattgcctcgcatagctgatttggttctggtacaggagcaagatgagtttcactggaacctcaccccgaatggggtcttctcagtcaaatctcattatctagctctaacacataccgaggttctgaatatcaatagacggatttggaaggtgaaagtacccctaaaagttaaaatcttcctttggtatttacgtcggggcgtaattctccccaaggacaaccttgctaacagaaattggaaaggcagcaagacatgttgtttctgtcacaaggatgaaactatccaacatttattctttcagtgccgcttatctcgcttggtgtggtctataattcatttggcttctaatctgaaacctcctcgcaatgttggtcatatgtttgggagttggctatcatgtgtccccaaagaaatgaggaatctgcttttgatgggtgcaacagctctgtgttggtccatttggctaagcaggaatggagtaatttttgataacaagatggtgtcttctcctttgcaggttatcaccttagttacccggtggctacgtacctgggctatcctccaccaaccgggactgcgggatactattatagtggtatctcgacgtttggaccaggtggcacaggagttttttacccaggagcatgggtggcagtttagtctatggattgatagccactaagatatacggtggtatctcgacagttggaccaggtggcacaggagttttttttacctaggagcatgggtggcggtctagcctacggattgatagccactaagatatatgtttccgttaaacttttgtgcttgggagatgttctagttatttctttcttcttttttggcggtgtgcattttatgcagaggccgggggtgactcagtttgattgtatcatcttgatgtaattaactgagtctaaataaagcttccattatctaaaagaccgaaagtcatgggtaaacaggcaaaaagttatgggtaaacaagcaaaaataaagggagaaaatttgggattgtgaaccttattgaatttgatcgggaaactgagtggtttgttttatctagaagttcggtcggtttttgttcggattgtgaaccctcgctagtattgtcacctctcgtagcttgaggtttaccatggccgttatctggtgggtggatggctgcatgggttatggcttttgagccaagcccatcggttggctgattggattgaagccattcaacccaaattaagctgctctattcgcttaagattctgagacgtagttggttgataagaatctggaaaatgtgggtttcccagcttatgacttcaagtttattttttagattctacaactacagcttctcaatatctagattaaaagttggactgtttggaggagcttctgattctgccagaagtttcaacagctagaatctccccccaagcaagcccttaatccactatggattccattactgtttcatataggtaccactttatttggaaccagctccttctaacttattgtactcgactctgattttaagtagctgacatgtgaatctcacgattctggggtcatatatcattaacccatgtcataggacagtaagtcaaagaagcttcttctccttatttatgtgctatctgtttctgctcaacaaagccaaatcaatatgtttcatttgatatgattgacatgatatcaaactttactcataagggcacccacaattagggtttgcaaaaccgccggtaaccacgcggttattgtgagggtacggtaagaagaaaaccgttgtaacctccttaaatttaaataaatttaaaaataatttgaaattttgataaattttacacggtttcatactgtttgccacggttaccgcggtagccgtgcttaccgtcggggtgcggtaactctagccccgacggtttgggaaactctacccacaatgttataaaaacccaagtagtaagcactaaatgactacttactacctggtattaaccattatgagagtggtacatagttacaaccaggtagtagcactactaccagtagcaaaggaaaaaaaatggcatgtgcacagtgtttttgacaacaaatttaaaactgcaagttgtcgttgctcctcccccagccaaccgttgcatggtatgtgcttcttgccatcttcatccttaacaaaaaaaaaacagggatggctcaagatttcttttcaacacaaacacatttctgtgaatctttgctagctgggatggatccctccaagagaagtttcatgaacttgttaaaccaaggctccccaaactttctcccaatcataatttccccaatccccacagtttacctatagtcgggtaacggagataatggcgtcggatgaagggatagcatcgcctagttgcagagaaggaagggtttgcagcgtcgatggtgggggtggagcggatgcggcatcgggtggcagatatagaggggattgcggcattgggtggcgggagaggaatccggtgttagtagaggggcggaggggtttgcgacatcaatttttgggtgaggggagtggattgccgcatggataggtggggacggaggggttggcagcgtcggtggaaacaacgagaggaattggggatcgatccagaactcgcgtgaaggaattgaggagtgccgattttttttaccttatggaccccaccttacttccatctcgccaaaataagtattgtggagggggtctcctcctactaccgcctgtcactttgttccacactatctagccacttagtcgcgctttgcgcgacactgagcgttaacctaacctacatatataattagatcattgatcctgacattaattgaaggtaccagtttcataagtacgataatttatttgttctcaaatatactccattaattcctatatataagtatttgtagtttgtttagtaaatagtaagattaagaaggaatgatctatttcagtcacttactattaaattttgaactacgattggctctttctaaacacatgatttggttaaaaatgcttaaatatgcattgaaattggtgtcctagaaatgcttagatttctatataaaatttgaatcatagaaatacttattttgagattgatgcagtagctagagatgtaaatggaggaatgctgtaattgattggcattaaaaagtaggcaaagaaattaaataggatatgactatgttggttaagatgggggagtagatgtagaaatagctatattttacgctaaatttgaatgttaaagatacctatattatattttagaacagagacagcaataacactaagtgctcgcaagtgtagggtgtgcatatgtgcattgtagtgcgtactactcagttgctgtgtgttgctccaataccaagcaaaagtagtataacagagcatttacatgtacactcccatacattataacttgcatataaattcaacacaaatttacgactaaggcctcatttgtttccctttatttagtcaggagattaattaagcaaacatatatatagtgttaaaaatacttttttgaatggtagtgttaaatagactaagcacatgagttctctgctttttgaggtctttagtctgaaagcatccagattggtccaatgtgtttccactgtcatagatgagcatgatgatctaactgtgcattttcatttaccagttcatccaacggtccataccattgtagatgatgtggctcatcctgcattcagaaagcatgttgctttcatatatttagatacccatgttgataatatacattgttgttgccctaacttaggtccttaatcattcattattcatttgcatttaactttcatctaagatattagatatgattgaccattccaccatccacaaacacattgtccaatcaatatatatatatccggcaaattttagccaaccaaaacaaaaacatgttattgtaacaaaaaacaaaatcttattcatcatatcattcgcccttcttgctgttactaataaaatttgaatccacaaacttagcccccgcggatttaactaattactcggcccctcgcgcgcgcgcgcgcggtacaggtacaatacaactagaagcacaagaagcagctgcatttcttgaaaaacaagaagccgcctcggcagtggccgccgttgttgagctccaggatgcacgccgccgtgcacagcgcctccaggcacggccccgtgtacagcgtcttctccatgcactcgctcatcgcctgcgcgccgccggccaccccgccgccttcccatggtggccgactgatgatcaacgcctcggcgacgacggcggtgctctcgccgccggccggctggtcactggtagttggtacgatttgcatgttgttattacctgcgacggcggcggcgagaggaaccacggcgacggcgacggcgaggagaatgatcgacacgcggcgtttcttggagccattttttttttggcactgtatattagtgatgaaggtgaagggtagtgttctaggggggcaatggtctgggatttataggagatttggatgatgatgttgcaggaatggatatattcatatgctcctagcaaaaaaaatgaaaaaaaaagtaggtgcacattaatacaagagaagaggagttttggattgccaaggcatttaaaaggactattaaatgggaaaatatacctgtggtttcaagcaaatcttccaaagaaattaattgttcgagtatgtgtagttgattcactggctaagtggtatcatatcatttatactagggttctactatactaaaaaccaaggacttcctgttgcagtagaaacgcatgttgctatggtaaaaatttggaggcccccactgttcaagttgctatagttgctcgacgcgccactgttcatggtgtggcaatactcatcgcaccgttgtcaagaaattgttttaaatatttagtgactggggttttgattttataattgaaataaaaaagggtaagaaaaactctgtctaccacagggccacagaaaattatgcatgcagacagctactcctccgtcccactcgataatataaaaattcatatttgatcaatagtattttattataaattaaattttatttgataaaaataatatcattgcaatgatattagaatttacttttatataatatgaatttattttatactttatttgagaattgtaaagttaaagattaattttaaagaccaagctaagtttaagcgagccttaatcagagggacggagagagtacgacttaaatgagtatggtaagaccatgggtttaatcaacttcatactactaatatgacatgcaaaagagaggaaattccatttgtacattctggatcataaatggcactagctgtgtgaatggtgtgatccagaatcaccaaaacaggagaacaccgtagcacaaagaagaaagataatagctataaacatgaaagagtgtctttgatttccgtcttttcatggctgagagtactttcaaggaaacatatgttacggagtacatgtttgaacaaaagtgtttcttaccaattcacatccatacatctttgttgtatcgcaacacataactcttgcaaataatagccagtgttcatgaagcattttagcattaaaaataaaaataactaacagtgacgggataaatcagtctagcaattcatgcagtattgttcactaagcatgcttaaatttattcaatcaaataataatacaaaaaaaactgaagagcactaactaaactgcctatcaaccaaagattctacatttgaaaatgaacaagggctacaaaatgtagaaacaggtcttaaaaaatacaaaagatttatcttggtgtaagtttctccagccatgacaagataatcccagctcctttatcccacgagcaatcaagcatcatatcatgggctatcccttcgatgcagactggttgcacattataaaatcttgcagtttctgaaagcccttcagcatcctaaatcaaggaaaatgaaacagtcaaggtggaatgcaaacaagtttacactatacaactgtaaagaaataaatacggtatctacagagagaaagagagttttttttttgggggggggggggtgcgtgtgtcccttacaacaatgaagtcactgctggcgcccacaacgaggatgtttactgtattatttggcacagaagctacaggcaatgatgcattgagcttccttaggtcaaatagtggtaactttgagctgtccttcattagcccttggtaccttcaagatattgacatagataatatgtcattattgaaaaaaaaaacacatttcaaatgtagaagctcttccatagatgtcattattaactggatctttggtgtgtaactaagcagatggcaggggattgatggttgcttatcgctgccaatacaccaaaacaatgtttgcatgttatagaatggaccaaactaaaagatcacctagttcagattctaatttattgattcttttttaatccatctaaaagtcattataataaaataccaggttaaccagttcaggtgacagtaataacaactacttcatctgtttcatattataagactttctagcattgcccacattcatatatatgttaatgaatctagacatatatgcgtgtctagattcattaacatctatataaatatgtgcaatgctagaaagtcttataacctgaaacggagatagtatcaagtaatgactaatgaccaattcactagtacattaccacccatataaaagattccctccaggtatatggcctaaatttacaaagatgaagtcatttactatgaagaatacctttggaccaggtcatcatccatctctggcgagaaaaatgtttccttacagagggacaacgaatttgcaaatcgttttgcagccaagctgagtgtcacctgattcaaagatgcttaagatttcacatatcatcaacaatgcataaaggaattgcaaacagcatgaggaggcatatacacttctgggtgtggatgaccataattgtgatatcaatagcagtcgactgcttattaacataataatttgtaaaatggaatgatgaatcaggggttcaaagctatgaaacaaggtgaacagattaccagcaagacgtaagcatggtactacatagccaaaccaatcacattaatatgacaaagtttatctaattataggttgcttatatttccttgaacaacaaggaggacacatgttgcatagtagtataagtagttaagtgactggcaggaagtttaaatatataaaaaagaggtgattggcaggaatggataaatgtttcagcataattccacgagaggataaaatgaatggaatttcaagagagccaagtgataaagatcaggttaatttaccttgatggcagcaactggtttggtcaaaaggtaacgccacaccaacccactgtagatagataacacaaaggagttaaacccagttatgtaagacaaagatgtaacattgcagtgagttagatgagaaatacctatttcctgagggaggcacagagcatacaagaacagcaccagcaagctttggatgcagaagttctgaaccttggaataaaaaagttaataatgattaacttttgcatgaaataaaacaactattactgccacaagctcagaccataagctgctacatcagaacataggtaccagtaccactaccactcattcccttcagttcacagaataactcacattttttattactaatttaagtaatcaagaatccattgagaaaccttatagtaattggcagtttggcatatctatgtgattggaacttttaaggctcttgatgatgaaaattcagttaagaagaactgaaaaatattaagaacacaaagaatcaccaggtttaatacataggttacaggaattttttcgatcattgagagggcatacctcccaaacaagatatatattgctgcacaatcaagcctccaaatgaatgtccaatcaatacaggtggcagggaaacctccttccggatgaaatcagcaatatcgccagtatgcgtctactgcaagttaatttaatattggaccaactatattgagatggtgaaatggaataccctaataaaaaaatatttgttacaacatactaattttctcaagtgacacatctatgcaactctgctgaatgtactagcttgatatctcctaatatatttatttcatatgatatttataattaacaaaaaacatctaatgaaaggtcagctgaaattaatcatatatcttagatatatgaaagttactccaaaggtggtggaaaacgaggatttgccagtttgccaccctatctcattgacaagtgtgtcctggtcccacaagtcaatagacacatgagtggcaaatccccaattgccacccagaggagtagaaaaatcctcaaatggcatgcatcaacattaaccatctagtacataacacatagcaatatttcagagttggagaattcagtccgattatgtttctcagaattacctcaagtgtgccagccactttttctggcggaacgctactttcaccctgcaacagcacaaccaagtcaatgaagcattacataccaaggaaaaacagtcggacaatcaaaaatcaagacatgcgatcagtcattactcaaaaactgaaagtgtcgaatgctctacagagcagagagcagtatcaagactgggcagcaacagacacgctatgattcatatccttaagattaaagtgcacacacatagaccccatagttgcataaactgcatttttttaactgaaatgtgagtaatgccacgctgttttacttggcttggctaatatataggcattctaaaagagcgctgctacaaaacgggatcccgttgcaacgggatagacatattaactattctcttgcacgagtatcacagatatcaggtcctagatatcatatgtaccgggtaacaggtatcagggtaccatgcagctagtaccacaataggtatcaggtattaggtactgtctcatagaagggtatcatattccaacgggataccggtgtctaggttttctgttctcaaaccgtaaaacgatcaatcaataggattattatttttttgtcaaatgtttttaactttcggtttaggagacggagatacgcgtgtttctgccagcgcctagaatggctagaagtaaaatagtccaacaccacagccatgagggccatgaagcaatgatcctcctccccattaagacatttcaacaaacactttcgcggggtgtacacaagtgactccacctgacctgggcgcggaggctgagcgcgtagcaggggaacccggcgctggagaagaaggggagccagtgctccgcccagcaccacgccgcgtggaagctcccgtgcacgaacaccagcggcggcctcgcggcggcgccgccaccgcccgtggccggggcaggcggctgctgggcgataacctcgaggtcgaggccgcagggcaggcggtggaaccgctgcgactgcccctcccggagcgcgtaggcgcacgacgcgcggaggaggaggggcctgctcctgctcgtccttgccggcggccgccgcgcgcgcagccgcattggcggcgaggcggggaggaggagggtgagggtggcggaggcggcgggggtcgccatggccatgggtggtggcatttttggtgaggaggatgtgccgatgcggatgacggctgctctgctcgcggggttgacgacccaaacataaatactttaatcattaaaaaaattaacatatgattaattacgtttttggcaaaatttacttcagaacactcaaaaagatatgtaattagctatgggacaccgaaaaaacgtaaattggctataggatatcgcaaaaaagtagtaattagctactagacacggaatacattattttattatttccaaacaacagggagagagaaacaatcgtaaaagactaaattgccctatgagtctagccaggtcaacgattatgtgggtcaaggatgtcagcctctcttctattttcttgttctcttcctcccgacgagacacaccgtgctgcagcgccgccgacgccgtccttttccgccgcaccgacgcacgcctcgccgtcacgcggttcgtctccgttgcatgaacggagcagacacaactttgggcgggccacatgacgacgaagaactgctgcccatcggctgtgccttgcacggcactgcaccgcgagctgctggccgctagccgctgcctgcacccacgcgccccatcgcggccacgagttgccgcaagctgctgcacacccggcgcggcgccatctcgcacggccagtgcactacctagccgagcagccccgcatgacgccgaccaccgtgcctgcgtcgcagcaaggccgtcgtcgccagccacaccgcaatcgcgccgtttccgcaccacgccgcgcacgggcccgtagtcggccgtgcctgcacccgaatccagcgccggcaaccccctcctcacccaggcatggtctctgcgcacccgcatcgtgccgcccggccgcggtgctcttttctcgcgcgcactgtccttctccgtcgcgccgtcacgcagcgtcgctccagctccaccttctcgttgtgctgtgccgcactctccgcctgctccctcgccaccgccgccgcggacacccgcgctgcgcagcagctcgacgtcaaggaccagaaactggagcaaaacgacacgggggcatttcggtacttttaccattctttaacttcccgtttccatcaaaaataataaaaataatgtcaccggtgtctagtagctaattatcatttttttcggtgtcctacagccaattcacgtttttacggtatcctacggttaattacacattttttgagtgtactatagcaaattttgcctaagttttaattataataaacttaaaaagtaaatttatctgatacttaaaacaacttcatacatatgggtgtatatatacgtagttttggttgttgctaactgatttaaattatcatatgtagaataatttttttccctcttttagaattataaattatttgattggtaatctggtgcaaaggactgtttgggtcgatcaactagggcaatgagaccgggtttacaaaaccgatggaatttcgtggggttttcgtaaaaccgctagatctcggtttgtgaaaatcgatcagtattagcccgttttcatacggtattgatggaaagttatcaatttttactggttttcggtcggatttcggtaaaccgctgaggagcggtttttctttgaaatcgaaaagtttaaccatgaggcaatgagtagcttgaaatcgaaaagtttaaccctgactgttccttctctctcattgtattttacttcctcatttcaatggctaggattgttccttgctattttgtcattttatggatccaactgccattatttaacagatgacgaagaatccttgctattttgtcattttatggatccaactgccattatttaacagatgacgtggctcgtcctggttgctattgagttttactttccaattagatagatgtgattgcaaaactaatgtaaactaatgttacatctcctatatcacgtgtaaatcaaatgaatagcctacagagcttgatgttacaatacgagcatgccaaacggcctcatggaagatcgcttcttcaatgtttcggaaacgagggcagctacacaatgggatcccgttgctacgggatactttaagtgacttatccctttcctttcttttgtataggtgagattccacgtgtgctcccctggtacctggtaccatgtactagaggtaccagaggcacgatacctatccggttcctactcggtatcgcgcgcgtgatacctctgttggaattaatgaatgggccttagcccactcgaagattaattctttggaaaatcacaaaagcccacctcatgggatggcatgcatgtggagtttagtaccaccttgcttattctaggagaggggaacctccttaaaagggaggatgccctcctagccacttgaagcatgtgtggtggagagaagaggggaaacacgcgcgcgcgctcgctcgcctcgcctcgcctggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcaaaaatcaatctagggtttgcctcctactctgtactgcgccgccgctcgtagactactacatcccgctcgccggcgtgcaccagcgatcgggagagcaagtctccggaacctctgcctttgacgtcctgcaccgggagaaggcggcaataaggtttttgggaagcgcttcgcgcgactgctccctgttcgttcgcgacggctcgcctttctcttcgctcgcgtgtttcgtgccttcgtagacacctgcgaaaagtttcgaccaaacagccggtcttttggtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagattagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggagggttgatattggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaatttctaagttttacattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctaggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcaccgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgtattcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctatccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctagatggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgcctggcagggcagggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcaaaaatcaatctagggtttgcctcctactctgtactgcgccgtcgctcgtagactactccatcccgctcgccggcgtgcaccagcgatcaggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaacctcatcgccggtgtcgctcctctgcagccggagcagcacagcacaggctggtacctggtacctgatacctaatactagctaccggatacctggtactcatacctgatacctggtacctgatacctggtatcagtatggtactaactgcatggggcatggtgtgtggtacttggtacctatagaattggaggattcaagatgataggacaggggaatcgatactgtccatataagctggagaaaaaatcagcaaggaaatcacaagcaaaaaaaatagaaaaatacacatgaggaagggatgcaaagcggctgtgaagcactgccaacgtggggggaggggggtggagaaatcagtcagagtggaatggagtgcgagaggtacctgcaggtatcgaaggaagggaagcaaagtagcggcgtagcactggcggcatgaggaggcggattgacggaggggagtgacgatggaaggtagagggacggaggagctcgcggtcctcgtcggcaggggcgcgacgacgcgagagctcgcacgctgctttgccgctgtgccgcacgttcttgagccggcgggagcagctccgcgcgacgccgtcttccctgtcgccggtggaggagggagagcaagacgccggcgaagcaccgccgcgcgtaagcgacggcgaggacgacggaagccgctggagattcgccgccgccgtgaatggcaacgacactgatgaagtcatctagaacgccaccatttttccaagagtcacgggtgggtggaggaaaatgaagcaggcactaaacgcttctgttcagaaaaacggtttatacactaattaatcgcgtcgctatcggtaattgcaagtttaagttctcccgttacaacggaaagccgtggagtagattctctgttcggaaatctcttctttttcttttcatttcatgcattcatggtctgcgcacagtatagcgcgcgtttattgctagttctgtttaaggcaaccatgcgcaggaatatgcccaagttcaagatttgaatgcaaaatgatcgagataaatgaagacctatctggttcaagctggacgctaaacatgaagacatggtgcttactgaagcagattgaaaaataaatacaacacctatctggttcaagctggacgctaatcatgaaagcatggtgtttattgcagcagatggcagactaagagggcttctgctggtggcataacagcttgacatctcatggtcaaggacgcattactggcccttgtcatttgggggcaaagacctccagattccagctaaaaggctaccatacaccgaatggcagacgctagaaacagcacagggaactgctgtgagaggatttccaaaatgcttgctcgcaagaactacacccagcaccgaattctgcaggcaggaaaatcatgcaaagaaaatgaactgatacatgaatgatggtaagagtatgacatttgttccataggttgcaatgggaaaatgataggacgtatatgtatgcgcgtatggctttctagcaatagttcattttaataatatcctaatacaagcatgagttgcaatctcaattgtaacatggtaagctaaatgtctgtgctttgctgcggataaaaggaaaaatatcacaatattttctaaaataaataaatcatattttccatgaaatatgttacccacattctccctatccacattaattttatatgtggccatctatttagatttagttgttatgtaatattaagaagttcaaggggtaacatgtaaaaattgcagcaggagtagatgaagtggcagattcactgccaccaccattggagtccttttaaaggagtacaaataatgagacttccgttatagaaatactccatccgtcccataacataagggattttggagggacgtgacacatcctagtacgaatatggacatggattagttgcaatgttaaaacaatctggacatgtttattccaaaggcatggcatgacaacaggacaaaattaatatctaagttagaaaaccatggcatggtttagcaacaagccactttttttaattaggaagagaaggaactgtaaatttgcttgtaagttgcaaacaaaaggaagaaattacctgcatgccaacctcaatagagattgttcgtgatgaagagatatcgatgccaatcgttctagaaagaacataaccaaagaaaaagccagatgcatgcaaccaacaaacagacataaccacttgtagaccggatgatagaatggctgaagcattctgtgcgatagcattgccacaaagaacagctacagttgccacagcaatgaatggcatcaagggagaaactaactgaactaaaccgttgcagtactgattaagtagagcaccaagtagcacaggtgctaggacaacctgcgttcatgtatatccaacttagctaggagtaaggaaattcagcagtataacatcagattgatttccagcacctgagatgttgacacaaacaatcccattggatctactgcaacatattgtcccgccagtttggatgtcagaagaggagttaagaactgcatcaggaagttacaaaagcataaaaaagagcttttggagttcagtttaaagataaaaacagatctgagagtggttcattaccgctgcagcaaaagtgcttgctgctgtcatcagtaccgaaagagcaacatttcccctgccacacagtgatgctaatttgtgttaattgtgtgcattttcatgatactaaaaagaacagaaagatgtcctctcatagtgccacaaatttgtccacatattgtgcagttaataatgcatcttctaatatttttgctatagaaatttgatgcaaatgctcaatttcatagaaaatacatttgtgtcaaaagtcaaaggagagaatgaactccagtctaattcaagatacacctgaaatttattactcagctagagaacaggttattttgtttacatttctgttttatgcatcacggggatccactaattcaaccatatagttaggatactggctgctggggtccacttgacagtaagagaggaagaagacagggatactttgggtaattcaagtgataatgtggcaaatgagaggatatccccctagttaccctcaaccatgtggcaaatctgcaaagcacctcaactttgtcgaattctggcaattttccctatttcataggcttgtgtcatagtcagcgtgaaaaattatcaacagattgacacattttccaacattttgtaacaaggccatgactaaatgaagattgctactccctctgtcccacaataagtgcacttctaggattcaaaaaacattatcaggggtgggaaatgacctagatgcccctcattaaatgaggtgattgggagccaagggtgcttgggggtaagatggggagaaatttgaatgatggatgattggaaggaaaagtagtactctagaagtacactctttttgggacaaaattcaaatactagaagtgcccttattgtgggatggagagagtacattaatattttttctcattaccttgctaaatatgtaacaatgttgcttgctgtgcctgcaaagagtatttgcctttctcagtttaaaatctggcaccaatataaacaaaaagactaaagtgtgtgcacacctccagggcaacaggacaccaatatcaatccagcagcataataggatggtaagtttaatagcttgctgatgagaaatcctgacagtggcatcacctgtacataaatcattagctctagacttttggatataacatggaaacagcaaaccacaaaaacatgcataatcacaatgaagtttaaatgtacgatcctctgcactggtagtgtacaaacaaataagaattcgatatggttttttctaaatgcatagcatgtcagctgcacatgataatcttgatgaatgtatagaacatctgtccattgattcaacaaaggatcttttttttgacgaaaatgattcaacaaaggttcctacacctctagtaataggcaagtccaaaactgcagctattttgttttttaattgaaatgatgatctcatggcctgtaaggttatgaaatgaagtggccagcaagtttgggaactgaccgagtattgaagtaaaaacccagatgctaactccttgggcatcaatagtgcagttttcaggtcatctaatgtcaatgtcattcccattcctgaacaaaataaattcaactatatatcagtcacaaaattcaactaacttaaaccgccatgcacaagaaaattcagttcacagcacccttctctcttcaagaataaaattgacaacaatataaggaaaagaatttcatgtctgtcaatgaccaatctatgtataaccagccatctctgatatttgatgtttcaggtgacatgtgctaaaaattactcccctccattccaaattgatctacatatagtttttttgaggttattcctaaatgatctacatatttgtgttcatttattaagtctattcgttatttgtgcattggagtaaatggacattgatgcatgcatccatgcacacaagtacttataacccacatgcaatatcttgatttgctattggctaggaaatattggggatggtgcatgcatcgagtttgttgctaaaataaatatagtatgagagagttattagcttttcttgatcttggtgtacctatgaaatatgtagatcaatttggaacggagggagtatattgaagaaaccttttatgcatatgtagtaaagctaacacttccatcttcaatgttagaaccatcacaaacaaaattgattttttgagtgcaggcatggtgatacaacaacacagaaggaaagtagaaactactaagtagtagaggggatgaatagtacagacccagcatggtaaaggaaatgccgacaatctgggccatgggactgacccagaggaaggccggtggccgccaaagcgcaacggcgcaagcggacgccacccacactgggaacccaagcgacagcacctcgccaacctgcaaaagcagatcccgccaacctacaactccagcctccaatgcaccgctgccacctcctggtatcttggagggcgccggatcagcagccgcatggcacctgctcgacggaatgccacaaaggtgtcgaaccgggttgctgctgctgtatcggatgcgaaggcaggtgacagggagagatgagacggtagctctatgacgggtgttgtgtgtactgaagaggtgaaggcgcttgtcatggtggatcggggtgcggtggggagcagccggcggccggcggaggagaggcatgacgtgggatgttgacctgtcaccttcaacgattactggaaacaaatgtgagtccaagattcagcaaagtatatgatataaatagtgaacatcttagagaaaatagtccatgttcaggttaagcattctcatagccacaaatgcaatgcataagtagtctacatgctcatttgctcgtcccgtcacatatagcatggttcaaatccaatgttcaaacatatgcaatcaaccaaccatccctcaatccctggattcaaatggtaaaaaaaaatgctcctaatccaaaatcacagcactacatacagtaggtcagtagcagtctagcaagacaatagttagtactagttacctttggccgttgggagttgggacttgggcgtctcggcctcttgggggcggcggcacggcgcggcgcggcgcggggtggattggatacgaggcgcgacggcgccacccaaaagacgcggcgagccggcgacgggtgacgggcgaccaccgacggcgcggcggcacgacgcgaaggcgggagggattggcggcggcggcgtcacggacgcacggcacgtcggcgtctcggcgtcggatgggcggcggcggcggcgcgtcttcctgtcgagcgtcgagaggaggtggagactggagagcgagtgagcgaccggggatctgggaatggggaggagttgggggcaaattctatttttggtctttctttttttttctttccctaattgggcttatttataagaatggatatttttttaaagcatatactcctactaatagtatatttataagaatggagtatattggaacatatcaggatataacatatcctatgtatacaatgtgcacaccacatgcacaccaattagcaaatatcacgaaaaattctaaaaaaaacatttactcctaatagtatacacatatatgcaaagtctcgtattcaaattcattatattttagccgtaataaaaaattaaaaatttgatagtttaaggcgtaaaaatttgtcagaattatatcttttttgttactgctaaaatataataaatttgaatataagattttacacgtaggtgtaatactattgaaaatatgtgtccaattttctgcgacatttgctagttaatgtacactggaagcttgtatgcataggatatgtttacatgtacatatgaaatatatatacttcattttcacgttgctgacttcatttaccatgtatcatgttcatggaacatcatgaaggaataggttaagccctctttgtttacgtttataagtcggcttatgagttaaaaagttcaagtctaaacaaataagcagttttttcgtttggttttttaaaagtcatcactcttacactatgaagctaaaagctaggttggagaagcttttttagcttatttgagatagaagtatgacaccacccttaaatttgggactttaaatccaccagcttataaatcatataagccaaaaaaaactaatataaagatttaagccaataagtctaagcctaaacaaagagaacctaaatagacgtcctattttagagtcttgttcttattggagaggagacgtaggaatttggtcaatgctaggagcttgctcttcatctttgtcatcagatgattgcacaaccagtttatgtttctttatctcggccttcttcatgctttgttcggaggccaacctattgttctcttggggggtggggggttgcctactgaaggtcctctagcagcctatccggcgccgctaatggttctccttggcgagtgatgagtaggcgtaggagggtcaaagattataagtttgttttcctgcacaagtgaattttgatggttcatatcgataaaaccgttgaaacatttggattatagacagggttcaaagctgcatactggaggaggagggttaaataagtgaaagggcaccactaggagtttgtgagaaacatctacggtgatcccagaggagaacaccttacatcctcttgcatacgagttcatagcctagttattctggatcttcttggtttggatccttttgaccctggtattcaaatgttgacttggctctgtctttgattggagccagtcgacacttgatgaagtgtcaagtgacttgttcttctactataccttttctcatttatggcatttattttggagaggaatcctttctgcttcggctttatcctggccttcaggcatggaattccaatcgaagttgtagattggaggaagaccgatgaaatcaaggcaagcaagaagagggttggagatgtagaaccaattttgtgccaaccattgttggtggacttcaagggaagagcgagataaaaatttccggaggtcaccacacaactagaatttggagctgcctagtacacaaggattttctttagtgggtcgggttttcagagagaacatataccggaagaggcagggccggctctacatattttagggccctaggccaactccatgacatgggctctcaggcatacactctcactatatatacacatatttgttttgaaacactctctctctatatacacatatgcactttggatttttaaagtatacttttaaagcattcatccgctaatcacgctgaaaataaatatcgataatatcctctatatatgttgctaaaaatacaaaaagagcattaaaatggaattactatggttaccttgaattcttgactaaggatcaagctccagggacttcattaataatacttgacaaaagataagatgacagacatccatttgcttctcataaaaaaatacttcttcgagcatttcttgatgcaaaatcattaatgacggtatcgagaccaatattgtccaagacattcttctcaatgcagcacatagccgagccatttaatctttcttgtgacatggttgatctcaaatagtttttcaataactttaattttgagaagctttttttttcagctgaggctactgtcacaggtacggttaagatagattcgataggcaactgaaacatttggatagcaatctgcagctgtaatgaattcaagaatctcaggtacactatggttgcagcacaacagtgcgcaagtacctgtaaattgaaacctgcagacactctggaagttgaggcagattcatgttgtgtcggccgatgtcgagggcgaacagagtcaacagacaaaggcataaagctgtgaagggctaaatgctgaagggatcgccaacggtccggcgtaggacgaacttgtggaggcgccatggagagcgctggaggcggattggcggagactgccgccggcagaggagaggagatgagaagacaaaagtttggaactcggacggtcgcgtatgcccggcgcttatgcgggcaacgattcgaccagaaacttgtatacatgcatatggtatacctaatacatacctaggtctggacccctacttttcctaggccctaggccatcgcacttcttgccgtagcccagagccggccctaagaggttaaaatgcgtcacgattctaagaaatatctcgcacaaatgaataaaaatggcgatatggagaattgaattgggatttagataataaattttt

SEQ ID NO: 11133 - DNA, 2381 bp, Oryza sativa
gtggctcgctgatcaaaggggatttttctctcttccaccatgggcagaaaagagggagctcggattagggtttcttgttggagctttggatgcggaatgctaggacggatggagggcgcttgtgcgtagcaagatttgggagagatttggtattggattgagtggaaaaggtcaaacctagcttcgacggcgacaggtggtgaacaaaagcgcaaaagttttcaaggaagacaaagcagtggagaagacgacaggtggtgaacaaaggcgctgttacgcattttatttgcaatgcagttggtttagtgctatgcacttgattttataaagtcacgtatacatgttttgtttttcttggactagtatcattggcttaatgctatacagtatatggcattttggttatttaattggcggttggtacttggtaacaccacatatgccgtatttttcgtaatatatgaaatcactcggatgtttaatttcttattcttgactttacgttttgttgctttcaactaatcatgtattcagggctacacctaattaggtgtatctattagttagttttcattattctcatttttttcagataagagctccacatcctcttgcaagcatcatgatgacgggataggagaaaaagcactcggaagattacaatgagaatattggagcacttggctttttattgaacaagcttgggataatatttttttttcgattgtaaaggtctcggggctgttgtggagattatgagtatcccatacccactcggtctgcttatccgactagagataggaggtgggccggatctatgtattatttaataggttaggacttgggaattatattgccttgtttcttactgcatggccatagttcttattagatacaattatgtaaacataaaaagaaaccgatgccatgtctgtctaactcttcctcttcgtaactttgctcccaacctatataagatgaacaagaagcacgactaaatcgtcagatcaatacaacacctgacggattcaatcctcaagcaggagtagggcattacttctcatcgagaaagcttgaacctgtctaaacctcgttccctttactcatcctcttttatagaactcatgcgctactctttttcttattggcgatttctataatcgataattcttttagtagtaggttacttacgttgacattgaggtaccagtgatgacttaatcgatctcaagatatactagtctggaggtgtttataggagtaggatgatgtgtgtgtacgttcataaaatggtgagtcaaacattatatataggccgtgtttagatgagactaaaacttaagtccctatcacatcggatgtttggacactaataataaatattaaatgtagactattaataaaacctatttataatcttggactaattcgcgagactaatctattgaggctaattaatccataattagcctatgtgatgctacagtaaacattctctaattatggattagttaggcttaaaaagtttgtctcgcgaattagtttttattttgtaagaagtctatatttaataattctaaattagtgtctaaacacagagactaaagttaagtccctggatccaaacaccaccataatcgtactcccgtaacataactctaaagataaacaaataaagtaggtgtttagttctctacataaataaaccataagtttgaactggaactcgacaagacaataatccaaacattatctaaaattgtattgtaatatcctgtaataatatataagttcaaaaaacaacctatcacaaaaggtaaataaggcaacaaaccaaaacttagtaaaacaaaggttgtgttttagatccaggtatgaaaatctttgtcatgtcacatcgaatatacggacacgcattcgaagtattaaacacagtctaataataaaacaaattatggatttcgcatggaactgcgagacgaatttattaagcttaattaatccgtcattagtaaatatttacggtagcaccatattgtcaaatcatggagcaattatacttaaaagattcgtctcgcaatttatacgcaatcagtgtaattaattttttttctatatttaatactttatgcatgtgatgtgataggatgaaaaaacttgccagggatataaacaggcctaaacatcgaaaaaaccaatatctatcaacgctaaaaaaaacttcctgtagaagttaaatattgacaaaatttagcatcaaaaccgtagagacaaaacgacagaagttatagggttggtttggtttggggcctaaatatgccttaccaaattttgtcaatgccaaattttggcaagactaattttggtaaggcaaagggctg

SEQ ID NO: 11134 - DNA, 1321 bp, Oryza sativa
caaagttgtgtatggattgaagccaaaatagcctaagttcaatattgaaatgacctattttcttaggtatgctaaaatttggcttcaaaccaaatagacataaaattaccaaatattagtaagcctaatttatgcctcataccaaaccagcccataaaatactcctctcaattcaaaacttgcactaaacggccaaaatcttccatcgtatagttacgtcacaccaaacacaaccgtgcaaaaatcacccaaaaaaaaaagagaggaaaaccccacattttgctccgctccccccaaaaaccctactccatcggcggcgatggcggagccagcggctgcggcggcggcggcggaggccccggcgacggtggggcaggcggtgatcccgctcgtcaacaggctgcaggacatcgtcgcgcggctggacggcggcggcggcggcggactggagctgccgcaggtggcggcgatcggcgggcagagcagcgggaagtcgagcgtgctggaggcgctcgtcggccgcgacttcctcccccggggccccgacatctgcacgcgccgccccctcgtgctccagctcgtgcgccactccgcccccgaggagtggggggagttcctccacgcacccgcccgccgcttccacgacttcgaccagatcaagcgcgagatccaggtcagccctgcagcttcgcttgtttgcttgcgtatagtactacttttggcgcaatgcttgagactttgagagatctttaatctgtgaaatgatgattgcaaggtggattagcttgcaatccagaagaaaaaaaatgtaggttgtagtttgcagttttagaaaaagggtctgttcactttgttgacttgatacattaccagcattagtccagaaaaaaaggatactccctccgtttcaaaatatttgacaccgttgactttttagcatatgttagaccgttcgtcttattcaaaaaaaaattgtgaaatatgtaaacactatatgtgtacatgaaagtatatttagcaatgagtctaatcatatgaaaataataaataattacttaaattttttgaatacagcgaatggtcaaacatgtactaaaaagtcatcggtgtcaaacattttgaaacggagggagtattatggtaaaaaaagcatttgggctaaatttagtgtatggagatcgtttggtacctttgctttgttcactgtattgtactgggcagtgggcactgatactttcgcgtacttataataatccttcttttttttggttgggggggggtgggtcttgttttatgctttcgtgattcttacgagatgaat

SEQ ID NO: 11135 - DNA, 1308 bp, Oryza sativa
gaattttgccaccattattaagccaatcctactaaagatttagcaatgttgtcattttcttaaaatttggaattgctaaattttggtaaggtttattttggtactaatctgagcaaacctttcagtttggttgctcattgatggctatatatcccagcttattctcaaacctggtggctcgcttgattggcagtcctgtaagctcatcttgcatacaaattttggggtactaaggctgcttgcatgcaccaagaacatttcttcccttatgtgtaagcttaaaactgaagattgtgaggtgttctactacataataagaaactttgagtcaaaaaacataataagaaactagaattagatcttgaaaacgatcgactccaatagatgctcatcatgagcttttttttttccctctattccaattgattggaagtatctggcagcactacgccagagtgacttccgaagcgctacggacgggacagctaacgtcaactacatactatgtcccaaaaataaaggactttaccaatacatatacattctcaaaatcttttatagtatttaaatacaaccgtttaaatttccaacgacacactacatattgcttgcaccagtctaccagttgagcatgaccatccagagggaaaatgcacaatattactcctcgagtgacagtcgttctgggttggtaaattactgcatccattcttaataactgactgtagtattatttattttgaaactttaaccacttctttttaaaaaaaaatcataaatacttcaaatgtctatattaccaaagtgtgtagtgctcacaaatataaccaaacaacttttcgttcatcatgatatcatattcgaatcatttaaaactaatttttgttcaaaataagatgccaatagtcaacaaagagtgttttcaggctttgtatttattatctaaaaagagtatttttcgtatttatcatcttatttgaagcatgttttacataagaaccaatacacgattctatagatctgcgatacctcatttcactatacatataagcagagttgagatattagtcactagtgaaaaaattgaaatgaatattatcttcgcctcatacataccaaatactctctctattcaaaaatataaagattactcgcattcaaaatttatgccacaatataagcatttcttagtcacttcatatgcacagaaattcatacattttcagcccaaccataagatacttgggaggggaatctaaataattcaaaactcataatttactcactgatatgtttgaaagaaaatat

SEQ ID NO: 11136 - DNA, 7203 bp, Oryza sativa
cgtgcccaagcacaaccctgtgtaccccaagttctcgtccttcttcaagagggtgacgattgcgctcgacccgtcgctgtacccggagaacccgctgatcatttgggagaatgcgcggtcggccgccccacaggaagggttcgaggtgaagaggaaaggggataaggagttctccgcgaatatccggctggagatgaactataaccctgagaagttcaagctctcgcagcctctgatggaggtgctcggggttgaggtggacactcgttcgagggtgattgctgccctctggcagtacatcaaagcgaagaagctgcagaatccaaccgatccttcgttctttatgtgtgatccacagttgaagaaggtctttggggaggataagctgaggtttgcgatgctatcgcagaagatatcacagcatctctctcctccgccgcccatcaacttggagcataagattaagctctctgggaatggcgcgcatgcgagtgcttgctatgatgtgattgtggatgttcctttccctctgcagaaggagatgtctgcatttcttgccaacactgagaagcacaaggacattgaggcatgtgatgaggtgatatctgcttcgatcaagaagatccatgagcaccgcaggaggagggcattcttccttggtttcagccagtccccagtggagttcatcaatgcactgatagcgtctcagagtaaagatttgaagctgatcgcaggagaagcaaataggaatattgaaagagaaagacgtgcagacttctataatcaaccatggtaagctcaagcaaatcttaaggctttactcattgtacttcctgcttgaaaccatatatcaatgtgctgactaataaattgttttccattccacaacgaaacagggttgaggatgctgtcataagatacctgaaccgcaaaccggctagcggtaatgagggcccaggcggtggtgctggtggttcatgaggaaaggggttggtattactgtagtgccattttggtgtagaaacaagctatctgttatgtactagtaaaaattcagatatgttagcgacaaccgatttgtttgctgctgtgaatgatcttggcaggtgtacctccattgtctgtccaaacgagttatctacttgtatgattatgtgataagtgatccctaactacggtggcagtatgaattgtcatgctaattgctaaatgctgaagggaaaatgctctgttctagttacctaacatataggtatcatatgtgggcacaagttttctctgtatgatgctgtgtgtggcttatcatttgtcccactggggaggttgtggagggggacctgagactccgagaaagctgtatcttttgtatttgaacatgcttattggagggaaaaggaaatggaaagagtccctatctttaagtgcctggaggatcaagtctcttttgggccagcagcatatgttctctcttttgctggatcatcgtgcctgtccactgttggctaacatgtgtgcatatacttgtggtgtggacatttatgctgaaaactgaaaaggcagtattgggctgtggtgcatttgttccctgctggttctatgcctgatgaagtgatgattggttgccccatttgatactttggtctgtcatatcttcatccatgcttggttgtcctatgtttggccactgcttcctggatctgtcaggtgttgtgattccagttgagttgagtttagagggcactaatcatttcactgtaaacactgcaggcctgcaatttcagagctgattgcaaggattcatgtgccatatctatctcccctcttctgtactgtagtagtgtgtaatttgagctatggattcagaatcatcaaacagtcggcaatggttgttgagcaatcgcgactacaggccgttattttatccccatattagaactatagaatagaataaacacgcacgtacttttcattgtaaactgtagcatcacggtcctaccaatattctactcctaatcacgaaatctaccaatattctaactcctaatcacgaaatccaggatctgaaactctgaatccagcaacaataatgaaatctcaagctctgaactctgaagcagatgtggagaaaagccagctcgatgtgtgtacgtactcctatgtaggagtatcaaatgtatgattgattgaagccgtgttctttgttcttatcctcttctttcgatggagtgcatattcggacattcagtttgatgtcacgggtgggcctctttttcgctttggaattgcatcaaccagctcagaatctgaacgaaacatgccaagaagaagcaggcgcatattacaaatggatggcgattttctctgaatctgccgcaactttgaggcccggtttagttaccaactttttctttaaactttcaacttttctattacattgaaattttcctacacacaaatttctaatttttccatcacatcgttttaatttcaatcaaacttctaattttggcgtgaactaaacacaccctgaacagctgaactgaattcgcgctcgtagagagagagagagagagaggggcacatggaagcaacatgtgccaaccattgcatcctatggtgagttaggtttagattgttactaatgtaagactcggttgattttattaccgttttcaaactagagttggacaaccgggcgaatcttttttgtagttgtatgcagcaattcttggagagatatacaaatatttgtgttgaactttgtttgtttatagcgttgtgctttgggtactacattttcctcttgtttcatcctaacacacttatgataagatcctttataatgtagtaagattttttaaagcaattttaacgggaactgaatcagtattgtgaatttttttgccataccactcctgtgtttcaagggaaaattaagatctatactatatttaaatgcatccccttgcagagtcaagtgtccctaaagtccattttcagcacttgaagtttttaatagcagatcagatgtagcttctgttggtgattactccctcagtcccataaaaaacaaatctagggctggatgtgatatattctagtacgatgaatctggacatatgtatgtccagattagtagtattaggatgtgtcaaatcccgtaataggttggttttttataggacggagggagtacgcattgtgtgtttttttctaccctgtaatttcaattcataagctgcaaattgacctaaacatatgctttcctctgttataaatatttaacgttcaagataagaattattcaaaatattaacatttcaaccataaaaaatatctcacatgtttagctcaaaaaaaaaataaactgcatataattacctcgaaaaatgctatcataacagtatcatgaactttactatactccctctgtttcaggttataaaatgttttgattttggtcaaaattaaattgtttcaaatttgtctaagtttatagacaaatatagtaatatttataatactaaattagtttcaccaaatcaataattgaatatattttcataacaaatttttgttatgaaaatatattcaattattctactttttctacgtgttgaaaatgttactactttttttctacaaacttttttgacgcgcttttttctacaaacttggtagaatttaaagcggcttgactttgactaaactcaaaacgtcttataacctgaaatggagggattacaagattaatggtaaaaataatcttaaagatttgagccaatcttgttccaagatgtcacggtaggaaatcatcaaaaatcataagattggatcagaaatcgcatgctttcctttcttctagtatcatttttcctccctttttatttattttttcgaacaatccgaaatccgatcatcattagctggttcccttccccatatcgagcggcttccttcttcttcgcttcctctcctctcttcgccatttttctactgcttttactgcgccccaaatcaacccaccctccgcggcggcggcgcgattactcccgtgctcgctcacttaaccctagctccctcgccgccgccggcgatgtcggcgccgcccgcgccgccccatccccagccggaggagctgaagttgccgaggaaccccccgccccggcgggaggagtggggaacgacaaggtgctcgcggcggcgcagcacatcgtgaagtcgctggccacgtcgaagaacgccgcggacgacatgatccgcatcctctccggcttcgaccaccgcttctcctccatcaccgccgacctcttcccctcgcccttgccgtcgtcgggcgccgggcccaccccgcctccgcttccgccgccgcggggggcgttcgaggccgcggagaggctcatccggcagtgggacgcgacctcggagctgctggtgttcgagggccccgagggggacgtcgccgactacctcgaggcggtcgacgtcgccgtcgaccagctgctctccggggtgggggccgccgccgccgacgccgaggccgaggcggcgggcgtcgtggtgcagctcgcgatggcgcggatggaggaggagctccgccacctcatggtccgccacgcggtgccgctggacgcgagcgggctcttctgctcgctgcgccgcctctccctcgagtccatggacgacctcgacacctcctccgagttcgatcccatcaccccgcacagcctggagggcggcccggacaccgctcgcagcgccagcctcgtggggaaccccttcgacgaccaggtgttcgacctggtgcgccctgaggccattgacgatctgcgctccatcgctcaaaggatggaccgcgcggggtatgccagtgagctcgagcaggtctactgtggcgtccgacgtgacctgctcgacgagtgcctcgcggtgctcggggtcgaacgcctcagcatcgatgaagtgcagcgcatggagtggaagcttctgaatgacaagatgaagaaatgggtgcatggggtcaagacggtcgtgcgttccctgctgaccggtgagcgccggatctgtgatcaggtgctcgccgtgtctgatgagctgcgtgatgagtgttttgttgaatctaccaagggttgcataatgcagattcttaactttggtgatgctgtggcggtgtgctctcgctcgccggagaagctctcccggattcttgacatgtatgaggcacttgctgaggtgatccctgaactgaaggagctgttctttgggaattctgggaatgatgtaatctgtgatttggagggggttcttgaaaggcttggggacgcagtgaagggcacacttctcgagtttgggaaagttcttcagcaggagtcatcacggcggcctatgatggctggtgagatccacccaatgacacgttacgtgatgaactatcttcggttgttggttgtttacagtgatacgcttgacaaactcttgggtgacgattctgctggagatgttgatcatagtgatacgcatagaggtggtgatgatgaggaggagtatttggagagcttgtccccacttggacgacatttagtgaagctgatatcttatctggaggcaaatttggaggaaaaatcaaaactgtacgaggatggtgcactgcaatgcatattttccatgaataatatactctatattgtccaaaaggtgaaggactctgaacttgggaggattttaggtgatcactggatacggaggcgccgtgggaagattcggcaaaattcaaagaactaccttaggatatcatggactaaggttttgtcttttctcaaggatgatgcacacggcggcagaagcggaagtggaagtggtagtgggaatagctctaggatcaaggagaaattcaagaacttcaacttggcctttgatgagatatacaggagtcaaacgctctggaaggtaccagatcctcagcttcgtgaagagctcaagatatctatctctgaaaatgtgataccagcataccgtgcttttctggaaagatatggtagtctagtggatagcggaaggaattcaggtagatacatcaaatacaccccagaggacttggagaatcagctgtctgatctatttgaaggttcactagggcctgccaaccattctaggagaagatagtagctcccatttgactaaatttggtgacaggtatgcttttgctacaagggatgctatgtgtccgaactgctgagtcatcacatggactgattggtgccttttgagtttagattgtccccttggttattacaatattgtaatactatacaaggatcccttcgtttttctccatcagattatatgtaccaagaagtgatgtacatacattgctttttcagtgtgttcatatccttgcacacttcatttccatgatccagtacctttgcactttgtagggtggccagttcttggaatagatcagacaagtaataggcatttgttgctggagcaatcttatctggcaagatactgatatgaattaaatacatttattgtcgattctgaaataaacgtaattttagtccatctgtaggctattgctaggaggtaatgatggtcttttgataatattctttgagtgtgattcatacatctgcattttggaaaagctatctcatttttttagttatattataagaaatagcattttgctatgtttacgggatctgtactcagggtgttgcacattttaagttccttttctttttctgatcatcttacacagtgttcttgttctagccctcttattcttatttaaaatgaaaacttgttattaccactgtccagactggtcaacatctaatttcatactactatgtcctttcacgttatcatttgaaaaggctatctaattaatacttgccttatcccaatactgttcataatttacattttgcgagtattattgaagtttctttggaatgtacaggggaaacaaaaagaggaatacacatccctggtcctcattagttggatgtcaattagtcagcaaaatttacacgcgtgacaactaaagaatgaaatatgaccttctatctaaacagttgcatgctaagtggattaaattccatgcattttccagctccagaattatgaaatgtaccactattagttgcttatatcaagtggctttcacatctgtgccaaattcagcagaacact

SEQ ID NO: 11137 - DNA, 7106 bp, Oryza sativa
ccatcagcagtctccaggtaaagattttgatttttggagccatacatttatcttttcttacctgtttcataatcggttttaacttgttcacttacctaggcatcttgaggagcttctctcttccagatttctttatatgcactttttgaattacattctccgttagatgtgaatttccagcaaagcctgtctgctatattatcttggataattggtacctgcaaaattttgttgactacctgttgctcaaagacggagttcaacttctgtatatcctagcatttgtcttatgtccagagatctgcaacattattaggcaattgaacttgcatagagtctagttttaagaaatcatggatatcagcatttagatcacaccaaggttagctccaaacagacacacttccatcagctaactgccaagacacagaatccttgagagttttcctgagattcagaatcgagctccaaaagatagatttgggagaattcttagaggctctccagaaggaagtatttgggaaatatttacctttcaggatttgagataccggctcatcaagcttactgactagtctccaggcagcatttagaatcaggctcctgttcgccatctgaatatctcttatacctaaaccaccatcctgaacaggtttgcaaatatcagaccaggatttaaggcagagaggcttcttgtcctgaccctccctcactcctgtccaccagaagattctgatgatagaagtgagtttggcaatgatctttttgggaaggagggtggtagccatgtaataaacaggaagggaggcaaaaacagttttgattaaggtaagcctaccagcatgggaaagtttgttagcctttagattagtaagcttggctttgaatttatccacaatgaattggtagacaaaaatttttgttctattagtgacaaagaggggatggcccaaatgtttggtattggaatcaacagaagcaacatggaagatggttttgatggaattctggatgtaaagaggagtggatttgctgaaaaggatggcagatttactccagttgggagtttggcctgatttgttgcaaaaatcctcaatgatttctttgatttttcttgcttcgatctcagtagcttcacctgtaatgattaaatcatctgcataaaggagagagtgaatggccggcccctgagggctaagtttaatgcctttcatctgattattaaggagatcctcattaagctgatcagaaagctcattaagagccaacacgaacagataaggagaaagaggacaaccctgtctaacacctctattagcattgaaagcatcataagattgaccattaaaggtcacataaaaggaagaggagctgatgcaaccctgaaccaaattgatgaaattagagtgaaagcccttctttttcatagcagaagcaatgaaatcccattccaatctatcaaaagctttggagagatcaattttcagcagaaaacctttgtttttgaaagagttaagaccaaaggaatgaacaatttcctgggcaataataatgttatttgcaattcttctcccaggaatgaaggcatgctaagagttaaagattaggtcaggaagtttacctttgattatgtttgcaatggatttggcaatgattttgtacatcacattacaaagactaatggacttgaaatctgcagggttagctggcctgtttttcttaggaatgaggacaatattggttttgttcagttctttgggaagattacctgtgttatagaagtcttcaacgagcttcatgacgtcatcttttatccatccccacgccgccttgaagaaggctacattcatcccatcaggctcaggagaggcattgctcttcatgtttctgatgatttgccaaacttcctgttagtccgggcattgccagtccatttgggctgggtcatcattacccgaagaatatgtactcggcctgttagttctgtctgaacaaaagagatcagtgaaataatcaatgaaaacattagcaatgtcatcagggttagtaaccaaatgattattagacatgatagaagtgattctatttttccttcttctcttgatggcggcttgatgaaaaaatgaggtgtttctgtctccatccttgacccaatgcttcttggctctttgcctatgatgatcagagagcttctgtaggagagagtcgtgtttggcaactagctctttctccttctccacctgctgatgtctgtcattggaagactaaatgtctaggatttcttgttcagtgttactacctccgtttcaggttataagactttctagcattgctcatattcatatagatattaatgaatctagacgtatgtgtgcttagattcattaacatatatatgaatgtgggtaatgctagaaagtcttataatatgaaacggaggaagtagcaatttgctgttgaagaggtttcttctttttgctccaagataagagattgagacctaatttctacgcttttaaaacaaaagaaccattaattttgtcccagctatttttggcaaagtcatgaaagtcattctcagttagccaccaattctcaaacttaaatgaattttttggttttctgtgagaaggattaagtaaaatcaaaataagagcatgatcaccataaatgaaagggagatgataaatagtagtattaggaaaattagcacaccattcaacattagccaggcatctatctagtctttcataaataagatctctacctgaccttttattagttcaagtgtaagcagggccattataacccatatccatcaagcccacatttctcagatgattacaaaacatggagatacgattaagatcagggagagcattaccatacttctcccaagggttcataatgtcattcaggtcacccatacaaatagtagcacggtgattactttgattaacaaaactactaatctcctgccaaattctgctagaactatgatgagtaggatcaccatatatacacaaaaggttaaataacatgagtggcctgggacctgagtctgccacttcagtagcatagttgaaaagaccggaccagtgagtgacccagtcaacctcctgttcaccggtccgatggttagatcgatggctaattgatactccatccgtaccaaaatataagagatttagaagggatatgatacttcctagtattacgaatctggacaaagagactgtctagatttgtagtactggtgttggtgacatgggggcgagggtatcgtgactagaggcttgggtagccgcggtcacccacgtggcctgaccccctcgggggggtcgggcccgaggatgatgtggccacccctccctctgtctcccctaggggtcaggccgcccctgtttcggccccaggggctggggcgccccgaccccccgtgattttggcgccacgtgtatgggttaggtgagcacagcggggctcacctaaccgcatttattgcgggttggacgagcgcgccacgccgcatttaatgcagcgcagcgcacgcttatccggtccgtgaccggtcgcagtgtgtgaccggtcacagaccggtcagatcgcgggttaggtggcaacaggcagcctgtcacacgccttgccccgtcccgtcggaatgatgagagcctccaggcactcgtccctagccggagccggcgtgctaactcctggagttggtgtgtcagtcccggccagattcattccaggcttcatcgcaaccatggcaaggaagtcattgtatgaagaagggcagacgtgcggcatgctaaactgacgcgcggtgaacaagaatgaccggtctgtgactggtctgacgccggtcacgtcatcggcagacaaccgtgttcccacgttgcatctgcttccggcggagtggaggtagatatgacccatcccatcggagggtcattcggacagcggccattgcaaatctccacccattaatgaaggaatgacagggttatcccctatgtcaggcgagtgacggcgctgggcctcactcaaggacaagttgtgatttagcttccaggcgaaggcgcgagccaagtcttggtcaagatagggtgggtccccacccaaaagaagagtaggtagaagtggtgcatgtggtatccccttgagatataaaaggaggaccttgcccaccgaagaagggggactctcagacgacactgaggatacctgaactcgtagaggagagaaagaggaagaggggttctagagcctgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacagatcgagggtgaagaacctcacttagcgcccccggccgaaccggcaaaggggggcctgcgcggtctcccggtgaggagccccacgctccgtcaactgggtaatgtcacatctctccaaaatacattatattatgagtcggagggattacaaatgctttatatttccatatcagcactaacaacccaatgcttggatcgctacaggagtcaacttccaacccacccacttgagttcaactccccaccattcccccttttgttggtgatttttgcctaaatatctagttatttcgagcattcgagttaaatgggccttcttccggcttatttaaacaattcagatgtctaggccagtccgaccaagaccaatttatcacggttcagtaatcaatgccaactatgctcagtagtaatcaatgccaactcgtctctctcctatctctggcgtcaataacaagagtattaatttactggaaaagctacaaatctatcaacagttttttctctaaatatatttcgatttctagtccattgatcttgtgttaagatccgtgctagttgtatggagaaatagaaacacagcaaccacaagtgtggggattcgatcccaagaccatgatcacacacatcacttcttaacaaagtgagcaatcagacagtttatagaattaaaactagagtgaattccactttggactaggtttagttacatatgttacaaagtataccaggcataagtaagcctttttaactagaactaggtattgttaccaattttgcaccttgtaccggtggcccacattccagtagatctttctccttcttcctcctcaaaactccctgagcccaagtctatccataccggtgagcttgtctcttcagccagtagaagcaaatagcagccggccagctagccctctcgggcccactccaactcctgttacacggccggctgcggcctgcagaagtgccaggagcgcacaagacgaagaacaacgagattgaataattgaatcaatgcatgcatatggcatgagaatggtgcaggacaaccactgcattatcagctctcctccaattgtcttggacttaattatttccttcaaattgcaaatcgggagtgtcgcagccctcagcggaggtcgagcgtggctgcagcgctagtagagtttgagcgtgcttagtcttctcatccagcctctcctctctccacctcaagtttgtctagagcatctagaataaatggagatgaggcaggatagatcaagcgtgcgtcggcaggagttgttgagaacagcggcagtggaagaactggcccaaagtgaaacattaatatagacttccctggtccaaagtgaaaacttagtcctatctctagtccaagttacaatttagataaaaaatagtggtccgatatgaaatttactcttaaaactaaaattacacctaagttagttacatagcaattacagtataattatatacaaattatatttgaagacgaaacgagcatgtagttttcgagtaattgtgggacacatagctggagaatttatttatttattgagccgtctgtaacaacaaagtttgagccgtacgtacgaaagcacgcacgcaagtgatgcgagttggcgcgacgggcgacggcggtcgatcgcacaagcttttggttttgcttgaccggccccgcccggccgcacctattcgtacgctggtttggccgctgaaaacttccaaaagaaccaagctaaaggctaaagccgcttgcacgcacgtgtagacaggagaccacctttattagggtatgtacgatggttatcaacagtggtttaattctttgcattgctaattaggaatacctgttgtctgttgacatggaagaaagagaaagaggaagagacaaacatcgttgttatacataacaacggctcttaatcgagatttctaatgggtgaacgatcgttctaggcgattggtttttttttctttttctctcaaagtaagtttatacgcctaaagtttacacatctaaaatttatccacctaaagtttgtaaagcgaatgtttataagtcaaaagtttatatacccgattcaaattcaaatttgaattcaaatattttatattttcctcttttagtaagtttatacacctaaagtttacacatctaaagtttatccacctaaagtttgtagagcgaatgtttataagtcaaaagtttatatacccaattcaaattcaaattcggattcaaatattttatataaaaataatttctatacataaagtttatgtgtgcaaagtttacggtataaagtctatgcacataaatgagagtattagatttttttttctaattttatttactaactttgtgttttttttgaattttatgatgaaaggaaagaagggaaaggagtatagggggaggggcgggttgatcgcttccagcgatcacccacccattagcctcatccgctcttgatcactataatatagaaatatggttgcatgagggtaaaaaaatggaaagaatattaagaaaaggaatattttttgagataatgattagagtttttatcgtcttaactattgtaaagacatggtctctaaataatcttatagcattgtttaagagaccatagtcgtctctaccattgaacaaactcttaagctttctttgatatac

SEQ ID NO: 11138 - DNA, 16915 bp, Oryza sativa
taaaactatatgtttacataaaagtatatttaacaatgaatcaaatgataagaaaataattaataattacttaaattatttgaataagatgaacggtcaaacatgtttaaaaaagtcaacggcgttatttagggacggagggagtaacaattaagcgtgtcatcaagcgacgccggccataagctggctgctatatatactctacaaacacatgtatggtcagtatggatagccaattaagcaaggaataaatcgaacgaatgaataccatgggctggactggctaaaggttaggcgatgatctgttagctcgatccttcggtgatctcctttatttttgctaaagctggtacgtgcgtgtggtgcgtactactgaccggtacacctgaccaactcaattgcctttgttcccttggctgagttgcagtgcctgtagctacagagtacagactgggacaatggtacggaagcacaggagatcgatgcgcctcttgcgagtgcggctgtcacggaaagcggccataaacggccctcagaataaattaatcttgtataaggtatgatatattttaatacgtataaggtataatatattctaatacgtttttatccagatttatagtactaagataatttagtctgcatactgcagcggtctgagcaaatgctatatattacacgtaactgctttttaatagctgtagcccctgttttgctggttgttacagacgttgcaggggctgcgaggaggccagttgatgagctcccgaaaaagccgcatccctccattcctgtcgatacaaaggaggcagccagcgaacatccatcaccgccttgatcgccgctgcctggaaggcatcagagcggtcggggatgcggatttaggaggtgccgaagaagaggagatcggtaacggtggggttgaaaccaagataacgagtgggtgcaagccgactataaggaactgacccctcaatgtcgacgtttgcgagttcaggggccatacctcgtaagagggtcggacgacggcggcacaagctatgggctcgaggctcctcatcctctcgcctcgacaccgcggcagttgtgaagactataatgtgataaggatgggcggaggttatgacaacagggagggcgtgacctgatctggcgagccccgtcctctttggtgttgggagttggtggggccatcaggaaaagctctgggtgggtggcggtggagcagtaagcttgagtggtgggtggcggtggaacagtgagcttgagtggtgggtggcgacagagcgggagctgatagggctgctacgtccctgtatccaacgttggcctgccaccctggaggtcattggccggccgttccggagttcgttgatagggagaagaagaaaagaaaagaaggaagaagatagaaaacatgacattgctagcaaggttctaattttacaaaatcagcatcagctaactgatatcgtgaataatataatagtagtttcataaatcagcacatctacactgacatgaattcgattaagcctaataatataaaatagtcggtggacagcacgcaactacacgcacaacacaagagtccaaaattattcgttcctgcagccgggtggctagctatagtaggttgtggtatatgcataccttaagtgctcctcagatcgtcgccggcctgcatgcaaactttccagccaaccacgcgcctatacgctcgcgcgcacgcactctcgatcggtgaactttacggccggccgggccggccagccagctgcttgcattgtgcatggtcgtagcaacagggaagcttagcgacgaaggctaagcttagcttttctcataaacagtgcgtcccaggcagttagggagtccgaatcatgtcacttcttgcccttgcaaatcgcaatcctctgtagccatgaacagtacgagcaagagcacgtacgatgaaatttgcgcagctcagggtttttttttttctgaaaaaaaaacatcgtacgaacacacgcagacgcttgattacaatgcacgcatactcgtctctatgaatgcacacacgtacatcatcacaccatatccttataaatacctctgaatgactagagatattaacgattatctgtaggattataactgctcataaattttacaggatctttagggaatttgtttcaatcatataaaattctcataattaaaaaccatctgttccaactgtactgctgcccttagctttctccttcaccatatttaaggttttcggcgaattggctgcgtacataactcaacaatatggtattagagcaaaatatctttagccttggtgcagttagatgtttaaaacatcaaagaaaaaaggaaaagtactccctctttttaaattactcatcgtttcagctttgtaataaatcaaatatttttaactataaacaacattttctataaattttatatagtttaacatcataagtttatgttttagattcatcgtaaatattttactttcataatttgttaaactatataattaaatttctagatattgatggtaaatgttagaatttctaaaagcaaaaagaagtacaagagatatctctatgaaaatgcatgataaagtagcagcagctagctagccagcacacaattgtacaaagcaccttaattgataacgagcgcacaactgcttatagatatggaaataagcgcacaaacccacacacagattattaacatcatgctgtacatatacagtaccagagtacgatatcaaaaaaaggacaggctaacatgcacatcaccgaaaaaaaatcgaaagcacaaacatgggaactaaagcgatcccaacacatgaccaaaatcatcaataaccacatcgacaaatattgcgcacacgcacgcacgcttaatgccttgtttacatcaatcccataattgggggcttaatttgcaccacacacacaatgttagagcacaacacatacaccatcacttttactctctttctgccttaaaatctcaataatctctctctgtgtgtgtctctacaactttgcatgcatgcccatcaaataatcatctttagtgagttaccttttgctttcttgctgacagctagctacacactgcctttgttatattaccacatgcacacactctctctccttttatgtgatgtttccttagcattgtaaaccagctttcatgtgatgtttgaaacttgaaacttctagaccccacttggtcaccactcaccaccttattgcatctctataaatacccttgctatcccacattccaaactccatgtccaaccatccaattccaagcactactactcatcactagctcacacacaattgcatacacctagctcaaaagcctttctatttcactaattgtgtgtgttcattgctagttgcattgtggttttctagttaattaacaagctagctatacctagcttataattagctagagtgtgagcttataattagttagttagttgaaaacaagctaagatgaggagcaaggcgtccatgttcttgaagcagatggtgtcgacgatcgtggcggtggtgaaggcgaagtcgacggcggtgagggccaagacgagcgccatgaagacgcggctgctcatcttcggcgtcctccgcaaccggaagctcctcgccaccgccatcaaccacaagatccacgccatcatgggcggcgccgccgcccaggacaccaccaacgacggtggcgtcgccggagtggaggacgacgacggcggcggcagcaagaaggccgtggtgctgtacaacaccgcgccgagcttcctcacggagcgcggctactacgatcacgccggcgaggaggaagaggaggaggaggacagcgacgagtacctgacgcactcgttgttccaggaggaagacgacgaggacgacgagctggtgaacgcgccggggtcggtgatcgacctggtgcgcgacgccaaggaaggggaagtcgccgagttccggctgtaggacgagatcgaccacgtcgccgacgtgttcatccgccgcatccacaagcagctcaagctccagaagctcgactccttcaagaggttctgcgagatgctcgagaggagcgcctaagttcatacccagatcgccaaactttttggctcactgtgcatggtgaagaaaaaaaaaccttttttttaccgttaagccaaggttaattaattgattaattacacacacaacttggtgacttttgatccatgcacgcatgtaagtagagagaataaagtgacaaagatatatacttctcttgtagaaggggttcactactttacttaattagggagcagctgctcatgtactttataatttacttgtcttgttctttagttcttttgatcagggggaggtatatcgttaagcttccaagaaattattgagtaataaacaaataaaaaagttgtagattcctgacattcagttgggtctatatctcacttctgttccatgtagtctaaactagggatgtaaacggtcggaaatggtcgaaaacggtatcactattttattattttttcgaaaacgaacggtaacagtaggaaaatttctatatttatgaatttatctatttagtgtcaacttcaatatttatctatttagtgtcaacttcaatgccacgttgacagaaatttaaaaaactaaaatttaaaaacggtaaccatcggtaaaaatattattattatattagttttacggaaacggtataagtacggtcgggaaatttctataccgtattcacccctagtctaaactatatttgtctcgatcaatttctctcatactattaactagcatagatagtcgtgcatttgcacgactttaaccccctctatacaaaatgtgtctgcatttcgtggttttgaaacatactatttattactttttaaataattcatacataacaattaaatgtgtcagttagtgtaatagatatggttagggttcatattcaacttctctgtcatagttttcctctacttatttactcaaccataatcgtctatttttttgtttgtgccttagctgctgctttgccacttttccgccttagctgctgttttgccaccaaaggggctcatcttttcacttatgcttatgtttatcagtcaaaatttgaattttcaacattaaattttgagttgattttaaggttttttcatcgaagtttatttttcagcctttgcttttatatcactaaaaacacgtatataaaagttttattcacaaaacccttttcgtttgcaaatatatcggttcacttattccgcgaataagtgaaacgatggctccgcaaatcaccaatggccacctacattgttgtagtaggagccctttattttcctattatattctatccattgttcatttcagcaaaaaaaaaattacatacttggatacttgctaaaaaaacgtatttagcaagaaagcataacatagctaaatttatcttgatatgtaataaatatttttttcatgcaaattaatagtttacaatgattatgctaaatttgcgaaattactgttgtataattttactgttactcctctgttcataaatattataggtttaattttgaataaaattatgtatcatagtcacaaccataatataaactgttttgagatgttaggcttttttttcctttccattgttttgtaatatttaattttttttagagatcactttgatagtttatttatgcgcgttcagtggtggtctcgtggagcttcccggctcgcgagctttctgttggaagcttcttgaaggccagctcccgaagccgtattgcttgatctttggcttgtacagcagtacaggaatataatccaacggtttatatcacttgctgcatgcattggacggtgtttaatttgtagcttatgtggctcaatcaggttttgagaaagtttactacttccaattctactggtgggccttaatcccggcacatttgtggataggcccattttaattcatatctcaacccatccacatctaatgggccggaataccggcctgccaaacaattcaaggcttcaggggtgaggacagcttataacagcaaactcctattgaaagaaaaatatttacatatacgattctaaactagattaatggaacatgtaaaaaaaccttggcaggattacatgcctattctattaaggcggagcataaggaaaattatacagattggaatatttcctgtattcatacctaaagatagctttattttaagatggaaaactcaacccccatcattccgctgtagctgattataaaccgcaacatttattagcgataggaaaaatttatgtgaaaaacttttatatatgtgttcttagcgacttaaatgtcaatcctgaaaaacaaaaaaaacaacaaaattaattctagtgtaaatatcgtaaaactatatatactctgcacgatctatcacaaaactacagatttaagaacttgtttcacaagacaacatatttagtgtttttgtttaccacaaaactacaggtactttgcacaatatatcacaaactacatatttaataacttgtttcataaaactacagatttagtgtctttatttatcacaaaattacaggtttagtgtctattattatcgtagttttgtgataatagagacactaaacctgtagttttgtgataaatgaagacaccaaaattgtagttatgtgataaacgaatacactaaatctatagttttgtgaaacaagttcttaaatatatagttttgcgatagattgtgcaaggtatctatagttttgtgaaacaagctcttaaatctgtagttttgtgataatttgtgcaaaatacctgtagttttgttaaacttactcttaattctaaaactaagttctaaaattgaaattttgatcgtggctaataggctaacgatggagctgcgaaatggagcatagcttaactggttaaggacccctttgattcacaggatatgaaaaacacaggaattgaagtagcaggtttctcaaatcctaggaatgagcaaacatgctatgggaaaaataaaggaagattcacaaagaggtcacacctcttactatatttcctatgaaatgcaaagcataggaatacaatcctatgaaaagttttctttccttcctatgaatcaaaggaacatgtaggaaaaaatctataggaatttaaatcctatacaaatcatttctcagtcatatgaatcaaagggccctttctttatggtataactaacctgtccgaggttaagttatagttttgtgtatgttcatagggatgagaatgcatgcgttgtgagcatttctagaaggctacagtaacctacgcagagcagtattacctccgtcccaaaatacttgtcgctttcagtttttgtttgtaacttttgatcatttgtcttattaaaaaaattatagaattgttatttattttgtttgtgacttgctttattatcaaaagcactttaagtatgatttgtcattttttatatttgcactaatttttcaagtaagatgaatagtcaaacgttacaagaaaaaagtcaaagcgaccactattttagaacggaggtagtaacatctgcactgtcggttcaaaatcgtgtggctgagggggtgtttagatggggctaaaactttttagcccatgtcacatcggatgtttggacgctaatttggagtattaaacatagactagtaaaaaaactaattttataaatgagagctaatccgcgagacgaactttttaagcctaattaatccataattatcaaaagtttactgtagcatcacattgtcaaaatcatggcgtaattagactcaaaagattcgtcggagcgaattagtccaaggttatggaatgggttttgaaattaatgtatgtttaatactctaaattagtgtctaaacatccgatgtgacagggacttaaaataagtccctggaaacaaaacaggccctgagatcgatcaatccccgaacggaagccgtacaagtcaacgtaacatcaacaactgtttcgcgaacaaaaagagtacaactgtttcgaaaaaaaaaagagtaaacatccacagctatgggaaatcatactggccgtccgatcttgaattaatgagcgcgagagataagaagggtttttttttatatataacagagagataagaagagttaaacaaacatctcttttgtctctggaagattggggggacaaacggataagcattaggcactgccgatgacgatgcaggtgggcccatttgctctaatctgccgagatgaggatgcagatatgagatatttgtctttcttaacataaattatctcgtgcacatatcattcgtcccttgaaaaaagttatactaccaaagttgtttacacacgggcttttgattataataacaagtaaatcaagcatatgtccggcctactactgaaacagttaaaacagtattttgtgatcaatatgaaactctgtaaagtttattatagaataataaccggtattcaacgaaaaaattgtgtaacatagatatgtttatacgttaattaagttccttacgtttaatcatatgacaacaggattttgagcaactatttttcttttttaaaaaaagatctagtcatttttctcatccttggacggaaattaaaggttgaacaatgattactgtaactaaaacatccaacaaaattatataactagtaaaaaaaatcacaaactatacaagtacccagacttgcatagaacaccactttgaaaccatataaaataaactaaaaatgcacattatataggggtataattgctacgtgcaattttaggtgactagaaaattgtatgaatttccacatgactaaagtccagcaaatccttatcaaaattgatgttgtgataagaattttcccaaaaaattgtgacctatcgagttgctgtaatatttatggcctatttcaatttgctataaaaacagcaaagaagattatcccaaaattataactttatggacaccttaacattactaacccctggagccaacatgacatagaggtgatatccggcatgacgagacgactacgggatatgttagcatgacatatcaacatgtgcattggagcactatatcaccttagcagacaactaagccacctactttaatccggctgtaacttcacttgtacagtcggtgcagctggatcaaaatgcatcaagcttaaaaagggcaaaaagacaagatgagagggccatttatcctatccggggatgggtttttgacctaggtgcaccaatcaagtgacgtttcaagtagacttgattgcaatagtgtaaccggatcggagtgacgggccgagtagttttctaatgtggcatgccactacaatttatacattactaatgtatcaggctaacatgttccgctgtctcgcccatgctaggtatcatctctataacattccttaatatattatgttagggtattcatagagttgtttttttttttgataattttatttgctacccttgtaacaaactgaaatgtgtctctaaccttgcagcaagcacttttcttgtagctccaaaaaaaaaactccagttttcttgtgcctctagcattttgcagcttctacacgccgcccgccagctcagttcaccggatccccgggaattaaaatcacacgagatcgatcagatcgcacgctgagacgtatagacgacgtgggtcccgccaaagtactgggcccaccagtcattggaccaccgtacgacgacatgtgtgcacctaccgtggacttcgctggaaaaaccaccgaagccgccgccacgtcatgccccggctgcggttttctttaataaagcccagaacacaactgccacacccaccccacttctacccaccctcaatgacgagtgggccccacgccaaaaccgtccccaggacgttagtgtccgtagccgacgcgcgccgcgtcggctgacatgcgggccccacctcctcgcggtcggatcagcatttcgcctttcgtcgtcgtcgtcatcatccacttccacttccaccctcctctgcatttgcaaccacgcgcagacaagaacaagacgcgcagcaaagcgcagcagcagcagcagtattaatcgaggccaaggacaaggagcagtggcaattgttgttgggagaagagcgagttgttgggagggagaaaggccaagaagaggaggaggaggaggaggaggaggaggggatcaatggagatggagagcccgcggagcccggaggcggagatcgggcacagggtggaggacctgtgggaggtggcggagccgcagctgtcgccgtccgagaagctcaactcctgcttcgaggacatcgccgtcgcctccttcccccgcccccttggctcgcaaggtaggtaacttactaacgcctcttcttcctactttgctcctcgctgaccttgccatggcctctgctgctgctgctactctctgattaatcagttcttgatgcgagctgagctgacatgaccatttctgtgtggatttggagtgaactgtgtgctgttcctcttcagttggggtgatggatagatggtgaacaaatttaggcattcagaattcttgttggaattgatacggccagcagccagttagttcactgattgaggaatgcgtttgctgtttctcctgattggattgaagtcattaaactggtagcattagaacctatcttgtcactattgtgggttgagccatcagacatgtctctttcgtgtcctgtcctactatatataccactacatatatagtcatttcattcctttgtgcagttgctggggccatatttgcattcttttctgaagcaaatgttccttcgtgcgggttagtgccgatggcctacatcctacctccagcctggccaatttttgttcttgacgggttgaaaagggtggcactgttttatgcaatcagtgacaatgcaataggggattgtaggacttcggtcttatctgtatgatgaagctttttggttttagacagtgaactgtatgattgagtcagggggagcatggtgattgctcttgttgaagggtccttttcacttcttagacacgctaaagaagaacctttctggatttcctttttatttgtgccaatatgtgaacattcaatggcatataaggaatcttctctataaatatagatatctgcttactgacaaatgacttcgctctcatgattccaagagatgttctagaacggtgagggtccatattaccgtctgatttcttaattgtgatctttgctataagactaagcagaaaagttatttgggaaaataggacctgtttaaacttgtccttggctttcgtcttgttaatatctgtgttaaataatgtgcttttcgttggtggttcctggtggtcgatacagattgtacagataggtgtagcttttaccaatagtcagcattttgcctatctcggctcacagctatttttctatggccacatgatgttaacatggcaacctcaacttcaaaatcctaagttggacatctggtaataacaaaaatcatactccaaaattgttaactgaactggtttgttgtaccaatgccacattgagtgtgcttttattaaactcattgacattatacggatctgaagttttatacctgaaaattgacttcactatagaaatttgtcatgagggagaatgcaccttgacttgtacaaaatggatttccaaccatcaatatatattgacatgaactcattaattgccacaaaaggtcatatcttgttacaatgtcagttttatgagcataccatgtctgataagcagttcctatccactttgcttctttcagaacttatgttcttggcttcacagaccaacctctttggtatttcatctccatgcatctcgggatcgataaacctgttatccaatccatacagatattttagatgtgctttgcttgagttttggaaaaagtgtagtctttcatcatctttcggtcacacatgctttcacaaaatcattttttttaatcattgtactcaagcgaatgtgaaaaaacaattgattctgaaacatgctggacctgtgacatcatattatgcaccaagaggctagtatacttatatgcaccaagagattattctgaaatgctctaatactacatgtatatcataggctcaaaaagttgtcaggtttaattatgcaaaattgattactggaatattattcaagtaatacgaattgagtactttctatataccataggctcaaatagtttcctgtagaacacttttacttaatatggtttcctgtagagtgcctctttttttttgtgcaaagaatgcttttacagctacagttttaacaaagataaacattttttttcccaagaagaacctgtaatctatgattttggtattatctaatcatcaatttaagctacaacttttatgttctttttctgcagtaatcgagataccttcaaatgctagtctggctgatactgttgaaatattatccaaaaacaaaattttgagtgcacccataagaaatgttgatgctccagaagatgctagttggattgacaaatacattggcattgtggaatttgctggtattgctatgtggttgctctatcaggttagccaccttaatactagagcactacttagttcctctctgtttctttttcagaaaaatatttgtctaatattatgttgtatcatatcatgctatatttgtgcacgctgttgaattttagtatcataccacgctagttgaatttgatgtatcatatctagtccagctttaatgacatggtagattctgacatgcttaatatgtatcattaaattcaaccctaattatggtgttcacaatgagctttcagtttcttttctcaagtattgacagcattttcatttttttttggaattcaaatacccatgcatgggaagtacctcgatctaggcttagtatttgttggactgctcatcaattcattcacaactgctaaaccatgaaaacacatttttcagatattacttacatgcttgttctttgcaaaataacacttgaatctgattgaaacacaaaaatagttcgtttaaaagaaaaatactctgatatagggaaggtaattttatatttggtgatacaattataggaatttcatgaacatcccatctttctgacatgggttgctttttctgttcctacaatagtctgaggctgcagctaatggcacggctggttctgccgtagggtcaccagtagccaatctagtatctaggctaggctctttcacattcagaaggacatcatctggcagggtagaaaccaccactgacccagaatcagatgaaaccgcatcggtcggtgggagctttttcgaaacactcacttcctctgaattctacaagaacacaaaggtgattttcttttcctctcagttgaaagcagttgtattcaccatgatccattcttgacaccacctgtgccaccataggttggcgatatctcaggaagcttccgatgggcgccattcctggcactgcagacatctgacacattcctcaccatgttgctgctgctgtccaagtacaggatgaagagcctcccagtagtagacattgggggagataagattgagaacatcattacgcaatcttccgttgtgcacatgcttgcagagtgtgttggacttccttggtttgagagctggggaactaagaaactctccgagctggggcttcctctcatgaagccatgcaaactcgttaaggtacctccaaaacttcaatgggcttcactcgtaaatatatgttaggcaccttcatacgcatatatttatttcaagtaaatacaatgagaaatttaaactcctgttcaaaaagtatccaaaagcacattgcaaatgttgtattcgattattagcattgcttgcacaacagttcttatgtgttcgtgccgacggtgagtataaacagccatccgactgtttgtgtcaacaaggtttaagcaagataaaatttactagaagcatgctgctttaatagctagaaacaattgcctgtaactaacctccctgtgcaagcatgttatatttgatcttcaggttcggggcactagttacataggttcgacaataaactgttttgacacacctgtataatacaggggctgggggtttagaaggggaatattaaaccttatacagcgccatctacaatttttccttatttttctgctcccttccacatgagatctataactgttctctgttgtcaaccaggtaaatgaagaccaacctgtgttaaaagccttccaactgatgagggaaaaaggcgttggtggcctcccggttatggacacaagtggcacaaaagcaattggcaatatcagcatcagagatgtccaatatcttctaactgcccccaacatatacaaagattacaggtttgaagttcttaccacacttgctcctattcttttcccatgtttgttcaccaatgcaaaaaaaaacttggtgcttcaacttgcactcccaccacatgcatcaagacacacttcaaatgcattgtaggaagtaggaaaaccaactgcaacttttaacctttttgatccaaccacaggacaatcacggccaaggatttccttaccgcggtccggcaacaccttcaggagcaacacgaggcctcgccgttgctcggctccgtcatcacatgcagaagggatgatgaagtcaaggacatcatactgaagctggactcggagaagatccacaggatctacgtgatcgatgacaaggggaacaccgagggggtcatcacgctgagggacataatctccaagctggtgcacgagccacgccattactttggggatttcttcgatggtgttgttcccctgcctccaaacagcactgtatgacacggcccttgagatttcatcacgctggtgtgctcttgtaaattgtacattatgtccctttacgacaatggttccaaatggatgggaatagtgtacagtttgccttgtgtagttctttggcagtggaacaactaatggactaatggatagcacgggtgtacattcaataacttgaaataatatctgagctcccttctgtatgtttttatgatgagaatgacgtctctttcttatgttcaattgctcccttctttttttctttctttttcttttaaagaatattggctccatggtttcatcttcagcttatcagccataatcaaaatttgagtttttttgctgcctgaactcagaaccgaaatgctaaaactcagcatcctaattgctgtggaattctggagtcactgttatctctggcagtgtcaaaaaacagttaaggagtacagaagcggctccttgtttctacagcctattggaagcattctagttcggatgccgaagtgtgttcatccacttaaatgtcttgaaactgtgaccagagaaaaacaaaaacaaacggtgagtcaaacatcaaaataacaaaaggacatgaaaagcgagaaataacatgctactactaccaaataacaaatccagtatcaagtgaaattctgctcccctcctgagaaagttgctgtacctgctttttttttctttggtacgcatgggaacaactaaatttttgcctgtagcatagcaagttacttacaagtttgtggtctcttctgcaaaaaaaaaaagcatttaaattacttacaagcttgttctttacaaaatactccctctttaagacatctctttagccccacactctcaagacatgggcaaccacaattgagagccggtctctagtgcctgacagtaccaaggatcattccagcattccatgttgccttccactacatctgtcaacgccatgacattactgaaattaatggatctgcactgcttgattaagtatttgttgttttgtctgagtcagaaccgaaatgctaaaagttagcatcctaactgctgtagaattgtggtatcaatgtgatatatctgtgtacagcatataatcgctgactgtgtcatcattttgtcagcgaactcccgggttttgctctaaccaattttctgtctccaagacatggatattttgcagaaattgtgcttaatttgaaattttgaaaaacgttagtagctaatgcagagagtatgaagtctatgacatactcgcttctgtggaagacgtgctgaagtacagcggagttggatctggaccatcatagctgtatcacattgctaatctgcaaaattgtgtgaacgtactcttggagacatgatggacctgacaagaatggcaaaaaaagtcaaatcttgatggcatggatctggaaaacagaaacaatgaaacagctatgattttaataaacgttcttactggcacttgataaaatttacaaaatcgccattgttatcatcatactaaaacaacgctacaaaaataggtgcgacacagtggcatgcctactggtacattattgaagaaatagcttgctcgactgaatggtaggagtaccataaattaaaagcccaaaaataaaccaatgagtaaatttcacaaaactgcagttattttgcacaatttatcacaaaactacagatttaagagcttatttcacaaaactacagatttagtgtctacttttatcacaaaactacaggtattttgtataatttatcacaaaactacatatttaagaatttgttttataaaactatagatttagtgtattcgtttatcccagaactacacatttagtgtcttcttttatcacaaaactacaggtttagtgtctccattattccaaaa

SEQ ID NO: 11139 - DNA, 17652 bp, Oryza sativa
aaaaaaaaaagagaagtaagccaataagaccgttaagtaaagtgagaatcaggatggttggagtgctattttgactgggcacttttgctcttctagcattcaaagtactccctttgtttaaaaatataagttttttttattttatttcattatcacataaggctttggccaacaattatatcatttatgtgatatagaagcataattaaccatataattaagtagtacttttgaatacaaatttaataaattcaatttcgtgtcatagaaattatacccaaacaaagtaatggtcgatcaaaatctcactctaacaaaacaaaactatatcttatattttgaaacggtggagatgaataaaaaaaattgagttccacgaagagaaaaaaaaacaactcttcaaactacacactattttccttaagcaacatctaattaattgctctttcccaacatgaaaaatatgtcaacaccatctcttaattaaagtcaaatccgccatatatatatttatgaccagaaacggtaacatgtttagatcccactgtaaaattttacaccctatcacatcgaacgtttgaacacatgcattaagtattaaatgtaggctaaaaaaataactaattgcacagattgcgactactttgcgagacgaatcttctaagcctaattatattgctacatgatttgacaatatggtgctacagtaaatatatatgtgctaatgacggattaaataggctgaataaatttgtctcatggtttactgacagatactataattagtttttttattagtacccgatcaccccatgcgacaccctatatagtacccgatgtgacactccaaaactccacacccctgggtgtaaacaccccctacgtgtgttgactggcatcttgcttctgacagaccagtattcaaatttcaattaatttttttaacccaaatttattaacctggctagggggtggcacaggctcaatgtaccttgctttccttgccacacgcatttcaagttcccgaacatcacagaataagtccttaatcccttcatcccaatataaatggaccctagtatagatacgagatcacaattctaaattcagattagtagtgtcctaagatatgttacatttgtgctaggttatatttatattgaaaaggaggagtaacttaaactcctaggtaaccaatcaatcagatgtgagagatcaatttgtggatggaggatctacagacttgggggcagtttggtttgagaaaccagaccctctatatgatgggttcctcacgagatctttgctcaaatttggtaggatgagcccattcctcatctatgaggtgatcagtgatgatggacaaatttattgcatttctaaaaccaaatatatttaatatcaagtagtattagtcaattggtcatcacatttcgtttattaatccaaagtccatacccatctttttgaaaaataatattgattttatgaaaaatagcaagaatatgattcggtaatcaattatgcattgagcttatgaccctatctaacgaattctttgtgcggcaacgtatatttactagtctgaagctaagcacagtacagatacctcggtttcatttgaagttcggtatgtaaagttgtaaactttaattttcttatgctgagtgtacatgtctcggttgggaacttcttttccctgtgtatacaaaacgaaacgattcagtcgtacataattaattaagtatgaactaaatagatttaaaaattagatcaatgtgatttttttagcaacttttctataaattttcttttaaaaagagaaaaaacatacatcatttacatgttagaaaatgtgcgcacaaaaaacgagagaagttatgatacgttatatattcgaactcatcctaaaaatgtttattaccgagtacaataaattgttacttcctccgtttcacaatataagtcattttagcattttccatatttatattgatgttaatgaatctagatagatatagatatatgtctagattcattaacatcgatatgaatgtggaaaatgctaaaatgactaacattctgaaaagatggagtagtaatttaagacagcacaaacaggttacagattcctttcacacacacttgcaagccactctatataaaaagccctccactttgaggctagataagcttaattagctctctcttaagcctaaagcgagacaattaatttaataagcaccccccaccaccagccatggagcaccaccaccttctgctgcaactctcgccgccaccgccgccgccgccgctgccggcggcgcacctcatgatgagcccgagcttcttcgacgccggcgtgttcgccgatgtcggcggcgactggatggaggacctcatgcatctcggcgagctgttcggcgtcggcgtcggcggcgacgatgatgataatggcggtgtcgacggcggcgtgggcggcggtgatgatcggatgcaagagtggcagaataattgcgagggcgccggctcgccggaccaccagcctagctgcggtgatggggatggcgatggcgatggcgacgtgagccctcgtgatggggagctcggcgacggcgacggcgacaactcggcgacgaggaagaggcgggaccggtcgaagacgatcgtgtcggagcggaagcggagggtccggatgaaggagaagctctacgagctccgagctctcgtccccaacatcactaaggtacgtactcagtgcttgattgctcgcgtcggcgtcgccatggcggcgccgccatgcgccattgccaacacaagcttaatgattgcttggcagatggacaaggccgtcgatcatcgccgacgcggtggtgtacgtcaaggacctgcaggcgcacgccaggaagctcaaggaggaggtcgccgcgctcgaggaggcgcgcccgatcaggccgcctccgccgttcgccgccgcgcaacggccgcagagacagccacgccgcgtggcggcggcggctgcccagctggcgagggccgcggacgccgccgccgtgacgacagcggcgggggcgccgcacggcgcgagggtggcgcacgtcggcgcggcgcaggtcggggaggggcggttcttcgtgacggtggagtgcgagccggcggcggccccggcgagaggaggaggaggaggcgtggcggcgccggtctgcgccgccgtggagtcgctgtcgtgcttcaccgtggagagctccaccgtcgggtgctcgccggaccgcgtcgtggcaactctcaccctcaaggtgcgtcacacccaatgcacctaactgtgtaattatactcttgatcacatctgccacgtcacttaactacaattaactaatgatgagttacaagcgattttacggtcctcagagtaggcattgaaggtgccttattatctaacataaaaggtatctcttggtatcttcaacgtgagaagaaaaaaaaaagaagttacactaaaaattacggtcttttaatactactcggtaactgtaaaattgctcttaagttaattgggtattttattttggaaggggaaatattagcaccatttacctgaaaattatttttcgtaagaaaaaagaagtttagttttggattagagatttagtggtaatgcaattcatgcctatatatactatctccgtttttcttttatgaacctagaagtttcctaggtccgattttcaatatttttacttgtttgatgtggtttttcactggatatttctctattatgtactccccctcttaaaaaaaaaagacaaaccctcagtttccgtgttcaattttaactgtccgtcttatatgaaatttttttataattcgtattttcattgttgttagataataaaatatgattaatattttattcgtgacttgtctttttatttttttttcataatttttttaaataagacgaacggttaaacgttgggcacggaaatcagagtttgtctttttttttacggagggagtaactattattccattgggatatgtggattaaccgctaattaccttgtggtgtgtgtaggttagtgaagcagaggaggatgtgtcggcgatcagcgagtgcacggtgaagctctgggtgatggcggctcttctcaaggaggggttccggccgcaaccgacggtccagatctcctgatccacccaacaccggccgatatcaacccttggatttcatcgccccatccctatgtatacaactactgctctttcatgtgtaacatcctaacaaatggtgtgaagagtatattgggagggtaattgagtggttaatcttggccatccacggccgatcgaacggctagcgtaccacctaatgcttcttcttctttttaataaagagtggtgcatgatgtatacatataccgtatttcggataattagatcaggaatgaatacttgttgtatatttttcacggttaagattatgattaggaagagtgagattgtttctgcagccaaaagctctcttggggactgacgtgtatgcactagttaaaaaaaaaactgattcggtgcaacttttgacaagaatttaggaagaaagtaacatatggcaagatgtcacacctgaaccaaacttgtatgtgagtaataatggtactcacagtaggacaggtttagaagtaaccatctctgattggaagtgagcttgtaggctaaccgtaactggttgcacctacaaaaatcgatatttatttttgcatatggctctttataggttcacatgtcaaaatctattttcgcatacgaacatcttaccagtatgaaaacaaaaacaagtataatttcgcagacggaccactgttaacagtgaaatttggtaatcggcaaagacgtcatcggcttagaatcgttatcagctgtagcatctcggaatcagccgatgtgagttatcaagtcgccaatagtcggattcctgctatattcggttaaggaaatcaatctactaaaggaaacttatccctaagtgaccgagtttaaagaggatgcggcatggcagtttatctattaattaggaatagtttgttagtttccttttatctttaggaaacaatgtttagtgtccgataaggactttatattttccttttatctttaggttagtttctttcttgtccgacaaggacttgtatcaacccatgggtataaatatgtacacccggggtctatgtaatctatcctcacgatcaatacaattcggcgcatcgccaccttttaccttttctactttattttatcgtccggcgggacttggcacctgacgcggggctgcatcggtgttcgatctccggctaaggggtaagtccaatgttctgccagcccaggcaattgtatcgtctacgtcggcgccgttcaaggctgcatcagtacattcgacctcttggattactccggtttggatgatatatttgcctacctatttatcatatgtctctgttaatctagtcttagcatatcaatctagctctatcggctgtttcttgttttagggtttctgctggtatcggctaaatcgtgttgctagattaaattagcttagacatctaccaccctgaaaactcagtcaacggcttgattgtctagatattatgtttcttttcatacttagtgctgcataagttaagtttgatctactaagtcgttcttagaaccataatctctagcttacttcttgattgccaataagggtttcatcggggttttagccggtgagttatctggacgttgcatcggctcataaggattgcatatacatataagttggatttagccgatgacaacaaaggcttcactatttaatctaatcttgtggatttcatgacatcggacctccagccgatgtatgctctaaccttcagatcggtgcttattctatcatatcaatgctagccgattggtttatactggactatattattgttatattttattatcagtagccgattgcctatatatcattatttactaaagtgttagaatctacattggacgtataaccgattgcttcaaccctatcgctatcggctggtatcggcatcggctattatcggctatcggctggaactactccatcgccttgttagccgatcgactgttttgatctactatttgcatatcttgtcagttgcaggatcaaactgactggcacgcccgcatctcatcaacctttggacctgcacaggagctaagcagatatcccgagccagtgtgttcgattttttcgtcaacaaccacttaaacggttggatgggaaaatgcatttttaagtctcatccttatctcctcacctctcatttttccacaaccttgtttcctatctctctcccccactcatttttctctctcaactctcctgtcacaccccaatctggcaccgccgtacaacgtcacctgataggagcgtgtcgtaggaaaaacggcgcggaccgcttcctatgaaaccgcgatctcagtaccagtcccaggacatagtgctggtacccacggtgacaaatatgaatcattgcaatccttaaaataaatagaggacttatttaccttaacttaggttgcagctcagaacagcccgagattgcaaccgacgacgcgaacgaggaaacaccaacaacagcggcagcagcggaaccaacggactaacacccaacaccacaggcgacggctgggaaccaggacgaaaccctaatcttcactttacttcatcttcaacttccgggcggaggaactatatatatatttatatagagcaagggtgagtacttttgtactcagcaagccatgggaatttaggtgtttaatgcaagcttggaggagaggcaaggttatttttgcaaatcttttgttttgaaatcattttgaaatcactaagtgatttatttctttctaagtttgggccgaaaagagacttgcgtctcgattcgactttaagagatgtttttcaacagctcatttggtaatgtaccgacctcctgggtcagatcattacttctcggctcccaaagccattccacttgattaatcggctcccagagcctttttcattttctcggactcccagagtccagctacccagcagcacaacaatccgcttccactcgggaagcctagtctatgatgcccgtagacatcccgaatcacacagattcgtttcttgaccactcaggtcatccatctgccacataggctgattctgggaatgattcccacaccacaacaacttttcacaaagcacaggcaaacaaatctacgctacaggaaacacctcacatccgcccatgaccgtgggcatggctgttcgaacagtcagttacccacacgacattactaacccggatcacccagcccatgagatcagccacgtcgggagaccttaaggctttcatgacaaggcatttcgaaagccgacacaggttcaccatatgccaacgagaggggtcccagaccaacaccagattaggtcccagaccatactgtgccaggaagcccgagggttctccccgacaccaccccgttgaatccacatgtctcttggcatcaaggcttccttggtttgctatttactcagccaggggcgtcccattgcacccgtgtggtcgcacttgttatatgctcggatgaatttcccacaggaatcggtacttatatgcgaatacgggacagtgccacacaggcacaacccccgcattgcgagttttcacaatttattttgttttcaaacacaccgacgccacatgtcgggttttcaaggcttctcaaacccatttcccaaattttcgacagacaacggtgtatgtggaatagttggtatacgcgctcagagaacacggatactgaagtaccacaagggtggagcgacaaggaaatcagggtagtacaatctacaggaattagtgcgactactgggtaggtccatcggtttggcacgcatactgaggccaagcaagttgagtgtgtgattctaataatgcaagttgcaaacaaaataataatgattttccaattataggagcaattggtcaaagggtgacttgccttgctcaaggtcttcatgaagcttcacgaatcttcgagaaaacccgcgatcgacgaaaatccggtaaccgcaactatacgcaagcaatcaaaaacctaaacaaaagaccaaaagaaagatcctatttagactaaataatagtgccattagatagatctcaattttatggaaatactggaagtggaacggagtcaatcggacgagcggtcgaggagatatgaattttggaagtttaatcggaatttctagaagatgagaaatggtctatggaatttatagaaataatattctcaagaatattattgaatttcactgacaagcaggaccaagggaaaatgattcatagaattttggaataaggaattgatttgtggaacaaaggaaaaaggatttattaaatccctttttggaagggaaatcaaggagggatgtatattagacttgggccgagtgaagagggcgcggcccagggcatttgcggcgcggccgaggcaagcgggccggcgcgcgggagggaggcggcccaaggccgagcgaggcgtggcctatgcgacgcaagccggtggacgcggtccaccgtgccgggcgcaaggtgggacccacaaggcagcgacacggctcacgcgggccgggtgcacgcaaggcggcgcgatggattggaggaccgggaaacctttgaccggtctccgcggggccgggcggctgaggtggcatccacgtggacgccacgtcggatggggaagggagaggaggccgggaatggcatcggacggccggcggcgagcgacgcaatccggcgaacggcggtgggagggagagagaggtggacaccggcggatagaggaggtcaaggggaaacaattcaacagagcggattagctggggaaggaacgacgacggctggcggcggcgaccaatctcgccggcacgccgacgtggccgcgcgcgaaaagagcgaagggcgcgcgggctcgggcttagccgaaccggtatggtgttgcgacgcgcacgcggtgacgcgggacccgatggtcgccgtgttcgaactcgcggcggcgctatgcggcggcggaaggggcggcatggcgcgggagcggtttgggaggccggcgactagggcggcagcctgggaaggttcaaggggacacggggagggtcgcggcgcaaggaatcggcgagagaagggccgacggcggcggattgcggcggcggccatcgccggcggagaaaaggggaaaactcgccggggcaacgggagtccaattcaccggggaaggagcttctacatggctccgggaactcgtttcaagcaacgggtggcgacgagctagcctagggggtcatggcgacggcgaggtggacgcgacggcggggcgacgcggcgaaaaggggggagaggaggggagcggccaaggcgacgtcccggggaggctgctagggacgcggggagggtgatggcgacgggattcggcgcgggaccgaccggcggtagcgcgcgactgcgcacggcggccgcggaagcagagcatcggcgtgacgaacgcacaaactaccatgtcccagtgctgtttaggagtcgctagaggatgtagacgagaggacttggaccgggagctcaccgacgagcgggaatggcgtcggcggacggatggcgtcgcggcgaggtagacgcgatggcggggcggcgcggcaccgagggggcgcggccggggaagaagggagggagaggtggtgatgggccagaccggtggcggtccattgacgtctcggtcccggcggcggcggccggcgacgaggaggcgacggcactccgttcccaggagcacgggaccaaggggatagataagggccgcggggttgggcttttataggaagatggtgctcggctagcgctcataggcggtgcggcggtttcgtgggcggtgcggaagcggcgacagcgtggatgtgatgggcggcgaaggcggtggatcggacggcgaaaaatcgggtcacgagagcgggaggagcaatttggcgcggtcaaggtgggagcggcgtgctggcacggttgtggtggaggcatgggcgcggcagagcgacgtcggcgactctgcctcctagcacagggggacaaggggaagagagagggaaagggtggaggagggcggtggaaaggggagcttgcctttgccaatttgggaggaagagggaaggaaagggggggtctctgcctccgagatttggaagcacgcgcgcaggatggcgggaccgggtggcagcgcgggcacaggcggtgctagggcttgacgcatcggcgaccaggcggtcggccacgcgcgagcgcgcgcgggaacgagcgaaggcggtggaggtttggatggtggcggcgggatttcaaaggcggtggcggaaatcaaatcacggtgacggcgcatagcgcggcgagaggagagagagaaaggaaacagagagagagcgaggaaggagagagaaagaagagaggcgctgcctctctctcccgacgcgtgcagcgcgcgggcggggaggaggaggagcggccgagaggagagaaccgggttgagaggagatgggccgaaggagggaatcggcccacaaaaatccgagggacacaaaatagacttttgacagagagattgaatttggagagaattggggcttggaaatggaatttggatatctttggagtcgggcgaatatttggcaaggttttgagatttggaatttgaatttcgaatttgattacttggactcagggaaacagggaggagtcaacaacgggattcaaaaagggaatttgatatttttaggatggggacaattatttggcggggattcaaaggatgcgattcacctttgggatagttgaatcggaattgggatcttgaggtggaggattttgttggcgatgagagagaacaacgatggagatttgaattgagatccacggcacgacttagactctcacacaaagaacgaaattttcacatataggattttgccgaactagtttttaacgcctcacgaaaagcggagcgttacatctcccttcctctcccacttctcccctcctcacattctgaaggtgggcttgggttggcgatggcaggagtgcggtggcgagcacaggagctaagcaggatgctggagtgctggagcggcgcgacacgatgggctcgagtagatgcggcggatcctgcgggagtgcggcaacggcaaaggggagggttggcgacggtgtaggatcaaggaggccgactagaggggggtgaataggcggttttaaaacttaatggcacttaaacaaaactaacctaagttgctaggcaaggtaaggtgcaaggttaactaagcaactaagttaagttttgcaaacctaggtgacatgggctcaaatatgtctctatgaatgtaaatagcacaaatgtaaatgcaacaaataaatgagacaagaggcaaggaatttttcaccgaggttcggaaactcgccggtttcctaatccccgttgaggcgagcccaactccaccgctcaaccacgaagccaccgcacgccccctttgtcaaggggtgggcaaggcgggagccggcccacggagaggactacccaagcctcgatcactcggggtagttcttccttcactccgaaggtggtgaactccaaaccactcacaaacggcgccggacctcctccacaatctcctcggagaggtcaccgggcaacacctacacaagccgtctaggaggcggcaacctccaagagtaacaagtctaggatgcttgccgaggatgatcaagtgccacactagctataacaatgaagcaatgcacttggattggcttaactcactctttaacacctcactagataaactaagtgcacaagggtgtgagagctcttgcaagggttcaagataatgcaatggagtgccaaaaccttacccttgttgctggggagtgggtatatatatacccccaaccaccaaaactagccgttgaaaccgaaatccccaactctgtgctctgccggtcagaccgccattgtgaggccggtcagaccggactactttgtaactagccgttacagggcaatcattgagcccactcaacctggtcagtctgaccatagtgtagtggccagtcagaccgtccacggctcggtcagaccgctgccggctcggtctgaccggttgcggctctggcggctctgtatcgccaccaaaaaccagaccagtacaacagaccagtgggccagtcagaccggccttaccacgccagtcagaccggctaacaggcccggtcagaccggcctaaggcccacgatcagaccgcaggtcacttttcagctcaaccaaccgttagtaaaacagcgatatctcttgactcgggtctcggaatttggcattcttggactctatggaaagcttattcaaagggctatccaaaccatgaacaatccatccaagaaacacaacttttctctgggagaaagggctcacactccaaaggatactccaccagacataaccacatgaggctacccaaacctataggatttgcccacatctctctttgtttaggacttgagaaaactcaccacaggctagacaagcccaccaaatacacctacatgcatatgaactaatatggcacaagatcatccacaagctcgcttcatagacccctcttgatagtatggcgcctatctagcaaatccggtctacaccaaacaccaagaccgggaaaagactaagaaaacattcttagctccattatacctttgccttgcgcatccaacttggggtcaagcttgagtcgagatcaacacttgtgaccatttgattcaaccatgtttataccaaggtatttaccatcatttgtcaagactttcttcttatcacaagcttgatttcattcttgccaacatggcgatgtccttggcttggtgaccattaacccatcgtgtcatccattagccttatcatagtaggacctattccttttcacatttcaaaggagaacattagtctcaacaaatcggttgtcatccttcacttgatgaccaaccggttgcatatgaaagatatggatatgtttgttgagttttcattaacatcacaagtgtcatatactcgtatgcaagctcaagtgcaaagattcgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacacatagagaaggcatatgtagtaatgatgtagaccaacataaaacatataccttcatgatctccatgttctcaatgtaaatgagactaaataagataagactcaagtaaacattagtctcacacttatatatcaataacatggaaatcatatatatgaatctatcaaaaagtaggagataagaagtggtacatatcattttatctccatgcatttcatccttgtcatgattaaggtccatcacaaaagaatgcaagtcttccacatctcattatcgggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatatagagagatgagatgaaagatgatttcaaatcaagatagaaatcttataataaacaaaatatagaataagctccccctcaagtgtacatacatatggatacaaaggaacacatatgcacataatcaatcaagatcaatgagggagctcacactatattttggatccacaagagagaccaagttagaatatgtgaagtttaatacatacctctcatcatttttattttcatatccaaatgagactagtcaaagaaaggctcataaaaacgttagtctcatatagttagatttgtcattaatcaccaaaaccaaattaaggcacttgaacttacagacggtattagcacggtggcgggctcgagcaggcttaggcaggcaaggcgggagtgcggtgacgacgagcacgacagcggtggtatggaggcgcggtggcaacggatatggcggtggagagggcagtggcggcggatttgaagatggggagggtgacagaagtggatttggaggtagggtgggcggcgacagtgacgacgatgagcagcgacgatgacgagaggtggccgagcgatggcgatgaagaacgggattgttggagttttatttttttttcatgatctttatttttgtgtgcgaacaacataagcacctgcacgcaaaatttctattttcacatgcgaatgcgccacccacatgaaaaattagcgattttcacatacactttcagggcatacgggtggtccaaccacacggaaaaatgggttttgaccacatgaaaaattctttttttttaagtagtggttagtgtcttaggggcacaaccaatcattaaattatgagtaatttgtatatgtagcctaatttagggcaacaacttagaagctgttctttattaatatttggatagattacagacaattgcttatagggatgaaataaatattacatagtgcaaagttacaaacgaaatagatacttaagacaagttatgcaagcaatgctagtgcagaaagcttttcgaagaaatcgtagtagttcgagaactatggtatgtatgataaatcaatatggtgaaaagaacgaaggttgtattcgggaggagaggttagggagaacaaacgaaatagatacttaaaaacgaaggttgtattcggtggcgggggaagaagcagggtccgggcgagagaagaagtggcggccaggcgggagaagcggcggccaggttggagaggcggcggcctcccctccgttagatccggtgggaggggaggcggcgatggtggagcgacggcggccggaccggaggaagaatttgtgatgaatttgtttgagaattgtgatgtatttgatctgtgatgtgaacatgttgatgtatttgtgattttttttagaacttatgatgtaattttttcagaatttacgatgtatttgatctgtgatttggagatgatttagtgatttcacgatttgggattatttggggatgtagtgaaatcaatatgcaaggagttaaaaacaatgaaaaaaaaaccctaccaaccaggacctggctctaccatctttagtctcagttggtagcaatctttaatcccagattcatacccccggtttgctactcgggactaaagggggttgcaaatcgggactacaaagggtttgtgcagcagtatgagattatcagaattgttggagtggaactaggaggggcaatagacttgaaaattatgtagggtggctaaattgagttcttgtgcctccaaactattttcttttaaaaaaaactgaaaataacatttggctttcttcgaaagtgcccgttcctaagttttctcatgtgaattgctgcgaggaataagttcactttggcttctttaactagtgattgaatctgattcgtttctgttggaggtatgtcatgagggccttcgcccgacctgccgaaaccgtctaaaccatcaaacatcggctaaatcccagatggacaccaaaggcgaaaccaaggggcgcagcccttgggcgaagccggatgacgaagactaaggggttcgccatcaggcctaagcgaagccaggcaataaaaaccgaagggtacgccaccaagcccatcaatcaaccgaagatccaccaagggcgaaggccgtaaggcgaagcataatgccatcgcccgaagtagaagatactttcgactaaaggcttgggaggccctacggaccatggaggcctttcgccaataatgggccggcccaggaagattgccttaggcccaggaatacaaaagacactgtgggctggtttggtttgaggcctaaattaggcttaccaatatttggcaatttcaatagtgtttagtgtctatttggtttgaagccaaattttggcatgcctaagaaaataggccatttcaatagtgaacttaggctattttggcttcaatccaaacacaactttgccttaccaaaattagtcatgccaaaacttgccaaaatttggcattgacatttttcattatagaatcagccctatcgcttaaggttcctgttgagtacgatcttttttcgaacttacaggggcgctgcgacagctaaataaagcgagcactcggcaacttcaatctcacctctacccgcattgaggtcaaaaccatctctcgatcggggctatactactgagtcgagtttgaggtagtccctttatgtttgtaccttaaaatggaaaaggggcgtggtgccttctagcgggagctgtaacaccacttggtccacaaaccaaaccaaccttgtatacccattttaatatccctatcataagggtaatcatgtaaattcccctataactaaaccctagagggtatgagcctatactaggactataaatagccccctaggccatgtaatggggtgatcctaaaatatttttaccaatcaatatattgttttactattccaacaattcatcgagtttaccatatccttcgacgtgaaacagttgtcattcgacaatagtatccttgaaccacaacaccaaatatcttgacccttcaactattaaaaccgtccaatttgacttcctttggttttagagggcggtttcgctgacgttgcgtctacatggcagcattgacttggtctataacgttgacgtgtcgcttagatggtattagagttaaaaacatatatgtgggatccatttatcattcacacactaagaaaaaattattatgagccaacatataggactcacatgtcatcctctcctcactccttgcactctctcccttctctctccttgcactctctcccttctctctatctcgctctctccccttcggccgcatcgccgcctggcgccgagcggcaccatgctgccacctgcatcgccgcctgctgtccgtcagtgcctctccttcacctcccaccgcatcgctgcctgccgccgagaggcgcccctcatgaagggagagagcgaggaggaagaaacggtgtgaaggtttatctttcttcactacttgcacgatgatgacgatgtggagctaaaattagaagcccatgaaggctcaactgttacagcccagcccataagaaacggttgcccaacacccaactcaaccccctatcttccattctctctcctcccgaaagaccgaaacctcccttcctcgctcgcttgacaccccccctctctctcccccccaaaccctagctcccgattcagatctcgcctgtccctcgccgccgccgccatggtcaccggcggcaaccccaacccgaactccacgccgacccctaaggcgcgcccgagccagccgcatcagcagggcgggtcccc

SEQ ID NO: 11140 - DNA, 5007 bp, Oryza sativa
cagaactagatatttgaattgatttacaaaaccaggcgcggagtttaatttatagtgtttcagagtctctcatctccttcctgttcatggcagggtatagttaactgaccatttttggccttactaaaaaacttggtagagccaaaaccttatcgagtttcggtagtactaaatttattatagtaaaacttgtactcgtgtatgtaaaatttgacgtcatacttcctattaaagttgctgaaaatatgataagataaaaatttgcttcgactcaaatagaggaggaaggaggaagtgcccaaatgtaactttgttttgggccttggaagctactacaggaaggaaggagagttattgggtggggctgggccgtcttaattacttagtagtggtggtgaactcctctcattggcgccccctcggagtccgtctcatcttctctatctacacttgtacacaacactagcaaaccgccatggcgccgccgccgccgtgttgtgtgctagtggtacgctgctgttccggatccctcccttcgccgccgccgccgccgccgcccagaccctctccctccaacaacctcagaatcgccagaaggttaggggtattggcctgcttccctcccttgttctctcttctctggggtggcctggactgattgatttgggatttgtatcttcttcttcttctctctgcgactgatgatgaaatgaagagagtttgtgctgaggagcagtgagctcgccacgctcgctgccatcttccacttgaggtaggtagctaggttaattaggttcccttcagattagttgcgatggttaattaaggtgttgaaccaccatgttcagcggcacgaagccaaggtacctgggcgtgcagaagagtcctccatcgctggctctgtgccctgccaccaacaattgcgtttccacttgtgaggacatcactgactccattcactacgctcccccatggtatatatgctctcttcttccctctcaacatgcattcatatactagtggagtatatgctactaattcattacttttaggaactataaccccaaggacggacgcagggctaaacccatcaccaaacatgaagccatcaaccagctcattcaagtcgtaagtcatccatctgcatttctcttcctttctttttttttctttttttgtttgtttccacgtacatctaatctaactagtaataaaaaatagtatcctcgtgggaattaatcttcaatcatataagtatgttttatggatggtgtcaatcggcaggtcacacaaacaaagcctgacaacttcactcctcgcctagtagagaaaacagatgactatgttcgagttgaatacgagagtcctatattcggggtataattcattctaacaccttcttgctcttcattcagttcacccatcttcttagtctctactccctctatttcacaatataagtcattttagcatttcccacatttatattgatgttaatgaatctagatacatcaatatgaatgtggaaaatgctagaatgacttacatggtgaaacggatgaagtagttgatagtataattgatatatccacatgaactttgcagtttgtagatgatgtggagttctggttccctccttgtaacaaatccattgttcagtaccgatcagcatctcgatcaggattcattgacttcaacgccaacaagaaaagagtcaaggcacgcacgcacgcgcccaatatcgatcatttctattacggagtaggagtagtactcctatctatcattgtgttgatccatgtctcatgctctgttcgatccatctttccattgctgcaggcgctcaggttggcactggaaaacaaaggctgggcttcagaaagcaccatctgaacctaacctcaaggaagccaacccctcgagtctgtactggagtgtggattctaatccctcgagggatatcccctcgtatatctttttcttccaaattcgatgcaaatagttgtgaaaaattctaaaaaaaattgataatgtagagtataatgatacctactagtccaccaaaattcatgttcaaattcgatctacacatcgagaaacaaaaaagacaaatttagatataaacagtacgctattattcatacgctgaatttgtcttttttatatctcgacttgtgagttgagtttgaacttaagattttgtggagttgtatatatgtgttgtatgaatgttgtcaaatttttccagaatttttcataaccgtttagatggtttttgagcaaacaaggaaacatcccctcgagggattaaaatagttttcctctgtgctgtacagactgaccgaccgattggctggtacaggcactcttccttcctggcgcttttaattgcacatttctcctatccttaatggattagtagaccttgatatgcaacagaatctctcaaactttggaccctcatgctattggcaggctgagtacttactcctccctccgtccaaaaaaaaaaaagacaaaccctgagttttcgtgtccaactttgactgtctgtcttatatgaattttgtttataattcgtattttcattgttgttagatgataaaacataattaatattttatgtatgacttatctttttaatttttttcatatttttttaaataagacggacggttaaacgttaagcacggaaatcagggtttgttggccggaggagggagtatgaatgatgcatgtccagtcaagccgatagatataagtcaactggctatggctgtggctcccaagaaaacagaggcaggagggttttcttctctccctgtcatgttctctgagatatactatatatgtagacgatgctaattacttaacacagctgaaaaaagaaatactggccgtcccgtcatgacttgcacttgtatgagggctagcgcgatgtttgtgaattgtgagggggaattgctctggcccatcgatacatgaatcccctgcttggtctactactttgggtgctggccacgcaaagccaatgtttgcattgcaaactgatgagatttagatctaggaacacattacatcaagtaagtcacatgcaaggctaaagcttactaagtactatatagtagtactagtagttagtggcatgcatctgaccctctctctctctctagaatctagattgtgtatttgcgttgcatccattcacagtttgttataattgcatttctctggtcgatcagctaggatgtgatgtgaaaacgcgcattcctgctgtgccggtggctatcaatataggtaagtgttgacatttgtaatttgtttgagcactagctagtcggtcgtgctttccccagcccaggcgcactactccattgacactgtctataaaggctgggaggcagcagaaagacgaaagtcaaaaggactaaaaagagagaggcatatatagtgacataaacatgggcactcgtccatttctggttccggagtcaaactaaacaccaagctaagcaagctatattgatagtgagtagagtgcaggcttcaattcagttgcatcgatgcatttgtgataaatcagcaagtgccttccctgtatatatgtatgacggtggatgcagctattgttagtgccccatgacgagatctcaccttaatactactacttacactagtattagtttttatcctcgctctgtccgtttgtctgctgactgactataactgattaactaggaatagttttgtatataggatgactagcaatagggattccttacagatgccgagaaagttttttaacacatagctatagctgatttctactgctactattttaagttttagttattattagtgcaggtggaggtggagggcttgcatcggagaaggattctaattatatccggatggacacttccattgtttatttcatgtcaactaaataactgtaacaaaattcaaaaaggatgacaaagacatattaatatgaaatatatcaatccacgaatataaaaaaaattcaaatttaacttctacaattgataacaaaaataacaaatttaattgtacgtatacatatgctaattagagtttaatttgttgttttttaactacttatacttaaacttgcatgtttgtgcatcgatataattacatattttaaaaaattacaaccatttaattaacatgacggagtgaacatatggatctaggtaattaaaagagtttcctttatggggtattatatactatctaatgtggtacgctacgtacggcttttaagtcaatgcgtccgtccgtaagtaagaaaacaaactgtacatcgtgcataaacagtaggactccagtatgtatgagtgttgtgtttgaggggtgtgtatgtgttgtgttgtaggtcaaccaatggaaaagcaaggagatgatgatgaatggttatagaggcagggcaccatcccaccttgaattgtcgcatcgcatcgcatccacaccaaatttcactgactactgatcgatcaactttccttttctcctctttctttcttcactaatcaatcaacttaatttgctctgtcaatgtgcatcatgtagctagctagctattcagattcagagtgatgaagtagtatatatttatgtcgccggtgcggtgccgcgtcgtccactggcttgctctactctattattccctttgcattgcattgatcgagtaggagtagtatgcccatggccatcgagtcatggctcaccaaggtccgctccgccatcatctcttccaaacccagcccctcgtcgtcgtcgtcgtcgtcttggaggtcgaagacggtcggtatcctggccttggaggtggccaccctcatgtccaaacttgtccacctctggcgatccctcgccgacgccgccctcgcccgcctccgccaccacctcatcaaccttgacggcgtccgcaagctcgtctcccaccacgacgccgccctcctcgccctcgcctgcgctgagctcacc

SEQ ID NO: 11141 - DNA, 2340 bp, Oryza sativa
agcagcagtcgtcgcctctccgccaccaacatatcgctggcggcggagcagcagcagctcattttcgccaagaagcaggaggtgaagcacctcaagcaaacctccctctggtcctccaccttcgacgccgtcgtctcctcgctcgcgcgggccgcgttcaccatcctcgcgcgcatcaagctcgtcttcggcgccgcccacgatcaccgcccgacgacgacaccgctgcaccggagcctcaccctctcctccgccgtccacccgtcctccgtcgacgtgcaagtgcaaccgccggtgtcgcgcaagtccatgtccatggatatgggcatgggggaggcgctgtacttggagaggcagaggcagagcgggctgttggagcgcagcgcggcggcgctggtgccgccgccggggacgctgggcgcggccgcgttggcgccgcgctacgcctgggtgataatctcgatcgagaggatggcgcggtcgccgcggctggtgggggcggaggagcgggacgagctgtacggcatgctgacggcgagcgtgcgcgcgcagcttcgagcgaggctgagtgggacggtggcggcggcggagccggggctggcggggcagtggcgggcggcggtgggagggatcctggagtggctggccccgatggcgcacgcgacggtgcggtggcaggcggagcgaagcttggagcagcagaggaagacgacgagggagatggagactcagacgctggtggtgcagacgctgcaaatggcggagcgcgggaaggtgaaggcggcggtggcggacctgctggtgggcctcaactacctctgccgctttcacaaggagatcaccacctgccgtacccgtacgtgccaccacgacgatgcaccatgacaacgtgcatgctgcttcaagacgacgatgtacgattgccaatggaacagtatgcatccatccatccacaccgatcgtctgatccatgctctcatcttctcttctttagtttttcttttgtttttttgggatggatcccaattcccaagtacccaattggctaatggagtaggagatgcatgggctggcatctgggtgatctccagtactagttaagtcgattgatgagaatggagttttctgataattggagcaggatggaatcttgcttcattatattcatgtacagatagcaaaccaccagcggtgagtgattacattaattaaccccctctctagttataccactatggaatatacacatctctcgagcaaaaagcaagtacacacccttatatattcactagcaaaatacccgtgcttcgttacggtgtattaaaactaaaaatatttgtttttaaccgaatttttttacactgctttggtacttttgctcgctagaaaaagtctcaaatgatagagggaagtatagctcataataaattattattcaatagtgcgttgctacggagtaatttcaattaaaatcacaataaatatttttaggatttaatttgtgatatgagtccttttagagtaaggcattcttgatataaatttgccaataaacaacatgttgaaaacaatatatttcaacatcaactaatgttttatcgcaattaaaaaaagactaacttcctcttgttgggtaattgtattttgtcaggtaatttttatttttagtttttctatgaaaattagattggagatatatttgagagagacaaagtggacttgttgctttaaaaaagactaaccataccaaatgtggcccaacaactcaatcgcacgctgttagtgcttcatgtgctgcgtgcggcccagtaatgctacaacgcagagatggaggccagctcgatgcgggattgatccgagccactcgttttgatggacggttcggatcggttcagaatccattaaaacggccggtaccaaaaccctaaccctatttcagtttttcctctcctaactcccgatcctctcaggctgaaatggtgatgacgcaccacgatggatgaaatctaattgttacgtttaaggcccccttctaaactccaactctaaacttcaacttttttgtttttcgttaacacgtttccaaactactaaacggtgttttttttttgaaaaataatatatataagttttttaaaaaattcaaaggaacccatttttcaaatttataataattaataattaattaatcatgtattaattgtttgctctgccttttttttaaaaaaaaatgcccatatgagcatgacggtggacacgagcggagagcgagagagcggcgcgcctcgttacttccgcacgcctcttttttctcttctccgcccgcctctatctcctcat

SEQ ID NO: 11142 - DNA, 8163 bp, Oryza sativa
gcaccctccccttccggtttggtttttttatttgtgttcttgtagtagtgttttctctaggatttggataaaatttgtgtgtatatgtttcagttttccctctcctgttcaatttgcatgatggaattccggatgggattttggttgtgtgtatatgtttcagttttccctatccgattcaatttgtatgatggaattccggatgggattttgggggcggacaattgaggggggggcacggacgaaaaaacagcgcacggacgaggtgacgattggaaaaatataaatcttttaattagttaagattacatgcaagttgacatcaacgagtcttcaggaacaatttaaggctgacaaatactatggcctgttgttagtcaagttgtgtgcatgtatcgtccatgatatatatggtgcctttctcttctctcagctgtgcaacactaactgcaacctagcatgcatgcatatgctgatgttgggttgacccctgaagctaattaagctagcagcgatggcaattcctataccagttgagaacaagcaaagctagcgcgctaacgatcgagctggagtgtgtgtgaatgcaaatgcgcatatatacggtaatgatgcatccacacacacacacaactatatagtaatagtagtagtagtatatataatgctgcatagatagcagtaaattagcgacgatatgatgcataggaagtaaagtagaaacaggaatgatgcatacgtatgtgaataagtgtgatgtgtccgctccatgggaggcaatcgccgggactataaatccatgtttagaatttttgctcctatatatgtagtatagatctttgctcatgcactctaccgcccagcaatccatatcgccctttctatctagtttccatcccatcatacgatcgatcgagcaacttgctaattaattgccaactttttaatttgtttaatgaatcatctagtagtaattgtttacagtctgcacttgacaatgcaagtagctaataggctgcccggccgggataacacatggggaagttggttgagtcgatatatatatgatgcatgaggattccatccatacatacatcacatgcttaattatgcttattcttatgcatgcatatgctgctcctgccctggatcatagatcagaaatcagttttagttagttgcggtagcaacctaacctagcttcatgttgctcctgcgctggatcatagatcacaactcagttttagttagttgcagttgcaacctagctagcttcaggtcggtggatgaaaacagccaaaacaccacgtactggccggtgtggtgtgattaattaaactgcaggcaggcagactccctccctccctatatatccatacaaccaaaaatccaaacttaacttaattttctttcattttattttcattacaaccggccggatcggactagtgttctttcaacagctagctagtttgtccatactaattggtgccaattatatagggtagtaggtctcgtcctccattgaaaatgttctttcacaagctggagtcgatccggaggtccgagaagtttaattatggttggttcacttaatttgttgtcttttttaatattaccaaagtttggtaatgttaaaatctggcacatatattgtggcgtttaccgaattttgatattggtaattgtaagggtatgtttagtttgttacgataccaaaatttaatagggttaaaaatgacaataaataccctaaaacatccacagaatatatgtttttatgctgtagtatctctgaagcagttacagatacagtaatacgtacagttttttttaacggaaaatatattttttttgaacagaagtaacacgtacagtttagtaggtgacttagcttgaagagcgagctcaataggaacggacgattggcttgattaattatatactacttcctctcagtgatgcagctagaaaattttcgagcccggacatactcagatatacatattatttgctataatatttctaactttaatcatttaaaagaaatttcaatggtgtatttgacggtaggcccagacaactacaagccacgcggtggctccgcccctgcttactctgtttcacataataatatgctttagcttttaaataggttcatgcatggcatgaactatatgtatgttcatatttatgtggatgttgataaagagtaaaaaaaaaacatcctgtaacatggatgtatatgtgatggagaggaaagcgccatcttatcttactgaaaaccccaagttatctaatcaggcagggatacataagaaacaaaaggtgcattttttttttcaaactacaaactttaaagcaactaaagagaaaccagctaaatactttaatcagtagtgccaaattaacaggggagataagggaggtaagctaatcaacaaccacagtcgccagctggttaatgttacctctcaaccttgcaattatgcatagtacgtaggagccaccaatataatatcgtgtggtatacttcttccaaagcatagggaccccaattaatcctctcaaaaatagaaattatatatatagctagatactcaatccatgtacctaccatcttcgttctgcatacacaaagcacaacaaacaaacacatgcatatggtatatttgtatggtgctatatatactattaaaatagggtaggtgtgcatgatttttatatatatagtgaatgaagcaaatcattgtccacatatatatgttaattggaacaaattaaaggccaggccaacagagatttatattttgtaatctgggattgcttatatagccagcagttgttgctttaaacttgaggcaacttcttattcagaatagtactgcacaactagacacatatatatatgtgccgacgattaattggagatgaagatgaatctgtgggtagctacatactagctaattagttgtttctactttctccttatgtcagcactaagctagctttctgtaaagtggtatatcaagttgctgttccagcgaaaacaaaagaaaagagagggacgcacaattaagtagcaatagattacaggccaaaatcaagtcattcatgattggtcagagacacctttgacttgaaaacactcaactatatatacatatattaggttgctgctgctatatagtggtagatgagctcgagtgcagtggagagggcagagggacctccaaattccaaaaggaacctagcagattttgctttctcaaaaggaaaccatatagatagcatagatatggacctctttttttgctaagaagaagaacaaattagtctagaattaatagtgcccgggcgaattgttaattctctaactaattaattagagctaggccatgtccatccctaaaagaaagaaaagattctcgatcgtgtgcctggctacagattaattagtacgtacatgacaagatgcatgaatgcataaatagctccaggacatctatccatggctgtgcctatggcgagcaacattattcttggcagggtatataatataattataggtggctgatgactcattgactaaactcaacaagaatgtgggttccaaatgttcccatccaggtggtaaactgagcgtgaagttaggatagatcatattgcttttctgaaaaatgtccagttcacagagcgtgaagtctaggattatgttttttataggacggagggaaggagtacatactccactgtgctagggtagtaccttggctatttactccctctgtttcaaaatgttgtcacatatactacgaattttgaaatggttctatcataggctctgtttagatttcaattttttcttcaaactttcaacttttccatcacatcgaactttcctacacatataaacttccaatttttccgtcacatcgctccaatttcttcaaacttctaattttggcgtggaactaaacacagccatagtagtagtactaatatttcataggttataacattttgggatagagggattattttactcacctcatgtatattaagaccaagtgttcaatgaactttgttagtagtacagtaccatataactgtctgtaaaagggtattaatgtcattaaggtaaaacaacaacagctatcggggatcagcgctctataatttgggataattaattccacagaaacgccaaacacataaagaggaatattgtatatgatgccctctatgactatgagcgagcctatatatgcgcctagtgctcttttggcagttctttaatttcttcctgatagtataaactaagaagacatggtgcaaaacgtacgtatggttcaacaatggccggtatagctttattcgacattctcaaacgttcttcgatcctccaatactgtttgtttatcatctactagctttatgttatctttggtttgttgtttatcgtgtagtctatcgatgtttgtcgcatgccacatgcagaacataaacatgcatcaacaaagtggagtaactaacatatgcatactgaatgcaagagaactcgataagttacttccaagttccactctagtttcttttgttctaacaagaaaagggaaaattgtgagcagcaggcaacctatttccaaaatgttgacagatatgtatttagagaaaagtgcagtgtctccccttcacaaactctctctgcatgttatgtttgacgactcccgtcagtaaggactcaactcaagcaacatatctgcattatctttcatcgtttttttctcttccttcagtgcccacaccgaatctgcgctgtagagggtgaccaggatccaaccacactcattcaggttgaaatagccttaggagctaaccacagcttcacctttttgtccactccagcagtcgctaaaacaaaagcaggagttccacctaaaagaaaatattatcagtgatcagtttagaatctgtaaacacttctccctcggaccaacaatagctttatcctagtatcctcagcctggaaatcttccagcaaaaagcaacacgcatatttgtaaatggcgacaagtgatgcgttgacatgagacatgaagtgcaccagctctaaaatatgaattacatttgcatatggctaaaaaggacaagcttcaaagaaaaacgttttggatttcaaagaatttcacatgtacatttcgttcgcgcggtttgcatacttcttaccatttggaattgttcgtgaagcccaggcaatgccagttatatcacctgattacataaagaaacatatcactgtaagattgcagcatatatctagcaaagatcataacaggaaaaggtgtaaattatagcctaatgtatcagcactgcatatctttatcgagtgaaaagtagttgaattctaaatactaaattacgatcaaatttctgaagacagcacaaagttgagaccatctgttatgcaagtaagtattggtataatccatggacttcatggccatgatctacaagtagtctgcaggatcattgaaaaggaaaataacacatgaacattgaccacagagtacagagtatgatgtatttgcccatggtagtcagttcttaacaactcgggactattgttgaaaaggataggttgtgactcaaacacaaaaaggttcacaagaaaaataaacagtgtcaaatcttctgtgattcagatcttaattactgccgtctccttaacaatttattaggtccatttagtagtaaaaacagtgtccaatctggcaaatcaagaaagaagagggcacataccttcatgtgctttctcagctgtatcaagaactgcaccagtttccacacataaccattgcagcgttgatccacttgtcgtggccagaactttctcatcaggagatacactcatgtgatcatactggcaaacagaaccttttgaatcatggagaggaattggcaaaactctcaaggttttagggtcttcatcaagatggtaccttactacaaaattgacagaatatcaacttgtgaggaaggagagtatctgagaaaaagagaacagtacaaggtgtgcatagacttctataatggcaataccaagaacaaatttattttcatcaggacatttgtataaattcataagtgcattctgtataaacatttggtagtgatcaatcagcacagcatctaacagaaaggaacggcatgagaatggctgggaagcaacttgaatacttgattacagaggattgcgtaaccaggtttgatacttaaaaaaaatgataggtcctctcaacttttgtgaagtcaggcacaaagacaactatagatgcactttggcatactgagcattcaataagtggaaatgaaaaaaaaaatcaaaagtataggagttgttgccgtgatcactttcagaattcaagtaaacaagtttttactgttacaatttatgaacccaatcccaacttattgcttcaagccatcaaggatatggtggtaagcggcatagaacataacattttgattaaaataatagaacataccattaatgttccatactcgaattgtaccatctttggaagctgtaataatctgctcagaattcagagcgaaacacaggcaagtaacagcgctctgaaaaaaggagaccgtcagcttctcatatgattcagaacatgcaaataaattcgtaacacgtccaacaagacaagggggggtcttactttgtgacccttaagttgcataactttattgacctccttcacagagctatcctttgaataaacaatctcccacacctactcaaataaatgggaaaagttatattgcccggatatcctggcaaggatatgctatagttcttcaaaataaacagaaaactaaccttgacatcagcttgtaaagctgcagcagctatgaaacggccatttggggatatatcagccatattatttttcaattgaatggtgtcgactgttcccaactcctttccactttttccatgccaaattttgatatcagttgctgcatgacaactcaaaatatcaaccttagtgtgagataaaaggaaatccatgtagcgtgcacaacttaatggcatataccttcagagcaagaaatcaatattgtgctgccatcaccagtcccataggttgcacgagctgccgcaagattcagcactgactccttgccgtgaatcttacggtgttcccactttatctcagggggagaaagcttgccctgctgtttgtttccgccagctggaggagcaccaacatccgcatacatgtagagagatgagcctaaaagtgcttgcgctgccacaacaactgatgatgccccttgtgagaaagcaatagctgtaggatgtgccccagcgggcaagttgatcctcagaattctgcaaaacccccataatctcatactccagcataaggaagtaataagaaagaataattcgtgcagaattaaaaaaaaaatcttacttaaagctcttgcttgagacatcatcaaccctgaatactctgacagctccatccgcacatactgcaacaggaagcagaaagttatagatgtagacattagaatttggagtagcaatcacacttggttgatgaagtgaaatatggtaaactgtatgtgtggtgccaactttgatttgtagcaatgagaaccacaaaacatgaggcatgatataagatgagaaaataagaaaggcaggacacgaacaaagagaggtcctgcctcgtggtaatatggtgttgagaaagtagagcggaaaaaagctgaccggtggccaggttgcaggcatcatcggagaaatgaagtgctgtgactgaatcagtatgccccctcaaagtgttgacatcaagatgatggtgcttttttgcggcgtcctaaaagaaaatcatgttgagatcaatgacggttatatgaaatttgccgacaagaaagaaatacagtaatatgacattttcggagaggaatgaaatagtaaggaggcttgtgcgtgtaatgcctaaaatttataatggataaacatatcaaatttggtaactcagattacggaatttgcaagcagcaatgaggttacatttaaagtcgtgggtggaagatagtactagtatataggcggtagtaataataaagaaaaaggaa

SEQ ID NO: 11143 - DNA, 9502 bp, Oryza sativa
agtaatagtaacaaattggcacggtcgacactcgacaagggcagcacgaacggagggatcggatctgatatcggaaagagagagctaaatactactactactagtatgatatgataatgttatacactaatagttttgagtttgattgagataagggcatgaggaatgaccttatcgacggcgtggtgagatcgctggtgtcccttcttaggctggttctggttggatggtcgaacttgcttgggctggtccggggcggcagcggtggcggaaggggggagatgggcgatggcggcgcgcttgcggcggaggtatccggagaggaagaggagggcgatggcggcgcctaagatggccgagaggaggggcagggacaccagactcgtcgccgccgccgccatgaactctctctctctctctctctctctctctctctcgggtttagggtaaaattgggtttggtttgtgtgctactctactgatgacgaaactctcagcggatgagtccgtactgctttacccttttgcttttgtactcactgccgccccggccccaccaacgcgtatgtaacatttagattaaatgtttcatgcaaaatgagatagaaataacatgtgattaattgagttttaattattacaaactcaaaaaatggattgatatgatattttagaacaagtttcatatagaaagtttttgcatgaaacacaccgtttagcagtttgaaaagcgtgtcatgagtatccaaaagtttatccaacttttgctggagaaaagaacagggccatgcatgtattagtgtactactctagaggagaaaaaaaataagaagaagaagaagaaaggagtaagttcatctcctgtctctcaatttcacatcgagtttgtataacatcctcgatttttaataccagaaatctccaccccttataactattttaaaccatgtaaagtaggtccaatgacattatagagagttattttttcttacgtggcaagttgatcgggcccactcactgggtcagtcaccattgatcagacccacatgtcatgggatacctctcttccttttacaatcctcatctcccctctactccaatcactcatcacctctccccactttcctatttctctccatgtcagcgccctacgtgggggaggggcggcagcggcgcctcaccttggtgcggctgacatagagaggagacgaccaacagtggtggtgaacggttgggacaaccttgtcacctggctgcacacaaaagtttgcaaccaccagtaccatcgacctcagcctcatcgacggcgacacttccacaggcccaattcactggttgctgttgtcgtgggcgagtgtgcgcagtgcagggattcttgtcgtgcatggagagtgcaccatgttggcggcaaatttgtgcacagcgaagggcgtgccaccctcacacaagctccaactcccaccgcccctactacatgccatactctccctgctcccctgcctcatctccccgcgccacatcctgtagccccccgcgctcctcctcgtgtccctctgtctcctactccatgaccacacggtcacactcatctcccgtgtctaccccttcgcgtccctcagggccgagatctcctcaaggccgccgcatggatggggaagatgatgatgggggcacagcaatggcgtcgaagacaacgagcactccatcatgggaggggtgaaaacgtgtgctaggggctatgggacgcgtcgatggtgatgtccgtcgagccaacgccagtgtctgccggtcaaacaagaagaagaggaaaatggttgatgctaccatcttgatgttgcattgatggtcggcagagaccacacggatgtggtgccaacgaggagaagataaggagtatttatttatttttactaactaggatgtcacatcagctaaaacaaccctctatactattatgtgatctagtttgtacgattttgaatatttaagggtaaaaatttctagtattggggattgaggatgttttgtaggccgtcgtaaagttcaggggcgttacctatttcaagaaaaagcacgggcagaaactaacttgttgttatgggccgcgtcgcgtcctcttgtgttaggcctgtcgctcgcttttcctttccttgtcaattcccgttgatcgaaaggtcttcaaattaaagcccagcccaaacgcatatgcagcactctctttcacaaatcttttatcgctccatccttctgtataaaaaagaatcaaggaataaacaaggtataaataagctatggattaaaaaaatagaacgcgaagaaatgaaaagaacgtaaactcaaatttaaaattaaattaagtttcggaattcaaacttttgctacggtcatggttgcatctctagcaaattttcctcggtataaacaaaagagaggaagattgatccgcgaacaagtgcaatggagaagagattggtctgcgagcaagtatggtagaagagattggtctttttcgacgctggattgaaaggcttaggccgcgtttgaatatcccattattaacttatactccatcattttttacgtgcacgcttcttaaactgctaaatgatatgtttctttttttaaaatgtttttatataaaagttgctttaaaaagtcatattggccgtttttttaagttctttcgctaatgctcaattaattatgtgctaatgagttaccttgtttttcatgcaggataaatgggttacaaaccaacacgttcgaacacaaccttaatggttttgctatgtttatttaggttctttgtgaaattgcacctctttttatacactttacaacaccaaagctaggcaaagccctagtagttttccaggtaaaaaacacacaccaaagattgttgctccaacccgattatgattttgacataggactttcacaaagaacccaaataaacatgagttcacataggacttttttacatttttttttcacttgagattaattaatttgactcctagagaaacaaacacctcctttgtttccaatatctgtcgttagtactaagtttagaaagcatgcatgcaaatttgatgagcatgattgtgcaataccatgtatgggtgccttttttgtattatggaaattaaaatatacaaatttgatgagtatgagagggtaataccattttacagcatttttttggggattggacaacaaagaggattcatgcatgatgggagcaatgaagatggggaaaatatctagaacaaactacatgtatatggtgtaaacttgaaaattaacgtcaaatagaaatggaacgtggaaaaatcttaggttttcctttttttttaaaaaaaaaagaaactatggtactttttaggtttgcactatatatttttccataaagataaatgttgtgactttctacttgcaatgcgtgatgaactcatttctagtactcataagtgatgaactacaaacaaatatcgggccatcgactggtttatgagttctacatttaacatatccatcgttgtcttattggctcgtgagagtaaaagaaaatttaagttttaaagctaaattttatagttgattttgatgttttctcgtcatggtttttgcagcattgtttttaaatcgcaaagaacaaaaacatatgtaaaagttatatccgtaaattagtttctgtatattgctttgttcaattttctggacttatcaggcgtggagaaaacgatggatggatgtgttagtttcctggctcacactgcaaggatgggacaaaggtttggttaaattaaattgattaatcatgctttgcatttctgcgcaagctaattaacaagcctcactgaatggaattgatccagcaggaggcagacatactgtagtgattgaaaagcagcaagcttattccagcaggagcaggtgataggctgctaagctagctagcaagcatatattcgattcgattcgaccgcccccgccccgcccattaatttcttcattctcatcagcatctcgatcgatccatcggcagctggccggcatcaagctcttaacttaattagctagctagtctctccctccctccaccgcatatccatcccccaccagttgtagcagtagctagctccaagagcttcttgtccatgaattgttgatctcgatcgatcgatctctgctgcctgctagctaatgaataaacaatagctaggctatatatatatatatatatatatatatatatatatatatatcgatcgaccatgtcgtcgtggatgcagcacaggcggcggtcgtggacggcgcggttgctgtcctccgcgtcgctcccgccggtgcgcctgctcgtcttcttcgccatcgtcatcttcttcctctccgtctcctcctacgtcgactacaaggccatcgagcgccgtgcggagatcggcctccgcgttttcgccgccccgctcgccgccgtcaccatcttcctcctctttctcgtcctccagcatcgacgccgctactggacgctgcgccgccaagtacaccaccaccatgcatatgctgatcaggccgaggctgcagggagcgggtcgccgtgggttgtggcgctgctgctgctgctgttgctgctcatgctctccttccaatcctctgtccattccatctggttcaggcctctctgggattctgctgattactagtagtaactagctacctacttctacggttctactccaccttgcagctataatttactcatctacctacctagcatatactatatattatctatctatacatacaggaattaatccatccatatgtaatacgctgtctcttatttgatctctagctcgtatatactccatctgttacacaatgtatgcatgtatgatacaacttatgttcccgtcttgatacaatagcaatatattactactagaaggattaattgcatctgtatactaccacgcgtcttcagttctgctctatttactggttcaaaagaaattgcactgcaaaactgttcatgagagacaatgtgctaaaaaagaacactttacacgtgtagcctaaatatgaatatgttatagtaaatgagaattcatttttacgtctttaatttatacagttatgaggtagtacactagttataacaagagtttactgtagttcgacttgaataattaatgtcaacggactatgtagccatgtccatattgttgtctttttcctagctcttacatgtttctaaattcgccaatcttctttttcgataccttggcgttagctagaaacctcttgggttttatttttcctttacacatggttcttggctacaatatcgggcaatatctgatataccgttacaaccaagtctgacaaacactactgctatggcttctttttataacaataatcattcaatgtacgcctaactagaacatataaataatattttaatctaaagttataacgactagaatagttagcattaacacgtatcattgtcctattgtagctgcttttcaattgacgtcatagaatctatggcattagacacatctttagtgtgcccgctaatatgtttaaactgtttttatttgtaaaatgagatttatatcatttttgtgaagaagtatacatcaattataaatactctcataataattgttctttttaaatttctatacataatatttggggatttgtcccacaccgtatatatttgagtatttagcagcaaaagcggctgttggctgtgtgctgcacaactctagataggggatgtaaataatttccgtaattgaaaaaatgctctcataatataaattcatgagagtagtataacacatgtaaaacaaacaggtaataactcaagtaagtagtacttagaagtaaacaacacggggagtatatatatatcatgaaaatgagaaaggaaacaaataaacaactagtggtattggaatgtattgatgtaaaataagaatacggagttgtagaggggggcagagtgaaaaagggggggcagcaagccgagcatcgcgtactttccccgcaaccccaaacaacaaggaaggaagacgctcctcccctcccatctcttaaaccccaaaaaaaccaaaataaaaatccttctcctccttcggctccgctttccttccctttcccgatagaaatacataccttccgccgccgccgccgccgccgttcctagggttccggcacctccccgaatccccccctcacttcgacccctgttcgcttcacccgccgccgccatggcggagaagctgagggatctgagccagcccatagacgtcccgctgctggacgccactgtcgccgcttctacggcaccggatctaaggaagaggtattctacttctccgcccgctcgctcgcccgcgccttgcgtgcttcttccccgccaccgccgccggacagctttcgagacttagggtttacgcgctttcttctcctatgcgttcccaaccctatccgctctcaccgcccgccaatgccctctcaaccttactctttttcatccttagggtttcgtatttactggagtatgcgtcaagctgggcgttgctgctgctattatagcaccgtttatgaccccccccttcacgctctgtgtttgctgttgctgccctgctgcatattcgtttatccttttattttaacctcctgccaatatacaatgtcattatcacctttaatgtgtttcttcctaccatttttttgattaagcaatgtcatgcatgcatccatattatccttatgtgccttttttcttctttcagaggaatgccgctgatcagatactacgggatctacagaataatccagatatgtggctgcaggtggtccacattctgcagaattctcacaacttgaacaccaagttctttgccctccaagtaagtttccgcacctcactagttagccatgttaggtttctttgcaactcaataaagatggctgccatttctcttaatgattagcattgtagtaagatattttttcatcccgtaatacctgcactttacattacacgtttgcttatatgattgtagtgtaactgtgttaggagaggttctcatagtcaccatatcctatatttgagcattcagattgttcaacagtgttgagtgttttatcacttatgtactaccacattatagagacgaatcaaccctaggagaaacacatgttgcttatttgccttcgcaggcctagcgcataggctagattgaatacatacataggccatgcttaaaaaatttaaatgcaggatggtagcatgaagtttgtacagaaccctgtttacagtaaaagtggatgcttccttttttacagaaatagatggagacctaagtttctaaatatcagtttgcagtttttgtgctatgcttattttttaacatgctggagaaacatggtttataatggcctctatttagagcagtgaaaggtgacatgttggttctattgtttcaccaacagaataaaaagagcttctcttttgccacttcagaatctctaatctctttcactattcaaataaggctcatctctttttttgccatgactccatcatcacccttctctttttggcagaaccacagaaattgtttaggggccatatggtatgatcatgcaacccatagttatgtgcatcagccataaataaaacctgggttttctgcatctacaagctagtttcaacatgatgctgatgcttgctccatgttcattttaaattaggagatcccaacctgggatgtctctgtgcatgcatgctagtgctacatcttcacttgtagctgcgaagttcattctgtgtcatttcctgattttgctacacattttaggtacttgaaagtgttataaagtataggtggaatgcattgccaactgaacaacgtgatggcatcaagaattacatatctgatgttattgtccaggtaaggaccaatacatttgacaaatcttttatttcatctggcccatgaaaacaaatctcattcgtgtatgccttttatgttctctttcgtcactctatcagctctccagtaatgaggcttcttttcggcaagagagactttatgttaataaactcaacattatactggtgcaggtaagctgtactgtttcagtcaccttttaagtcatagcactgcttgttattatctatttgttcatctggcaagtcaactgacttgtattattaattgttgcaatataataggttctgaagcatgagtggccagctaggtggtcatctttcgttcctgaccttgttgctgctgcaaagagtagtgaaaccatatgcgaaaattgcatggctatattgaaggcaagttgagttatcacctgtttctgtttaacaacatggaaccaactactgactctgcgatttgcagcttttaagcgaagaaatttttgatttttcaagaggtgaaatgacacaacagaagattaaagaactgaagtcatcacttaacaggttggttcttgttaccatctttgtccttttagggtgttctgtatctatatatattagaccacagtcaattattttgacatatactttattgcgactgccttttgaactgatgcaacattattttccttattgttgaacagtgaatttcgtcttattcatgagctatgtttatatgtcctatctgcaacacaaagacctgagctcatccgtgctacactggctacacttcatgctttcttatcatggataccagtgggcttcatatttgagtcacctttggtatgtagcttatttctaaacttatcaggaaagatcctacatagaatttatcaaatcatgtcttatttttcttcatatatgtttgttagctggagacattactgaagttctttcctatggctgcttatcggaaccttacactccagtgccttacagaggtaaattggtgatgtatttcctgctgtgtctaattagcaatgtttctaactgcgtatgttcctaatggagtaataaaaaatggaccatatccattagtttggttcagttttttttttctatatatcctttttgaatgggggcagtaaaccagccctattgcatttgagaaacatgtaaccttgttggtttaataccctatttatcttttgtatatatggatcttgcaggtcgctgctcttcagtttggtgatttttataatgtgcagtatgtgaagatgtatacgattttcatgatgcagttgcaggtaaagaatgtcttcaggaatctgttgcttccttctttctaaagtatcctcgccctttccccctccttttaaatatgtacttatgaacgacccttccataacatgtataggctattcttcctcctggaacaattcctgatgcttatgctaatggctccagtgaagaacaggtatggcagtgattacttcaataacagtcagtcataggagtctggttgatttctcattttttaaatac

SEQ ID NO: 11144 - DNA, 16242 bp, Oryza sativa
agcaattaaaaatgtctcctttttcgatataattgttgcacaatttctccatctggtttagtgctttgtacgaagttaaaccagaaaactacaaatttgttttgggatcccagatgctgaagaaattgagtaagcaattaaatggagaagactggagttggaataacctcaatactctctgctgggcaatcggatcaatatctggttctatggtggaggaacaggtttgaataatcatacactgttccattctttttgtctttggcaaacgttaaggaggactaatatttagctttgtgataattttgaccatttcatgcagtgctgaaattcttaatggtttctgtggatctttttcaggaaaataggttcttggtaatggttattcgcgatttattaaatctctgtgaaatcacaaaggggaaggataataaagctgtgattgccagtaacatcatgtaagcattcatctcaactacccatgtttatactaacaaaattaaggtttgactgatctgatgattgctttgttaggtatgttgttggtcagtacccaagatttctcagggctcattggaagttcttgaaaacggtggttaacaaactatttgagttcatgcatgagatgcatcctggagttcaggtcagtgtgcattcacatgtagtctgttgtgttggtgcagaatcactgttttgcagcccttgtagtgtggaacttagattggaactgcttgcagccatctttccttccatgatcttaataacaagttactcatgtatctgttgtttgatcatcacacacgctgtttgctgctatctccagtttgtgcaaatagtttaatgcctcaacacttctgttagtgttgtatgtaatgtatgccttgctctgctgattgcaggatatggcgtgtgatacttttctgaaaattgttcagaaatgcaagcgcaaatttgtcacacaacaggtaaattcaatcacattgcttgatatctcaaactcttatgtggatactttgctgctatttcattacaaattatgttttacttaaagcatgtgctgaatttaatttaagcacatgcatctaatttatgctaatatgcaccggtgacacaccaacttcatgtttctttgttatctaggtgggcgagaacgaaccatttgtttctgaactgttgtccagccttgccacgacaattggtgatcttgagccgcaccagattcatacgttttatgaatcggtatgcttaaaaaccaaataagtaaaacacaatttcaatcagaatagtttatcattaatattattttgtgctatctgattttgctgctcaggttggccacatgattcaagctgaatctgataacactaagagagatgaatacctcaaaagactgatgagcctccctaatcaggttccttattctacattcttagtatgcctttatactttttctggaaaatgtagttttgacaggttttcctatcattgaacagaaatgggccgagataattggacaggcaagccaaagcattgatatcctgaagaaccaggatgttattagatctgttcttaacatcctgcaggtaatttaatggagcctgagaatttcatttgtctattgttttgaaattcgctgtgtgaactgcggtattatttcctttctttcgttgtttttgttttttcttgatgttctttttatttatttattttataatttgtaaagcttcaaagttagatcgtccacctagtaggaactgaactgcgtagccaggtatatgctaagtcacgaactggtagggacatttttgttcattatagctcactgaaccaatttatagagcatgctttttcttgtgagattgtgcttgggaactttgaaaatatttagggtcaatttgctgtgtaaaactgtagatatcatacattctagaaaatatattgcaattgttgtttgtgtgttacctctaggtagttagccagcaattgcacttgcttgcttttggttcctctgtgtgcttcgctgtctgttgaattaaaacattttctttgtgtacaatgtgctgtttttagtgtaattttcagtttcatttacctttgcacaaccctccttggtcttagatactgttggttttttgttatttctcctggtgtaataaatgttgttatatgtgcttgcagacaaacacaagtgttgctagctcacttggaccacactttttcccgcaaatttccctaatctttcttgacatgttgacagtttacaggtattttgttcaccgcttactgtattttattgctgtattatgttaactcttagataatggtacagcattttcttggaagtacaaagctaatcaagtattacaaatctggggcactcggcggggtaaataaattgaagcaactgactaaaacaattgatggaaatcaaatctcgatacactatattgctaaatctcagtattgtactacataacaccttccgaagttagatcaaggtctcagatgaactgttctttgggattgtcctgcctggtgcctgcccatgtaaaacttggtctcttttgtatggcaatatgcaaacaaccacaactttctggggcctgcagaatttggcccagaaagcaagcgatcatgctaaatttgctccaatctactagttagaatttttttttttgccaatgggcctgccatggtctgattattcttgtggtcaaggttgatttcatcttgtaatgcctttaatacttcattagctaataccatcttttttgttcgtgcattgttttcacatcagaatgtacagtgagcttgtatcaagcaccattgctgaagggggaccttttgcctcaaggacctcctttgtaaatctccttaggtatgaattgttggtttactaaattatgctctatatgtgacagatctgtcaagagggaaacattgaaattgattgagacttttgtggacaaagctgaagatctaccacacattgggaaacagtttgttcctcctatgatggatcctattcttgctgactatgctagaaatgttcccgatgctagggaatctgaagttctgtccctgtttgcgacgatcataaacaagtatatgcctccaacctgataatgtctttgtttttgtagatgtaaattaaaatgtgtttttattatttcagttcgtaggaaatttcttccaactgtacatcttgttgcactgtctgttctgatattcctttccagtaatcatcattttaatgtttattgtagatacaaaggtgaaatgcttgaagacgtgcctcgcatatttgaggctgttttccagtgcactcttgaggtaggaatacctattaagcttcctttttcattctatccataggtaatatttttagattggattaataatttgttctgtcctgtcagatgatcactaaaaactttgaagattacccggagcatcgcctcaaatttttctctttgcttcgtgcgattggcacccattgcttccaagcattaattcagctttcaagtcaggttagtaccaactatttaaaacatcattcttccttgttgatttaaatttactattgagttcagatacatcaacatattatcttctattcttctgttttatctgattattggattgttatcttattcagcaattgaaacttgtgattgactctatcaactgggcatttagacatacagagagaaacatcgcacgagactggtctcagtctattgctggaaattttaaagaactttcaggtagaaaatacaatccacaatttgctaccattgcataatattctgtttgcttatgttttttttacatgattcacttgcaggcctcaggattccaaaatcaattctacaaaacttattttttgaatattgaacaagagatctttgcagttctgacagacacattccacaagcctggtttcaagcttcatgttttggtgctgcagcacttattttgtgtggtatgtcaatattcatttttatctgttctcttttgtttgtatggatacacttaattattaattttcctaatttgtaggttgatggtctgacggagcctctctgggatgcatcctcagtaccataccaatatactgacaacgctatgtttgtccgagattacacaataaaacttttaggttcatcatttcccaacatgacacctactgaggtatgatccttcttttgcagctatcctgtgcttctgtggccatcatagacctaacaacttttcccgcacaggttacaaaatttgttgatgggcttcttagttcaaaacatgaccttccaagcttcaaaaaccatattagggatttcctggtgcaatcaaaggagttctcggctcaggtaatttgctcctaccccttgacactggcatggacctgatttttcacaattcaaaggaattagaggaaccaatacttcactataccagaaatagtaagaacatagtttatcagaaaccaacagttgctaattaccagagagtggatgttgccacgtggtagtatggtgccaacttgagaaaacgatagatatggaatcatgtgccaagtatagcgttaatgttagggcctttacaatgcataagtgcccattttttatttgttttcatgttacttgctattgaactcatctgatgagttgtttcatgttcatttgcttaggataataaggatttgcgattattttagggcctttacaatgcacaagtgcccattttttatttgttttcatgttacttgctgttgaactcgtctgatgagttgtttcatgttcgtttggttaggataataaggatttgtatgctgaagaggctgctgcacaaagagagagggagcgtcaacgaatgcttgccattccagggcttattgccccaagcgaattacaagatgagatggttgattcataattctgtgattcagccttgctaatccagttccatttcttgctttggcctccaaacctctggagccctcaacaccccattgcccaagttctcttccagggtggtgaaagaaggtgcctgctgtaattttattttcggtaacctccacttggtgctgattgcgagatttctgctagtcaataggaaaggccaactcaattttgtcgcaagagctgttttggactgccattggtttgcagtatgagctgtcaggttaatgtgatgacagcagctcttgtgctcctgtattttgctaacattgctgcgtgtgcggggccatcatatagtatgatcacggtacaacattgtatcatgatttttagtttagtttatagatcggccgcattctgtattgtggacaagattcaggatagaaacttatattcgtagtgtactattttgtgaaatatgttctttttacattgcccgcatatgtgctgtttggtttctttttgacgctcgtgatttgtcgagtctgtatcaaagtcggatcgcccgcgtgtattccgcacatgcatggagcgaatctttggcgtcgctttttttttctatattaccgcaagttctgagcgaattacgatttcatttatgttttcatattcaagcttgattcttcaggagcgtttgggctcaaataagtgtgtataggggcttgtttggggaagttttaaattgtaataagtagtccgtaagaactggaaaagtagtccgtgagaaccgaaagaagctgagaaacctagctttttcggcttgtagttcattttctggattctataattacagttacttagaatctgagtgaaaagttttgactgtttgaaggaacttttgattttgaaagaggctacaacttgtcggaaggaacccaaaacaagcactatgtgttagttgctagtggagtatggagatttttcgtttggatgatggttatatagatttttgatgcggttttcctcttcctcctgaacagtgcactgcaaacgggaagttggagaagtttctcactttgtatgaaatgtgtgaaaacgtgtcatgttatttgatgccagctactgcgacttttgttttacgacgcagtgtgttatgttagagatagaggtttgttacatagagttgttacgtgagataccaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatatggtatcagagccaatcatccacgcgagagatcgcatctaccaaaaatggcgagttcctccaattccgccaccaatccactctccggccaagttgtcccagagaagctcacaaggaataatttccttctatggaagacacagatccttcccatcattcgcggtgcccgcatggaggggtacctcaccggcgcgactcgcgctccgtcggcagcgatcgacgtcaaggaaggcgacaaggtcgtcaccaagatcaatccagcctatgaggaatgggttgtcgtcgatcaacaggtgcttggatttctccttgcatctgtatcaaagacatactcacccaagtcgtcaatcttgaaacggcggctgcgacatggagagtgatcacaacgatgctctcctcgcaatcccgtgcgcgtgctctgaacacgcggcttgcactgtcgacgacccgcaagggcgatctcagtgtcacggagtacatcggcaagatgaagacgctggctgacgagatgtcatccgccggcaagcccctcgatgacgaggagatgatgtcgtacatcctccccggactcgacgacgattatgagcccgtcgtctccactcttgtcggcaaggcggaggctgtaccagtcgccgaaatctacacccagctcctgagttttgagagccgagccaagctgcgacagcaggctaatggttcctccgtcaacagcgcacgacgaggaggcaagggaggcggcggcggcttcagcaacaacgtcaacaccggcaacaccggcgcgtttcgcggccgtggcggtggtcgcggcgatcgcggaggccgggggcgagaaaacggtggcggcgcgcgcttctccaacaaaccgcgctccacctgtcagctatgtggcaagattggacatgtggtggcagactgctggtataggtatgatgaaaatttcattccagattcaaaaacagcagctgcggcttcctatggtgtagatacaaattggtacatggacaccggagccaccgaccacatcacaggagaactggacaagctgacaacccatgagaagtacaacggcaaagaacagattcacacggcaagcggtgcaggtatggacattaagcatgttggtcattctattattcatacccccatatgcaatattcagttgaaaaatatccttcatgttcttaaagctgaaaagaaccttatctctgctcatcgtttagccgttgataatcatgcctttgttgaagttcatcctcgtttctttgccattaaggatcaggtcacgaagaatcttcttcttagaggaccgtgccgcaatggactgtacccgttgccaacatcttcattggccacatccaagcaagttcttggtgccatcaagcccacaatgtcaaggtggcatagccgtctaggtcatccttctctagctattgttcagaaagttgttagtagcaataatctcccatgtttaggagatgtcaatgagtcaggagtctgtaatgcctgccaacaggccaagagtcaccagctaccctatccaaaatcctttagtgtgtcaaataatcctctagaacttgtgttttcagatgtgtggggacctgctcctacttctgttgggggcagaaagtactatgtcagttttatagatgatttcagtaaatttacttggatctatttgcttaagagtaaagctgaagtttttcttaagtttcaagaatttcaacaacgagttgagcgccttttcaatcgcaaaatcatctctatgcaaactgactgggggggagagtatgaaaaattgcactctttcttcactaagattggtatctcacatcatgtttcatgtccctatgcacatcaacagaatggttctgcagaacgcaaacatagacacatagtagaggttgggttggctctcctttctcatgcttcaatgcctctgaaattttgggatgaggcgttcctagctgctgcctatctcataaatcgcacacctagtaagggcattcagtatactactcctttagagcgcctccttgatcaaaagcctaactattctgctcttagaacctttggttgcgcttgttggcccaatctccgtccttacaacaaacacaaacttcagtttcgctccaaacaatgcgcttttcttgggtatagcaatatccacaaaggttttaagtgtcttgatatatcaactggcagagtttacatctctagagatgttgtatttgatgaaaatatttttccctttgaaaggttacatgcaaacgctggagcaaggctgagatccgaaattcttttgcttccttcctccttatatcaaaatattgcaactaatggggttgaatataatgaccgcatgcctaatgttcctgagcaatctaatgtgcctgttgagcatgtgacagatcaggagatacaattcggagaaggttcagaaaatacagcacaaaatgatcacagttctgcagcaaatattgaaggagatgcaccggatctagatgccgcagcgatcccgagggaggatttcagccctcacctgtgcacacgcctgcactgtcttttcccgacgatgaagaaatcggcgaaaccggtggcttgacgtctctgcagcagggggagcagtcgcatgcagccacgtcgccaagcagccatcatgatggggggagcgacagccctctgaccggcggatcgtctgcacccgacacagccgtggtcgagcccgcacggccggtcactcatctccagcgaggtataagaaaacagaaggtttatactgatggtactgtaaggtatggcatgctgacaactacaggagaacctcaaaacctagatgaagctttgactgataaaaactggaaagatgctatggatgctgagtttactgctttattagaaaataaaacttggcacctaattccacctagtcatggtaaaaatgttatagactgcaagtgggtctacaaaattaagagaaagtctgatggtagtctggatagatataaagctcgtctagtagccaaggggtttaaacaacgctatggtattgattatgaggacactttcagtcctgtggttaaagcagctactatcagaactgtcttgtctattgctgtttccaggggatggtgccttcgccaactagatgtgcaaaatgcttttctgcatggataccttgaagaagaggtatatatgaggcaacctcttggttatgaaaataagagtaagcccaattacatttgcaagttagacaaagcactttatgggttgaagcaagctcctcgagcttggtattcaaggttaagtactaagttgattagccttggcttccaagcttccaaagctgatacatcattgttcttttataacaaaggaggtgttacaattttcgtacttatctatgttgatgatataattgtggctagttctagatagaaggcagtatctgctttgctggcagatttgagtcaagaatttgcactcaaagatttgggggatctgcattacttccttggaatagaggtcagtacggcaggtgatggtattttactgaaacaagaaaaatatgcctctgatttgttgaaaagagcaagtatgctagattgtaaacctgttagtactcctctgtctgtatcagaaaaactgtcagctcatagtggaactgctctaggagaaacagatgcaactagatacagaagtatagttggagctcttcagtatctgactttgactaggcctgatatttcatttgcagtaaataaggtctgtcagtttttacatagtccaactatagatcattggatggcagtgaagaggatattaagatatgtgaaattctcagttgatcttggtcttaagataagtcgttcatcatccactcttgttagtgcttttttagatgctgattgggcaggatcaattgatgacagaagatcaactggaggttttgctgtgtttctggggtctaatttggtttcctggagtgcaagaaaacaggctacagtatcaagatcaagtacagaagctgaatacaaagctgttgcaaatgcaacggcagaggtaatgtgggttcaggctctacttaaagagctaggaataaattcacctgaaactgcatgtatgtggtgtgataatctgggagctacttacttggctgttaatcctgtgtttcatgcacgaactaaacatattgagatagactatcattttgtcagagagagggttgccagaaagcaattagaaatcaagtttatatcttcaggtgatcaagttgcagatgggtttactaaacctctcggtgctccacaacttaggaatttcagatacaatcttaacttaaataagttatgattgagggggagtgttagagatagaggtttgttacataaagttgttatgtgagataccaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatatgttagagcgaggatgtattgatcagttcgtagctcattagaagcacaaccagctgaaaggtgttttttttttcatgtgtgaaagaaaggtatggttttgagtatgatatgtactagcttgtttaggcaggtggtgaatgggccatgctttccccattctgctgtgtcggatggtcaactctgggaaattaagcactaccgcgacaaattgagagattattacccgacaaggaaaaggacgcgcgcatgggccgcaaaatcgaattgggcagctgcttttgcttcctcgctatctagagagcttgagctagctaagttagcgtcaagctactccgcggattcaacaaattaatcgcattcctacatgtaacaatgagtatgcattgcttaattttctagtggtcagttgagcaatatgtgatgccgattaattcatgaggatgcatatgcatgattgctgcaggacgcaagtcgtagccaggtacatatgatatgataatagggtagctactgaaatatcaacacctaattaagatagcctgtagaaacaaaaataggcaaatcaaatactccaatttaaggtaattagaggccttaaggtcattctgaacaaatatattatcactcatgcatgtctgttgcctattattgatcatctgacttggacgtatggaaagcagctgccaaatagttaaaagattttcacttggtgtgtaggcgcctgtttctgtctactactagtatacttgtgactagtcacgttgcatcatgggataaatatgtatgcacacagaattgaattgaattatgagataaacgacggagctagtcaagatgattaggtagaaagggatactagtctagtttttattttaggaggattattatacatatgcctgaattccaaattgaactcaacagcaattgactttacctccctatattaattactggctattatctggacagtccaaacatgtccagacaattcttatccaacatttagtttacatggacagccaaacagaaagatagcatgcatggtccctgtctatattcctatccatccactagcagtagcatggggctcttctcttgtgtgaagagatgaggtcctctcatttttggtccagaaagaggagatgagaggagagggcttcctggaaggagactgagactctgagtgagtgagagagagagagagagagagagagagagagtagtccacatgcatcgattttactccaattaattaattgtcattttcggtcttgatcagaattcaggggaaactcactggaaaaacatctcctagctagctagtagtccacaggagaggagaagagaagagaaatgctgttgccacttgccagaatgccagtgttgtttgtttgttactcgatggacaaaacgacgatgactagctagtgttgtcactacggttggcttttttttgtttgtcacctcacctcgtttggtcggtcgatcgatcgatcggttggtgtctcacctcctcttccttccttccttccttccgtccttgttggtaaaagttgccgatatactccaattgcgcctctctctctctctatctctccacgtgtgagatcgatggaggacctgtcgtgttgcaaagaggacacgggaaggaagttgattgattggtaatttgctatgtatgcaccccaaagtagtattagtaagtataatcctactcaaaatattacaacatagtattagtaagtactctcttcatcctctgacccaaaatataccaacatagtattagattagccacattttattaccaggctattcatatttttagtaacaggttatttggactattcgtgatactagattttgtataattcagtactaggttaatatatcttaaagcggagaaagcagaaacctagtacttgattagtcatgaggtggtgccctaaacgagtattagattgctctattttaattttgcagttttcctttaaaagaagaagaagaagaagaagaagaagaagaagaagaagaagaagaagaaaagaattgctgcttcccaatcacagggcttcctcccttggatagttggatcggtctgcttcctctagtacctagtctaggtccttaccctttctacgagtaatagagatcgatgacaacaaaacaacgtgtgtactagtaaatgatgagagaacaaattaatactcccaactcaatcaactcataataacactccatagaggaaaattaactagcttctagtacaggaaaactaactagggccgcctgcctcttcgatgtagctaggattaattgaagttacaagtaattgatgatgtatacaatatagtacgatcgagtatatatacatatatatagggaattaatatatggaagaaataattagcagcaagattatatgagaagaaacaagataagtaataatgaagtggatcgagtagctagctagctagctagcgtgccatgtcgggcttgggggagtagatgcttccggcgtgctgctccgatacggtggacatctcccaggtgagcttcagggcggtggcgtcgtgcggcggcggcacgtattcctcgagcttgcagagcacgtcggaggcggtgggtgcggcgacgatgatgcggcgggcgggcggcgagacgaagccttcgtggacggccttgtcgatgaaggcgagcagggagtcgtagtagccgtcgacgttgaggaggccgacgggcttgtggtggatgcggagctgagcccaggtgatgacctcgaggagctcctccagcgtgccgtagccgccggggagggcgatgaaggcgtccgactcccgcgccatctccgccttccgctggtgcatgcttcccaccgccctcacctcccccagggtctcgccgatcagctcgcgtggcagcacgccattgggcaccacgcccaccacgtgcccgccgcctccgtggacggcgcgggacaccagccccatcagcccaacgctgccgccgccgtacaccaggtcgatgccgcgctccaccagctgctgccccagctgcacggcggccacctggtacgacgccttcttcccggggctgctgccgcagaacacgcacacacgccggaaccgcgacgccgtcttcttcttcttcttcttcttgctattgttgttcgccggcgacgactccggctgctgctccctgctattctccatcatcatatatacggccgacgaccttaattattggctgctgctggtctgcacccaattcgatggaggtcggaaggcagagaggctcccaacgatagaaagaaacctccggtcggcctctagtttcccacttactaatagtgtttttttctgaatgacccgcacaagacaacacaagaagattcatattgatatagcatgaaaaaaattatgtatagaattacaacagaagaaggtcataattagggaaaaaaaaaagactactccaccacatgctacaggctccaaacacacacccgttgtacgtgaccgataattgctagccctacaaggaggtcgcagacgctctcgcttcaaaccaatttcaccaagaatgtcgacgacagactcccggccaccctcacaggaggtttgaggatgaggatgagagagagagagagggggaaagatctgctcattcttacaccaacctagagacgaaactaaccgaacgcagaaggccaaactaggaagaaggcaatgaatgcgagggaacatgaccttcgaggcggtgcctccatggaggctatccaccttggactaggttttcacccgaaaagtcatatcgggtggagagagctgacaactcagcaacattctcaagagcaagtacaacaccgaggcgtcatcgttgtcaacccgaaaacatcgagctaggatttcgcccacagcaccagctcccacccaaccattgccattccaaagctgtagcgcccgttccgtcgtggcgcctagcgggaaaattatctcttaaaaaccctaattgcgaaatttgtttctttgcttgttgtctagtgtccgtgccatctcagatctcaaattcctccgcaaaagtctattttgcctccccctgggttcgatgggccgaatctctctcgggccatctccccctccctccccggctatctctctctctctctctctctctccccctccgctccgctccgcccgcgcgccgcgcgcgcgtgcgcgtgagccgctcgcgccgaacgcccctcctccgctccctccgctctgcccgcgcgtgcgtgagccgcccgcgccgagccgagccctcctcttcgctccctcgctgccgctccccgcgcgtcgttcgcgcgcgcgcgcccgcgtggtcgtcgctcgcatcatgcctgcgctgtctgcgctgtctgcgccgcccggccccgctgccctgccacgcctgcagccgctcggccccgcagccagcgcgcgtgcccgagccgcgccactccatccgccgcgcctcccgttgcaagccgcgcgcgagtgccgagtggccgaccgcctggtcgccgccgtcgtcagcgcctgctcgcgcctgtcgcccgtgtggccgctccgctccacaccgccccgccgtcatcatcgcttcggccccgccactccgcgcgctagcctccaaggggcggaggcagagtccctcctccctttgccgggtcgccccgctcccccctccttttcccgaagaggcaagggacaagccccctttctctccccccttttcttcctttttccctctcgccggcgtcacctcctgtcgccgttttggccgctagccggagcgccagctcgtcggcttgaccgtccaatgtcggttcccctctcccaaactgacattgccgcccctataaacctaagcttccccctttcctttcctctcccgttcgcctccacgccattgccgccgcctcccgtgctctgttcgccgtcgcctttcgtcgttgcgcgtgtcggaggagccggcacgagcaaggacgcggaaggggactccgggcgcgccctctccttcctcttccccggcccgaggccggagagattactcccgcgccgtcggcctctcgtcactgcgccccgcccgcacggtagtgcatccctccgttctccctcctcgctccatctcctccccttagactcgggtagtagcacgagtagcctccccgtagctagccggcgccgccccgaccgttgccgccgctcgccatgtgctcgccgctgtcgctgcccgagctcggaagcgcctctcgtcgccggcctccctcgatgcgtttcctcctaatccaacgctagcatcggattcccgtagccgcgtagatgctctcgccgccaggaatcggccccttgtgacctcgtcgccgttttcccctcctcccgccgccggttgccgccgccgcgattcgccg

SEQ ID NO: 11145 - DNA, 10023 bp, Oryza sativa
ccccggtcagcccctccccgtgcgcgcgttccaccgcgagccgtgaggctgcgcgtgggcccgccgcatccgttccaccgcgaaccgcgcgcgtgcaccgcatccctcccccgcccacgcgcgtgcgccgcgtgctccctccgcacggtgagccgagccgctgacaagcgggtcccactcgggaccacgcgaggtgagcccggtccaccggcgccccctccctcccctcccccgcgcgcgctttgggccgcctttcgggccggccggcccagttagctcggccgagccgcctcctttctctcgggccgcgccctcgccgcccgagggaagtctaattttccccctccttcttttcttttcttttccaaaaaggatttaattaaatcatttttcctttagaccaaaaatccaataatattagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctctagatctcgagcaaggcaagccacctttgaacatcttgagcctataattgaaatttaattatgttgcttgaaaaatattatgtattgataggatcgcacttaatctgttgtcccgtctgcaaggcagattggcggacctacctaatttgttgcatttgatccttcctttgataattgttatatcgtgtccccttgtaaccatctagttgcgtctcgatattcgtgcaccctgtgcgagtatcgacggacgccttcaaacttaaaattctgaaaaacttcttgggtaaaacttgggttttacaaaagacttggaaaacccgacacctgggtcggtgcttgcgaactaaatgaatttccaaaaccgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggccattgggggaccttttggacagtatggtctgggacctaaccagttgttggtctgggacccctctcgtcggcatatggtaaacctgtgtcggctttggaaatgccttgtcatgaaagcttggaggtctcccgacgtggcggatccccatgggctgggagatccgggttagtaatgtcgtgtgggtaaagtgtaccccctctgcagaggttaacaagctgttcgaatagccgtgcccacggtcatgggcggatgtgaggtgattcctagcgtagttttgtttgactactgcttgtgaaattgctgttgtggaaaggggttcgatgattgaaaaatctgcagctgatgggatcagctaggcccgggtggccgtttgaaagttgttggcccgggtggccgtttgaaaagctggtggccgggtgccaaccttgaatcaattctaaagactgatacattacacatactccgaccggacgagacgcactgtctcatccgtgtcgtttgagaagcactcacttagttgtttttagaaaagagttcaaataaaatcaactgcaaaaacaacagccttccttgaagcctgcattaaacacttatttcccatggcttgctgagtacccccgtactcacccttgctctatataaataatccccccagttgctgaagaagatgaagcggatcctgctgatgaggagttcttccaggagcaagccggcttcgatgagttttagggtttcggcctagttcccaagtcgcgcctgtgttgtttggtccaagtcctggcttccgtttcccccttttgtaatgcagttgtgagctcgggatctgtccgcagcccaacatgactgtacctctactctataataaagagacctctgttgctgtgataatccgtcttcctgcgataccagcactgtttcctgggactggtatcgattaacaggttaatttggagcgtcacgggctagttccggtcggtactagttcggggcgtgacaaaagccctgccacccgaacgacctcgtccagcatgtaggctcgccgcaccggcacccctccaccggccagcacccctgcaccagctcgatggcactcaaccatcctccatgcaccacaacaccatggaggtccggtcatgtgtggtcatcaccgcctctccccaagccaaggagcagctgccgcatccccgcaggcgaccgtccggacccacgcctcagcctccacggccatatccaccgccgcctcgcgctgctgacccgtagtttcgcctcctccgctttcccgtggcctcgccgccgtggctagacccctacctccacggcagcaggcaatcgtctctgagctatagtgcctcctcgcaccgttctcctgccacgagcctagacaggaggcgccgaattcggccgcgggggtgacggatccgactgtagagacgttggatttagccaccgatgccccacaccctatgggagaggcctaactgccgtcttcattgccaacgctccattccgcagcattgctcctcgccggatccggcctggatttgaggggtggtgcctctatctccttgggtcgccacggctccctagccactgtggtgtccttgtgagagaggagagccctatctactcctttctccgtttcatattataaaagacgtttttatctttttactaaattaaagttgtttaagataaaaaattgtagaaaaacatagcaatatttttaacaccaaacaacacatgctatcaaaatatattcaatattagatttaatgaaactaatttgatatcgtaaaagttgctgcatttttataaaattaatcaaacttatagaaatttaacttaaaaaaattcaaaagtgttttgtaactttgaacggagggaatagtagtatctagctattgaggagaagagcagagcagtagtaacattcagtggatacaggaagcaggagtatataggctatgttcggaagtagccgttcccaacaagcacagtgcccatgaaaaacggagtgatctattagcatgcaattaattagtattagccatttttttaaaaatagattaatatgattttgtataattttttttaaaattacttttatatagaagctttttgtaaaaaaaacataccgtttcgcagtttgaaaagcgtgcgcgtggaacgagaagggagaggggttggaaacctgagcaaataacacagccaccatacaccacgagaggcagtaggttgggtgattatttctactgtacatatggcgagcgcgcgacaggggatcggaggtcacgctctgttcttggatctccattctccaacctctctaactcagccttgccactttgccagtagtatacaactacaagacactgcagatcgacactcttgctagtaataagcagtgcagcgcgcggccaattaaccccaagatatatatttttcctttacctcttctttcttaaatcggtacacggtacatatatagtcccagtgtaggcgatgttacgtttgtgccgaatcctgacctgtttgctactccctccgtcccaaaatataagcatttttagctataaatctaaacacaatatttttagctataaatctagatacatatgtaagctaaaaatacttacattttaggacggagggagtatacaccttgtcccatcaccatctactcctccgtttactatgcatatatacgtacacaaggatctatacaaatacatagctaaagatagggatagtatctattttgagatagggatagtatctatttttgaaatttgacaatgtcaaaatttggtaaggttttttttggcatcaaagtgaataggccctttatgccattttcaaccttaccaaattttggtaaaattacttaaaaaaaagtggctacatttagtttgctgccaaattttggtaactatataaaaaatcctaccaaaattttagcaagttgccaaaattttaataatatgccaaaattttaataactatgccaaaattttgatcatgctaaaatttggtaaggttttttttgtcaacaaagtgaacaggccctaaaccccaaaattccattccatctgtgatgatctataggtagatagtcggatagagcgacacgtggcgaccactattacgtacgtaagctgtgaggtcactcgatcagtttgactactggattaattatcggctgggccgcagactaaactctggcaacgcggttttgctagctcccaatacgagtatattattactccatgacgatcatcttaattaatctgtcctacttaatcggatgcatatactccctattactcgtaaagaaaatcgtttaggacatcaacacgatctccaaaacacaacttttagttcttgtttctataaaaatatttattgaaaagtgatatatatatatatatatatatacacttttatgaaagtatttttcaagacaaatctattcatataattttttacattttcaaactcaacaacttaagtgttattcatgatttatattcctaagatttgacttaaatattatcctaaacgacttcctttacgagtacagaggaacgacgtatatatatgtagtctgttggatatttgtcgacacacattattctccatgcaggttaagcgaccgtgtgaatcacatcgttgcttaattatatttagggctctttaaagcaaacaaattataaggaattttaaagcattaaattcctatggaaagaactcaattgcaaatttgcggtatgatccatttgatgaagacatcagtcctttagatacacaaagtactcttacttctcaagttgttaagtaaggtccaataactaaaactcgcgtctgataattgaatttacatgtgagcttgttattgagtacttctttatgtaattttgaggatagattactacctattatttaattacgattagtaactatggagagaatgatgtagcacttggagagaggctagaagatggaaaaggtcgtcatggacgttcaagccaagatgaaggtccgccttatatcgaatttgagtccacctcgtgctccaggagcaatcgacactaaaatcattactcagattgcattcggactccgattttgacgttctatatgtatggaaagctaacgagactatctttccaatgggtgtggtcacacgtcaaaattccttccgagttaatggaaatcatcgaaagaagaaggcgttcagaatctgaccaggtgttgtgtcaccatctttgggcccgttgggccttgtatcatgtcggagtccgatgaggacgcgtccaggggttcgaggtcgatcctagaacctatatattcagtagctatcattgaattagggttgggtttttcttagattatttctgccatcgcagtttcgtcgctagttcggtttgtggaatcccaactttcagttcgtgattaatcattcatctgcaattgagttgttgtctttcttgttcttgattttgttctccggttcgcacgtagggattagccttctcggcgaggttaaacgggttttgacacggttaataactagagaagacgtggtgctacgacggattgtgttgattgaaagcatgatcgtgtgtgtcaagtttccaccatcaagagtaatcgatcttcacctgacggaagatcagacatcccgtttccatcaccattagaactaataaatggctctcctgaatttcgttgaaattcgttaggattgtcttaaactataggaatttgaaagatttttaacatgaggttcatccaaacagcaactccttattgattttaaaccgttgaaaatttactttgtgcctgcgcatgcaaaagcataagaaaataaaggaacgactagcttagtgtggtccttgttggtagatgggagacgatcgatcgagctgtaacttaattaaattcccttaattttgttttctggatgtatgcatgcataatccttgattgatcttttatatgcacgctagctacctagtagcagtactgttttgtctttgctaatacatgccaaatatatagctagctctcgtcaaagattctctagctagcttgtccttaatttgttaatcgtcataattagtagttgggaattcgttagcttcggttgtgacctatgcaatccaacaatgttgctcgcggaaaaaaaatcgtatacagtacacccatcatttttaatataagcaattgaacattttgaattttgacgagcgagaaaataaaaaatattagtcatgtaagatgatattgctatatttatcattaaacaaaactatcatgatgtgaaactcttctatttaaaacaactcattttatataaatattattagtaaaagtaaaatctcatagactcttgtcaaaatccgaaaatgcgtatattttaggaaggggagtataatagttgttcaattaccatgaaattctggtgttgtggattaacaatgcatatatattggttaggatttcgctattcaataattgttttgttcgggagttagcttagtcctattgacttaaaaatcaaaaagcttattttagtatgaacatttatgttttatgctggtctctttggcttatccggaatgatattgtgtttgacaaagctccaataaatcttatatgcaagtactttaattttggtccaattcattagttgtggttttaaatcaaggtacaaaggtgtaacgaggaaaaagaaatcatacttgcatgccaaggtttggagacgatggtttggtatatcgttgtcaactttggatagagattttacatccaaccgttgaatgaagagaactaatggctgaagggtgttttgtgcaagttttggcgggcatatccttaagaaaaaatatgaagtcttccttagtgtgtgtgtatatctctctctctctctctcacacacacccctagatgaacattgcttgaagttgccatgtagcgaagatagcttgtaatgtactccctccgtttcaaaatgtttgacaccgttgactttttagtacgtatttgatcattcgtcttattcaaaaaatttaagtaattatttatttttttcatatcgtttgatttattgttaaatatactttcatgtacacatatagttttacatatttcataaaattttttgaataagacgaatggtcaaacatgtgctaaaaagtcaacggtgtcaaacatttcgaaacggatggagtatttattgtaactttataaagaaaagggaaaaaaatatactgcggtcgtagaaactgttaatcgggcgaaagcctttgaaaatgtttattatccatacaccccataggtggtgcatgtgtcggagagcaattaaacgtcataggtatgtttaggtcacttggttgaaactaaaaaagtggggttaagaaagggaccaaagacccataaaataaataagcgattgtaaaaataaacggaaaaacgaaggtacggggttgaattgatgaagcaagaaaagaatgaagtagcccacagacaggaggcgaggcgaataagaggcaggcccacaggaaaacaagaaagatgggccccggcccaactaattaacgcaaagaagaaattaagatccccaccccaatgaggggaggtgatgagatccccatcatcggagaaggagaagatggagtccaccaccggcggcaaggaggaggagaaggagaagctgtgccggcggtgcaaggcgacgtacgcgccgtcgggcaacacgcggctctcctgcaggttccacccgtcgtatttcgtgtgccggcgccacgacgaccagaagaggtactaccagcttcgcgacggcgacccaccctacgccgccaagttctacgactgctgcggcgccgaggaccccgacgccgccggctgcaccaccgatttccaccttttctacgacgacgccgatgcctagccgctcacccctacctacctaccttgtacgtataccgtataccaccaccgcctgtattcctctttctttctcatgtatgctactactccagttcactaataacgccacgcctacaaacaaattactgtaatactaatcaccaatcatttcaataaattcagtcatatgagatgagatggctccttaatttctactgctatgtagtaatacttaatttccgatatgaatgaatgacatggatctgaatcccaaatactactccagttcaagttaaaggatcaggataattgcgaacaacagtaatgatgatgcattatcaactcatcaacatcaagcacatgcatgtatgtatgtttgtatgtactccacttccatttgaattcaatgattgcgactcacacaaactagaagtaattcacacagctgcatcactagcttagctagctagtagtggactactactccgcaattccgcatgcgcacccgcatggccaccaatgctctttcttgtgtcaaaacaagattcatactcctaggctagtggggatgatcttcacgttgatgattgggaaaaagaaaagggcaatatataatactccatatgtagtgggcggactggccctcattgatccatttgtatttttatcactactattttctttctcttccccttttcaaatgaatgagcagcagcctgagttttgtttttatttgaacgcaggatttccttttaaaaaaatagaattcgattgctttgtcatctcaaatcctatggatgaaaaaacacaagaaaactccaggaattacagtttgaatgtaacacaacaaaaacacatgaatcgaaagagagaaagatagacacaaaggaattttttctagcggtagaatctcatgttgacaatccttcaaaattcctatgatttgagacagtcctaaagactttcaaaggaatttggagaagccattcctttgttccaaatgcctgtaatggaattttttttcatagtaatccaatcctctaaaattactttgttccaaaggagccctgaaattatttcagtactctggccggcaagcaaggttgaattggtgggatgatgaaagcaaaggtccctgaatcaatgaatctggctatcttggccacacaagggaatcgtctgcactagtgcagtgtcacaagttgctgtatgataggatgagcacgtgataggtccccagatcctgaccttcaacagttatttgctactactgttgtcttcatcctaaaatgtaaagaattttacctacatatacttgatccatttcatacaacttattttagtatttaaattttatatcaaaatacttatcacttttattacaaagtagttttaatttaaaaagatcttccttccctatcttttattgatgcagtcatacattaatacaatctcaagtcttattgactcatttgcttttttaaaaaaataggatgtattgaatgagggtaaccatgtaatctaccacatcttttggtttgtactactataatgtttgttagaacaagtaatttgaaatagagagatttaaaacagaggaagtagtaggttactcccttcatcattttaaaatatagcaatacagtatgagatgagatttaacttagtactccctccatcccatattacatattagagggcgtcaattttttatgacagaaggcgtgatgtgttttctggttcaaatcttccaagagtgcgcttctgtgtttggtcttcatgtatgcgtgtgacgcttttggcatacagatccacccaatgactgcttgagcatgcagatgcagtcagagcaacgggattaattctacattgatgctctttattagagcaagttcaata

SEQ ID NO: 11146 - DNA, 17787 bp, Oryza sativa
  unsure (1)..(17787): unsure at all n locations
ccttagatgagccatatgattaattctgcatgggcgtttaattaggggtgcatgcggaggaaactaccacctacacccacgccttgatctccgaaaaagaaaaagtacgccctttagatggtcttcttttcatctgaatatacgaagataaagattaagttttttatgctaaatgagatggtattaacatataattaattgggttttaattattataaacttgaaaaatagattaatatgatattttagagtaacttttatgtattttttttacactaaacgtgccgtttaacagtttaaaaagcgtgtcatgaaaatattaatattcatccaacttcttctgaagaaaagaacgggatcctaataagcgacggagggagtactatattggattactgtagaagtagatttgattaagatatggaatgaatggtaaagctgatttgaggtgtactgtagtagtaataaacaagagaataagacatctctggccccgagtcaccgtgtcagacagaccaacatctttattttagcttggcgccttttgtctgcccgaaacatgcattgcatatgttggccaatcaaagtgagtaccgaaccgaaccgctcgaaggattgaaacagggagggagggagatggttgcatactacattacataacagatcatcacagcatgagtacaattggagctgccgacagtacacatttcaggagtactaggagagtatagtaatgtaagtaggaagaaagaagcattagtccagaaatcaatccaggtgtctgtcctgtgtgtgtgtaataaccaaagtagtggagtaataattgtgggaaaaagaaaatcagtaacattatattttaatccggaatgaaggaagaagtggtaagatactcatcccctacatacagcacgcgctccatatgacagattttgcatagaggggaaggggaggaatgaatcagtacttagtagccagcagtgaacgcaaatgatataattagagcgtggataggtaggccttggctagcaatttgccgagcttgacctgcgccggggtggtgaggtgcgtgtagttcttggcgatggggaggcccttggcgtcgacgtacttgagaaaaggaagcctgaccgccttctgggcctccctgacgggctcgacgaacttgcctgccccgtcgcgatccccacctggatcaccagcagcttcggcaacgccaggtctcggcggacgtcgcgcaccatgccctccatctttcgggcgtacacctccgcgtnctcccgccggatggggtccgcctccccctggtaccacagcagcgcccccattctgggccctgcacctgcaccggcgggggccatgggcgccctggcgggccccaccatacgctcgtacagctccgtgcccctggtccagttggcgatgggcgtgcctccctgggcgcaagggacgaggcccattaccgtggagggcgggatggcgcggaaaaggcgtgggcaaaggacatcccccggcccacgccgagcacgttgtggacgtcgatgccggcgtggaggggctcccgcgcttcctcccaccggagctcaggggacaacccgaggatgcgaggtgacggggcgcactccgggggcaccacgccgtcccacggcccgttggtggcgccgccgcgaccgcccatgttggactgcccgcccaaaagaaatatcagcgtcggcgtcggcgtcgccgtggccgtggccgtggtggcgagcagcagcagcagcgctagtacctgcagctgtagctgtggcgacgccatgctcactgctcctcacgctcactcactagctaggactaggaggagtacgtaccaatgctgctgctgctaggtgtttgttggatctgctacgctacgctagaaacgcatttaacacagcaaggtggacggacaggacaggtaggcaggcaggcaggccaatataggagtactaccgtatatatggaggagaggagagtgagaggattggctcaataaaaatatacacgctcgttagagcgctccaaatcatcatagttaatgtaatagctaattcatacaatagttgcttactatactcttaatacctggtcctacttgtcatatacacacattacgtctttgagtccgtgctgtagctggctacaaatatatagtccgctgctattctctctcttcttttatctctttaaaatatgtttatagctggtttatagcctactacctccgtcccaaaataagtgtagccatagatatccatgtttagcgctttgaccatccgtcttatttgaaaaattaataaaaaatattaaaaaaaaattagtcacacataaagtactattcatgttttatcatctaataacaataaaaatactaatcataatcttttttcaaataagacgaatggtcaaacgttgaacatgaatagtgctaaaactacacttattttgagacggagggagtactattctacctgctcttagaggaatatttttagggaaaattggttccacgacatcgaaagttcctgagttctgttttataccatcgaaagtttgtggcgtactttaataccatccaaaatttactccgttacttatttcaccatcaccgtcaactttagtggatctgtcgttaaacatgacattgcttgcccttgtctccggtccccgacgcatccagatcaaaagcagcatcttcttcaccaagcatcgccgccagctccatcacatcctcttgccaccgcacctgtcggagctggccagccatccgctgtgtgaggaaggggttggcgcgggagagcacgatgttgaccgacgctgcaattcctggagggggccggcttggaagagcttgaggcaaattgggccaccggcggcgagattacgcggattgatgggatgaatggtgcttgagagttgaaatggtggggaccagctcaccggtagggaagagatcagtagcagggacgtgtagattggcgaatggcggggagaagatagacagaagacagggcgacagcccgtccctgtcggccgtgcagctccggcgcgcgcgctcgtaacccactcgccgtgctccggtgctcgtgcagtcctctattcacaatgttcctccggcctgtgctgcctgctcttgttgctcccgatccccatcgatggagcgatgtgcccatgtcagccaaagaggaaaaaacgagaaaatttgggccagatttagatgagtgaaggaagggcaatacagtcatatcctgtttgtcttccagccaaatattgaaaagaaaaaaaaactgacggaaataaacagttgtggtatagagagttaacggagaaaactttgaatggtattaaagtgcaccacaaattttcgatggtataaagcaaaactcaggaactttcgatggtatggaaccaattttcccatatttttatctcatcatcattcatcctatttctcttctcttcatacgacaatggtccattttcacctactagtacgatacggtcaaagaggccatatttttattacagaaactagtggatggagtcccgtgaattaggatactagtacacctacttaacaataaacaccctagatcccgtagaatgggatacaacttaacaacaaacaccctagatttatttcttattctccatatctgtttctcctctttcttcctctccgactcattctctccgtcgtccactttgctcctcccaactccttcactccaatcaatccctccttcactccaatcaatcccacctccctttgctggaggaccgatcgccatcatccccaacacgatgacatcccacatcctctttccccttccccacaccacatcaatgggcatgtggactctaacgaggttatgtagctgttggaatcggtgaaatcggcaagtagaaaggtaactgcgacagcgaggtcaccatttgtcgtggctggggagggacaagagggaggacgcgaggctgagggagatgaggtcaagggcaccaaggataaaagcaagtcggtcgttctcggtgtgagggcaatctcggagttcatggaggtctcgaggttgttacattgtacttgtcgctagctcgtcatgctgctcctcttcattgtgcataggcaagtcattcttgactggtataaggtgattatcacggctgataccaagtattaggcctggtacgtcagaaaatcacagccgataaccacaagtatcaggcttggtgcccagacacctaggtggtggtactactagtagtagtgtatttcagtaaaatttagttgaccgtaccgtgaatgatggatgttccggcctagctaacctttggatgaccttgctgagtgaaatgtgtttatggcaaggatcggaggagaagaagatggtttgaatccagatggaagagtgatcggggcgggcagaagtggcgacgaccgtgacctccagtccagtccagtatactgtagtccggagcgacggcgaacgagcctggctcgctcctccgatgcacctgggccgtagccctaggataaggagcccacggccatccaacaaactaggcccatcgtactactttccttcctgctatactcgcgcaaaacaaaaccccaaaaaaaaaagaagaaaagaaaagggaagagcagcgcacgacatgggtggatgttgtttcctttctttggtggtttggtttggttgggtcaaacaaactcaaacagacatgccgctagctgcattataaattgactacgagtagagtagtgaggaggagtagatttcaaattatttgtcccaaacccaaccccccaggccccaagcccaacggtagcaagcagcaatgcggcggatgctgctgctgttgctgctgcttccggcggcggcggcggctgtgtccctccctccgtcgaacaaggtggtgttcatcctgggagggcagtcgaacatggcggggcgcgggggcgtggtggggtcccactgggacggcatggttcccccggagtgcgcccccaacccctccatcctccgcctctccccgcagctccgatgggaggaggcccacgagccgctccacaacggcatcgactccaaccgcacctgcggcgtcggtcccgggatgtccttcgctaacgccctccttcgctccggccagttccctgtcatcggcctcgtcccctgcgccgtcggcggcaccaggatggccgactgggccaagggcaccgacctctactccgatctcgtccgccgctccagggtcgccctcgagaccggcggccgcatcggcgctgtcctctggtaccagggggagagcgacaccgtgcgctgggccgacgccaacgagtacgcccgccggatggccatgctcgtccgcaacctgcgcgccgatctcgccatgccacaccttctcctcatccaggtattatcccttattattattctcttctttttctcctatcaatccatatctctccaatccaatacacgctgaccttctatgcaatgcctgccctagatttgttagctttacttgtcacttgggcatgcttgctgttccttcctcttcttctgttgttgctacatctacatctactcttttttccaattagaaaacaaaatgtaataataaaggaaggtggagggtggccatacggaatagagagttgttaatagcgtctgcatcaagatttcagctatactactccaacatacttatattccaagctactatttcctctggtctggtctgttctggtcttctcctaatgtaataacataccatcacattccgtcaggtagacatgccaaaataaattccattgtagtttaaggcattccatcttactttagatttgttggttttcaaagtctgagatgatggtatgcattatatgttgccaacccaccgccacctcagctcaatcatgcatgatatgcacacaatccctatatatatctgtatagaataggcatatatatgtccaaggtctacatgcacaactactgtcatcttactatggaccattgcatattcttctcctcattcaaaccacccaggcaatgcaagacaaaactatttgtggtattcgtcaaatcgcttgtaaattagactcttcgctgctatatcacataatacagtaggcaatccccattcctctgtttggtgtttcaggtaggactagcatcagggcttgggcaatatactgaagtagtaagggaagctcagaaagggatcaaacttcgaaacgtgagatttgttgatgcaaagggtttgccactagaagatggccatctgcaccttagcacccaagcgcaagtccagcttggacatatgttggctcaagcctatttgaactatggtacttccacgctctagtcctctctgtgttgtttttcttttatcagataaatagctaagagactacgcaccttatgttctacttttcttatttagtttcatggaccactcattcttatgattattgaattggcttggtataattaaattttccaatttagcccagtacaacttcatcatattcaatgagtacggatgaccattagtgtgttacacttttcatgatggaaagtgtagtgtcccctttcttgtgtttgtgtttgagaatgatagcatcaaaatgattgtgcatagcaaatcggcaaggacaaatacgaaggaaaataatctaggatgtggagtgaaattgaatgccaaatgaccaatggttctcaagatgttgcaaaacttttactacaactttcaggtctcaacatacagtggagacatgataatatgcagaaagtataaacccgcattaagtctggtacaatttattgtatggtaattcattcagcaccgtatttatttctccattttattttcccctggggtggtagggcatgcacattctcaatcccctatatcatggtggctgcaaattatgttggcatgctgcttcatatttctctgacgggaaccgtgcacatgtatgatcatgccagacagaggagctgaagaagaaactggtaggccttttgcacataatcatataccaacacacacacaacacaagcattttgacgtgatgctgttagaagattcactttgtgtaaagtaaagcagactaaacattcacaaattctttcccagacaggtgatagatcagttccatacactatacacgattttctccctctcattacatatataaaaatcctagtctcagtgtattttgtgctcttcaacattaattgttaccatttggcacgtccaaattaggagttggctcaagtgtacaatgcatcagtgctggttcatgctggtgcgtaactctaacaacattacatgaacagcaaaaactgatacatctgtgaatatatgcactcaatacatagcgagtaagctatatatgctaacatacattgaaattaaagaagcggttgagagagagaaactatatcatgctactttaggtataaaactagtgttttgcttggattgatgtggagctgcatatatttttcggcatagtacccagccactgtaaacttgcgcttgagttaaatatatatactccggccgtattactaatatgagtcaaaagagaacgttcaatctcgagggcatactaagatgcagaaaaaaatattcgattttatatggagaaaaataatatgaattttatgtggatcatacaaaggaagataccaaataataataactggggaccattacaagcacaccaccttgagtagaggaacattttgtccctagtcagttgagtgtcaggatggtaccaaaaaaaaaaaatcctaggaaacgaatgtaatttcaccctcaaagagcgaggcaaatgaattttctctatatattttttgcccttaggcctgattgagacaggccgatccaatttggagttggtatgggaaatttgtgtgggctatagtttgtgccatgtgaaattgggcttagcccagaagtaagtatgagaaagggaaggaggaggggaagaaaaatctgagaaggagccaaatggagagctagtaggtccaaagggtgtggagaggagaggtgtaagaagaaatctctctctttttttgagatgggagggaggaaatctatctctgaatgtgagcgaagcaaaggatttccctagctccatcttcgtcctcgtccacacaaaatgttttcctgtttgttcgtttgtttacctgatgctgctgctgctgcggccatttgcacatctctctctctcgcttctgccactgctggctgtgctgcttccctagctcctcggttggatcaaagagaagagaagagaagagttaatgctgatggcctccgaggcgtggctgtcgccggcttcccgcctcttccaccctccccgctcctccaccgccgccttcttctccgcttccgggctcccccgcctgcctcgccgctcctcctgtgcactcgcaacctccacgcgtgggcggcgcctccgccttggcgccaccgatcagcagcagcagcaaggcaaacaagatggtgatgaggttgtggacagcaacgtgctccagtactgcagcatcgacgggaaggggaagaaggccgagaagaggtcgctgggtgagatggagcaggagttccttcaggctcttcaggccttctactacgaccagaaggccatcatgtccaacgaggagttcgacaacctcaaggaggagctcatgtgggaaggcagcagcgttgtcatgctaagtaagtactactccttccatctcttctgcggatacctatctgttagtatcttctttgcccactaattaacactaatatcttttcaggccctgacgaacaacgcctgctcgaagcctccatggcctatgctgccggcaaccccatcatgtctgacgctgaattcgaccaactcaaactcagattgaaggtcgcttaattcaactaactaattccttccttccatgctactcttactgctactgctactgtactctcactaaaatatttaccagtactagctgctacgtagtttaatttcttttctgactggctgctcttattatattatatgctagaaagacggaagtgacattgtcaccgaaggtcccaggtgcagtctacgcagccgaaaggtaataaaaattactccgatcctcttatactgatacaacactatattctaagcctgcctatgggctttctggagcaacaaaatatggaaacataatcctgtacaacaaattcatgaccaaaaccaccaccattcatacaacaaacctgtcaaaacacacatacaacactcatctccatgcatcttgctcatttaaatttactgacaaattaaaagggcctttttctgactatttatttatttatgctacctggcgcaggtgtacagtgatttgaccgttgactacctaaagatgttcctgctaaatgttccagcaactactcttgctctaggactgtgagttcttttcatctcactcttgcttccttccaatatacctagctagtatgaaataaatattggactgtcagtataccttttactgtccattgtcctggtgggatttgaactggttgcgacgaattcatcctttatcagactttacttatgtttgtcacctctaatttcgatttgcatgcatttaggttcttcttcatcgatgagttgactggctttgagatcaacatattccaggtaaattctttttcctttcttccaattaattattcgactgactatttgacatgtttttccccactcggtaatctttatgaacaaatgcagctgccagagcctttcggtttcattttcacatggtttgctgctttgcctctaatattgttcatagcacagtcgataactaatgccatagtgaacgacttcttaatcctcaaggtattatttttagtctcctctctgcttgtctgcttttttgcattagacattagacatcaaatatgattatttgttcaagtgaagtgatgattattctctgggcaatccaggggccatgtccgaattgtggcgctgaaaacctttccttcttcgggactatcctgtcagtgtctagtggcggtgaaacaaacaaagtgaaatgtgcagagtatgtattatattctcctatacttttatatgtacatattccatcattgttgattgtgtataatatagtactgttcgagttacaaatataatactacaatttgtgtcaatctgaaaatgtgcaactctttgttttgcagttgtagcacggagatggtatatgactcgaaatctcggctcatcacccttccagaaccatcgcaatgaaatgaatggtgaattcttcaaggtacgatgccagatggagagatgcaaacaaggaggtgatcaggtaggaaacaacaaataaaatggaattattgtaacggatgggtgttcacaaattgcatgcagagtgtatatatactacagtaagaaatgtagatcgacttctatactactaactattaagcgctgttgtgtacagtatataaaatgtagtacatacatgtttactgatatctgactcaactgaaatactacacacatatgtgtgttggagatagaaactgttttgtctcttctttgagggaaaggttggtggagctagcatagctaatgttagttctcaaaaaaagaaaaaggaaaaagaagcagcagcatagctatgttcacaaaaagacgaagcaggccggccctgtcagcccaaaaacgtacgcgcgcggcctgtatagatagctatccggcccatcttctttcactccgttttgacttgcaagcagccagaaaatgcgtgtgctctgccttttctttttcaagatcgatcatgcaaatatctctactacctaaaaaaaaaattaaaaaatttatagtggtgatgatgaaaccacgcaccattcaaccttaaaaaaaaaaaaggtacatcgacacgatcagagcgacacgctccaccttcgcaccaccattgcgccgcgcgagatccggaatcaacgcccaaagaagaagaagaagaaaaaaaagaaacagggccttcccacatcgccgcgcccgcgcctacatcgcctcccgccttccgccttcccacctcgccgcgccggcgcccccatcgtcaccgtcgaccgtccgccatcgccgctctcctctctctcgcactcaccccgtcacccgacgccgccctcatcggccttcccctactcgttccactgccgaaaccctagacccgcaccaccctcgccctcgcgaaatcctcctcgccgccatcggtctccatcgccataccaccgtcgcgccgccacgccttgctccgctgatgccgccaaatcaccgtcgcccggctcgtcggtctcctccgcaccgttcccgatctccgccgacaaaacatcgtcggactcctcgccggttccttctcgccaccaccgttcgccgccgccagaccgccgtcgcgctgccacgatctgcggagcccagcctccatggctgggtcggcgccagatcgacaggagccaccggcagctccacttgcgccgtcatcgggaaccgtgaaacgacctccatgggctgcgcctgcgccagattgacgggagccgccgccgcctccacttgcgacgtcgtcgggagccgtcgacgacctcctcccatgggctacgcagccgccgaatcgatgggagccgccggccgctccacatgcatcgtcgccgggagctgtcgaccgacctcctccatgggctgcgcagccgccgaatcgacaggagccgccgaccgctccacntgcatcatcaccgggagccgtcgactgacctccgtcggctgctaacttgccatatttgttcttcagatagcttaatatgtaagatgctaagaaacaactactgttatcatcatcattaattgcataattagttcttttagaagtgcacatctgtttttcattactattataatgtctgtgctgatcgtgtttgtagtactaaccaagcaactcccttgtcccctgaaacgtccatacctttgatgttatcgtttgcattcaatacatatctagctaaagtccttaactggtactctaattacagaatttcctcgtcgtacagggagaagactccgccctccgcgcctcactataatgaactgctctatctgaaattctgagaatgttatatctgaaattctgagaaaatgtgacattgttaaattgctatataatttatgatatactagaatataattagcactatcttctaggtgcttatttctaattgaatactcagtggtagttaataattgttgcattgataaacaagtgcattggacttaagttttgcaagatagtcttgaataagtaaagatgcttacttgtctgtgctggtgaaatcttcatgctagatgagcttgtgtgctttttggaaaaaaaaaactgagtgcaaacgtacaatttattgagatgtaaactttgggtggtttgttgttagcactattaagtattctattgttccactgatgggtgtagctgctaccaagttatctagcacaggggtttttagatgatcaggtccattttttcatgcacagccgtggatctttcactaaggtggtccagtgctcgatctgcttcaggtttagtcctaatcccctgaaggtctcaacgtctgctttcagaacgttggcagcagcgatccgccatgcgtgacctcaccaatcagagacctcttgtgcccatatcctgttgtttccattcgacgtcctcagtaactcctcatctgaatttaaggtaaacaaactattttccatttttcccttgtgtgattcatatgagcagatattttgcacttgttcttcacaatgagaaatgcgcagtgatgattattgatgttcatttttcacactatgagaactcttcttccaaaactgtgcaaactgaaagtactattaaaggaaccaaagataaattcttattacttcattgcatatattgaaggacacaaactctcagtagtctgcaaactgaaaaactgaaagtaatatgctaaaggatgaagtataattttcaaaaccaatccaaaaaaatgcatatgctgaaggacaaaaactctcagtaattcttgcatgaaaaggtattaaaaaagcgtctccacaaacaaaattcatttatcactgccagttaacaagcttatggtcttttaacttactatccataaagttctacatgatgtgttcatgttatcgtcactgctgaattcgggatcctcactgctgaacagagacacagttggaggcttgaagctgctagaaaaccagcgtacatccttgagctgcctaacaagtgagagtcttcctagctcaacaaataggttcatgcttttcatcggagtgcatacaaccacccaccatattttttaatcttgctctgtaggacagggctaatcctggtgataataaggttacggatggcgcccacgtttgctgcctctgtgccaaaacgaaaagatctaaacaatatgtgtgctactcatcacgtggcttatcattcaatttacactttcagatacagaagaggtttctgtttggctgctagcctgctaccttgcttaattagaggatgaggctgcagacagtttcttacaagaggtatgcaacggcgcatctgtatgcataggtttctcggttagaacattcttttttctttcacccaactcgacccaataggtgtaaatatgtatccttctttataacatgttagagggattatcttgtaatctgttcgtcgcctggataagcatattgatatggaggcacgcccgaactcgacctacccagcccccaaccaaatattgataagcatatttcctgcacctcatgtctcattctatcaatgcaaaaataagtagtaaactttctttaatgctctttggaactggtacttccttctggattagccgacatgtaggcagtttgtaccatgttactcatgtgatggagtaaatggaaataagtatttaatattattttgcatttttagtcgaaaaagtttatgtataactgttaattgcctttttgaggtggcaatttaactatgctcattgatttttgcgaattcaataggtttactgttgaaaactactattgcaataatttgtaattgttctgatgaatccatattttcatctattccgaagaacatactttttggtcatccatattttcatccactcgtgccttatttttttgctctatttcaaggagcccatttaatagcttgcagtacaactccactatgaaacgtagtctaaaatataattgtccattttaagttatgatcattcttgcttgatccttttccataatgtatatttattgctgccataaatcgcagtgcctataaagtatttctttatctgtgattgcttggattttattttggtatgtcttgtgtggacaaatatgtgcagcaaagaaatatgcaagaaacgacgtggccatgaggaaggcggtgccttccagtagcctggtgccaaggttgtattttaattggagtaaaaagttgctgagggtgtgtttagttaacgccaaaattagaagtttgattgaaattggaacgatgtgatggagtaaaaagttgctgagggtgtgtttagtccacaccaaaattagaagtttgattgaaattggaacgatgtgatggaaaagttggaagtttgtgtgtgtaagaaaactttgatgtgatggaaaagttgaaagtttgaagaaaaaattgggaactaaaccaagcctgaatctagccggttctggtctcagttttctgttgtaacttaattgcgcctgacattgagtgaaaatctttctgaatccacatatctgaattatattgcatcctatctatttttttctttcaaaatggaaatcatgatattagtgggtcagaagatagctggtgtacatggacctacaagggtgaaatatattctttagaaattatgagtagtagtagtatgagttaaagttgatgattttatttcccgttgcaacgcacgggcatctaactagtaccataataaataaatctgattccaaccaccgatacgattcgatggatgccaaattaggttggtggatatgtgcactcctgatcatctcgccagtcgtcattatcgaatatatgtatatatatccggccggtcgatcgaaatgaaacaggcactcgtgagtttgctggttcggatgcaccgcacgcatcacatctctctctctctctctctctctctctctatatatatatatatatatatatatatatatatatatatatatatatatatatatatatatatatatatatatatatatatatgncactcatatgggacaccatggtgcccgggcaccatggtatcaaatgcacaaaatcactcaattttttttttaaattttcaaattatgagcatatacctagttataagaattcgatttatacctacacctatcaacaaaacaactcaaattatatcttaactaattaaaagattcctatttttccaatcatcacctccttttcacccgtgatttttgttcaaaaataccatccgtttcgtctgtcgtccctcataggagtcgagtccgattccctcaaaaaaaaaaaatcccccatcttgatccccaaataaatcaaacaatgagacaaccaaaaacactcataggattcgagtccgattctttaaaaaaaaaatcccccatcttgatccccaaatgaatcaaacaatgagacaaccaaaaacaacataaaagagcaattttaatccgagtaaagctcatgaacttgatcccaatgtccaattcacgaaaaagaaacaaattcgggcgaaaaaaaaggcgaccggatccaccctcggccgccgccaccgccgccggatccacctacggccatcactgacgccaccaccaccgactgctgccgaatcgccctcggctgccgccatcgccgccggatccactcgccgctgccaccgctgccgccggatccacccaacgccaccaccgccaccgaaggcagaagagaggccgcggccgtcaccgacgccaccaccaccgactgccgccggatccgccctcggccgccgccaccgccaccgccggatccacccatcggaagtagtggagggagccgccgtggctgctcacggtggggaaggccgcggccgccgctagcggccagagagaggacaagatccagtcactggtggaggatccgcgcaagaggggaggatccacgcaagaggggatcaagggagatgacgggatgcgtgtgggaggggaggaagtcgtcgcttcgctccccgcccacctgcctcggtcgcccgtcttccgcctcgctttgctccaaccgtggctctcccgccggctgccacaccgctgcgttgcagtcttacagagagggagaacagaaacgacggctgggagagaaagaacgagagagtgacacagggtgagaggataatgatctccatccaggccaccgcccaccacacaattctcgcctcaagaaacctgcacgtggcatatgactcctagcagtttttcataagagataatccattatatgccactgactttgtcacacgtctacgatttaccatcgactttgtcacgttctacaatataccattgacttttgcttaacctctacgatttaccatcaccgtccggttagcctccgttagtacagtacaattttgtccaaatgaccgaaatacccctagaacaaaaacttccaaaatttggataaaaaaattcaaaatatcatattataaacataagagtgtaaacatccaaaatttggccaaaaacttaaaatcttatatttcagaaattttatcccaattttaaaagttttgtcctacgggtattttggtcgttttgataaatttgtacattactaacggggactaaccggacggcgatggtaaattgtagaagttaagcaaaagtcgatggcacattataaaacgtgataaagtcagtggcaaatcatagacgtatgacaaagtcagtggtatataatggattctctcttttcatatttactcctaatagtatattttatcatatacttcagtaaatacaaaatatttctaaaaatacccccagattagtactcacacattgatatccaggaccttggcagttttaattttacaagactggactgatgtacaaactaccttttatagctctgcgtattgagctggccatagaagtcattaacctcaaaaaatatatatgtgtgttatatattttgtgattaacaaattttgtatatctacatctatataccaataaaaaaaatacataaggcttcaaggtatttttttgaccgtcctttttttacgattttttccatcgtttttttcgcttaagtcgtttattttatttttgcatgcggaacggtgtgcgcaaccttagcgtgtatgcgcgtcgatctaggttgaagacggcagcctcggataggattgggagtatcagcactcttattggcaatctatgcgagttgagcctgcagttccacttgtgggctgcaggccgagcggaggaaggtaacggactaggcggggctgaaaagaaatgatgtaatgggctttcgaattaaaaacaaagaagatgtaaaatttatcgcaatcaattttacccagtgcaatgcacgtgcattttactacaaaagttttaatttggatcacatgttaagctatgcttttact

SEQ ID NO: 11147 - DNA, 7965 bp, Oryza sativa
gttaggggacgtaaattagattttatttacgggctgagacagtaaaaggactgaaaatggcccatagagaaattgtggtttttatttacatttttatttaaataaatgctaaaatgatgtttgtgttatcaaattaagattcgaaaattccaattaaaattcaaagagcgttattaatcatgattatttcaataaaaataaaatccaaccatataatattatttcacggcctgcggtggataaatgcgcagctgctgtcggtgggagagaaggagcattgtttatgtccagaactatctcctatagctccgatggaactataaaataactataatcattattttaacattagtttttttccctgttgcaacgcactattgaataatattttgagaacggttagtttttttattggacaaatatttttacttttaatacaccgtaacgaagcacgggatgtatgtgtgtgtatatatatttatatatataagattagtatttttccaatcgtcacctctccgtgtgctgttttttcgtgcgttaaaatgtccgattccagaaaaaaaatcagtatctttccaatccaacaccaaaaattttggtccgtaagtccaaccgagcgccccctaatagcgtacggtgggcaaatcacaaatcaaagatcaattaaaaaccgaatcacagcatataccatccagtctgtatcaaatctatccccattacaaccaaatcggatacaccacaacacaagcaagaacaagaaccaaagctaaaaaaaattggacaaaagttgaagcataaacgcatgaacaaatccaaatatccctttacataacccaattttgggcttaccccaaatcccaaaccgatccaagccctccaaatcaaccatcccatcattcccttacccaagaaattcacatgtgtagtccagctcgaatcaatcaagatgcggcagtggctggattagtgaagcgaagagctggatccaatcgaatcagaccaccccaatcaaagaaatctttgcttcacctcacccgctcctctacctaactggagatgaaaaaaaaaatcctcaaggtgctcctctaccgccttgtcgccgatggcagcgacctttatctccatggccgacggtgcggtggagataaccagcacatcggcttggtgcgacgaccaccttccgcctcggcacggcggctctccagccaagcgtgagcgcgaccgcgagcgtggccaggggcggtggagtcgactgtggaggcgtggccaggggcggtgggtgaggagggcagcgagaaagcgaggaaaagagggattgtggagaaagcgaggaagaggcaagaagtggctccatcggtggccttatccactcgggttcgttggttgtgggaatttttggccgtttttttgacaaattgacccttttggaaaacttatttcgaaactaacccctgccaaaaacttcaaccaaaaataggccgtcgcctcagcgccaaacacattggcgctgacgttggccgtgtcagcgccaacgggactggcgctgacattgtgccaccgtggcggccgggccgatccccagctgacgtggcagctacctcagcgccaaccggactggcgctgaggtgggacttggccgcaacccccaaggcccagaccagcaaggcttctggatggcttgcgggcttggacctcagcgccagccataatggcgctgaccgtgggacactcagcgccagcccacctggcgctgagggtgggacttggccgcaacccccaaggcccagaccagcaagccttctggatggattgcgggctgggacctcagcgccagccataatggcgctgaccgggggacactcagcgccggtccacctggggctgaggttgtatttgagcgtttaggccgtggcgcagcgcaacaagccttatggatggctgggctgggacctcagcgccaggtgcactggcggtgagtttggacatgtcagagccatttagcatggaggtaacgtcccagccctgctaaactttagcaaaactttgcacacaacacaggcaaacatcaaatcacagaaatttacaggcagtaatatatccagagaaccatacaaaacatacatccatccatcaatcccaacatcattccatacatccatagaatccatcaatacatccatatatgaagtccatatatataagaaataaaaacatcccatcgatcctcgtctatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctttgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtacttgttctgctcctcaacatcctcggggtcatccgctatgtcggctagtgtccaagccggacgtaggacaagacggtaggtcctgtggagccacgccaagtacaagtcgaactccgtcctgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaataggtagtaaatgttggagtgactgattgggcaagcaaaataaatggttaagtgaaatactaacctgggtaagtcgatacttgtggaaaaacggtgcgggattgtttgaagcctcccgaattgccgcatccgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgttgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccgatcgtcgaacagtatgtgcgccgtgtgacctctgactcgaagggtcttcaagtgctgcatcaatagacaaacataataacataaagttagcgacaatatatcatatacaagggttgtggaaaatacatcatgcaactaggaactttaattttgggattgagcaagaaaactgaaaagaagatctgtgtgtttacatgctctgctttgaggctcctgaactttgatttgagatatctctatgatggatgatctatctgtacaaactaaaatcaaagaagaaaaaataaattcgatcataaaaaaaatggaatattgttgatgctaacctctccgctggcaatctgtggggcccggtgcttctcctcgtagaaatcctctaaccccggaaagtgctccatcctgcaaatgaaaatggaatcattagtaattgaaaaaatattaaatggaaaaatcacaatgagaacggaaaggaggacaacagaaagtaaacattgaagcaacaatatgaacttagcaaatgaatgtcatccaatcccacctgtgtgctaccctcaccacctccccctgtcgtacggcgctttttcggtcgatccttagacttgtctcgcttcgggcacctagttttcttatggcctagttcgtggcatagcgagcatctattttgcatgaccggctctgaatttgtattgttcggcttttgtgaccgtcggttggctgagcctttgtatgctttgtccatatcgttcttgaaccttcttgtccttcttcttcctcgtgtgttgttctttaacgacaagtcgggcacgaagaactctccatcataacttggccactgcgatggatctaggtaaggttcaaacctaggggagtacgagtcctgcacagccttattggaagcttcataacacattcggggggccacctccacatccaaacctcgcaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatacttcatcgaagggaaatcaaaacatgctgctctttgccccaaggttcgtctttgctgctcctccaaaatgtccttaacttttgtgggccacttctttccacacaggatatctacagttgcctctttgtgtctatcgacaaaccaactattgcactttgaaaatgtgtatgccacaatagctgtaaccggcagtttccgaatgcctctcaatacattattgaaactctcggccatattactagtcatgatgctatgacgacgcccgttggtatcaaatgctcttgcccatttgactttaagtggcatatggtcttctagccacttctttggcctctctccgaccacacccatgaggcgttttatctcatctaggaacaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctaccagagcaaacgccaagggaacaagatgtaacccggcgtcgacccctattggcgtgagcaatgtaccctggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaatacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgctcaactgcctcgacaatcgctgctggagataaagttggttcagctcgcacaaatgcctgtaacctgtttccaataaaccttgaagtaagttgcaaatgcttgccggttacttccgcactacagcatgtgtggtcttcgcccaccctagtcacccgccacctatctccttcactcttccttgcattaatctgccatttgcaatggcgatcgagacaagccacagtatactttactgacgcgttagattccttcacatggtacggccggtggacacggatagaataactctgtagccatattttcagatcatccatcgatcgaaactccaaccccttccttggttcatcacacattggttcgaaggcaccgtcatattgtgtatccccatcagcaattgctagcccagatctggtaagatcctcgaattgtgttatttccgggtttctacccaccagtttcgcaaacacagtcctttcatgctctgacatcttacgcactggacgatcatcataggagtcgaaagcggactcatccaattcatcctctgtatcatactccaaccaggctgggttcaatccactgcgtatcatagcctcctcacactcctctggggtatagaatttcagcctagccaactcccttaggcccatacttacattcttagcattcgcttcttcctcaggtaactccacatcatctcctacctcccgaccatcctcaacatctccttcctctcttaccggcacattctcctccacattagcttcctcccttaacggcacattgtcctctgcatgtacttcttcccttaacggcacattctcctctgcatgtacttcctcccttaccgggtcattctcttccctgacctccacatccgccatatcatttactccctcgccccctccacgtcttcctcaatcaattcttccttcctactacacctctccgacagttcgtgacagctaatgggtgattctatgagttgactttcattaaggtctataagttctttcttccctatcctaccatctttcttccatgcaaacacctcaagagatttgaaatgtgaccccaatactatatctatatatgtttgccattcgatctctccattcaagtctaacataaatttatgtgacatgacaccgccgcccacatcgtatctcccttgcataccaaccgactcatcattacaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccacccatattatccatctaataatccatccttagccaactattatcaaaccacgtctacaaccaaaacaatgcaaaatatccaataaaactttggggaacttagggtttatagaggggtttaccttctcttccgattccaaactcaatgccgcacaaatcaccttcgattagagaggtttttgggggagattgggcgaggagaacgcggtggcgaccgaaccctaagtgggcggctggggaaaaaacggaggaagaactggctgggg

SEQ ID NO: 11148 - DNA, 16538 bp, Oryza sativa
  unsure (1)..(16538): unsure at all n locations
ctatttctatctctactacttaaaaaattaaaaatgtttccgtcgtccgtaatagcgaaatcagggtgaaaaaaacatgaaaaaaagaaagtccgattcaatctatctatatacctatttctaataattaaaaaatttgtaaagcttccgggttagagttttcgtccgttgtcaaatttggacctaaatactagagaaaacactactacaataacacaatatcagattcaagaacactaagaaaacacgccagaatgggagggtgtctccgttgctgccggctgctcccctcccactggatccggtggagggggccgccgggccgccaccgccttcccttctagatccgacggagtggagggtgctgcccgccaccgtcgaaccctcatgcggccccatggcgagggagaggaggtgagggcggagaggaaccactgcccgcggaaggagagccgtcgtcgcagggacgtcgggctgccgccgcctccccttccgctagatccgacggaggggaaggcgccgcccctgcctgccgcctccagaagggaagtgggggagatagagcggtgccgccggtgggatgagaggaagggggagcgtgccgcctgtgtgggggaggggaggggggagaggttcctccgatggggttgggaaaggaggaatgatggaaggagagaggcgttccccccaccattggttttagagagagaggggggagggaaaatgattttatggttagggtttgggcagttgaacttttatataagtcgggatcaatcaggatcgtccatcagatcggacggctccaacatctcccgcgtcgggccgaacgccattcccaggccgccaatatggaataagttcactttaggtcccttaagttgtccctgattttgttcccaggccacccacacttttgggccgcctcatggaccgcgtgtatgctccgtatggaataagttcactttaggtcccttcagttgaaccttttttatttcattatgaatatattttcttaaagagctcatatcatgtaaagctaaaccttaatcatataatatttttatatttgttataatatcagtttactcgttgcaatgcacggacattttttctatgtcaaaaaaaagaccacgacgtacaagtgaccacacgcacccgcaggctcatgtttaaacgagatggccaacagattttcaattacaggtctaattgttttatttaggcgattaaattttttttcatttacaaaattagtttgctctatttaagctttttgaaaattgctaaaatttgagaataacttttcctacttcatattaaattatttttagctaatggaattaacggaaaattaattatatatttttatcctttttccaaatgtcactgcaatttcatttcattattattattatgattacgattcctttatcatttttgtccaacactatacatgattaaaattatcttcactcgttgcaacgcacgggcatcatttttatcactgtacatataaccgatgctaataatcatactatggtgttttggtaaatcattaatatcaaacttcaaacaccccgctaatacccggtgtaacgcacgggcattttgctagtatatatatatgtatgtatgttcctaattaagcttcactataaagaagactactgcttcttactccctctgtcgcataatataacatccctccagaatcccttatattttagaatgtagggagtataataattgtatttctactttttaaattttctcctaaaataattgtatttgtaataagataaaacctactccctccgtcccaaaatataagcatttagccaaaaattgttatattctgggaaggacggaggtagtacccaattagaaatatcctaccttctaccccctcctatatttccatctccatttgtctcaatatttactttattctatatttttaggattattatggtaatttgtttgtacagctaatatgtctcttttttagaaatataaatattttgagccggaggtagtcttggctagctactaagttgaattcttggcacatactcctatctatctatctatctatctatctatccatccatctcgatcatgcatccgtcgcttgcaagcacgcgtgcacggcctccttgcattgcaccccaactatatataactctcaatgccaagcatatactatatatactacgtatattggagggccgggcggaaaacgaactaggatgcactaaatttaatttctttataatttgctatataattgttatatataactaatataacaaattaaaattgaaagcatatatacatgcatgtcgaccgtagtaaaaatatagactgaatgaattactaattagttttcttttgctcaagtacaattatgtactgtatatcagttttttttactactcagacatgattaaattaatttggcacacgtaatatatactagctagagaagagactgaaataatttggataatcatcatctaactaaccaaagaatataattaatggacagcagcggccgggtagggatcggaataaattaaagatgagtacatgcatgcgagatcgatcgggatcaacatcagcttcatgtaattgacttggacagcagctggttgttggtacgttagccagcagctagctgaggtcgttaaacatgatagatacatacaccatggacatatatgtgctagctcgatcgtggtcgggaatcgatcgatcggtcatgtatgttaatttgacactggctaatttcgatccctatatgcacgcacgcatgcaattttttttcttcaactaatatatgcatgaaacaatgctagctagctgttaagtacgtttctcctaattatatattcttggacagtaggaaaaaaatgttatacgcatggacacatgccattttagccggctgtagaaatcactatgagagaaaaggttttcgtatgcgaacaaaacaggttttcgcacacggtcggccatacattgtttgcgaattaagacatacaaaaatcgggtatttctagaggatggtttcggttgcctgtagaaatcaatttccccacttggctcatgggggggggggcatacaattgccctttgtctgcccattgccacatcaattttcatagaacaatccacaaatcaaagagaaaatgggaagaacgtttcatcagatttgcaaatcaagctactccaaaatattttgtatttacaaatccaacaaaaattcacaagaaaaagaagaagcaacaactacaatcaagcgaccgcgatggactagatccaggagccttgccgtcgccgttgcgcactatcgaggccatcgtcgttgtcgtcgtctaggtcatcattctccactgcgctgccgccatttgctcctcttcccttgtcactgccggccgcagctacaatcgtcctcctcccctctagctagatctggtagagggagagctagtctgggaaagggaggggagtggagtggaatgaaggagccctttgaagcccctgttgccgccgccatcacccctttgctaccgccgacctcctccctttcgaccagatttgggagagtgaggggagtggataggcccgaccgaagccccagcagttgccgctgacctcatcccatccggccagatctaggagagggaagggagataggggagtggaggaggccggccgaaaccgtagctgccacaccttccgctgccagccgccgtctccgccaccctttccaccgtcgggctccttccctctagccatatgtgacagaggagatgggaggggagtagacaagcacaaacgatatatatgatatttatatgatatttttaaataacttttatatagaaagattttattctatttaataatttgaatgtgctaacgaaaaccaggataaaatcataataacatgcctatatatatccgaccgattgaagcaagtgtgtgaagacgcgcctactgattcattcttcaattagtggaagtagcatccgtgtttcgaattattgcatatatatatacccacccagtacgttcctaccaaagtctaacttacttttcaaagcaataacctagctaattgatgcatgcccatcatgtatgcatcttaattctgtttgagctcagcggtcaaactcaaacaagtacaacctacacgctagtttatcaactcatagaacctttgtaattaacacaacacatgcatataaacactaagatatatccaaaaaatggcaaatcatcaatttatcttgtccctatcgacatatatagctctaaattatttcgagaatagatgcatctctacacatatgcatcattgttccttgaatgcatgagaaatggttggggatcagtgggagcaaggaggggtgattagaagtaagattggtaaaaaaatagacgcggtgattggtggaagcagacagtagtagctatatcataaacattaagagtagtgaagtacacgtacggttcttaaacttgtatacggatgtgtcatctagatccctaataaactctcgaaatatatttttgggttctcaaacttgtcataagtgtcatatatgtccaaacgggctccaacccgctttgtgagatgacgtggcatgtcacagtgacgctcgtgttagtgggatccatatgccagccatatagaaaaaaaaataaaatttataaagagaagagaaagggattttttttattttttttaaaaaaataaaaaaatagaggagaaaaatatgttcttgattttttctatatgtgactgatatatgggttctactgacgtacgcgccaccatggcataccacgtcagcacatggagcgggttgaagcctgtttggatatatatgacactcgagacaagttgagggacccaaaaatacattttgagagttcagaggcctaggtgaaacacccgtagggattagccttctcagcgaggtcaaccgaacagcgcatggttgataaccagaggagacgtggtgctgtgattgcaaggttcggatcgtgttgatcgaaaacgggatcgtatgtgtcaagtttctatcaaattgagagttatcaatatctattgaaagatcaggacctagtttttaggtccatactataaaacgtgagtcctagctatagcaatagaagtcggactccctccatccgtacctaagctagaagatcacacgatttggtgccaccatcctgttcgccatttctcttgtgctagagtcggcgagaatgatttccgactcgtggagagtgagaatgacggagaagggaatacatattttaaagtaggaagagaaggggtactattagagcctaatatttacttactgggactgtctacacatctgttgacagaaaatcccacctcctatctttcaaattttggaccattggatatgcttcaagattcatgcagacccttaaccctaactcctctcctcctcccccatccagattgcgccgccaccgctactcccgtctctcgcgtgcgatcccccgccgccaccggcccaccgagccgccgggcgccttgccggctggccggagggcgtcaacggcaccggcgaggcccccgcgggcacgctgctgcggctgcggctgcgcgctccttcctgcgtgagccgtgtggcgggagatgccctctccaccaacggctggcgcagcgcattctgcagccccgcgggttcgacgcctcgccgcccatcgccgggctgccgcctcacccagtcatccctttaagcccggcgaactcccccttcttccccctccccctcccacccttcccaccccaccccactccaggaccctaattcgtcggctcttcgccggagtttgggttgtcgccggcgccgaagaagaagaggagttcgtcggagttggagaagaagcagctggagtacgaatcgtgaagcacatccagtgaaccaaaatttgcaagatttggaggtaggttttttgtcaactgaagtgtagcaattccgttacttaaaagcttaaaactttggtattggaaggggggggggggaaactgttggtcatgatcttaattacttttgactattagtacgtaccgtacgttatagctagagagagatatatgggccgggtcaggcaaacaaaataaaaggagtgttcgatccacgcgtgcaggtttgagaaaggattgatggatggaggccggccgggcagctatctgctgcatgggtgcacatactgataaatttagattagattacaatagtatttgattagattgcattcgcggggcgggggcggccgggagggaccacagatatatgtgcatggcctggtgtggacaatgcaaagctgatgggcatttgttcgatatagctagtataaaactaactgatatcgattaggttttgtggtccttaatttgctgtatatatgcatgcatgtccaaatccatctactcgatcgtcgatcagatcagatttccccaccaaacctcaccacgcatggatgcatgcaggaccgatccttccgtccatccattgagcaaattaagctaccttagcgatttaaccttattggaagttggaaaaaaataatctaaaacgtgttttcctagaacctgatttcacccaagctgccaagcaatgatcgcttagggagtgtttgaggagaaggggattgaggagattgggaagatacgcaaaacgaggtgagccattagctcatgattaattgagtattaactattttaaattctaaaaatggattaatatgattttttaaagcaacttttctattgaaattttttgcaaaaaacgcaccgtttagtagtttgaaaagcgtgcgcgcggaaaacgagaaccaatctcccctatcacccctaaacgaacgatgccttagaagtttttacagttctattctttgctatccagctgagtgacgaaaaacaaaactaaattaggttgtactcgtacgattcggctgcaagaaagaagcgtgcatgcataggtgcatggtacacttgacaagagaatatctgacagcactactgtatagtagcatgaaacacaggttgcagggtggagtgtgattggtacgtgtggctgcaggttattcttgctggatggctgatgtggcatccacagtagtacagtacaaattaataaggaattcaataacgtactcccctctgtcccatgaaaagtacattttttttcagtttttgatactctttgtttttatttaattatttatgattaatatttttattgttattactcccttcatcccaaaataagtgcagttttagcactgttcatgtccaacgtttgaccgttcgtcttatttgaaaaaagattatgattagtatttttattgttattagatgataaaacatgaattgtactttatgtgtgactaatttttttaatatttttcataaatttttcaaataagacggatggtcaaaacgctgagcatgcatatggctgcacttattttggaacggaggtagtagatgataaaacataaataatactttatgtataatttatttttaaaatttttttataagatggatggtcaaatgttgaacatataaactcaaaaatatgtttttttatgggggagggagggaatatatgcaaaggaacacaccctgtactattaatttcagtaagaatttgtgtacagtagtactcctatatgcaaaggaacgtgtcacgcgtgtgtatagtactagtagtacgtagaaccactgagtaccggtgattgtagcagtacagtacgtacagtagatggacagtacatgggtgacgtttgtgggcagactgatcgacaatcgacaaaataaagcaggcggcgcggcggctagcggcaccaaggaatcgcccacagttccagttggcctgccttctctcttgatccttcctgcagctggctgccctccctatactatgcccaagtcgcgacaaactatgattagctgttccaatgcttgagaaactttgagaggctataacataatggatccacatatgagtaactcgtaaaaagataatgttgtgttagttaatagactctctttacaatgctcgctactcgatcattattactaccaatactgaaggatatatatatatatatatatatatatatatatatatatatatatatatataataacttataacgaaggacgtaaaatgagtctatcttctatgatattatactagtacatgtgtgtgcattatgcacatgtaagtatatgttggctagttgtgcaaaacatcttagtgacggatatgtaaacacgctaattaagaaagtagtcaactactatcatggagaagatttgcatttgataagtgggaagctgatcgaagaaggatcttggcatgaaaagacgaagctatcctaacataggatggaacaaattaactgaatgttgtaatgcaaatggttatttgggatagtaatggcgggtcatatgagctgcctatagatcactagaggtctgttcatatgctctagaagctgaacttatggccacaaatgaggatggaagtgtgtcttcaatggtcaatctttccgggtgatactagaactgtctagctatatgcaataattcacgtgatgataaatgacaaaatggacaaaagatgaagctgtcctaaccaaggatgcaccaaaatgaatgctgatggatataatgcaagtggttcaattggaaccagctttaaagaaaaccaaaattttaagattagaaagccctactgggcatatgttggttatgctctaaggttcatgaatgatgaaatccttttccccaaaaaaaagaacaaacaaccctatcgtttcacttatgctaatgcctatatgccaaaatttaatttcaaaacttacttttttagtttttttcatcataatttattctaccgcatttgcttttaaatcgctaaggatacacacacataaaagttttactcgtgactttttttttggttgttaacaagtagtactaatggataagtataagtacaaggaaaacgatggggctgaaagtctgtttcgaggagtattgtggtaaacgtactctgttggtggagaagaggataattagtaattaactgagagtttagttgagtggagagattaagagcatgcagaggttgaatatatacatggagagaagcgcattggattgaaatccaacgaacgcgatcagatgattgagatttgcctaagaaatagccaagccgttgtgtctaagtggagtgtttctaggtacttgttgtttttctttttttttttagagaaaatgtcgttgttatactagtaggtcgataggcgacagcaagcggcctcgatcaatatatatcgattgattttcatcactctgatcgacccgaccctgatctgatagctaggaaacgatctgatgtaagtactgtagtatagctgaaatgccgatcgatcgtttcctagctagctactccctccgtcctaaaatgattcatagctaaaaatgcttacattttgggacggaggtagcagcatacatgtagcatggcatatgcatagtgtagtatatacgactagtcatgtatactgatcatcttaaaatggtgatactatatctaatccggccatgccgatgcccatcccttcccatgttcttttctaattgcattgtattttctttcgtttcataattcttgacattttagataaatttaaagttaaacttttataaatttaatggttaacagctttaaaatatttaattttttttaaaaaatactaaaataatatatatatttttcttataaattagtataataataaaaatatattttagagaccatgtaattatccaagacattactagctagctaagcatcttgatcggcatcttaatatttgctctatatatgtattcatatcccttcattccagaatataagtatttttagagatggtccggttattaagaaagttggtaagattaaatggtaggataagtgaaggtaggtgggaaaattgaatggtagaggattttgattagttgagaagaagttgttatattttggaataaattttaaaggctagaagttgttatattttaggacagagggagtagtattaattatatttgcttaattaatttacttttgatgctagtatattataatcaatcccttgaagttgatatctgatatttctttcagtactagtattaagctgagctgatcgatctctcccggccagatctctatccgtaaccactgaggcgcaagcatgaaaagctagctatagagattggtcagtaacgtacagtagcacacacagtgcagcagagagaattgcattagcattagcattaattagcgttagcacgtgatgcaatggagctataggtagctggaggagactagtcaccagtttgttttgtacgtcctgctgccgccgtcgtctgatctacagtactacataataaatactatctgtagagtatatacgtacagtatgtacctatgtcctttgcctgtctgaaaggagaagcatcgagcatacatacagtatatataggtcagcagctagccagccattttctttttttttttgaacggaaagcagcactagagtgccttttcattgaatagagcaagagaaaatacaaacccctagacgtaaaaggaaaacggagaaccactatagctgtacactatacagagtgcgggattattaactcacgcagccgcttagctcctgctaaagcccaaaggctcgcctcctctttgattttcattagtaggaagttcgttgccacctctttgtgatcaaaaatccgccgattcctctctttccaaatttcctagacgactaacagaatgagcgatcgaagtccttttttcgggacactaggcgtgtttgcaatgttctcccaccacttgttgactgactgggctttctcccattccgttgggtccatctgctgatagcccacccatgcagagatgaggtgccagatcctcttggtgtatctacaagtggcaacgaggtgcaatgccgtctcagtctcgcggcggcaaagagcgcaacaaccattgttctgccatcccctggtcgcaagccggtctgaagtccagactctgttctgaatgatgagccaagcatgaaatttgcatttccccggcgcccaggctttccaaatcaaggaattgaagtttgtactcggcgtcccgcagcactgcacatggtaagccgaggaggccgtgtaatgcccgttgtttgtgaacttccaaataatctgatccggttctccaacgtctaagtgcacatttcggaccgcttcccacagtgcgactagctgttcgacgaggtcgactgtgatagatgattgtgaatcaagcttcaaatcttgcacccaggcgtcctcctcctttccttgccgaagggattttcctctgttttttgagatcgcatagacaagcggcatgaggtctttgggtcttcgcccaccaatccacgcggactcccaagatcgcaccgtgtttccgtcccatattgttatgtttgttgaggcggcgaagaggttcctatctacttcatcacatggcgtcacccgccccacccaaggtttagccagccattttcttttgagaagtagaaattgaagcaaccattgatagatcgatgttactagtaatcgattcatatgtctctctttctttgtttgtttgtttgtgtaggtagctatagtatataggtaaaaagctgagggacgaacggacgggcaggggaaacgacaaaagagaaaccaaacacaacaacacatttacacatgcatgcatcattcatatcgtccttgagcttcctgcatatcgtccgatcgatccccatatcccatggattgatcgagtgacagcaacaactggagtaattaattactcctacagcaagaagaaatcaatatattttcaacatatgtattacatctatatataatataatatcgtacgaccaacaatagtcgacatgcatgtatatatagatcatagatgggtacgtgcaaaccaaatgatatatggaattaaaacaggccggccgggatagattagatagatagatctaattaagcaaagcatgcatgtaggagtagctaggaactgaaataatcgccagatatatatctaagccggaactagtaattaattaattaattaatggatgatcgatcgatgctaatggtatagtagtgtaagatggatggatggatggataataggagtatatagctaggactaggagctaggagtatattgttggttgcaggtgacgatgatgattaagccagtcggagaaggcctgaagcgtgcgcatgtcggccctgtagtggcgctgcgtgaagtccagcagcgcccgccacgtgaagtccgggtacaccctcgggtggtggtcgtcgaccagctcctccggcgggcgcaccaccgtgtccatctccgggcagaggaagaaggccagcgagcggcgaggcgccgtgctgttgacgaccgcccggtgcaggcagctgcggtacctggcgttggagagcgccatgaaggtgtcgccgacgttgacgacgagcgccccggggcgagggcggatggagcgccaccgcccctccgcccacacctccaggccgccgacgtggtcctggtggaggatggtgagcgaggtggggtcgcagtgcggaccggtgcccagcgtgtcgagtggcctctggcacgccgggtagtagttgaggcgcatgatggagtcgttgcgctggaagaatcgccggaagtagtggcgccggtctccgacgatgcccaggctctccccgagcacctccatcagctccagcgacagggggctcatctcgtggcagtagcgcgagtacacctcgcccagccgccgcccgtgctccgccccgagcttccgcaccaggtactcacccacgccctcctcgcccttttcatctccagccgatgagtaccggaacgacagcgtctccttccacggcagcttggacgcgaagcgccccgtgaagctgctggcgtagccgcagctctcccccgcgcgccgctgcgcccgctgcttctcccccagcggcagcgtgaagaaggcgtccatgcaccggtgcgcctcctccagcagcgccgcctcgatgccgtggttaaccaccaggaagaagccgtgcctctcgcacgcctcccccacctgccggaccaccgacgacctctccgcccccgcccccacgtcgatcagcgccacctccagctcctccaccgccaccgacccggggctctcctccgccggccatatgaactgcgacgggatctccgtctgcccgctcagcaccgccgcgtcgaacaccacctcctgctcctgctgcaccaccatgctcattaattgttgataatctagctatcaatcaattaattaaccgatggagatatgatagatgcaacctacaactaactaataactgtatttaactaactagcataagtatatcatccattagtagctagctccgagctaactaagtactcatccccagcagctggatcgaccgaccgcggctagctagctgctgctctctctcactccccttcccgcccttatatacacgctgcgccaacagatcgatcgatcgatcacggcatcaacctcgctctctcccctagctaccttcttaactctctctctctctctatcccggcatcaattaaaattacttatctcttcttttccatgagagagaaagatatcaagagcgagtgaatgtgaaagggatggtgccacaacccggtatttgcttagcccactctgctctttgtacccagccaacggaccacacggccgcggccacatgcggcttaccctagctatagggtcttggatctgtagtgtttattcttttttttaaaaaaaaaaatcgttctagtcgaaagtccttacttgcctgcctgcaaaaatcagttttgcaagcagcctcctcaacagatccatatgtgaaaatgggttttcacgtgcacctgtgatgcccacacgtcaaaataccacatccaaaaatgagttttggccatttgcgaaaattatttatgtagttctgagtttttcacttgggccaattttatcttggacatgcaagggttatctaaatgcaagtttttttttctttggctggcgttgcanaagtgttgttgtactgcgacatgacgctatgtcgagatttagacaaccacttcacatgtttgatttttaaaacgtgaaattcacgtttatgcaatttactcaagtagaaactacaaaacaccccagcgcctgtgccaccaccagattgatgactggacaaacaactccgcaataaggtcatgttactctagagagacctagaaattattgcgcgttcacaaaaacctagaaattattactacattaataagaaaaacagaaagatttacattcctagattgtggttggtctagattataaattaatagatatagttgtatataaattataacaggctaatagaaataagagagttgtttatatttaattcaagaattatatattttaaatccagcttcacacaaatttgcgaaaaaaatggattgagggttggcttcgaataggatctatataattgaccataaactgaggtagtctaatatgaaaagagttttgatagggtgaaaatatataaaagcatggcctttgagaggccatacacaagctgagaactgtcatattaataagagagaatctcttatatgctactagaaattgaccagttcccttacacgccaattaaaattggcttctcccttatatatcactggttaagtttttctacccttttatgccatcctcagcactgcagcattagttgactgttagtcgcatgttagtttttttcgtaaatgaccaatatgccctctcaactaaaaaaatgtgtaaacttcaaaaaatcataactattttattttaaatccgttttgagtgaacaaaattttgtccaaaccaatgaataatgctctttgtattaaaaatattgttggaaactgtatgtttcatgcttatattgaaaatttatttgtgatggtgatggctaaaattgcatataatgcaaaaaagaatcaattttcatatgttgtatccagtagctatattagtattaaaatacctatcattggttgtataccaactctcaagggcaaatgcgtctttttactatgaagttaacggtcaactgacggtggagtgacggcaatggcataaaagggataacaaacttgaactggtggcatagaagagagaagccaatttgaagtggcatataagggaaccggttaatttagagtggtatataagggattctctctattaataatttggccttctatctctagagaatattattcttttgttgcattaaggagcatatccagaattaaattagaggggaactcttatttttctttctacccttcctactcttcctcttctcccgcttcttctaccctcccttcctccttaattaaatggtgatctagcgggataggaggactcgagttcccttagcatctacgctggatttattttaaatatttactcatatatggattattgctcgatacttttttgctttttctgtgtgtgtttgaatcgtctcaaccatcgcaacagcttttatatatatatatatatatatatatatctacgctccatgcatgcatatatatcaagcagttggtttaaacttaatgaggacgaagatagctgctagctggtgccatatgatcgatcgatccattacatagagctaggcagcagcgcagctagctagcctcaactaatttgtctttcatgtattttgtctgttggctcccaaacaaatatatgtcagatataataagttaactatacatatataaaatgtactgcatgctacagcgtagatcgatcttggaattagagattgttaattaatctggcgtaccgatggatggttttggcagtacgcatgtcaaccacgcaattaacatcctaatctagaatcagcgaacacgatcgagctagaagacgacacacagctagctagtacgtcttcatgcatctctctctctctctctctctctccttgatcatgcatgctgatgctgctggctctggctctctcttccatagaactattacagccagagccaggccacatcatgttgatgcatgtggtccagcaatcaagacaaaacagcatgagatagatagataactagctacccaccaaatcgctcttcttctcttacgcaaagattgcattgtaccttccatcctacccgtacatatatagtatattattgagtgagactacgtagtggtataccgtttcaatagaataacgtatgatgtcagcccgataccaaataggtatcagatctggtatatatacctctggtaccaaacatgatacccca

SEQ ID NO: 11149 - DNA, 7238 bp, Oryza sativa
agcagccacacatgcctccccgagctcctctcaaaagccgcggtgcaccggaaccacacgggattaattggctagtgtctctggtatcaaacatgatactactccgtaggtaccaaatttaataccatgctgatgtcagctatttagttggaacgatattaccatttatgcatacaattaattgtaatgcatctaagctgatctatatatgcaaacaagctagctagtagctatatatattagccaaaatggatatacaaagtaaggctacatcttttttttatatatatactactattattatgtatgttaatttgttagctattcgttggcgcaatgtagtaattaatatattacaatttccagtctggctaataatatttgttctcttcaatttttgagagatttgaagatagtaaaattatattacattttcagcctcgatctcttagttaaccactgataactatctcgctttataagagtacgtcgatcgatctataatatgagacgaatgtatctgtgtgtgtgtgtatatataagtgcgtgcatttttatatatgcatgtataggatcatatcattaattatcacccactagcccggactggactgctaatgttgttgtcaccactgacacagcacacttgtgtgcaattactagctagtctaacaattaattaacaggtgacgatgacatctcttgtcggattaattagcacgatgtacttgcatattagcgaatggtcgcagctactgtatgcatggatcaactgcgatcgatcgagcgtataaatgtatgtacaattaaaaagtttgtacacagtcgcacgtatatatagctaattaattatgagtattttgttctggcattaaaatgtatttttgtgagatatatatgatatttaattacactatatgatccgcatatctattaatcatctctcaaatagaaggatatttggcaaaatccaaatcaatttgttggaatttgcacaatcataggcatgttccacgttaaacctaaattaagctagccagctaggtaggtatagcagctagcaaaaagctgcgactagctaatcgatcagattacttggctcctggcatagctgcgagggttattaatttcttaattaatcaggcaattttttgtttgtttcggcaacagcagctaccacatgcatggatgcataacagtacgcacagtgcgttcaacaagtcgatcgatcgatcgtgcttgcatattgcggctataactagccatcctctgtagatatatatagatcgatgaacacttgaacagaactgtgaaactaacaacaaacatgtacgtactacctccgtcccagttacataaacaaaatcacttatggctctttgaattacaagaatataaaaaaatacataattctaacataaatacaagtgtaaaacaaagcattacaaaacacataaattaatatcgaccgtttgaattagactgcgggaaaaacacagcaatcgggtaagagagataggctcaaagaaaattgtctaaaatattgaagctcatgctaagtttcctcaaaaatttatatgtaataaaccattacatagaaatttcataagatttgaaaagcttctatatagtcgtatcctttatatacacaaagggccaaatagaaaaaaaaccattaagatttaaagtcttatgaagttttgcataaatcttttgatttaaaaggacacaggggtaattaatatatatggtgctagctagttagctagagtatcatgtaacgacgaaataaacaggtcaggtacttaaattgcatacgtgtcgactagacatcccatatacatgcaatttatacatcacacacgcacccgcagacgacgtacccatagctatatataatatatagaatcacttgattgtgatcaatctctgctggcggccggtagaaagatcatttggttcagacataatttgcaaacatattaggctagacataattaactgaagtattaaattaaattaattgcatgttttatgcatgtctaaatatgttttctaaaaatctttcttccactatactccctcgtttcagatgtaagtcattctagcatttctcatattcatactgatattaatgaatctagagagatatatatatgtctagattcattaacatcaatatgatgtgaaaaatactagaatgacttacattgtgaaacggagggagtattatttagaccgtttgttctaaacttctatgtagtagtatttaatttatctctgtgatcataatacgtggtaataatacgcttagtagtctaaattgaacggtcacaaatggtaatttgatctgtaaaaaatagtaatgtcatgatagggattgtgtctccgccgagttagctattacttatgtagctaccgtcaatggtaaacgttgaaatagaacatttatcaacggtatttttaaaatttcttctcttgatttttccttttagaagttcaatgtatcttctctctcttaattccattaaattcatgtaattatattcctattaaccatccaagtttctatgttttgatttcatatgttggatttacccatacatgacattctataatattgtgtttttcatgcatgttttatgcattttttcagatcctgcgttccaaattaaggagcccttaagatgtttaaaaaataaaagacttcacacggagagataatattgggtcgtggtgagggttcttattttccgctgttccttaatctgtacagtaatgttcttgtcttggtgccgcctagcaatttggctagtttgctcaaaagcatttgctgtcatgacacaagcattcatgtagatgtaatattccagtcattacaaaaatccttttggattttgctttttagttgtaagctactacctctatcttagaatgtagcaatctacaatagattttattctagaaaaataaatctggatatatgcctcatgtctagattctgttctaaaataggtctcattccattctaaattgctatattctaagatggagctagtgattgtgtttacttagcagttggacagtattttcgtcgtcgatcattttgcatagaaggattaacataaagtatatatcaaccgtgcatgcatgtttaagggcttggaatatgtctatacagctagcaaagtacagtaactagggtagagtggcaccaaggaatccaaaatcgatcatgcggttttccggattggatccgatcagacaactgtgagagggaagcttggaattaagagatcaatatatgctaatcttttcttgattttttgagatacgtttaaccattcatattacacaaaatatttatgtaattatcatttattttattttgacttaattaatgacaaatattctttaagcatgacttaaatttttttatatatttacataaattttttgaataaacgaatgatcaaacgttaataaaaatattaataatgtcatatattaaaaaaaagtaatactactagtagcagcctgtatatatgtatgtacacctgctacggatgagtctcctctgacgtaaagtcagagggactttgtcactgacatgtgggacccacaaaggttgggcccacacgtcagtgacccacgtccctccgactttacgtcagaggagcgcgatccacctgctacatatatgctcaattcaatcccttaatctttgcaaaataagtacaatgcatccaaccagaatactagcttgctatatataggaacctgcaaattaagtttaatttgagaagaaagttagcataagctatgcaaaatttcttttgtgtgtgtgtgtattactaccaatcgatctatctatttatggttctttgccaaaagacactttatccgttattttaatatattcccccaaatggagagataaaactttacaaaaaagacgattttactctcggctaacctagcttaattcaaatttaaacacagttttggtataatttaaatatattttgcaaaactcaaaagttgcctagaattactgaaatcaaattcattcaatttttctaaaaaagaaatttgaaatattatttttgagttttgacattttttgtagaatagttttgatttccgtaatttgagatagcttttaaattttgcaaatatttagaaccaactaaaatttgtttggatttgaccatactagatgaaccaagggtaaaatcgtcttttgcaaagttttatctctccatgtgaagaggaaatattaaaataatagactgactttttgataaagaaccacaatactaaagtatttagccacaaaactagccgtccttttaataaattggtcctttttaaaaacttattttgaaactagttcctataaaaaaattaaaccaaaaataggccgtggactcaacgccatgggccttagcgctaagctataatggctcagcaccaacggctctaatttgaggtggtatgaatttgttgagtcatccggaggttcacgacgctgagttcacggtctagccatctttaatttggtgtctggctagtctctagctagctgatcaatttgtcttttttctcttttgcccttaattatttaaatatgttcttgagcaagcatatgtatgtaaagtagcaagttgtgcttgggattcccttttggttttggaattaaggaaaccagctcggaagtactgatgcaatcatttgtggattaagtactgcacacattagatcaatgcgcacaattagaggaccaacagccaaccagtctgtcttgtcatttaattcgacgaatctccaagaacttactccctcggtcccagagtggtgtgtttgcaagagcaagttcccaacactctccttttgttttctgtgtgcacgcttttcaaactgctaaatgatacgttttttacgaaaagttgtcaaaaaaattcatattgatctattttttaaaaaaaattagctaatacttaattaatcatgtgttaatgaaccgctccatttttcgtgtataggagatgggttcttatttcttgacccctcacgtttatttcaaaataaatttattttaagtaattatttttatcaaattatgttagtagtgcattgataatagataaagagaaaaatgattgtattagaatttaataaagttatgatattatatttttttatattggtatatatatgtgtagtatggatgaaaaattagtgctagttagtttaagatctaattggcttgtaaccctagatcgagagcagtagcaattaggagtaagtaattagttgcaagtacaagagtacgaactagtaaattataattagttagttaggcagcagggaccgggtgtagtcaagttgctgacatgtaagatcgatcagctttactgcgtttagcgatagtacgacataatcgtttatgcagaacaaccccaaatctgttgtactagtacacctttaacaaccttacttccgttggttctctctctctctctctctctctcaccgataaattattataaacaataagctgcagttgcatgcatgaatatatactcaagtacgctggttcactctcatcaataaactccctcagctatatgtagaccgtatatttgacatatgataaattagatatagatggaatataagagttgaggatagtccaaagtgccataaaggtaaaatcatctaatataaaataaaaacattggttgaaaggtgatccaaaatgaatcaaacatcagtaataaaaggtggtccaaagtgaaatttatgtaaagaaataacatcctactaatttttattttaaagatttatagtttgatgctgattataatgaattacaaaactcactactacgaaaaccatttttcgtgacggccattttagattttcgctggcggaatttggagccgccacaaagcaaaggccagtgaagatcagaatcttcgctggtggtcgtcttaagtcagccgccagcaaagatctatttttgctggcggttgtcttacaccgaccgcgaccgccagcggctgtgttaaaacgaccgccaacgaaaatcaaaaccatgcagctaccctagccgccagcgaagaggaaatttgaaaagaaaaaatatgaaaagaaaacactgctccgtccacctccatcagcgctccatccacaaatccacataaatttacatcgacaatttacagccaaaaattcccattcacacaagcattcaagcatcacaaatatcaccaaattaacaaaaatttgaacatcaagcatcaatccaaatagagtgcatcacaaatattacaaacatcacaaatacagagaaccgccgccggcgtcgtcgcactcgaggttgccgtcgtcgtccttgaagtcccctccaccatcaccgccgccgctgccgagccccgtcggcctcaaccgccagcgaagatcagttttcgcttgcgattcgaagccccccacccccagttacattttttgctggcggtttgaacaaatagccgccaccgagaataattgggtgacgtcgtgaaaaatcattttctatagtgatttcaatataattttatcgtacatgcatacaaatcgtagtaaaagtaatccataaaaatggtactatattgtactaacaacatatcaattgatattgttatatctaagaaagctactttggaactctgaatacccatcatctatagccctgatttgttgacaaacaaattaactcttctgcgggagctagaacgatcgatcgactagctaaggtaatactactattaattagcagtagtattgatcgatatatctctgacaaaaacgacaacaaataagacaaggaagggtagaagatctgcaggtaggtgcatgtttggcaggcatacatacatatgatcgatggatggatccaggcctgtgtatatagctagcgaatgcaactagcaagcaatcatatatatccatgcttagtaccatatgtcatgtcatgttccataccggacggactggccgcctagcttggatcttccccctgcttttataatttgcctgctaattattgtccccgcaacaagagtcgagaaacaatatatcggacaagagttagctaatactagcaaccaacatattaattaataccatgggcgatcttatggttggagctagcacataatggatggatggatcgatgtacgtatgctgagcta

SEQ ID NO: 11150 - DNA, 1677 bp, Oryza sativa
  unsure (1)..(1677): unsure at all n locations
gtgcacgtgggctggtctcaatgcgtttgtgcgcatcccaggcacgtgcgtagtccaacattttactatatcacatctcactgttccaaccttatattccgtccgtccaaaaaaaccattcctagcatcccaaggtggaaatagtggagagtgagaatgactaaaatgcccttaatcattaataaaagtagtaagagtgatggtaggtaaagggtattgaaggataaagcttctcattttttaactgagggagtagatgcattgcacgaataatagtgcattgtttacctttagctattgtcccatttttatacaccctaccagtgctggaataaagtgtttatgaattgactattgctttcatgataattaaatgctgctttcattgtagaaaataatagctaaacgtttgcggattgattgtaatgtttgaaacatgcaattgtctgtgtgtgtgtttttatgtgcgtgcgtgcgtgtgtgttgtgtggtgggggggcgtgtgtgcgtgcgtgcgttgcgtgtgttggtgtgtgtgggcgtgcgcgtgtacgtgtgttttgtgagtacattgtcagtgggtgatgttgaacattcttgttttgcatgagaatatgagataagcctaactataatgatggatgattgacagtttaaagtgagcgtgcagtaacataacgtatagaagacacataatcagcctgcttagcatgcgtggcgatggaccgtgttgatcataatgacggcccgtttatagcctaaaataagcctcgtataggcggcccactaatggctatatttattagaaataagttcaccggagatctctcaacttaacagcgagattttttaaggtctcttaaccacaaaaccagaaatcttcactcctaaactatacaaaaccatctaatttgggttctaaggcagtatagatggctggttttaatgacatggcattctagtcagtaaaaataataaaataaatatgtgggggcccacatgtcagtgagagaaaatgatgtggccccacatctcttttttcttcccctttcttctcttttctcctttattttcttctcttctctcttcttcgacgggccgagcgggcggggcgacggcgggctagcgcagcggtggcaagcgaagcaggcatgagcggcgggggtaggcgagcgcggcgacggcggacgagcgccgcggaggcggcaggcaggcagttgtttccaacgctggtaaagaagcagaatgaattggggaagaagttgaacccacgggagtactggttcttggccgcgtacctgcccgaacgtcggcggctgcatgacggcagcgccatgcattccggcggccccgaacccattgtacagcgcctggtcacctacctacaaagaagaaaacccaaagaaacaccatatagctcaagaaaagcgaagcttcaattcatccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11151 - DNA, 898 bp, Oryza sativa
caatcaaatggagcctgcagcatctgtaaacatgatgggacttcaggtgttcctctatgaattttttacatgaattcaatggctttgatatattcacctttgcaattcatgcactttttgcaaacttttccttctatttcacttgttatttcttgttttgaagtgctgcactcttctacatcgtcgactcatcgcacatatgaataatctgtaggctcagatgctccctggagttgatggcaccatcacagctgttcagcagaggcgtcagctttactcaggcccactatcaaaattacgaatgttgatgatttgtcggatggcaaaaccagaggaggtactgattgtggaagatgaaaatgggaatattgtacgtgaaacaatgaaagacaacgatgttcttgtccagtataaggttagtaacagaatgtgtagctattttccacccctgtacacaaattgtgtcacatactctgtgcttcacctgtttaatttaattgtcaaacttatgtgttgcctcctttctttaattaattgttttggcagattatgagggaaacactgatctacttgtctcatcttgatcatgaggatacagagcagcaagtatgtcctgtctacagatattttcattaaaaaaacacatgctataaatattatgctttgttcatgctatgtgatatccattgaatttgttccatttctatgttgagatagcgcaagttgtggcttaaacctgacttcaaatgatgacaacacatggctttagtttgaaagtgcctactgtaatattagtagttagtaagctacttgttggtcaaagctcaattctgtgtaacctaggaaagttatgtgagcaagctcactatgtgtagcccaagagcaattaaaaatgtct

SEQ ID NO: 11152 - DNA, 157 bp, Oryza sativa
gcatttgttgctatctaaatcccatttaaggtcgtaccttatcgcccagcatcatcttattctctatttgtattccctccatctttcagatacggatgtagccttggatgtgcccgtgcccaatgaagaggaagagcgcaacatgaaacgtaagtac

SEQ ID NO: 11153 - DNA, 1567 bp, Oryza sativa
gtacgcgcggcggcctctatcgtccctcccgctgctgcgcgccaggtctgcgcttcaatgcgccacaggggcagcatgcatatccgtcgaccgccgcgacgccatctttattcccccgttctctcgtcgcgcgcgcgcacttgttcactgtgatacgtcgcaccgtactgttcactgttcagtcgtcgtgatcaatcaatcgatcggtcgaccccagcaagtgaacgctacggtgcacgtagcgcatgcaggcgcgtatacgttatgcgagatctcgccgaactgtgcccccatttatgagtcaggtccactcgctgtctggtccttttttttctgactgctgatcagccggtgcaagacgccaagacggatcagacgtgatcagatcgatcggatgtttgcagggttcgaagctgggccaccagaaaggggggaaaaaatcgaggccgccaacgtgctgcgcacaagaaacggcggataagttttgtaagttttgcctgagccgcatgcaggtaggtgtgcaaaagcttgatcgaaggttcaaatcggatcgaactcattcatagtcataacgagctaaaccatgttagaattatagttcgtgaaattaacgagtcagatcgtgtctagctcacttgtaataaaaaaaacgtaaaatacgtaggtgatactacatacaacttataagatacacgaaatttagtcagtcatctcgtaaaattctcaaacaagttttagtcaaaaaaaaattctcaaacaaatcactcatcttgttttttttttcaaatcacataagcacagtggtggagtcaggataaaattatagcggggctaaactaaagtggaaaataaaaattgaaatatgtctcatataaattggctatatttctaatacaaaatataaatatatggattagaattttataaggtattatgggggctctaatggtacattagggtagagagtctaaagaccccagcccccaagttgtcactgccgctgcataagtacatgtgtcaagttcgctattaaattggatacatgttgatttatttttgtaagcatgaccacactcaatgaaaaaacaagccaacttcaatatgattgatactaaaatccaatttaagatgattttgttattgcttgctaagtttattgaaagcatacaagtagcaactaacataaatgaaaatacgggtgctaatatttaattttattgcttgcctataaacatgtcaacttgtcctgcccatatcactactagaaaaagtatttttactaacgtgagggccttatttttgcaggctgatatgacccttagagccaaatgaccgtctacaaaaatataaatcggggtaaaatttgatgcccgcttgcgaaaatagattttcgcagacggaccacttaagtggcgccgcttaagtggtccgcctacgaaaatagacttgaatataaatagacttgcgggccctattttttttttaagtcctcacacctctcagtcctcccctcgctccacacctctcctcccttcctcaccggcctctcccctcccctcccctctcc

SEQ ID NO: 11154 - DNA, 5848 bp, Oryza sativa
cttcccccctccctcccagatctggccgaagaagaaaggggggaggccggcgggggcgacgacggcgacgactgtgcaaggcggtcggcagcgtctcccctccctccctcacagatttggccggaggagggatgggggaggccggcgggggcggcgacggcgacgaaggcgcgggtcggcggtgaagacgacgacgacggcagcggctcccctcccctctcagatccggccggggagggcggcggcggcgaaccgcgtgcggcgatttttttgttcgttttttttttttgcattttcgcaggcgggccgttgccccgactgctaaaatcgatgattttcacagtcgttgtgatgcaggcggacctccctcccgcctacgaagattagttttggccacctgcgaaaattagttttctagtagtgtatgcctcacacatgtatttatgttaggcttgtatggcttctaattgagaaacaaacaatacatgtgatgtattttacatgattttcaccatcggaacaagatggcgactcatttaaacaatttgtaagataagtgactaaattgcacttatatcacaagttgtgataccacagaatacattttactcaaagaaaaatcagtgtctttatatgcataatacttcctaactattctatctatcctaaaattaactactagtcatttaggattaactacctagttatagttatattcaaatttgtaatactagataacgatattttaagatgaagagagtatacatattttcttaaattagtctaagctatttatatctgttgagttctttactactacttccacccaacatttcaaacatttcaatttgaagattgtccaagaatataagcattcatacactactgcttactctcagttaaatttatctcatcgtactcccaaccaccttttcaccctaactctctctcgttaaatgtgggccgggcactaaaatcttttttcttcaatcttaatctttgctaaataatctagaaatgttcgatgaagggagtagttagtttttgttgttatgttaacgttgataaaatagtaaattaaaaattaaaaagatgatactccctccgccacaagccgtatgttgtctcgttacggtcaaaatttgactaacgattatcctattttgatatactttttatgacgtaaaattgatgttgttatattcatatttaaaagtaatttgtatcatattgatatattagtaaagtgattgttttaaccttgtcttagattggcatgttagaattgaggagatggctatgtttttaaataatttgtggcaaaagtacaattttacccctacacgtctatatttttatggataatcatacctcttcatatttctactattgttaaataaggttatagtataaaaagatctgaactctcaaataaaattagatttgtggttcagatcgattaacttctactactagtagggagtaccatggtaggactcaaataaaatacgttatatttatatgaagtagtgtaaatgagaaaaaacttgttctaacgagcttagctcaaccaaatccgtcttctatcagtcaatctagaaggcctgggtgccacccaagtgcaaattcttctcttggctagtcacgcaaaatagagtttggacggcagataggctggagaaaagaggatggtaaaaccaaaatatttgcccactttgctgcactgttgacgaatcgtccttacacctcctggccaaatgcagactcacaaagaggatatgagcagaaatccagagatggactgggacttacctccaaatggacgattgggaaaactgccactcagtcgatcagtggtggaccctcgtaacggaatccccaaacaccccgcacaaacccctaaggaccctggtgattttaatctcgtgggaaatctggtgcgaacgaaacacaagaatatttcgcagcaatgcatctgcgccgtcctcaattttagcaaagatcaaggagaaaggaagagcatggatcaaagcaggggctgtaaccctgcaggagtttggaactttgggagatatcacttaatatccgccttttgtcttccttttgcgggttattgcttttttctggctaaccctgtatatatcttgttataatttttttctactctattaatatatacaagacaaagctttttccttctttaaaaaaaaacgagcttagctcagctcacgaactgagcaaagttaactagccttaatcaatcgagctgtagcctcgttatccacctcaggtgtggctgctggcttggcttgtgggcttgtggcagcgtcggtgtgggggcgatgattttgcactcgatgctgtgaccttacttggaagatgctatgctgctattcactggcccgttcgtttttgacagccttttgtggcgtcaaggcttgatttgatacacgatgttcacgatgatgtctccagccatcgtgccttggcgccttgcttctgtcgctagcagcggtcagggtcttggcgtcgaacatgccatcatggctcgccccgacaaaattgacggactcacgtcgcatgatgcttactattaaccattcaatggaagattggaagaactagtgtactattatggtctgtgaatttccaactaaattaaaaataactaaacaaactcctcgcctgtttggtttctatttgaagagaaaggtaaaccagagtggttagcgtctttctttaatcccactggccttttgtttctcttcaagcaccgctagatttattctactacatcatgggagtgatacatgtagcttttggcaaaagcgaccttaggagaaaatttggattggaagctaacagcagcattaacaatgccacgaaattgttgtccaaacattactacggctcctaaacaataattggaattgactatcatggatggtgctcctaaacagtatctatctttctcattgctttcgtgggacacaaatcaagaaaagctaaaaaaacaggatagcgacttgggcaagcaattagtgagaaccttgattgttccttcttcaggagaggaatacacgttacacagtcctcccagtggcagcaacttacagagtacaagtgtaagaaacttaattattcttacaaaatctcatagtagtaattaactacacagtgttcacatttctataccctttatttatatttttacccatgcagaaatcataaaaaggtgttaattaaggagtatggactagtgaaaattaacagagtacagtctctactctcccggttggtcatgccctctgtgtaaaatgccttggaagaatattgtatatacgataatggcttaattcacaagaacctcatcggaagtactcgaagttgaagtcgccgaccaccatgctccggctgacgtcgaagtcgaaatgtgtcatgccctgctcttgctgcccatggcagggcagcccgaacttgtgctccatggcgtccccctcgccgtagcccacgaaaggctcgaccttgctctcggtggcccaatgcagcggctcgctctcgagcgcattgttcacctccggcgcgcccacgccgcagttccagttgctgctgttgctggagctctcgccgtagcccaggttctccgacacgtcaagcacgctgctgtagtccacgaacccggccgcgtccttgccgccgaggtggccgtacaatggcatgcccgtggcgtcgaacccgctgccgaagctgtcgatcaccgggaacgggtcgaacacctgctgctgctgcttcagggcgaagccgtcggcggtggccggcggcttctggtcctgcgtcgacgtgtccaatgccgccgccgcagcagcagcagccgtggagatgggctggtgggtgctggggtcgatgccgcgctgcctcagcttcttcttgaggcagctgttccagaagttcttgatctcgttgtccgtcctccccggcaagtgcgacgcgatttgcgaccacctgcatcggattcgcctcgctgatcaggccacttatcgctaacaaatcacctccacacaaccacattgcgacgaaaatagtactggtacgcattattgccggagcggcagtacgtacgaacctgttgcctaggatctcatgcaggccgacgatggcgtcctcctcctgctgcgagaagctgccccgcttcaggtcggggcgcaggtagttgatccaccgcagcctgcagctcttgccgcacctctggagccctggagcacagaagaagatcgttgcacggcacgggtcagcgatgagacactgagacacatgcatgcaaagagcggatcgagcagagcaggagcagcttacgacctgcgagcttgggaacggagctccagcaaccgacgccgtagcggtagatgtgattgtagagcttctcgtcttcctcgggagaccagagccccttgcgcagcttctgctggacaccggcggcagagcacgcgtgccgtcccattcccgcccgacacgcgagcagctacctgccgctgggttcgttgcccttgccggcgtgtatctgtctatcgatctctctgtcgatcgaggcggccggctgggcgcccgatccagggggtatatatggggaagcgtgccgagaactactgcacacacacacgtacggtgcgcgcgcgcgagggaggcagcagatcgagcagcgatcaagtggcctttaagcaatcaaccaacgagccacggagccaagcgtctctctacctagtactcctcttctctgtgtgtactacctggtgcgtgcggcttgatatcgtgcttccgctacaatggattggagcttaagatatctccggttcgtgagagaaattaggagaggagaggagcgcagacactgggccagcgagcgaaagcgagcggcaagctagggccccgcgggaacaggacggaaaggacggaggaaaaaaaaagcagggttagttggagattatgactaagatttttccatcaacacttggttagggaagaacacggtacagccatatcactattaatctcactattaatccctccaggaaacttgcaagttgcagctacacgaccgaagctataagcgaggcagcgaaaaaacacacgcctcgtgcagcgctcgtacactgggagggactaatgggcgggcgatcgccgctcccctatactctatacactcctccctcccttcccctctccctcctctctttcttctcttcctactatagtacaccacacaaatttttttaaaaaaacaaaaagttagaaaaatttatgtataaaaatactatatataaaaaatttgaattcaaattcaaatttgaatcgggtatgtaaactttagacttataaattttaggtgtatagaaatactatatatagaaaatatttgaattcaaattcaaatttgaattcaaatttaaaattgaatcggctatgtaaacttttgacttataaactttaggtctataaactttaggtgtataaactttagatgcataaaaatactatatatagaaaatatttgaattcaaattcaaatttgaatcgggtatgtaaacttttgacttataaactttgggtttataaactttaggtgtataaactttaaatgtatagaaatactatatataaaaaaattgaattcaaattcaaatttgaattagatataaaaacttttgacttataaacttttggtctttagatgtataaacttaaggtgtataaactttaaatgtgtaacttaaggtgtataaattttatgtgtataaatttactaaagtagaaaagtaatacggtgccaaaaaaggaaacaggtggagagagg

SEQ ID NO: 11155 - DNA, 2817 bp, Oryza sativa
  unsure (1)..(2817): unsure at all n locations
cattcgtgcgtgtaaatacggcattgtttttcatagatcgggttaaactgatcactgtccacgagatcctgaagaggatagcagccgacagttggaattgcagcgttggccccacgtctttccacgtaagagtccttttgtggggtactggtactactacttgtagtaggaaattttttacacggccgaatcgatacagtacctagaacattctttcagaatttctactttgttatgttctaaagaaggcataaacacttaaccaggttgcttatcgcacagtgtcagtttcatgcatgagaacatgtacaggatacctgtcgtaggatctactgacatgtgggtccgatatgcgtccgtagacggaagaagaagttgatgattttttttttcttccaagtagagagtggatattctgtaacagttaaaatgtcgaagcataaaactatctttaatttaggtgcgggggtaaaaaccttgctcgttctagaaagacatgcaaaggtgaaagttacacgctgaaaggtgaaaataacgcacacgctttggtctcatcagctgcaagaaagcagaaatgagagagcaaaatgaccacagggagaggggtacctgattaaccgccgagcctagccaaagttactgcagaacaaaacgggaacaaacaaaccaagcaaagcagcacagcagtaggccctggccatcgtaccactaggaaggaaaaggtgagatgcagatgttcagttcaacgtaccagacggctcgatcgatcagtcgactccatcctaaattcgagtactacgtacttgcagtgcgtggctcgatcaaccgtgcaatcattcagctttcagtacactaaaagcgagggtccctaaagcctcgggccatagcaattgcatgcaggacagggcagcccccgcttaacccccagcacttagcctcccacgcttgtgcgctaaagcatacgcatgatcgagttgtacacgtcaacctttttattttcttttccatctatctggaggccctaggcactaattaagagcacgatactaaaacgatcaaacttgccataatgccatgcacgcgttgcaacgaatttctcaataacggcacacatcatccgtggtgttcatgctgttcttgcatgccaacgcagcttgtagcgcgaaaacgatctgaaaaccacttaatttaagtgctctggcctgtaccgattaattagctagtgccgtgaccctcgttagagtggcttgaaggctcgtgccaaatgatggcagctagttctcagcagtatgactgtgcagggagatagagataagaggccaagagcagtgctcgatcgaggctggctacaaccgcaaggataatgatgtagcgaggggtgtgtccgttccgtccaggaggggagggggggcaaagctagcgtgctccggagaaagcatgcagggttagcgtagcgcggagaccaccagcaccacccgtccaccgcgcgcgcacggcctcggcaacaagtttggtggccaatcagggtcaggcttagcttccagcctgctccatgtacatgtcgagttcggtttagttgggaaccctagtatccctaacggccgcgcacttaattttttttaacttgctcttggcgttgttttgtgcgcgctgcaactgcaaatgcatgcagacacaccaagttgcaccaatgtgctcatgaattgtaatgcattgatcttgtgccttcacagatcgattggaataacgggaaaattgtgtttgcagtgaatgatcagatctgtgaatgctactgagcatttgtctgattctcccctcttttgacttgagagactgctactctgctaggcaatatcagtgatcaatcacttgcctaacggtgtctacaaaagctaattgcttggaaataacaacacatgtgtgagtggctaagtggtgatagcagtgcggagtcactataatgctggaggcacaattttgcatgtcaccggtaaaaaaaggcatatttttcgccagataaacctgcatgagtgaaactcaagaaatgtgcgtcaacgtagtagtgttaaccttctgataaaatgggatgatctacatgttccataggcgacaatgcttcttctccaattcttctgacgaagttacccgcgtaccaggaccagggtaggcagcttttccctttcgaccgagcttgcagcagttgctaaaagacaagctggcctctttttcacccacaagaaaaaagaggctcacttgaagaaagttggacaataacacaaaaaatatatttgttgacaacttggtactgttatcatcctctccttcctttttgtactctgttttttttctttcttcaagggaactccaattgtagtaccaagggggccgggggcaactgcagtgtattcttgcagttgacgttgattatttcagagttcagacaagtggacggctaaaagaaggaagaattaggactaccgactaccgagctacgtagccactataaggcaagttgttaccgctgcaacttccgcagcactaactaagacgacgactacgtggtagtatgcgggatgcatgggcgacatgtaaaagaatcgcccggcaaagtagtcactaatcgatcaattgggaattacctcaagtgcatgtctctattgtggccaaaaggatcctccaggattctcctacctgaggcttgatcttgacatgcctcctctataaaggaaagtactactagtaagtaaaaccccaaaggtgagagagcgagannnnnnnnnnnnnnnnnnnnnnnnnnnnnnnnnnnnnnnnnnnnnn

SEQ ID NO: 11156 - DNA, 735 bp, Oryza sativa
  unsure (1)..(735): unsure at all n locations
tgggggcgacagtggaggtgacaatggcgctggtcatggaaaaagaataaaaggggagagaaagggagctctgcccatgccattttgggagaaaggaggagggagagagcgcgagctctggctccgcgttttggaagcatgcggcatgggggcgtcgggactgggcgatgacagcggcgatgactgcaaaaaagcgagcggggttcggcggctgcacggcgtaggcgtggcagggctgacgcggcggcgactgggcggcagcgcgggcacgggcggcgaccgggcgacggttgccaccagggcgcgcgcgcgcgggggaaacggcggccgaccgaaaattgaatggcggagagcgggggatttgacgccggtggaggagctcgacgagagagagagagagaaacagagagggagagagagaaagaacgagagggcgagagctctctctctctcggctcggctcagctcggcgcgtgcaatgcacgtgcgaggctgagggaggagatgggccaagggaggaagaatcggcccaacgaccaagagggagtcaaaatagacttctgcttagaatttgaattggagagaattgcagcttggatttgaatctaaatttgatacttgtgcacaagggttcaaggagatgaggaaggaaacaaagcgggagtttgatacttttggnnnnnnnnnnnnnnnnnnnnnnnnnnnnnnnnnnnnnnnnnnnnnnnnnnnnnnnnn

SEQ ID NO: 11157 - DNA, 2149 bp, Oryza sativa
  unsure (1)..(2149): unsure at all n locations
cgaccaccttgggggggagatgaggttttcccggcatggttcggtcccccccatcttgcggagccgcttcttttttcgctccctctcgggctgcgacgtcggcacagcaccctccgggcgcctgctgctggcacgcaccgccccgccccctcggggaggagatggagagggggtatcctcctgtttcctcttcccccgggcgtcggcagggcggctgccccccgggcccccgtcacggggcccagaagcatgaccccctcccggggtagattgttcccccctgcggctcccgcccgtgccatcgtggcctcgaggagcccactcccctgacgccccgaccgcctgcatgatggtcaggatgttggcgcgctctggatcgctgcagagggggaggacaccttgggggatgagggatgcctccacggagctgagattcagcacccgttggaccaccatcttgaagtcctcaggggcccagtcccatctgcccccctggtgggtcctcatgtagtccttagacccggtgtactcccaggcgccccgggcgcgccgctggagtggcgcgatccggcgatgaaggtagtcaccgaacaccatggcccccgtgagcccctgggatcgcagacccgccaggcagtcaagaacggcgtcgtagccatctcccagatctaccggcgcccgccagctggaggcctgcgctgggggctggctcggaagtcggaggcgcgcttcgtcggcgagaggggtgtagaaccagtcgctcttccagtcgtcccacttcttgcgaaggacgcagggaatgtagcagttcagcaccggcccccgcggctggaagtagcagccaccgactaccgacggtggcgacaccggctgtacggtgaagaaccaccggaacagccggagagatgggcgcaccccgatgaacatctcgcataggtgcgcgaagatggccaacgtcattaccgcgttgggggtgaggtgcgccatctggagatcataaagctccagaacatccatgaagaaagaagagaatggcgggaccagccctgccattgcgaaagagaggaagaagacggaccgccccgggtaatgcggcgccgggcgtccctcgcccagcgcgaccacctcccgggcggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgccggaaacggagagtcagagcacaagtggcaaaggcaaagggaagagtgacgagaggaaggaaacaaatcccttccttgatgtcttagtacccttgccaacgctatgcccggctcctcgatccccgcgcccactacctcgccccctcgtctctcgcgcccacgcctccactaatcccgctcgcccgtttgcggcgcacgaggcggatgtgcggccatggcagtcgagatgggacatatcgtgcgcgcgttaactacgctcgccgaccgatgcaccgtcatcacatctccaggcgaaacgaaccagctcgtcccggttcgcgcgctacttaagtaatgtagcggtcttgaaggaagccgctcattattgtcggtcggttttttccttgacgatgtgcgcgatttgcgaccgctgggtttctgccgcctgtggagaccggccccacctgtcaccaggtctaaggagtggcgtcacgcccgagcgcttccctcgggggggcgatcgccctagcgtaacgccgggggctactgtcggtgacatgggaccgggggtatcttgactagaggtttggggcagctgcagtcacccacgtggcctgaccccctcggggggggggcgggcccgagggtgatgtggccgcccctccctctgtctccccgaggggtcgggccgctcccgtttcggccccgagggctggggcgccccggccccctgtgggtttggcgccacgtgtgtgggttaggtgagcacagcggcgctcacctaaccgcgtttattgcgggttggacgagnnnnnnnnnnnnnnnnnnnnnnnnnnnnnnnnnnnnnnnnnnnnnnnnnnnnnnnnnnnnnnnn

SEQ ID NO: 11158 - DNA, 2254 bp, Oryza sativa
ccccctgtgggtttggcgccacgtgtgtgggttaggtgagcacaacggcgctcacctaaccgcgtttattgcgggttggacgagcgccccatgtcgcatttaatgcagcgcagcacactcattcggtccgtgacaggtcacagtgtgtgaccggtcacagaccggtcagatcgtgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatggcaaccattgcaaggaagtcattgtatgaagaagggcagacgtgtagcatgctgaactgacacgtggtggacaagaatgaccggtctgtgactggtctgacgccggtcgcgtcatcggcagacaaccgtgctcccgcgatgcatctgcctccgatggagtggaggtaggtatgacccatctcgtcggatggtcatttggaaagcagccatggcaaatctccgcccattaatgagggagtaacagggagatccccggtgtcaggcgagagacggcgctgagcctcactcaaggacaagttgtgatttagcttccaggcgaaggtgcaagccaagttttggtcaagatagggtaggtccccacccagaagaaaagtaggtagaagtggtgcatgtagtatccccttgagatataaaaggaggaccttgcccaccaaaaagagaggagggaggggaagtgagaggggttctggagcctgaactctctggctctccggctctctgtaaatccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcaccaagagtaagtgctcaaaccatcctagccttcaaaaccttctccaatccttaccttcaccctcaaaatcactctcacacacaagaagggctcaagattggggtggagagagcaaaatcacattgcgaaaagctagaaaccactaaggaacagaagagcaaaagtgaaatggcaaaagagtgagttagggtcgagtttgatatatataacggctagatgatgtcatctagctgttactcacatttttgaaccggaatgttgcccggaagttccggtccttggtgccaggaactttcggtcatcatttaggaaattttcttcatttctcctcggcccggaagttccggacatgggggcctaaagcttccagacatgctttgctatcttgaggaggctatttccaaaaatagctcctaaaaatatttcaactgttggatatagctaagggcacttagagtatctcagaacacaccttgaaacccctcttaatagtaaggtttttcctaaactcaaagtgaaaaattaaactagcctaactcggctccaattcttttcaccactttgaatttgatgatttgggggctccaagcatcctagccacctcgtaagcaacctgggactaatacacctgcatttactcagtaaaatcataagtcccttaatcattttgtcattaatcaccaaaacccacataggaggggggttaggtgcacttttagttacaacccaccacattctaaaacttaacatgtaaagatgtcacatcatcattcactggcaattattgtatcttcaagttgtgtttgtttcctaaggttcccaacctccagtatctcgtttccgcacgcacagttatgttttttttaaaaaaaaatacagaaattgcttaaaaaatatattaatctattttttttaagtttgctatgttttccatgcatgggattagtctccactccgcactaaagaatacaggcatactacgttatttataatttgttgtattttagagatttaaaatattagcatgttaaatcatcattacacatcatctacatagcatttcaatatatatatcaattcattatatttctacgatatccagtatattgcatccccacttaattaattgtttatctcttctctcattaagccacgacactttaattgtttctatcccttggatgactactctatgctttaagttatctctca

SEQ ID NO: 11159 - DNA, 4317 bp, Oryza sativa
  unsure (1)..(4317): unsure at all n locations
nnnnnnnnnnnnnnnnnnnnnnnnnnnnnnnnnnnnnnnnnnnnnnnnnnnnnnntgttttttttaaaaaaaaatacagaaattgcttaaaaaatatattaatctattttttttaagtttgctatgttttccatgcatgggattagtctccactccgcactaaagaatacaggcatactacgttatttataatttgttgtattttagagatttaaaatattagcatgttaaatcatcattacacatcatctacatagcatttcaatatatatatcaattcattatatttctacgatatccagtatattgcatccccacttaattaattgtttatctcttctctcattaagccacgacactttaattgtttctatcccttggatgactactctatgctttaagttatctctcattttcttctctcatgaagtcacaccaccttacttttgcttttggtcaattattaatatatactagaaaatcggcacgccttgctagtataatccatgctaagatccttttcaaaaaaaatattgaagatattttgctagccttaatccaatttctgtaaaatcctttaatttgtttcaatcagtgtcaaacgaacgatgattgtataaagaaaatactccctccatctcattttgatcatctcctaagcaaatggtaccaaaaccaataacatcaacgcattcatcattctaaaattaatccgcatcgatgaatgtgctatatcccctcgtgtccaacataaattaattcacgctttaaatgttgcatgggttgaaccaatagaaattaatattggttgaccgaatgtgtatagttgcatgcatgcatgcagggcattccacgatgtgcatttactctttgtacaaataaataaagagacactttgttagatgatcatcattttgagaaaacctcaaaaacttaggcgatgatcaaactgggagagagggagtatgtttgactagctctgttacttgttcttacaaaaaaaaaactcgagttatgatttactaactcaattcaacctaatttttcaataaattcaattgaacccaagttgtgtgtcctcttaaactccacaactccttagatttgccattgcgcaacaatagctcgctgtccagcacaaggttagcgttgctgtgctctcagctatcaaccattggcattttgtctcattggtatatggaagtagcgagggcgtcaacgtgagcttgacaggggtttaccatcaccatcaaggcgacgatggtgtcgtagccgaaaggcaagtgagactttttttccacaatgtttgatttcttatagagtttttcttaacaatggatttatatttgatcgagaggttcaaggaatgcaaatttatttgattgctaatgagaagataattgttttgtttttcagcacaccaatgatccctagatttatcttaatgtctatgtgtgttgtgagcagggaagatactaaaagttgaaaccctgtttatctcgatttttaacttcacacacatcaggatctatctagatccttcacttcaagggtatctgtatccttttgtcgacggggatacccataaaccggataaatagagtattagggtatgttggtacgaggatctacacgatacaacatcaagcaaacgaaaagacaaggattatactggttcgggccctcgtaaggtaatagccctaatccagtttatatatatgagatagatatgaaaaaaccacatattacaatagaagaccaataatcctgggattatcggcgagacccttgtcgttggcgagacccttgtcgttggcgagacccttgtcgagatggtttcaacgagatctcatggcgagtaggcttcacgtcctccggattgtaggctatggtggtggtgctggcgctatgattcggtcatctaaacccctcagggggtatgccttttacaccgtgaatcaccttagtcttcaagtagaactcggagactacggaccccgcatgatatagtataaacccgattctctccaagtaggactctgctattcacttgctgtcacaccccaatctggcaccgccggacaacggcacctgataggagcgtgtcataggaaaaacggcgcgaactgcttcctacgaaactgcgatcacagtaccagtcccaggacttagcactggtacccacggtgacaaatatgaatcattgcaatccttaaatttaatagagaacttatttaccttaacttaggttgcagctcaggacagcctgagaatacaaccgacgacgcggacgaggaaacatcaacagcagcagcagcagcggaaccaatgaactaacacctaacaccacaggcgacggctgggaaccaggacgaaaccttaatcttcacttcacttcatcttgacttcaaggcagaggaactatatttatatagagcaagggtgagtactttcgcactcagcaagtcacgggaatttaggtgtctgatgcaagcttggaagagaggcaaggttgttttgcaaatcttttgttttggaaatcattttgaaatcactaagtgatttatttctttctaagtttgggccaaaaagagatttgtgtctcgattcgactttaagagatgtttttcaacagctcatttggtaatgtaccgacctcccggttcagatcattacttctcggctcccagagccatttcacttgattaatcggctcccaaagccttttcattttctcggactcccagagtccagctgcccagcagcacaacaatccgcttccactcaggaagcctagtctatgatgcccgtagacatcccgaatcacacagattcgtttcttgaccactcaggtcatccatctgccacataggctgattctggtaacgattcccaaaccacaacaacttttcacaaagcacaggcaaacaaatctacgctacaggaaacacctcacatccgcccatgaccgtgggcacggctgttcgaacagttagttaacctctgcagaggaggtacactttacccacacgacattactaacctggatcacccagccggagaccctaaggccgagataacgggccggccagcctaaggagacacggcccattagggcgcgcgggaggctaggagagagggaaccgatggaccgggctcacctcgcgtggtcccgagtgggacccgcttgttagcggctcggctcaccgtgagcggggcgcacgcggagcgcgctagggtttgggagggggagtcgcagcgcacgtgcggtttgcggtggacgcggatgcggcgggcccacgagcagcctcatggctcgcggtggaccgcgcgcgcgcgagcgggggtgcaggggagcgttggaccagggtcagccttgaaccggtcgcagccgagatggcgccgacgtggcgccttcgtggcagccacgcgggccagcgggaggaggaagaaggggaaggccgagatggacggcggacggcggccgagttcaccggagctcgacaagacgactatggtcaagggggagcacaccggattggcgagcggcacaagagaggacgagccaatggctcggatcgcgccgggagaggtcaagggcggtggattgcgacggcggcggctggcggcgtgcaaaaggggaaaaactggcggggcggcgagggttcgattcaaggcgtcgggagcatctccgttgttcggggaactcattctcggggtcggatgggacggaggggcctcgagggaggccgacgagcggcggctccccggaacgggtggcaatggtggcgaggccatgccgggcggcggcggggcttcgtctacgcgcgttcaggagggctaccgagctaccacgcgagctaaaagagggagagggcaagcgagaagggagaacggagggaggcactaccgagccgagacgggcgctgtgacgagcggccgacggcgcggggcatgatcgctacggcctcgggccggggaagaggaagatgagggtgcccggagtccgcgttagctcctcgcgcgcacgccggcttcaccagcacacacggcggcggagggaggcaaggacagcggcagcaaggcggcgagggtggcaagaacagagagagagagcaggcgagcggcttggctgtggttttataggcgtggggtgtggagcttcgaggggaaggaaccgagcacgggcagtcaaggggagctcggttgggtcaaggtgggggcgacagtggaggtgacaatggcgctggtcagggaaannnnnnnnnnnnnnnnnnnnnnnnnnnnnnnnnnnnnnnnnnnnnnnnnnnnnnnnnn

SEQ ID NO: 11160 - DNA, 7876 bp, Oryza sativa
ccgaccgaaaattgaatggcggagagcgggggatttgacgccggtggaggagctcgacgagagagagagagagaaacagagagggagagagagaaagaacgagagggcgagagctctctctctctcggctcggctcagctcggcgcgtgcaatgcacgtgcgaggctgagggaggagatgggccaagggaggaagaatcggcccaacgaccaagagggagtcaaaatagacttctgcttagaatttgaattggagagaattgcagcttggatttgaatctaaatttgatacttgtgcacaagggttcaaggagatgaggaaggaaacaaagcgggagtttgatacttttgggaacaattatttggagaggattcaaaggaggggattgactttaggaatttgatttcggagactcgaatcggaattggaaacttgaggtgggggattttgatgaggcgatttttgaattcgacgagagggatcaaggagatttatatcgagatccacggcacgacttagactcagcactcaaagaatgaaattttcgcatataggattttgccgaaatagtttttaacgcctcacgaaatgcggagcgttacacttgcccgcgagggtaatttccataatctcttgataattaccttatcgtatacggaaacatatcatacatacgaaaacatgccgtatccacatattccataagtcataggatatgagatatgccttatccgtaaccatgacagtagccccccgacttcaactcaaatgagtactcgttgtcatccgagacttcacagtcaacgttgtcatgctcactaggtcgttctcgatgaaaatcgagaaggacatggagtatgcggcatcattgaaagaaaatttattctaacccacagcacactgcatatctctagatacttctcttgatttattttgttttacagagcctagcaattttttacacttattaatttccaattatttctcaaacattgttgtgccacgtggaccaatcaacaataggcaaaactgccggcttgagaaggattgattgatattgtttaagttatcataaacaacatcaatttaatggtttatagctttttttcaatgatcgatcaaatatgatgattatataaacttatattatttagttatcttatacgctatttctactattatcataccaagctcccgtaatattgtgcgggatttcatgtagtttcgttaagaatgtgcccttgtcaagtaacatggcattgctagtattttgtgcatatcttgtgccgttcttgtaagggacacaaatgcaatatgttggaggaaataatcaagacttgaatcctgacaagttcttttagggggagaatcttgacaagttggaccatttgaattcatgcttctatgattttctaaacaactattgcccactccaatcaggagggcaaataatatattggtagggtagatctccatattcgatctgctgatttaaataaacttgagtcaatttccggcaaatataaagcccgtaagccagctatgttcttagggttctgtttttttacaaaagttcaggtatgatagctggccacgtccaactataaacagggattatctatagagctcaaaataaaatcccatccaatcacttttattctctctcaattttattattggttgctacacagagctggtttcttcgtaagaaatgatttcttcatcttttttttcatctcttctcattaactattttatcgcctctttttacttatgtgactgttttttttttaaatacgcgagagacgcatctttatattaagaaggaataaaagtatttacagagcgggccgaaaaatcaaaaacacgaaggggacaagatacaggagggggaggaggaagaaaataaaagtctaatctcccaacgaatgtgacgaacttccatccgacataggtgactgtatatttaacggtatgtaagctaggtgtgagaaagagggtttggactgctctaatgcctttgctctaatcctgagcactagctgttttgcatgctgcgcgcgcatgtggacggatccattatctgctgtctggtaattaagcagtactggtgacttaggagtagatgccaggttatccaacacgtgagctcgtgctcctcactacggacatactgatcagaaggttgaccttggcgtctataaattgcgggattatgtgaacagagtagacacgaagcagatcaaccaatcatcagaatgaggggacggtcccgagtttttctcctcgccttggtgctcttcctcgcgctgcaggcgccggcgtccgcaggcacaaaggcaatgctctttcttcacttctctctcttaccctctcgatctattcatcatacatgccctcaatattttttaaaaatatatccgccaaagtcattttgttctttaattgcatgtcctctcgtttctcttgtatgtcattcgaatatttatgaaaaatatttttttaaaaaaatgtatttaatggattttttaatcatacatggagattatatttttaaggggatgctcttttacttcttgccactcaaatagttttacaaaaaaaaatggcaacatatataacatattcatatgtgatttaaatttgatcaattataaatcaacaactaaattcaatgagaaaatcaaactaaactgtaacgtgtactacttaccgtcgtatttatttatttatttctaatttagagttacaaagagtgatatatcacatattaatttgtgttgttaaatttatttaatttttataactatttcgatgatatatgacagaaaacagggtatatattccttaaaactgcaaaaatgtttttccatcgtatattcgtcacgtacaatacaagcaagtcaacaaatataggactgcgattaaatgttctattgacgatctctaatccatgaagcggggtactttcgtgcatgcagacttatgtgatcgtctttgatggcttaccagcttctccttctggtttgcttgctacagtcgtcaccaggtcagaaaatactagtgtggccgttatggatgtcggtgctaccgtactaggctactagctatgtactcctacatcactaatgtgttcattttgtgccgtaaaaataaacagctttcagttactgtacgtcttgagccccatccaagtgatcgtggtgcagatcgatgagagtttcgtaggagtcatcaagcgtacgccacatatatcatcatgttatagtgtgttccccccttggagtttgcagttcatacctgtcactgacgagcgcgttctttttttcgcgtactttggactcagagctgcccggcgtgctggccgtgatccccgacgtcctgcacaaggtccacacgacgcgttcctgggatttcctcgagctagagcgaaatggcgcggcgaccggtgcgtggaaggacgccgcgaagtacggggtggacgctatcatcggcaacgtcgacacaggtaccactacttgaaaaatgatattcgagacgatcaaaatggatttcacgagcgactggtacaaccgctagcaaccaaaaactaatgaaaatcgaattttttaaattaatttttcaatggatttttttttaaaaaaaacgcactaagagcacccacaatagtaaagtaaggtgctctctataaaaatgtacatctcagcaatagactagattgatagtaaaccacctcaatagtatgtctacatgggtatctgtagctctctcatccattgcctcgtttttctctataaactatctccagtttagtagatagatttactctctctctcttcatttaatctgttccaagtagaaaaatatgctgacatggatctcttgtagagagtctatagataaccattgcgggtgccctagaatatgaggaagtgaaattgagaaacacagccccaaataatgaacacagaacgatcggagcgaatcagttattccgtgcatcggtacatgcttcccgatgagatacatgcgcgagataacttaaaataatcaccccaagatgacatgaggttaacagaatcaaatcccaagaatacgggaactaaaaagtcaattcaaacctcgcaaaatggtagcgtcgccatgggcgcagtgcgcctgtgcctctgttggattacgggatccctggtggcctggttcagatgtgctgtcgtcctatctgctgtactgaagtgctgtgcagttagccatagccggaacctgttctgattcctgaactcctgattcttattttctgtgcgtgcacgtactccctacaaatgaaggtgtatggccggaatccgcgagcttcaaagacgacggctattcagtcccgtcgaggtggcgcggcaagtgcatcactggcaacgacacgaccttcaaatgcaacaagtaactccactgtccacagctgctcatcaagctgcatgcaactaatgcagtaaattttctggcgagaaactaacatgtcgtacatgcagcaagctgatcggcgcggggttcttcaacctcggcttcctagcgtcgggcttgctgcaggggaagccgccaagccaggctgcagagctgtacacgccacgggactacatcgggcacggcacgcacacgctgtccaccgccggcggcgggttcgtgccggacgccagcgtgttcggccatgggaagggcacggccaagggcggctcgccgctggcgcgggtcgccgcctacaaggcgtgctacgccgagggctgctccagctcggacatcctcgcggccatggtcacggcggtggaagacggcgtgaacgtgctctcgctctccgtcggcgggccggcggacgactacctgtcggacccgatcgccatcggcgcgttctacgccgtccagaagggcgtcatcgtcgtctgctccgccagcaactccggcccgcagccgggctcggtcaccaacgtggcaccatggatacttacggtcggcgcgagcaccatggacagggacttcccggcttatgtcaccttcggcggcgtcacgagcagcatgaccatcaaggtttgacaatacgaccgaccaaatcacactgtagtttgcgcacatgagaatacggcgtacttttgctcatgccattgggatttgggcaatttgcaggggcaaagtctgtcaaacagcactctgcctcaagggcaacggtacgcgatgatcaacgcgaagaacgccaacgccgcaaacgtaccgagcgagaactcgtaagaaatcaaaaactcagatatcatctcgacttgcaccgatcgaatcgaaccgacgtcgatttgcttgcactgctgcgtgcgtgcaggacgttgtgcttccctggctccctggacagcgacaaggtgcgcggcaagatagttgtctgcaccagaggggtgaacgccagagttgagaaggggctggtggtgaagcaggccggcggcgttggcatggtgctctgcaactacgccggcaacggggaggatgtcatcgcggacccgcacctcatcgcggcggctcacgtctcctactcccagtgcatcaacctctttaactacctcgggtcaacagagtaagcatcgctcatcagcacatagtactacttttcaggtgcaacacatcacagcatggttatatactatactaattaacgttactgctctggttcatgtagcaacccggtcggttacatcactgcatcggatgccaggcttggcgtaaagccagcgcctgtgatggcagccttctcttcccgtgggccaaacccgataactccccagattctcaaggttggcacattgctcatcgtattcctacagatactcgagagagaaagcttgccccttccaaataggaccagcagctgtgtgtgtatgctaacctggtggtgattttgcagcctgacatcaccgcgccaggagtcagcgtcatcgcggcttacagcgaggcggtttcgccgacggaactctctttcgacgaccgccgtgtcccctacaacataatgtccggcacctccatgtcgtgccctcacgtgtcgggcatcgtcggcctgatcaagaccaagtaccccgactggacccccgcgatgatcaagtcggcgatcatgaccacaggtgagcgagaaatgcagatcgcgatcaatcgagccagcgcaaacatcacataaactctgatcgatctcacgtccttaatatgcctgtgcattgcagcgatcaccggggacaacgacagcggcaagatccgggacgagaccggcgcggccgcgacgccgttcgcctacgggtcggggcacgtgaggtccgtgcaggcgctggacccgggcctcgtgtacgacaccacgtcggccgactacgccgacttcctctgcgccctgaggcccacccagaaccctctcccgctcccggtgttcggcgacgacggcaagccgcgcgcgtgcagccagggcgcgcagtacggccgccccgaggacctcaactacccgtccatcgccgtgccgtgcctgtccggctccgcgacggtgcggcgccgggtgaagaacgtcggcgcggcgccgtgccggtacgcggtcagcgtcaccgaggcgctggcgggggtgaaggtcacggtgtatccgcccgagctcagcttcgagtcctacggggaggagagggagttcacggtgaggctggaggtgcaagacgccgcggcggccgccaactacgtgttcggaagcatcgagtggtcggaggagtcggagtcggacccggaccggaagcatcgcgtgcggagccccatcgttgccaagacgacctgcgggtagcacggacggggtcgattcttttcgagtcagaactggaaactgaataactgttggtgttgtcacgccaaggtccacaagtcgttagggctaactgcctaaatcctaatggcaggagacttggttagagaggagaggatcgatttcgttttatctggcagatagatgtgagctatcgaatccagatatttgttctgattccgacggtcaagttgtttttgtgctactcgaatagtgtaatgcatcaatcttcatcttgttacgataattatatacttctcgtcgggccggcgaagcgccggccgaaatatataattacgataattatatacttgttcgttcttttctgccagagatgtgtcgctacatttctccatggaaatcagtcaaactttgaactgtataatttatactgtgttttatgctgtagtgttgcttggtttctcttttttgcctcttcacggaggagtgtaatttattttcctaccataaactgtgacgaacacatgcaacccctgaagctagtgatacatgctgacgtcttatttgatatgccataaatattaaagtgtaaatgagaaatttaaaggtgtaagatttgaataatttaaaatcgactgctttttagtacaaatgggctgtttggttaggtgccacatattgccacacaacatgttaggcatgccacagattgttagcttagcgtttggttacttgcttcagttgtggcaagccacactttcttgttccatggatatacatgtcatatacttattttctagccaaacattgtcacacttgtggctaacaaattgttggccacactatatttgccgtgccatacctatgataaattaagttgtggcaatgttaggcaacaaccaaacagaggggacccaaaaattgtagcgctatgatataggactcccatactttcttctagtttcggctgggactatttggtgggattcgtggcccaatctcgcgcgatggaaggattgtttttttttttttttgaacttgatgcaaggattgttaggagttaagaagaaa

SEQ ID NO: 11161 - DNA, 1134 bp, Oryza sativa
  unsure (1)..(1134): unsure at all n locations
ctatcctggtatgtgtggtttcattgcattagtgtattcgaaccatgttgtcctcctcaggagttatgactgttcatcttgtgtttttgattctagaacccatctgcactgccggggcctcgggaactggttgttcttcgtcctagcgacccatttcccataggagtggttaacagagaaggtacggtttccagtgaaacacatgaatttgtgctgcattccttttgcttttcacgtgttatcagtttagacggataatatgattgccgaagtggagtggaagagatgctcggtgttaagtttctttatgttagcactgcatagtaagaaaaaatgattgggacagcttgagtttagcagttactttagagttctgtcaacaacttaaatgttatgggtggctgttgtgcttgagatcacggtggacaactccaaatgatgataaatatcatcaatatgtacactttgctttctttaaaaattattaagcaatgccttaggctaattgcatgtgaagatgcaattcaacaatatgcatccagaagttacgctttcttaaacatcaattcagcagtgtggatttgagttcctacaaaaataaaattgtaattttaatatgtaattatcttgattacatgaaatttttggcagtcaacttctcttgtgacaaactgaaaagtaacactggacatcgatagaaggtgcgcaccaggaatcagtttttattgcttattttgcagatctctttgaaccatgtataatgcccacttccttagcacgtgaaactgaattatgcgctcgatctatttcatggtctcaacaagggttttctcctaactccgggtatgtctttttttaagtcgtttcatcacatcatttttgtctctctctagatttattcttcagcactactaggttcatttgcttatctggcctctgtacttttttttccctatatggattcagttgtctgttggctgtttgtactgttgatggtcatgtaaagctttatcggtcaccattttgtgaattctgtgatgaatgggttaaggtaagcatgttcacctaatgtattattaatttnnnnnnnnnnnnnnnnnnnnnnnnnnnnnnnnnnnnnnnnnnnnnnnnnnn

SEQ ID NO: 11162 - DNA, 776 bp, Oryza sativa
  unsure (1)..(776): unsure at all n locations
nnnnnnnnnnnnnnnnnnnnnnnnnnnnnnnnnnnnnnnnnnnnnnnnnnnnnnnnnnnnnnnnnntatctggattcgatagctcacatctatctgccagataaaacgaaatcgatcctctcctctctaaccaagtctcctgccattaggatttaggcagttagccctaacgacttgtggaccttggcgtgacaacaccaacagttattcagtttccagttctgactcgaaaagaatcgaccccgtccgtgctacccgcaggtcgtcttggcaacgatggggctccgcacgcgatgcttccggtccgggtccgactccgactcctccgaccactcgatgcttccgaacacgtagttggcggccgccgcggcgtcttgcaccttcagcctcaccgtgaactccctctcctccccgtaggactcgaagctgagctcgggcggatacaccgtgaccttcacccccgccagcgcctcggtgacgctgaccgcgtaccggcacggcgccgcgccgacgttcttcacccggcgccgcaccgtcgcggagccggacaagcacggcacggcgatggacgggtagttgaggtcctcggggcgggcgtactgcgcgccctggctgcacgcgcgcggcttgccgtcgtcgccgaacaccgggagcgggagagggttctgggtgggcctcaaggcgcagaggaagtcggcgtaatcgggcgacgtggtgtcctacacgaggcccgggtccagcgcctgcacggaccttacgtgccccgacccgtaggc

SEQ ID NO: 11163 - DNA, 1307 bp, Oryza sativa
  unsure (1)..(1307): unsure at all n locations
nnnnnnnnnnnnnnnnnnnnnnnnnnnnnnnnnnnnnnnnnnnnncttgctggggggagacggtcagctactagtgagaacggagcaaggcggcagcggcaacggagtcatagagctcaagcagtcgcctactcgcctcactcctctcacctcacgaccggagtgcagcatcgagggcggtgcttgggcaaaacacgatgcgacggctcctgtctcccaagcacaacattggctgcgtgtaggacagaaacggatggctcgggccttggtgacattgtcggcctcgacgcctcggcagtcacaacaacgacgaccatatcctcctcctcccttgcccttccctctcccctaccagcggcaatagctgcacaagcacgagccatacaccccccgccccccgcccccggggtgtccagcgttggagatcaggcgaaggtagaggccaaacacgtgtggtgcagggcgcaatgggagtcatcgcggccacaccacatgatgcgacggctccgggggaggacgagcgtcacctccaagtctttcggcgttggggcctccacaacaccctgtggagggctccaggcaccatggagacgctcgtttgcatctgttgtggctgtcgaggcaggctagcatgggatgcgcatggagcttgatgatggtggcgttggcttcctcgcctgcaggcgcggtgaggtgctctccacgcaggagctggcctcgtgctagcgatggccaaccggtgggaggcggtcgtggtggtggaagtcgcctcacacagccacaaacgcatcctctctagttgctcaccgctaccgtcgctttcaaggaaacggctgccaagctcgagctcatcagctccttttcctcctccgctgtggaccaccgacaccccttcgccgttgacctccaactaccgcttccgtctcccatgacagactcatcggtcgttgtccctctcctcatcggcgagctcctagagaagagacgggagagttgaaaataggaaagagtcgataggtagaagtccacttacattttttttggaacgactcacacgagacggtgcgaggttctattgatagagtagtaaaaaattacaagattataaccctagagagtcataactaggaaaaggaaaaaaataccaccacccacacgccgacatcgccaacacacacgcccaggagaaggctaccaccggatcggccgccgctaagcgtgaccgactgccactagaccaacaaagggcacannnnnnnnnnnnnnnnnnnnnnnnnnnnnnnnnnnnnnnnnnnnnnnnnnnnnnn

SEQ ID NO: 11164 - DNA, 894 bp, Oryza sativa
catgcaaaattgtgcctccagcattatagtgactccgcactgctatcaccacttagccactcacacatgtgttgttatttccaagcaattagcttttgtagacaccgttaggcaagtgattgatcactgatattgcctagcagagtagcagtctctcaagtcaaaagaggggagaatcagacaaatgctcagtagcattcacagatctgatcattcactgcaaacacaattttcccgttattccaatcgatctgtgaaggcacaagatcaatgcattacaattcatgagcacattggtgcaacttggtgtgtctgcatgcatttgcagttgcagcgcgcacaaaacaacgccaagagcaagttaaaaaaaattaagtgcgcggccgttagggatactagggttcccaactaaaccgaactcgacatgtacatggagcaggctggaagctaagcctgaccctgattggccaccaaacttgttgccgaggccgtgcgcgcgcggtggacgggtggtgctggtggtctccgcgctacgctaaccctgcatgctttctccggagcacgctagctttgccccccctcccctcctggacggaacggacacacccctcgctacatcattatccttgcggttgtagccagcctcgatcgagcactgctcttggcctcttatctctatctccctgcacagtcatactgctgagaactagctgccatcatttggcacgagccttcaagccactctaacgagggtcacggcactagctaattaatcggtacaggccagagcacttaaattaagtggttttcagatcgttttcgcgctacaagctgcgttggcatgcaagaacagcatgaacaccacggatgatgtgtgccgttattgagaaattc

SEQ ID NO: 11165 - DNA, 5049 bp, Oryza sativa
  unsure (1)..(5049): unsure at all n locations
nnnnnnnnnnnnnnnnnnnnnnnnnnnnnnnnnnnnnnnnnnttgatgctcttcttcttcctccgcccaccttgcccgtcatcctccgacgactgggcacgcgctcatcaagtcagtcagcccatcgacaaaattaatcaagaacacaacgactagaaagagaagttaccgagctggagctggagctggatttgccggagcggcgcaacgtctcgccgagcgtcgtgtgcccctcctccctggtggtgggctggagctgcccggaggcgcccgtgacgccggcggcgctgaccgtgccctcgtaggcgaacgtcttctcgccggccgggggaactacgccgccgccgtcgcgcgtgtacgcctcgcctcctggtgcgacggcagcggcggctgcgccgctcatcaccgcgctctcgtgcgggtgcggcgcctccgcgccggcgaggccgtagtcgccagtcgacaccgcggggtccggcggcgccacgtaccccgcggccgtgtcgcgcggcgccggctcgtccgggacggggttgccgtactggtcgaccggcggcacagggttcccgtactggtcgacgcgcgggtacgggtgcccgtacactcccgtggcgtgctccgccattggttggtgtcgtcgagttgcttcctcctcagtttctaactcggttaccctctttgagccatgagtgatacgagcgatcgagctgatgggaaattggatgatgatgaagcggaagcggactcgtatttgtacgaggaaacaggaggcgacaggcggtatctgcagccctgcaggcaagccacgtgtgccctcgtaaggacggcgcgcgtgaccggagaagggcacgtaagcgccgggcgcgccacgttgcggcctgatctctggaaggttccgggtgaacagtaaaagggtacactttgcccgggcagatagccatcgaagatctcaagacctgattataactatccaaattacctctaaagcatcaaaggctcgaaaatatcgaagaatattgcgtggctacatggaccaaacatcggtcttgcaacacactatccacatcgtaacatctttgctggaatgctggacgcaacgaatatcaaatgctcctacagaaaagcaaaaagaatcacaaaatgaagcctcggcggagtggtgtcccttgtagcgatgctgccgtgctgctcctgagtcctgatcaatccgacggtgttgcttctgcatcgcgagcctcaacacgcaggctgttctcgcgccggcaatgcgattttgcaccctggtttcacatggaaaacgggatccaaatctcattatgattttgcaacctggttaaccaatggaaaaatacgaggatgtttttcaaatcaacatggcaatatagcattagcaattagcttgagtgcttgacatgaagatacaaaagactacatgaaagcagaacgcgcactgagtctgaaaggtaagcaaaatagaaaaggacatcaagaaaagagagaagacgcgtatgaaaccattcatatagttcgtaacctccgacatgttacatatgccaatcatcatctctcaccctccaaacaaaaactccgagtagttctctgaactagtttcctatataaattgccacctctgtgacgatttacaacggctttacaaaatttctccacagaaacaggccacggaaacatatttgttccaaattagtttcaacacaaacttcaatgttttacggtttgcaaacaagatttgccagaatgatcggtatcaagtcctggtgattagagcaatcctcctttgacctaccatagtagctggagaagatagaaagatgaagcaaaacttacttggaatattgtccccagctttttcagtcctctagctcgcaccttcagaacatctttggaaacagtattctccctcaaaacctgaagtcaaaatggttgccacgatcatccatatttgtatgttatttctaagatatctcaaaattcaagcatatcggtacagtactgcaaaacatgaggtaaaaactgaggtggacaatgcttactgcttggcaaacacgagaaagcgttgattcaatatcgactacattgattttccacagagaattcaacattgcgtcttttttctcctcaatactcttcataagctggccttccttgtcgtcgccctcaatcttttttataccttcttgtagctgtatcagagaaattgcacctacagtaaaagatcagactcatctttaacaaaagagggatgtagaacaccgagggtcagactcattaagaagtattataggtgatgtaggaaaaggtagtacagcatcctatgatgtacctgcggccgcattaacctgtgactttacgtggtggcccttatctcttacccattcagctatgaacggcacacccatatacattttgctttttccaagctctcttgctgcttgacgagcataaatgtagccaatagtgtggagcatagcctcaccgaaagctgaaaaatcaattcataacagacaccaaggaattaaaacaaatgcaatcagcaattcagtataaggcataatagaaaattcagtggtatgagtgtatatactgtacatacagcagcaaaagttgaatgaaatgtccatgcttatcaaaaaatacaacagtgcaaatgagtatgaagatggagggcaatacccgcttgagaaagacgctgagcttcagcacctgcccaatcaccaaattcatcctgcattccatcaacatatggttgaagtcgatccttaaggctttgaacaagcttttgctctctttcggtttgcaactcctgtaatccagagatattattaaggcctaagcatgaattatgaactgccaaccttgaggagatggatactagaaggctgggagcactactagataacatctgttgtgcaatttacagagcattactggagcatcatacttttatcttatcttgaatccttgcccttgcctctgtattatctgattcttcctcaatctctactgaagctacagatgccagtgcaaactgaccaacataatcttcaaaatagtcgctcccaaaaagcattccaaagacagcagttggatcaatcatgttatccctaaaaaagccattttaaaagttcaatagctttatgttgataataactaatacaatgtacatgcagcatgcagctaaaacttcaaatcgcttgtgcaattgaattttgttttacaatttggccgatccaattctatagaaacaaagaatttggagcttaatttctatctaggttgatagaatagtgacagaaatattcaagacttactgtggaaggccttcttttccatgcttgtcataagaatcctttcttacaggatcactgagtatttgataggcctcacccagttccttgcagaagtaaccaattttagttagtaatcctcctataaaggtagtgggtgaattaataaggcctactgatagggatgcaagcgggccgacccatgaacccgcttataggcaaaattagtgagcagtggcggagccaggataaaatatagtgggggctccttagtcttttgagccttataacaatctcagacaaagtttattttagcccccttgcaatagatatatggatttaaattttagggggggtctaaagaaccccagcccccacactgcctccgccactgttagtgagtaacccgcgggttacctactaatttgacctataaatagctttatggattgatccacttatatctttacgacgcggcaagccgagccatgacatgaatacccacggattaccttttatttaacatattagtaggttcacgggttggccggtttgcatccctacctactgacattaagaatgcaccaacataaggcattaagagttttcaccggtttccctaattaaccgttgtaagatttttgtgtccaatttttgtttataaactggataactctcttctaatagtgaatcgcatgagctcatgcctgcccttttcggaggtttccctcgaaaaaaaaaaggtagaacagaaaagttcacaagagaacagaagtgaccagagctaccaccatctctttggttcagtcgtcttatcgtctaaagccattacctatactgtttcctttcctagaacatcgaactgtgacgcacacagcgcaaaacagaagcgaaaatctaccttgaacctccgctccgcatcagggttattgggattcttgtcagggtgcaccaacttggcctacagaaacccaaacattgcaagaacagctgaaaccatgaacccaacaacaaacattgcacgaaagaaaaaaaaacacaagaaaaacaaatatgccagcgttctcgatctcgggccaagaaccacgcaccttgaggtaatacgccttcttgatctctgccgcggaggcgtctgtgctgacccccaagacgtcgtagtacgcgctgtccaccaccatggcttacgccgcctcttcctggatcgtgctgcaactgatcgtcggagcccgacgagaagatcggttactgggagagagagagaacaagccagtcaagaatcggaaatgccgaggagagtggtcatcatctgacctggccaggagggaggagttgagcccggagatgatgggagtcagttgatgcgatcgatcatgtggtcaaatccgggaaaggttcctgggtcggaccccacccactgcctcgtcctccacaatctctcgcaagtgcttcgctttcgaggctgctcccgttggctgcaacctgcaagggaagcatcggtgtctgtctgtttgctctttccagcctccctggtgtgggtcatgtgtacatgcagcaaacaacatctggcctgccacattatgctctacaccctgtatctcatattctcacatcaagtagtatatattgcccgctttattgccaagagttacagatgtcacatgttacacggggtgttacattatgatggcaccaccacacctagcgcaaaccagccatgcttatttaagcacatgttttagaagca

SEQ ID NO: 11166 - DNA, 7557 bp, Oryza sativa
  unsure (1)..(7557): unsure at all n locations
agcgattggttaccatgagtgacatcccaaaatgatgtgggcatggtgaagaatatttccggcagcagcttgtcgaccgtcctcccgcaacacgcgcagtgccatgttggttgaagaacagggcacagccgcatcgacgctgtgcatcttgacaatttgtgagcttcagctgggggagtagcaggattgctaccactgcacatggcaacatctgcggactcgaaggggactggtgcattgcagtaggtgcagtattcttcaactgagtactcgcacactgagttgatcctgcatggcgcaaaacagttactgaacaggttcaacatccaattttactttcagtgaagccatttcaaggcaattctactgaactatcatgtggcatatgctctatgccgtttcacaagtgaaatgatgttagaaaaatggtttacctgtctcctagatcattgatcctcgttctaagaaatttgagctcatccctcacttctccatcgttcatggatgcccaagagtccatctgggcaactccaacaggaaaccagctgttttcagcaggggcacccttgagcaaatatgctgttcggttgaggacagcagcaaaagtgaaagccacaagcctctcttgcagctccctttcacttcttaccagaagattgttccacaaatcagccattacatcattacctttttctgcaccaggagaatactgcggttgatcactaagcattactttcctacatacgatattcagcaagtgcaacttccgcgagctgactttggacatgttgtgaattgaatgtgatgggatgtcgatagaagcacaatgtggatcatctgaaaacaaacctgacacccatttatgcatcaatgtctcaagaaaggtaggtgcagatttcttaaacccttgtagtgcagcaatgagatcccataagacaagcactgtttcacaattctcatatttcttcagtgaccaaaaaatgttggatccccaccacaagaaattagtctcagataaggcggcagactgaagactgaggataacgctattgtccaatggaataccaaggaactgaccaccaatccaaatgaactcaaccactgccttttgtgtcctgttgtttttattcacaaaattattgtgatgacagtggattttctaaatgttagataaaagaaatcattaattagatccaagcagacctcactacttcccataccgaactcccaaacaaaattacctggcctgatacatctgatttaacaagtttgagtccaagctgcgcacctgaaggagataacattcataaattgttttagcttattatatatgaaagctcaagtacaaatgttgcacagttaagcaatatgcgtcagatataagagatagcctaaagcataccacagcaatcattagttctccaggtgctagtgcaaggccataacatcgatcggatacttctgtgagctgcatgcacatttcagatgtcaaccagaagaaaaaacttgcatgttcaggataaagggttattgagtatatgttttacatctacggactctttcagctccggaccatctgtgtgcagaggaatttcttctagatgtttttcgttgaacatccaacaatgtgcagaattatcctgacaaagtagcaaggctttatgcataagcaagtaacaaaaggttcaagaaaataagttaacacagtgcgcaggattttttgaaggttcaagaaaataagtcaacacagtgcataggattttatgatccagcagcagaacataaaatataactttcagaaaacttcagctttccaagtcttaactaacacaactccaaaatactacagaaatcaatgtctcccgtcaatctgccatcagttatttatgcacgttttgtaatcagcagctagtaatattgcaaagacagagatcgtgaatacactgagaacatagaaaatagtttacactttaatagaaaagttaacatactgtcaacggaactttggttttatttaaaaacaaaatcagaattaattacaaagtgcaacgaggacataaacacacctgactgcagctgtataaacaatgcccatgaaaaccccatgacagacctgtcacctatggtgatgttagatattttttttcttttatcaagatgtaaacatactaaggtaaaatgaaattttaccacttgatcatgagcgtcacatgcatgaatcttctgaattttgttaccagatatgttccacgaccatgcttctagtgacccagatgctcttccaattgccagattaactgagtcttgatgctgagctggtgcagataatgagattgacgagactggtgctaatgaatcagtagtgacctgacagtacaacgtttggagcagtatatttaataacagaaaggcattagctggaactagaaagtgcaagatgggcatttcaatctattatattattaagatagctttgaaaggaggcatcacgttcgctgtgggggctagaaattcccacattaatcggagaaaaagagaaaaatattaaccgttgtattgtgatatgactagattttaatggtagagatttaatgacagtccatatgtaagtttgacttgatttgttttgttatttggaatctgatataatttgcatattaccatatgtaagtgttggaaacaaacacaaaaatagaaaactagctttagctacataagtacgaatttgtgtccgattcccatggatgactgcctaattcccagctaaatatcaaagaaaaataagcagtcacctctaataatcagactcttattagtgtttattcttaagccaactaaactctggcataactctatttagaagtagcactttccacactgggtgtcagaaacacataccaacagagagagtttgcatgctgcagagaaaaacataaacgatagtatatgcatacagcaaagcaaacaatccgagtactactattagtcctcactttggacacatgttgttccgttctaaaacctatatctatacctaataaaaaaatacgcaaggatttcgttttttatcatggtccgtcggtttaattaacacagacaaacgttgtggggattagaaatttccatatcaatcggagaatagtccatatatatcacaatgcaagattaaattaaaattcaaaataaaaaataatttctgaaatgacaaaacgaaaaataagaattcaactagaaatacaatttataaataactaaaattcgtaataaaaaataaatactattggaagaagagacatctagaacacatgacaagattaattaaaattccaaataacaaataaaataaattctgaaaatagaaaaataattataagagttcaaataggagtataatgttgtaaataaaaaatatcggaatgaaaaatatggaatttttttaaaaaaataaaatctagaacacagatgacaaatgtcaataaatatgggagaagtaacatgtttgtaaagaagtagagtggtgacggttaatgggacatctaaaaactattaataaaaccccaaatagaatcctactgaatattaaaaggagagatgacggacataccgttaaacaacatgatcacgactgttggcgggacttctaaaaggtaaaaaataaacccaatgataaccatgtttgattttaaaatcttaacgacaataaagaggggaggctgtaggcgagccgtaaaggaaagtattatagtggcaaagtcacttatggtttgacagaatttctagaatgtaaaagaatccaaatgataattatgttctatttttaatatcccaatgtgacaataaagagagaaagcagcggacaggctgcggaggagtatagtgtcagtatttgacgggactttaaaaattataaaaataaaacccaacgagataataaactctaaaaagtaggttcggaacttctaaaaagtaaaaaaaaaacaatgatgataatgttcgatttaaaatctcaatcacaataaagaggagaggcagcgggcgagccgtagaggagtactgtgacatagccgctggcggtttggctggacttctataaagtaaaaaaaataaacccaaacaataattatgtttgatttttaaaaatcccaatgacaataaaagcggaggcaacggacgggccgcagaatagtataatggcagcatttaacgggacttctaaaattataaaaatggaaccaatgagacaataaactctagaaattataaggcttaatttttaaaggttctgagagaatgaatagaaatagtggtagatcgagcaagcaaataaagaaggggatgacacaagtaagggtggcaactggtgtgattttaaaaaactataaaaataatatagaaacaaggggacaataaggtttggttttcaaaatcttaagacaactagatacctgcgcaattgcgcgggttacccagctagttttattaatagaatattggatattagtcatatatcgaatcaaatatgtatatcaatagacaacacagggtaatggtaattatgtacctcagccactaatgtcaagggcacttcttttgcgcatgtacattgatttaacccttcaatatcacccagccatatctttgagctgaaaaaaccccagaaaacgaatttgaaaggttttgagtaaaacaggtatttgggaggattaaggaagcatcacaattttagtggtttatgcttaaattgtcgagagagagagagaaagagagagagatggaaccatggaagagcaaattcaagagttagctgtcacatagtatgacaaaaatgtaaaatcctttacagtggtgacggaagttgtactgaccttccatctgagcatccagttgccaaaagcaacaaaggttttgaagagcctgaggaaaaaagttcccaacttatggcagtgacccatgataaatgagcttgaacaaccccgatcagcattggatctctagtaaccatgccgatgtctattgtgtagtattcaggtttgtgtattttccaaaaggaaacactcccagacttgcaaccaacagcaagaatgcaccaatgtcccgtgaaataagaacttctgtcaggtgatggtagaactggagaccatgcaactacgagagaagacaaaagtgcttcacgacatgaatactgttttgccgtaataagtgggagagatttgtcttctccattgcagtatgatggtgtctgaatattttgagtgttgccctgaccatttctgacagcatcgtcaagtccaggtctcgtgacctacaatcacaaccaggtaaaagatacaggatgccaaagaaaaaaaaatcatataaaataggctatgtgcgagtgtgatttaacagcacaaatagttctctccttagttatgaaacaaggtttagcttttaatgttaacaactaatgggcatacactggggactttaacctaaatgtgaacatgtaaatcctaccttcttcagtgtatttttctttaaattagagattggatccaatgaaaagtctgcatcctttggatcatctacatcgtccttctccgatgtttttttctttaaattagatggatccgatataaagtccacatcctttggagcatctacactgcgcttcttcaatgtttttttctttaaattagagattggatccaataaaaagtccgcatccattggagcatctacgccaccattatcctcatgataaacaaaaccttcaaatctaaaaaatgaaacaaaataattcagacctaacatacgattataggccaaaaatagcttcttgcaaaataaagttagtgcgaaaaggaaggcattaatcagtggcggataggttgacatatgaacaattggcatcctataataagcttagcaacaacccatagcaaatacttactacagtttttctaccagtaatcgtcagtaattcagtacttcaactgtaaaaattagcaaacaagagcctctaaattatcaatcttattccaaaaccacacatggcaagtgtgtcgtgccaaacgaaaaaagaattactttatacaaccacattataagcagcctctcgccacctaatgatagaaaataaaatggcctttttgcaatccttgacacatttgtctgctcgtctaagtcaaagactgtcaggaaaggggaaactgagttgctatcattgccattttcagtttgttggagattatcttcaattttccctggctaaaattaaacctgattcaaatagcacatgcagaatatttacccattgacaatgtaccaccagagaaaccaagtaagtgcactaggccagtctgccagtgttaagcatagatctttctctggtaaatacattttatacttctaggcactcattatctttttttgaacgactctaggcactcattatcatacatcaaattgtaagcatagaacccatcatcttatttcttgaactaacccctttggaccatcttgttatcttaaactttgatggccagcaaacagaagagtgtgactcaccttgctggtttcctttttctccgttctgtacccatgctcagaagaggctcttgcagtttaccaatacacatgacttgctggttttgttcagtattttctttttcctgacacagaagacaaactttctgtaagttaactcaataacatatatttctgcctcacaaaaaaaaaattttctgaggcaaccaatgaaagggagacactggtgatagagtggatggatgggagaatacctgaggaagtgaactaggaccatcattttccccaaattctatacctttgtaaaacttaaacagcaatcgagatatatctgcaacctagaccaatagatttaagttgacaggcagaatatgagaaaactaaagaacacatacaccctgagatatcctaagcatatgtaactgataggttcaaatgattacaagtggtgaatgaaaataaatattttatctaatggcaaaaggaaaaggaagggacatgacaaacagcaagaaaaacacagagaaatacaaacaaaactgccaaaaagaatatcttcttttgtctgtaatcgaagtcagaagtagtactgaacaaacggttgaatgtctactaggtggtgcagtgattgttaagcttattttaactgcattgcctgtccaatatgttttcaaattcttagatagtgaaaaaataatgtagggggctgcatggttgcatgggacatggcaaattggacctacatggaacaaattactgttgcataacaggaatttggcaggccaatcaagctgcccagctatcaatgtttatacaaattaagttagtcaataaactaaattaataatacattaggtgaacatgcttacctcaacccattcatcacagaattcacaaaatggtgaccgataaagctttacatgaccatcaacagtacaaacagccaacagacaactgaatccatatagggaaaaaaaagtacagaggccagnnnnnnnnnnnnnnnnnnnnnnnnnnnnnnnnnnnnnn

SEQ ID NO: 11167 - DNA, 1076 bp, Oryza sativa
  unsure (1)..(1076): unsure at all n locations
nnnnnnnnnnnnnnnnnnnnnnnnnnnnnnnnnnnnatttaagttgacaggcagaatatgagaaaactaaagaacacatacaccctgagatatcctaagcatatgtaactgataggttcaaatgattacaagtggtgaatgaaaataaatattttatctaatggcaaaaggaaaaggaagggacatgacaaacagcaagaaaaacacagagaaatacaaacaaaactgccaaaaagaatatcttcttttgtctgtaatcgaagtcagaagtagtactgaacaaacggttgaatgtctactaggtggtgcagtgattgttaagcttattttaactgcattgcctgtccaatatgttttcaaattcttagatagtgaaaaaataatgtagggggctgcatggttgcatgggacatggcaaattggacctacatggaacaaattactgttgcataacaggaatttggcaggccaatcaagctgcccagctatcaatgtttatacaaattaagttagtcaataaactaaattaataatacattaggtgaacatgcttacctcaacccattcatcacagaattcacaaaatggtgaccgataaagctttacatgaccatcaacagtacaaacagccaacagacaactgaatccatatagggaaaaaaaagtacagaggccagataagcaaatgaacctagtagtgctgaagaataaatctagagagagacaaaaatgatgtgatgaaacgacttaaaaaaagacatacccggagttaggagaaaacccttgttgagaccatgaaatagatcgagcgcataattcagtttcacgtgctaaggaagtgggcattatacatggttcaaagagatctgcaaaataagcaataaaaactgattcctggtgcgcaccttctatcgatgtccagtgttacttttcagtttgtcacaagagaagttgactgccaaaaatttcatgtaatcaagataattacatattaaaattacaattttatttttgtaggaactcaaatccacactgctgaattgatgtttaagaaagcgtaacttctggatgcatat

SEQ ID NO: 11168 - DNA, 652 bp, Oryza sativa
gctcatcatgtaccctttctgcagctgctcatcaacctgcttcttgacctcggctaattcgttggccgccattctgtacggtctcttgtaaattggggcggttcccggtgccaagtcaatccggaatcaatctctctcttgggtggcatggtagtgaggtcttcgaggaacacttccggatactcgcagactatgggtatatcttccaatttcctcaaattcttctccacggtgtccactgggatttctgcttcaatctgattcaaagagaccccttgctttggtgagactagtgatttgtacaccacggtttctcccttctcgttggtcaaggtgactgtgcgattcgcacaatcgatgacccccttaaacttggtcagccaatccatcccaagaatgacatctaggtctttggattcgagaagaatgaggttggctagaaatggtgatctttgaatttctattgttatagaagggctgaattgaaccgaagtggagctattccctggggtatgaacccgcatcggtgtgctaagttcctctcttattaacccatgcatcccaacaaacttctttgaaatgaacgaatgcgttgcaccagaatcaaaaagtactgttgcagggattgagttaatagaaaacgtacccagta

SEQ ID NO: 11169 - DNA, 632 bp, Oryza sativa
ggtgcatatcgcgcgaggcgattgaactcgtggaggtactctgtcacagtcctgttgccctgatggagtgcccggaattccctcttcttttgtgccacaaccccatctggcacctgcgccttcctgaagctacggcagaactctacccaagtgacttcagtacctggtgggcgggtggccatgtgattgtcccaccaagctgacgcgggaccttgaagctggtgtgtggcgaaagcaaccttctcctgatcattgcattgcaggagattcagcttcttctctatggcatggagccagtcattcgcctccatagggttggtggtgctggagaaggtgggtggcctgacacgtagaaactctggcaacttggactgagggggagggggaccaaactgttgatgctgctgttcggcgtgctgcagcatccgctggtgcatctgctggtgctggtgctgcatcatggctgccatcatctgggtctgatgtgccattacttggactagcgtcggattctcgggaagtggtggcggaccattgccggaatcgctgtggggatgcgccccatcagtgcgctcttcgccgttgctgccctcgcctgttgcgcggctaccattcctggtgtagaccattga

SEQ ID NO: 11170 - DNA, 635 bp, Oryza sativa
tacatagtccatcagagatggaatcaaaagcatgcaaccgttgtggagaaattggacacattgctagcatgtgtctcacactctgccctcattgtggggaagaccatccaccaggtgaatgtcccacccgcaaggtcacatgttttctgtgcgaaggtacaaaccatgtgcccaaggattgccaactcagtgtgttgttgaccaagaccgcagaaatccaacgaacaaccctacgattgtctcatcagctagttagctccaacagcaacatcgacgatatcatccacagcaccaatgctcctcctgctgcacctgactctgcaataaatcatagcaataataccttcagcaccaaccattctctgcaccgacagcctcagcaaagaattgtcatcgatggaagaagttgtgtctctccccgacctactccaggccgagcaaagggcaatcaatctcaggagggcgataccaagcagaagaccgttctctgcttcgaatagcaatcagaaggaagcttctcctgtgaatgatagcaatatgcagtcctatcacatcatcacagaaccaatcaaggatgcagtcactagaacaatgccagctatacctctccagaatcagaatgagtagccatgttt

SEQ ID NO: 11171 - DNA, 693 bp, Oryza sativa
gttcacacacatgtaagcgtttggaattttggatagaaatttcgggcgtgacaacatactcctgaattgatgtaagtttcatctcccaaataaacatgtcaagaccattcaaaaagtgacgagaaacctcagattgtgtgtaattaacatcataagaacaatcaatagatctaagataactcaaaattttgttaaacctagaaagatagtcatccaaagcttctccaggtttcatctcaaattttatatactccttttttaaaagatcccgatgaagttctttaatattggtaattccttgatgaaaattactcaaaacaatccaaatctcattagcggtttgaagatgagaaacacgatcataatccgaacgagaaatcccactcaaaagaatattgcgagctttgcaattattttcaaattcaatttttaaagcagcattattaatttgatcaggaatcacataaggattagaaacttttctccaaatatcaagatcctcagccataatgtaagattgcatcttactacaccaagaagaaaaatccgttccatcgaagacatggggcgtagttgtaaatttattagccatggcaaaacaactctagatcagttaaaatccaaagaagaaaacaatgctctgataccacttgttggatcgaaacacaagaactaagccaatgatgaactact

SEQ ID NO: 11172 - DNA, 707 bp, Oryza sativa
ctgcaagtagttcatcactctcatagccagatcttaagggatggcttaggtaggatgaggatgtgaataaaactatcactgaagattctctaaagttagctcaaggtgagtgtgagacatattcaacgagagcatgaaccatatctgtgatgactactagctagtagccaatatattatatatttttgactcaaatccataatggttgccagtgcactgtaaactacattacagatttaaatccattttaacaagatgggttggatcagaacatatcatcttttatggtctaaaacgttataaaaatgaaattaattcatgtagtgctaatatgtttttgacatcaagtttcaaaagatagtataagaaaagttgccaatgtagaaatgtatcagctttcacgtactgggacaatatattgccgaagcgccgcctctctgacagggtgaatcctggctgtccacaatcctgcagagtaggatgcaagagatttaattgcatcaaaaggctcaatagtgatccaataggacttctattttgtaacaggcagtatgccagctggtacaatagcacgtgaaaggcacatttaaatatatatcacattctcaagagcctaggcatatcagtattctaatggttgcctaggtaggctaggcagcgacctttttagaacagtgatgattcaagtaaaacatactactataata

SEQ ID NO: 11173 - DNA, 2551 bp, Oryza sativa
  unsure (1)..(2551): unsure at all n locations
aattttgtcgatgggctgactgacttgatgagcgcgtgcccagtcgtcggaggatgacgggcaaggtgggcggaggaagaagaagagcatcaaggagaagataaaggagaagcttcccggcagccacaagcaggaggagcagaagcaagctggccacacggctccggcggccgggacggggacggggacggggacgcatgcagcggggaagcacgagaagaagggcatcgtggagaagatcaaggagaagctccccggccacggccaccactgagcgagagctcgcgcgcacgcactttcatcggttgacgttcgtgcaactgtccatgcatgtatgtataataccagtcgtgtttcagttcgttaattttacggtcgatgtgtggtctcggtaaaactaggtggtgtacagtgcgtctatgcatgtacggtgtatccaataatccagagtcagatctcttttaattatcctttataacgagtcacgagtgctttacgtttcgcaccaaaaaattgtcacctggcgaatcgaattcctctgagacaaccgtgcgcataactgatgatggtgtgagacaaaacgaatgtactatatgatacgtttaggcaggaccgccgattgatcggttttggtcgatcccgacgcttacaccatggacggtcactgcgtcaagtggtcaagccgaaacaggagccgcggcggtggcgcggtgcgacggacgggaggcgaatcaaaacaactactggccgcagccgcagcccgcaagtcggagtcaagacgaactggtgggccgtaaactgaacaaccaaacaaaccgccaggaacgaaacacagagtgcgccaaccacattgcgcgcgcaacaagagactgagcggccccggcccaggagaatttgacacggcattcactcacaacttcacgccttccgctgtttcccagcgttggctttcggtagacaagtagtggctttccgtgatccgcgtcgtccatggcgacctctgtccggtggacggcaacatcgttctcggtcacagggtaagctcatgcagaccactcatggacaggttaatacccggcgtcaggcgtgcaaggaccaaggagtaatggagtatacagcgatgcactgaccgcagtatgcaatgccacaagtgtgtacggtcaaatgtttgtcacggaacgttgtcatgtttttgtgttggtactcactcccgtaaggagtacatgagccggccatgagtgtaggtgggaacacctaatttgcctcgtcttataccgtatttgttttgactgacgtgcgttaggtcgcgagaatctatccctggaaatccgttgtgtggaatttattttagagaagtatctcattctcaatatttgcttggtttacgtagagcatggaggacgcgagtggagcacacggaattaatgtgctgtaaagtatgtgaatcagaagcagcatacagttgagttacacttgatagtaatccctccgtgctcgtactcgtaaaggaagttgttttgaacagcgatacggtctccaaaacatactttgacttcttatttctataaaaatatttatttaaaagtgatatatgtatatttttatgaaaggattttcacgacaaatctattcatataatatttatattttcaaacttaacaactcaagagttattcataatttatattcccaaggtttaacttaaacattgtcctataaatataaatataagaccccctataaagggattgatcgaatcacaattcataaccagagccacattgagagataatccaaagaaaaccaaagcctagttgtcgtattctactcatctagacgtactcgatggattctatttggcatgttagagtagcctacagatcaccggttgtaacatgtgcgatatctttcccagtaatacatataaactagagtagggttattactcatctcaatgacccgaaccagtataaatcattgtcccttgttctcttaatatgatatcgtgtatattctagtaccaacgacccctatactctagtacggataccattgttgtatagcccctcgagataacaaaaaatagtacaaaaatttccacctttcaaccaggagaacatgccactagtttgtcttcgatccgtagcggctatggtgcagacggctaccggaactatggccgatgcaacggcgtgccccggcagccagctacgatcaagccgatagccagggcgcgcggtgcggttgcgcgcgacgtgacgatcaggattgcgaccgacgttgtggccaacgcggtgacacaacagtcaactttacggtccacttggtacccacaacgcgtggtccgattacacttagcatgttggctaggacggcagccggcgctacggccagcgcgtgcagtgcaactactcaacaacgacgggacggttcagcggcagtgcggcaacacagcgactgtcttggcttttggtgtcccggtagcttgtggcctatnnnnnnnnnnnnnnnnnnnnnnnnnnnnnnnnnnnnnnnnnnnnnnnnnnnnnnn

SEQ ID NO: 11174 - DNA, 2201 bp, Oryza sativa
tcttccccatctccacctctccggctctccccactcctccataggagcttgctggggggagacggtcagctactagtgagaacggagcaaggcggcagcggcaacggagtcatagagctcaagcagtcgcctactcgcctcactcctctcacctcacgaccggagtgcagcatcgagggcggtgcttgggcaaaacacgatgcgacggctcctgtctcccaagcacaacattggctgcgtgtaggacagaaacggatggctcgggccttggtgacattgtcggcctcgacgcctcggcagtcacaacaacgacgaccatatcctcctcctcccttgcccttccctctcccctaccagcggcaatagctgcacaagcacgagccatacaccccccgccccccgcccccgggtgtccagcgttggagatcaggcgaaggtagaggccaaacacgtgtggtgcagggcgcaatgggagtcatcgtggccacaccacatgatgcgacggctccggtggaggacgagcgtcacctccaagtctttcggcgttgtggcctccacaacaccctgtggagggctccaggcaccatggagacgctcgtttgcatctgttgtggctgtcgaggcaggctagcatgggatgcgcatggagcttgatgatggtggcgttggcttcctcgcctgcaggcgcggtgaggtgctctccacgcaggagctggcctcgtgctagcgatggccaaccggtgggaggcggtcgtggtggtggaagtcgcctcacacagccacaaacgcatcctctctagttgctcaccgctaccgtcgctttcaaggaaacggctgccaagctcgagctcatcagctccttttcctcctccgctgtggaccaccgacaccccttcgccgttgacctccaactaccggttccgtctcccatgacagactcatcggtcgttgtccctctcctcatcggcgagctcctagagaagagacgggagagttgaaaataggaaagagtcgataggtagaagtccacttacattttttttggaacgactcacacgagacggtgcgaggttctattgatagagtagtaaaaaattacaagattataaccctagagagtcataactaggaaaaggaaaaaaataccaccacccacacgccgacatagccaacacacacgcccaggagaaggctaccaccggatcggccgccgataagcgtgaccgactgccactagaccaacaaagggcacagacgagatcgcccctgcgaaaccacggctgacgcaccgatgctccaccaccacacaagctttgccgacatgtgggaccccctcaccggcatcccccgccagctagccttcgtgcgccgaagaccgcgccacacccaccggcaggtcctactcacacctaggtcgcctcctccaccgccggcagtgcctcactacgccaaaccggccttctttaccggacgcgcctctcgcgccaatctggcctacctctaaccgtcgaacctctcgcgccaagccgggctacatctgcgccgcccacgcctctcgcgccgagccgacctacgatgccatcggttgcgtttctctgcaccaagccggtctccgacccctccatcgaacggtgccacgccggccagatgcggacgtctcccacgccttcggctagtcaaccgaggctgccatgcctccggcgaccgagaacacggtcaccaccaccacagccgctactgccgaacacctaaccacctcgccgtcatcatccccacctcgcacccgactccttccccgccaccaacgtcatcaccgcctctagagtcacagccaccgtcggcgctgccaccgacaccaaccaccgcctccgcaaaaccgccgttgcgccatcgccctccaccaccgagtaggtagcagcccgacgccattgcttccaccgccgtcgccagatgacacggcagccaccacgttgccgccggcccacggccgccgccgctgccgtcaccacactgccgccgtcgtcgcccactgccgccggcatccagatccggccgagaccatcgcctactgccgccggccgtcgtcgtcgtcgtcgccaactgccgtcggccaactgcctccaccctccagatccggccgagaggcgcggatctgggaggcaccgccgccgcctccgcgccctcggccaactccatccccg

SEQ ID NO: 11175 - DNA, 2450 bp, Oryza sativa
gccagttgccgccccgccaatccggccggagcgggccggatctggcggtcaccgctgcttcgcctaggacagccccgtgcccgcccgaaagagaaggacgtgagaggtcccgccgccgcccttgcggtcgaccggctttcccggcggccgctcggacggtggcgaggcggagggggaagaggggagggtgaggggcggccgggttgccgcctcccgtgccgcccccaggggaagacgacgcgagagcttgtttctttagtccacttacatgtgagccacacatggtttttctttctgattaggatgccacgccaatcaaaacagccattcatactgtcttatgattttatttaacctggttttgaaagacaggggttcaacattctgacattacagttcggtgatgtaattcaaactcaaactcaacgtcaagatgagggagcaagagtgaacttgttccaaattttaaattccagcaggatcctggttgcgaaaatttctggtccacattgacatttccggggcgttgcgacgaggaggccacgaggccggagcgtccccgtttcttcgaggaataagttcactttaggtccctctatttgtcgtccagtctgattttcgtccctgaaccgcaaaaccgggcacgacccgtcccccaacttacgaaaccaggcaaacgagatcccttggcggttttgacagtggttttggctgacgtggcgcatacgtggctaatttgacttgtcttcatatgacgtggcactgacgtggcaattcgatccggaaaaataataaaacccgtgggacccacatgtaagttgcacacataaaataatataaaaatggtgggacccacgtgggtcccacctgtcatcgtcactcctcatttcctcctcttctctcggcatcttcatctctatcccctttcctctatctcttctctctacagcagcgccaccaccacggactccgccgccgctcccgccaccgccacatcccttgccggtgatccagatgaggttccgcggcgtgcaggtggatctcgtgtacgccggcgtgtgcctcccgtggtgcccgacaacctggagtggacctcagtgcgaccggtcggtgctccgcggccttgacgaccttgccacggcgcgcagcctcaacggcatccgcgtggccgacgagatcctgcggcttgtcccggagaccgccgtgttccgcaccatgctgcggtgcgtgaagcactgggctaaggcgcggggcgtctactccaacgtcgcgggcttcctcggcggcatcggctgggctatcctcgtggcgcgcatgtgccagctctaccccaacacatccccagcatgctgctcccgcgcttcttccgcggctttgcgcggtggaagtggcccagcccggtgatgctgcgcgccatcgagcacgacgacggcgagctcggcctcagacgccaccctgcgggtcatcaccgagcagctcgccgtcggcgacgacgtctgccaggagatcgtcaaggccgacgccatgtgggtggtgattagttaagtactgcttggtcttaatgatcggtaactgtatgtgttgcagcttgactaacaaatcactgagtctgagaaataagagtggaagtgtagctagttcgccgcaagctcgtgtttgtccactgaagtatttgcatcacttgtgtattccttcgtgcgtgtgtgacctcgcgtgtgttttgttgtttctctgggccaaagctcacagggctgggtggagtcgcggttgaggcagctgtcggccagggtggaggcggacacgtccgggatgctgctctgccaccttcacccgcaagcgtacgccaccgagcaccacaaggagccgcggcggcagggggagcgggaagctgtctccgccgcggccgcctcgacgccaaggatctccgggcggctcgccggcgctgcacggatggccttgaggagagcagctagctcgctcagatggccttgaggtggtcggcagcggcggcggcggcgatgtccttgccgtcggcgtctcagcgagggcgacgatgttgggggagtccatggccacgacgtcctccgtggtgaacccatcctcgttgcggaggagctccttgctgccggcggcgaccatccccggcgtaggcgtggcagtgcacggagcatgcggcagcgtcgacggcgaggtccgcctcctgagcgccgtcagccttcagccttcccgagccttggcacggcggacctcacgtggtcctctcccaccggggactgagagagaggatatagataactgataagaggggagaaatagggtgacaggtggggtccacgtgggtcccaccattatttttattattttgtatgtgcaactgacatgtgggtcccacgggtttgttatttttccggatcaaattgccacgtaagtaccacatcagtgccatgtca

SEQ ID NO: 11176 - DNA, 2020 bp, Oryza sativa
gcgaattcgagctcggtacccgaaaataaaacaactaaagtatcgaaaagaaaatctcaccgtggtgtactactaggagtactttataacaacctttgaacttgtttgaccgtgttactttacagctagttgcaattgtggttgggcgataactattagggtttaccaaaccgtttaaggtgggattattgccaccccatggtttggtggttaccgcaaggtatatcgtaatttcagaatctggtaaggttatcgcacatgataaacacgataaccgcacgattctatatataaactcggatagatagctataggacgagcaattattttttttcgtttgttgtgaccgtgcatccgcaacaatctctctcaaacacccccctccccccccccccaaaatatgttaagttaaaatatccaaataaaaaacaaaaacgatacgaagattggacatctggaatgaggatcaataatggcctattggcaggttggtctgtacacgtccagtcactgtacaataggtagatttggacatataccgttgcagtaccatgcgtattactactactactactacaaacgaaaaagaggcatgataagaaaaggtcagctatcaagttttaatccccgctgtaatcaagctgtgccgcaagagaaggaattctagaagcaccacacacaccctcggctttcctcgctgattggctgatggagaccacgacgagacggatcgacaattcgacactaacataagaggggtccaaaatcttaatccaccttgtgtacatatagttaactccatgtttgggcacagtggtgtcacccagcccccatcaccaatcgatcgacgggttatttcccaatcgcacttaacgtgacattgaagtcaatgatccccacggcgatcgattacgatcgctaaaccaatgcgattaccgagcgattaattaggtcctgatacatatattagtcactttttttcgattcagatatcccgtcctgccgtccatccgtctatccgagtcgatcgtagtactacatggctgtcgctatacacacagcaaattaatttcttacagatggtgcatggcatcgcttgtgtgcattgttgatgactagatgtgcgtggttgttcaacgtcacgtaggtttagtggtacgttggatcgtgctaaaactcttctcgcttgcttgcttaattagttgccgacttgctgtgtgacctgacggtattttcagtcggtgaatggagatatggagttggacggatgcgacgatcgatggatggaacgaggcatgcacgtgacacgtcgtcgttaaggtgagcctttgtcacacgatctcctgctagcgcatctcggctcgctcgctcgacgtctcggctgatcagtccgacccgatcgacgttcgtgcgcgcggcaaacgccaacaccgttgatttcgcctggtgtacgtgcgggtgagctgtgcatgcaccgcactgcaggcgacacgaatgtatggctcgagtgatagggcggctcgctatctagcttacggccttccgcgacctcgatcgtgccgacactcccgcggccgggcggcgaacgccgccgatccttgtgagtgcgccatgcggggcctgcaccaccgtcgacatattgggcattggccgattggcgttccacgctctcccccgcccctatagctatctttgtttcctaggtgtggaatatcgcacagcagcgtgcgaaagcaaccgcgccatggatcgatccgtagttcggtacgtacgtatagtagcggcactgcggcagtagtgctagtgtgatgacggcaggattgtggcacacgatcaaaagcaagcagctcccctgaagacctgaatcctgaaaccctgatgcggagagaccacgtaccggccgctgggccgggccgcgtatgtccatccagtggattggtcagtaactcagtatagcagcctcacaggttttgtttacgatttcttttcggatttgcaaattgcaatttcacttgtgaca

SEQ ID NO: 11177 - DNA, 2644 bp, Oryza sativa
atcgattgccgatggatatatctaatatcactaaaaaaactattactcgtgaatgtgtgcactcgtgtcaagtctaaaacttaaatgattttactacacatttgtcgacaaattacgttgtataacatatgtaggagtaagttataatgtagttatactacgatcatactatatctatatttggtaattttttaagaaaaaatttattgacaaatgtatagatagtccctaaaccttataccaaaagaaaaggtagcctaaaccttatactaaaagaaaaggtaagccaagacaaaatattgacaaagttagatgtttggttgtcaagattttggtacacagttcctttgtttgtttcagatgtaacgcaccagtgcttgggcaagtcctgcttcacttgagatcagatatattttggtctaaaaggtgaaaatagtatggaattcccccggctatcctgaacattttcccccttttgtactgaccatttacttggaattggaattgacggaagcataaatgtgatctggtgaggcttttttaacggccgtttggttaggaggagtttttacgaaggattgagagtttagagggatgggaatattaactgttttattttggttgggagacataagaattttggtgggatggagacggagaattaagaaactccctcattttcaatatctaggtagggagtggtaatcgggaggaaattcctcctttacttttcttaaacaaatctcaattatccgttttcattaataacctaatctccaactaaactccttatcaatttccatcagctctaccaaacaaactattaggattaaaaattaaattctcatcttaatcaatctcacatcaatttcctcatgtaaactctcaatcccctgcttcaagttgccaaacaagccgtaatagtttcgccggtgtaccgttttcataagttttttttggcaaaaactactatattgtactggcaacccagcacaaacaatcctttattaaatcaaaccctaatcaacccctgacccttatgtgttactagtgtgttgaatgctatggcatcctcagtagtatttattagttgtgctttgaatcttcacgacttcaccaagtaatttgtaaagtatttatggcttcatttgcttgacagttgacactatggtgccatgttttcgatatattctatatcgttttcttactataccattttatccgttttttcaagaaaaaagtataggttgtgtttagttccccgtcaaaattagaagtttgaagaatttggaacgatgtgacaaaaaagttggaagtttgtgtgtagaaaaatttgctgtgacggtaaaattgaaagtttaaagaaaaaagttagaatctaaacaaggccatagtcgagaaatggtttgagcaatttccaaacattttgacccctattttggccacagttctacgatttgttttctattgatacagaagggtactacagtgtggcaaaaaacacgctcacacacacacaaaaagaaaaagaaaaaggcagaatatgcttttgtggacatgtcaggaaggttcctggcagagaagttaacatcagaagagggtcatgaacaaatcttccctgggaagcaggtggcatgcaagattttacgtccacctttaggtcccttcaatttgtagaaaaaatgtagaaaatttaaaggattttaattttatagaaaaatttcctatgaaaccctttgaaacaaaggattgaatcctatactatcctttaaaattcctatggaataggtaattctatagaaattttggaggaaagttagcaagaggtccaacctcttggaaaaattcctttgagtctatttctctcatccgattcttgtgttttttctgtggtccaatcaaacgatcattcctgtgtttttcctgtatttttcaatcatctgttttacacctacattcctgtcagaatcctgcgttttttctattcctatgcttttacattcctacgattcaaaggggtccttacaatattgtgcaatctccggtgtgctacgtatattggaaagttgtcataggattattaaaggtgcagtgcagccgtatcattttcactgaggtaataatgcctactacagttgagatgatctcacacacacaaaaagaaaatgtcatatcgtttgaaaaacgagggatatcaaaagggatggccagacaccgatgatatctgggctgcaaaatcaaaatgtaagagaacgggacacatctccagctaaacatgacaacggagcaaaactgcacctttgtttagttctaaactttttttttccaaacttttaattttttcatcacatcaaaatttttctacacacaaacttccaacttttccgtcacatcgtttcaatttcaaccaaactttcaattttagcgtgacctaacacacgactagttttttttttattttttttagataagggtattttttttacccggcctctacatccaaccggatatatacagccattgaaatagggaacttagccactgaaacaatctaatctgaaattcgctacatagaagatttgaactagggaacttagccactgaaacaatctaatctgaaattcgctacatagaagatttgaac

SEQ ID NO: 11178 - DNA, 878 bp, Oryza sativa
gtaaaaaatacctttctctaaaaacacacacacgactagtccatgctggttctgacgtgcatgtcgccggcagaacattctgaagccgcagcccggagggcagacacagaaaatgtgcagctttgtggagctgaaggccacctccacttaacgactggaagttcgttgttttctgcccctgaagctacactttattgttttgcaaaaacttcatttggagactggagtacccaataatattcagaaactcgagctacggatgatcaaataatggcagaacgattcacgttgcatttcaacgttcgccgtgggtgcagtactgcaagtttgttatattaagcaatgaaacatgtgtacggccttcctcgtggctagatacggattacacccgcacggccagatgattaattcttgctttgcccgtaagttttttctaagatgcatctgatgcatgcattgatcactaataggctattaggctgatacgtagaaatgacgtacgcgcaatactattgtctagcttggtacgcactacgaagataactgcattgcgcccgcgatttcaagcccggtaggattccgtttgaaagcaatcacgctggaatgattagtcaggtagctcggaatgcactagaaacggattccatttctactcctagatcggacggcaccaatattgaaacgaagcagaggacgacgggaagaaacaatcctctgaactgaagaacggaaaattcagtaaactgcgtgtacggacgctccttactctgaaatgcagctagcatccaaactttccaagctccaagcatcaggacagttggacagtactggagagtaccactgattagttatgttgcttggcttccgttgcgtaacct

SEQ ID NO: 11179 - DNA, 1047 bp, Oryza sativa
  unsure (1)..(1047): unsure at all n locations
nnnnnnnnnnnnnnnnnnnnnnnnnnnnnnnnnnnnnnnnnnnnnnnnnnnnnnnnnnnnnnnnnnncttgtggctttcacttttgctgctgtcctcaaccgaacagcatatttgctcaagggtgcccctgctgaaaacagctggtttcctgttggagttgcccagatggactcttgggcatccatgaacgatggagaagtgagggatgagctcaaatttcttagaacgaggatcaatgatctaggagacaggtaaaccatttttctaacatcatttcacttgtgaaacggcatagagcatatgccacatgatagttcagtagaattgccttgaaatggcttcactgaaagtaaaattggatgttgaacctgttcagtaactgttttgcgccatgcaggatcaactcagtgtgcgagtactcagttgaagaatactgcacctactgcaatgcaccagtccccttcgagtccgcagatgttgccatgtgcagtggtagcaatcctgctactcccccagctgaagctcacaaattgtcaagatgcacagcgtcgatgcggctgtgccctgttcttcaaccaacatggcactgcgcgtgttgcgggaggacggtcgacaagctgctgccggaaatattcttcaccatgcccacatcattttgggatgtcactcatggtaacgaatcgcttgatttatcagcgccggccgtcccattttgccccttctgcggcatactgctgcagaggataaagccggagttccttctctctgtctcaccggtatagaagctagtgacactaggcagcttccagctgtaagttgtaatactgaatacgtcactaatgcactttgaatttgttgttggtggggggctgcttctaaaaacatgtgcttaaaataagcatggctggtttgcgctaggtgtggtggtgccatcataatgtaacaacccgtgtaacatgtgacatctgtaactcttggcaataaagcgggcaatatatactacttgatgtgagaatatgagatacagggtgtagagcataatgtgg

SEQ ID NO: 11180 - DNA, 685 bp, Oryza sativa
tttagaccccccctaaaatttaaatccatatatctattgcaagggggttaaaataaactttgtctgagattgttataaggctcaaaagactaaggagcccccactatattttatcctggctccgccactgctcactaattttgcctataagcgggttcatgggtcggcccgcttgcatccctatcagtaggccttattaattcacccactacctttataggaggattactaactaaaattggttacttctgcaaggaactgggtgaggcctatcaaatactcagtgatcctgtaagaaaggattcttatgacaagcatggaaaagaaggccttccacagtaagtcttgaatatttctgtcactattctatcaacctagatagaaattaagctccaaattctttgtttctatagaattggatcggccaaattgtaaaacaaaattcaattgcacaagcgatttgaagttttagctgcatgctgcatgtacattgtattagttattatcaacataaagctattgaacttttaaaatggcttttttagggataacatgattgatccaactgctgtctttggaatgctttttgggagcgactattttgaagattatgttggtcagtttgcactggcatctgtagcttcagtagagattgaggaagaatcagataatacagaggcaaggg

SEQ ID NO: 11181 - DNA, 1168 bp, Oryza sativa
aaagatccgcgacttcgccgcacgcgggcgatggagaaggacggcgagacggggagcgtcgtctcctcgtctacggtgatggcagcacgccccagggcgcgctccaggctgcgggcgcgctcctgcgtcacccgcccgtcatccctgatccagagactccaacccgacgttggctagatgacgtggccaatttggtcatgacggcgcagcagcgcctaggcgccggctggtggtcctccgccaccaaggccactggcgttgctactgctggctccggtcgtcgaggcggagggcgcggcgagcggcggccgctacccgccgttcgtccgccattccctcgtcaacgcctccaacccaagaagatgtgcgtagggggccagatgcccgcttcaatatcgagcgccggtgcaatgatcgccgtgctgcccacgcatcggagggcgcttcctcgtccggagcgccacttcggtccgggcacgggggccagccccctgtgtccccagttggcggtgccggctgtcgagcctttgtggcgagccttcggaacgtccgttggcccccaaggttccggcccaccatcaccgaaaaatacgacggaagcatcaacccctccgagtttatccagatctacacgactgggatcgaggccaccgggggtgacgacagggtcatggcgaatttcttccccatggccctgaaaggacaggcgcggggttggctaatgaacttgccacccgcgtcggtccactcttgggaggatttgtgccagcagttcactatgaacttccagggcacatatccgcgcccaggtgaagaagcggacttgcacgcggtacagcgaggggacgatgagtctcttcgctcatacattcagcggttttgtcaagtccgcaacaccataccgtgcatccctgcacacgcggtgatctacgcgttcagggggggcgtgcgccacaaccgcatgctcgagaagatcgcctccaaggagccccagaccaccgcggagctttttcagctcgcggaccgtgtggctcgcaaggaggaggcctggacctggaactcctccggttccggtgtggcagcttcggccgcccccggatccgccgctcggtcagggcgacgggacaggaggaggaagaagaggtcggcccattccgacgacgagggt

SEQ ID NO: 11182 - DNA, 1945 bp, Oryza sativa
  unsure (1)..(1945): unsure at all n locations
ctgnnnnnnnnnnnnnnnnnnnnnnnnnnnnnnnnnnnnnnnnnnnnnnnncgacgatgacctagggttccaggagcctgaggccactgtcgccaccgttgatgggggagcgtgtgctcacgcttctcgccggagcctcaaggccatgaagcgagacttctggccgtggcccctacccatgaggcgacgcggcgggcgcggtggtcggaggttgccctcaccttcgaccagaccgaccacccaccgtgcgttgcccggggaggacagatcgcgatggtggtttcccccaccgtttgcaatgtgaagttggggcgtgtcctcgttgacgggggtgcagccctcaacatcctttcccccgctgcctttgacgccatcaaggccccggggatggtgctccggtcgtcccagccaatcatcggtgtgacgccggggcacacttggccgctaggccatatcgacctcccggtcaccttcggtggttccgccaacttccgcacggagcgggtgaacttcgatgtggcggacctcagtctgccctacaacgcggtcctggggaggcccgcgttggtgaagttcatggtggcggtccactacgcatatctccagatgaagatgccgggccccggtggccccatcaccgtccatggcgacctcaaagtcgcgcttgcttgcatggagcagcgcgcggaccacctcgccgtggcatccaagcccgcgggtggcgacgagaggctcagcacctccgtcccagccgccccgaggcagcggatgatcacgtgcgacgaggtcccgatcaagcaggttgccctgggcgacggcccgtccaagaccacacgaatcggtggtcttctggacgacaaataggaagacgcgctcgtctccttcctgcgggcaaacgccgacgtcttcgcctggagaccagcggacatgcccggggtccccagggaggtgattgagcaccgtctcaccgtacggccgggcgcaaggccggtccggcagaaagtgcggcggcaggccccggaacgtcaagccttcatccgcgaggaggtggcgcgacttctggaggccggattcatccgagaggtcatccatccgaagtggctggcgaacccggtcgtcgttcccaaggcgaacggcaagcttcggatgtgcatcgactacaccgaccttaacaaggcatgtcctaaggacccttaccccctgccacgcataaatcagattgtcgactccaccgcggggtgcgaccttttgtgttttctagatgcatactctggttatcatcagattcgcatggctagggaggatgaggaaaaaactgcattcattacccccataggaacttattgttatacgacaatgcattttgggttaaagaatgcaggtcctacttttcaacgtactactcgaatttctttgggtagccaaataggacgtaatgttgaggcctatgttgatgacttggttgtgaaaacacgcaaccaggagaccttactcggatctagcggaaactttcgaaagtctccgcaccgcccgcataaagctgaaccccgacaagtgcgtgttcggcgtgcctgcgggcaagcttctcgggttcttgatctctgcccgaggcattgaggccaaccccgagaagatacgagctatagagcggatgcgcccccccagcaagcttagggatgtgcaatgcgtcactggctgtatggccgccctaagtcggttcatatcgaggctgggagagaaggcgctacccctatttaagctcctcaaacgctccgggccgtttatctggacggaggaggctgaacgggccctcactcagttgaaggcgtacctcagttctcccccagtcctggtcgccccggagccagatgagccgttgctactctacctggcggcaactccgcaggtggtcagcgcggcgttggtcatggagcgcgacgaggac

SEQ ID NO: 11183 - DNA, 555 bp, Oryza sativa
  unsure (1)..(555): unsure at all n locations
nnnnnnnnnnnnnnnnnnnnnnnnnnnnnnnnnnnnnnnnnnnnnnnnnnnnnnnnnnnnnnnnnntgaagcactgggctaaggcgcggggcgtctactccaacgtcgcgggcttcctcggcggcatcggctgggctatcctcgtggcgcgcatgtgccagctctaccccaacacatccccagcatgctgctcccgcgcttcttccgcggctttgcgcggtggaagtggcccagcccggtgatgctgcgcgccatcgagcacgacgacggcgagctcggcctcagacgccaccctgcgcgtcatcaccgagcagctcgccgtcggcgacgacgtctgccaggagatcgtcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11184 - DNA, 719 bp, Oryza sativa
ataatcgtatgttaggtctgaattatttggtttcattttttagattgaaaggttttgtttatcatgaggataatggtggcgtagatgctccaatggatgcggactttttatgggatccaatctctaatttaaagaaaaaaacattgaagaagcgcagtgtagatgctccaaaggatgtggactttatatcggatccatctaatttaaagaaaaaaacatcggagaaggacgatgtagatgatccaaaggatgcagacttttcattggatccaatctctaatttaaagaaaaatacactgaagaaggtaggatttacatgttcacatttaggttaaagtccccagtgtatgcccattagttgttaacattaaaagctaaaccttgtttcataactaaggagagaactatttgtgctgttaaatcacactcgcacatagcctattttatatgatttttttttctttggcatcctgtatcttttacctggttgtgattgtaggtcacgagacctggacttgacgatgctgtcagaaatggtcagggcaacactcaaaatattcagacaccatcatactgcaatggagaagacaaatctctcccacttattacggcaaaacagtattcatgtcgtgaagcacttttgtcttctctcgtagttgcatggtctccagttctaccatcacctgacagaagttcttatttcacgggacattggtgca

SEQ ID NO: 11185 - DNA, 1189 bp, Oryza sativa
  unsure (1)..(1189): unsure at all n locations
nnnnnnnnnnnnnnnnnnnnnnnnnnnnnnnnnnnnnnnnnnnnnnnnnnnnnnnnnnnnnnnnnnnttttcttccgctttcagcgagattccgtcgcgcccccctcgccattccaagtccggccggtctgaggccaaggagacagcgaccgcggaggcccggaggcgggaagctatccggcgagaagccgcggaccgcctccgggaagctgaggaggctgcccaggaagccgtccgggtttgccaggctgaggaggccgctcgggaggaggccagactccaccgggccgggaagtcagcccgggaggcagaggcgacgtgcgcacgccaggcgggctgccaagcccccgacccgactccgcccgaggcgacgacgacttccgaggccacccacgacgaggccgcgggcgcaccgctcggacccgacccttcgggcgatgttcgggacgagccagcctcgggggacgcccctgagtccggcacgtcgattggcgggccgagccgcacagcgcccacaccgaggcggctctcccctctgccttcccccgccccattgaacacagagcccctcctgcaggccctggccgccgcgaacacgacggtgctggacgggttaggtgcccagatggaggtcctgcaagcagagcgggcggagctcgacgcggcgtgggcgcgcgtcgaaaagggcggcgctcggtggaggccatggtggatgcgggccgcaaggcataccgccggcacgcctcagagctcgaggcccgtcggagggagctggcggagatcgccagggaggtggaggaggagcgggagactgccctcatcgccaccgccgtgctcaacgaggcgcgggacgatctccgccttcaatacgggagccgggtggcggagctagagaagaaactcgacgccgcccggggagtccttgacgccgccactgcacgggaatggcgggcgacggagaacgaggcggcgtcccggcggcgcgaagtggcccttgaggctcgcgccacggcgctggaagagcgcgcccgcgcgagggagagggacctggcggaccgcgagaccgccgtcgctatccgggaggcaacgctggcggcgcacgaggccgcctgcgccgaagaggagtccgcannnnnnnnnnnnnnnnnnnnnnnnnnnnnnnnnnnnnnnnnnnnnnnnnnnnnnnnnn

SEQ ID NO: 11186 - DNA, 1300 bp, Oryza sativa
  unsure (1)..(1300): unsure at all n locations
tttgttgtgtgtatgagacgaggatggtctgtgccgcggtccttctgtgtcttggcttgaacaagggctcgtgcccaggtcccagcctcaaacggcgcgggtcggggctagtgcctggggagatgcacatgtcgagactggctaggccgggagcgcggtgaccgagggttatggggacccgattgtgggcctttgccgattcccccccggagttcaccacgccccggggcacggctcggttctgggccccctttggcgatttccgccggcccgggccaccgagggcagggtcgagcacgagcgtgctaattcaagccaaaactcttcaaaaggaaacaatggcacagacacaatccttagaaaatcgaaaaagcttttattgaaatacggaagagaaaaaagataagtatatgcatatgtggtagcccccggccaaccctgcacgcccgaggggggtgcggggttggcccgagcccgagacctgacacccgacccccactaggggtagaagcgacgaaggtgttcgatattctatgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtgacgctgatggtagcgccgcaggctcttgctggtagcgcgcggctcgaagggccgcgcgccgacttcgtttttccagaagtcgaggtcatctctgcgatgctgatcttgatcagcctcgcagtacatggtggcccgaggggacctcagggtgagctcgtatggaagaaccgcctccgcgccgtagacgaggaaaaaaggcgtttccccgggtgctcggcttggcgtggttcgggtcgccaagagcaccgctggcagctcctcgatccacgagtcgccatgcttcttgaggatgttgaaggtcttggttttgaggcccttgaggatttctgcgttggcgcgctccacttggccattgcttctagggtgggcgggagaggcgaagcagagcttaatgcccatgtcttcgcagtagtcaccgaagagctcactagtgaactgggtgccgttatccgtaatgatacggttaggcaccccaaaccgagcagtgatacccctgatgaatttaagtgcggagtgcttatcgatcttgatgaccggnnnnnnnnnnnnnnnnnnnnnnnnnnnnnnnnnnnnnnnnnnnnnnnnnnnnnnn

SEQ ID NO: 11187 - DNA, 749 bp, Oryza sativa
  unsure (1)..(749): unsure at all n locations
aaaatactttcataaaagtatacatatatcacttttcaataaatatttttatagaaacaagaagtcaaagttgtgttttggagaccgtgttgctgtccaaaacgacttcctttacgagtatggagggagtagttcatgtgaagtcatttcaccttagcaagatacaatcgagaatagtatgtatcatggaccatttctgtaatcagcacaaaacgtacctaaagggaacagatctgaagtaatcaagtaactgataaatgaacatattatatgacatttaagagaacagatctgcagaccgtgaactgtggaaaacagctttgcactagcacactttagaaaagatgtatgtattgtccgagtgcatgatatccagcatacagtaagtaataatgttaaaatagtaacacacataagcactcccatgaaacactaaacagaaaacataggccatgaagccacacgaaagttgcaaaagaaagtctgcttataagctctcatattaaactcaccgcatatcccatccgttcagtcgtgtcctttaccacattatatatagttggcgtggctggatagacagaagagtcatgcaaatcatatatagatcattaattctatctgtcaccacgatcatgtggatgctccccatctcacatatatttatgatttccacatccaactctttcagttctnnnnnnnnnnnnnnnnnnnnnnnnnnnnnnnnnnnnnnnnnnnnnnnnnnnnnnnnn

SEQ ID NO: 11188 - DNA, 845 bp, Oryza sativa
gtttatcatgtgcgataaccttaccagattctgaaattacgatataccttgcggtaaccaccaaaccatggggtggcaataatcccaccttaaacggtttggtaaaccctaatagttatcgcccaaccacaattgcaactagctgtaaagtaacacggtcaaacaagttcaaaggttgttataaagtactcctagtagtacaccacggtgagattttcttttcgatactttagttgttttattttcatttttctatgtgggtatctacactccatggatgggtttctttacagggctgccatctaatgtgggtgacttacatgtgggcacgattttgtaagtaggttggacagatcgtggctggcttgcttgagtcgactcgtttcatttttgtgaagagctgagctcatgttttaattagttcgttagagataacaaaccagctcaagctagctcgcgagctactcatgagccaaacaaggtgaaggtctagagcacttgccgcagccgctggtggtttggaggctcgtgcttgttgccccgcccctcactgtactctattggccttgacctggttgtactacatgcgcatgctgccgcgtgcgctctcgccgccacttggatttggcagctctctgctctacttcccatcacgttgtggcgcctgcgctgcatgtatcgtcatccgttgactgttgtccttcttcttcccgtccaagacgacgagatgctgatgatgacgagtccctgtttcgacagaagactggtgagcttttgctcgtcatggaaccttgcgcttcggtgaggtctgctggggctgccaaccatgacgttctacttcttgt

SEQ ID NO: 11189 - DNA, 933 bp, Oryza sativa
  unsure (1)..(933): unsure at all n locations
nnnnnnnnnnnnnnnnnnnnnnnnnnnnnnnnnnnnnnnnnnnnnnnnnnnnnnnnncatatgggggtacgaaggtttgaaatcagcaagtttacaacttctcaataagaggtacaagtatgaaggtgtcatataaagacctgaattaaaagccattgagctggttgatggaccggcgcatgtgtccacagccttgtcaacaacagggatgtcctctactctgggaggggcaccagatgtggaagtatttcccggcaatttggactgcagaaatataaaaagatgcatttatgatcatatttaccaacataaagattgattaaggaggaagaaaattaagaatgccacatcattgtttagagcgagtactaatcagtaatctgagctcagccttgtgcagttgaaaagaccaatagaacgagtactaatcattaatatcagcctcgtgcagttgaaaaaaccaaaaggtacaagatcttgcctcgtcaacgggtgtcaaatgagggtttatgatggggttaactgaagctataagagatgaaacatcttccatttcagaactagactcaacagaggcatcgctgcattttttctgcgaggggatagaatcaagcttctaacggatagttgttattttaagatgatgtatgagtaatctccattcaaagcatgcttacagttaagtgtctaaggttaatataacatattttcttcccatcaacgcttgatataacaaaaattttccgtccatagtttacttcaccattaaagaccctctaaaaatcatagacacattattttagtgtacacgatttcttttcaaaaaaaaaaaagtttgcaggatgaataataagaatgttgggttcatgaagagtggaaaacctttattatttcagaatccttccaaaaaccttatctgattttatgcaacct

SEQ ID NO: 11190 - DNA, 7292 bp, Oryza sativa
  unsure (1)..(7292): unsure at all n locations
ttgtggcagaggggacaccggtctccgagcccctctccatccccgaggccagctcgggcccttcgcagctgcctcacaccgcctattgggtgatgcagttcgacggctccctgtctcttcagggcgccggtgcgggggtcacgttgacctcgccgagcggagatgtcctcaaatacctggtccgccttgactttcgggcaaccaacaatatggcagagtacgagggactccttgcgggactcagagtggcggctggactggggatccgccgcctcctggtgtgaggtgactctcagttggttgttaaccaggtctccaaggagtaccagtgctctgacccgcagatggatgcttacgtgcgccaggtgcggcgtatggagcgccattttgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgagcctgaacggcccccgaggcccgtcggagtccaggcctcgggacccgaggggggcgctcccagctcccttagattgattgcttggatcgctgagatccaggcgtacctcgcagataagactctacccgaggaccgcgaagggagtgaacgcgtccagcgcatctccaagcgctacgtgctggtggaagggaccctctatcggcacgcggctaacggagtcctcctgaagtgcattcctcgggaacaaggcgtcgagcttcttgccgatatccatgaaggcgagtgcggagcccactctgcctcacgcaccttggttggcaaggcctttcgccagggtttctattggccgacggctctcaacgatgcgatcgacctggtctggcggtgcagggcgtgccagttccatgccaagcaaacccatcagccggcccaggccctgcagaccatacctctttcatggccgttgctgtctgggggctcgatatcctgggtcggtttagacgggccccgggcgggttcgagtatctgtatgtcgctttcgacaagttcactaagtggcccgaggcttatccggtcatcaagatcgataannnnnnnnnnnnnnnnnnnnnnnnnnnnnnnnnnnnnncgatctttagctgcgtcacgaaccctgtcgcgctaaaaaaccgcccgcttcacgtaccctgctgcgccaaaaaaccgcaccgtcttgatcttgatacacaactctcatcatatttcattcgtcactatgtccctaaaatcggccgaatccccatcgattcagatctgacaatttccagtccctagtgtcttcgctcaccgacgctatccagtggagacagagaagaagcccctccaatatagttttgcactgaaagacctacttgggatacttctccaggctactagtttttacattttgtttatgaacgtttgactaatatatcataacatctcaatcgatcatgaaaacaagatatcaattctacatgttacaccctttatttctctgaactacacgccgcaccttgcaaaatttagaaatacacctaagcctattaagtcaaataggtggcaaagtgaccacccacctttctttctttctttaatattcagagatacacggctgaacaaaatattcacagttttaaaattggacaaagagtccaacttacaagtattcagttgacagaagaacacgaaaccttcgaggagaaaagcaagcaagccactctggtacttagaagcagaacctctttttctgcatataatggatgaacacatatgaattggctagctcagtgttatgagatattctttacattttttttcctaatactatatgatgttgttgacttttagatatatggttgaccattcatcttattaagaaaactatgcaagtattatttattttgttatgatttatttttttattaaagatacttcaagcataacttatattttttatatttacactttttttaataaaacgaatggttaacgtatgttaaacattaatggcgtcatatatttaaaaacagagggagtacgatagaacagggatgtgtgcgaaccaaatcatgaagttccctttgactcaatctagtttaacttaaaaaaacacacacttagcaacaaagaataaattcatttttatataaactagcgggtcaataggtacttctgggtgaactcactcacatccataactaaagagtagttggcatcaagaacaagcatttctcaaaaggaaagagtaattcataggaaaaatccacaacttacccgaaattgaatattcttttgctggtcggcgtatgcaagcagttcgtccagcctcatcaatgcatcataaagcatctgctcatgggagaaacaaaggtcaatatggaaaatcgcaattttttgttcagttcttagttcttactatagcgaacaatcaagaaattcggtgaactgccaattcttgggtgtaatagtataacatatagaaacattacctcagaacagtagttatatccttgataccactaagcaataagctatctaacgagagtacatcttccttgtcacacatgcacacccacagagtgcatatgatatgtcaagactcaacagtaccttctttgtagatattagctcggcttccaatgcatcaacacggtgaatggctccattgagcaattcctctctatccggtggcatttgagattgctttgcttcaagctcctgtaatttctcctccaattcaccaagacgtctcaatacagacgaatgtgtactgttttctgtgaatccgggagaagatggaggtcaaaactcttccaaaaactcaatttcttgagggaactcagcactatagttaccacgggaaatggcctggcttgatagacttgcagtcactctgcttgggacagaacgaagcacggcaacaaagctcacgattaagactatcaaccacgcagtaattcgatttcgaagtcctcccagttccatcgttatgtttctcaacgagaacgaatctgtgtaaaacatgcaacaaactcagtcaaaatcactccaataaactcttggtgggcttaccggtcaccactcactacatactataatgtaatggcatgtttggtttgaggaatgagatgaccacttgatcttatacaggtcgcttggtttgaggaatggaatggatttgtccatcatctctaaaaagtacatactaaatgagaaactgagaaatggagtcattccactagatttgagagatggtcccatgatggatcacccattctagatagtttgattcctcaaaccaaacggccaacaaaattcccagtatctcacatttccctagttgcatatgggggtacgaatgtttgaaatcagcaagtagacaacttctcaataagaggtacaagtatgaaggtgtcatataaagacctgaattaaaagccattgagctggttgatggaccggcgcatgtgtccacagccttgtcaacaacagggatgtcctctactctgggaggggcaccagatgtggaagtatttcccggcaatttggactgcagaaatataaaaagatgcatttatgatcatatttaccaacataaagattgattaaggaggaagaaaattaagaatgccacatcattgtttagagcgagtactaatcagtaatctgagctcagccttgtgcagttgaaaagaccaatagaacgagtactaatcattaatatcagcctcgtgcagttgaaaaaaccaaaaggtacaagatcttgcctcgtcaacgggtgtcaaatgagggtttatgatggggttaactgaagctataggagatgaaacatcttccatttcagaactagactcagcagaggcatcgctgcattttttctgcgaggggatagaatcaagcttctaacggatagttgttattttaagatgatgtatgagtaatctccattcaaagcatgcttacagttaagtgtctagggttaatataacatattttcttcccatcaacgcttgatatagcaagaattttccgtccatagtttgcttcaccattaaggaccctctgaaaatcatagacacattattttagtgtacaggatttcttttcaaaaaaaaaaaggtgtacaggatgaataagaagaagggtagggttcaggaagagtggaagacctttattatgtcaggatccttccaaggacctttatctgattttatgcaacctccatgttcttcacacctgcatttgccacccagaaaatctggaagttcactgaaaacatgaattaaacaaaattattaggataggaaccaaactacagtatttgtgacagtagaaaagacctaacctctcatcaatagtttcaagtagcttattttggtatttgcttccaaggacctaggtgaaaaaagacagataaggctattatcacatactagaagtaaatattattctgaataacaattttcaatacttacatgaatcttcgaagcagtttgtggatcaagaaatgattttattgtaccccataacatcttgaagccttggccagcatttataatgtacaatcggtgcaaggtctgcacgagcactagaaaggtattagataagtcctttgttatgaccccagataaaaacaagttctatagaaatgtatatagtgacaaaaaacgaagtgaaagggcaatagtgaaaaataacattaaaacataatggaatcacctacctctggatagttgtcattgttgatcttctgaagtcgcatgattagctctcttgcatcttttgagaagttcttcaaacccttcacataaaaaacaagttaactactaatctacccagaaattttggcgatagcaagattggctataaaataacataccactccttgcacatccaagatagtactgcacgaatctatgtgcctttttgcagcaatggagcaagctggaaacctcatctgcaagcacttctcggactccttgacatgatactttacatatctgtcaatagttgtgacttgtactaatttgttgggatcaacttttccaattagttctatgtagacaggccttccctctttatccacaccatggtaaaattgtggatagcactccagaacatcatctaattcgctatagtcaaattcctaaatgatccagatgtcaaacttccagaagttacatgaagaaagactatcactacctacgtactggagcatatggtccagtctctgctttacctctatgttgtcagccccgaactccttcctccatctaagcatttccgaccacatatgttttgctttatcaatatcaaattttcgcgctttcaggaacctacatgtgtaacatgtcataggcacatgaagaaattttaaatcaaataagcaacgctgaattttctgcaggagtaaggagaaatccaagtaactgtgactctgagatcagaaaaaaattgcacctcaacatcacgtgataatcatcatgacgttctggcaacaagccctcatcatgtaagcactggtgaaatctttggacagcttccagctccttgacatcccttatgtcctctatagaggctacatggtcgccgaccctccttcttctcttccttctcaaggaacgcctaaatttatttccagcactgatagctcggttcttgaaggagactgccttggcctttttgtcaccttctgagttgtcctcatcggatttccactctttcttatcatcatcatgcacaatgccttcaaaacctgcacctgctatatagtttcaacgaaatgcccctcctcctaatcaggttgaaatggtaacaactacattgaaaataatcaatacgagagcagagtacataggagttgcaattaactgaaagcagcgcaattacacgcacgttaaaaaaattagggaggtgtgattataatctctacaggtgctaaactactactattaaaatttcaatcccactcgaacatgaactatttgtctatttccgagtgatttgccatgttctccacttgccccaatgaaccccctcacagaatcaatctctctgcaaccgcaattttccggtgttcgcgaatgacaagcaggtaagcattgcataaacgagaacgggcaacgcatggcggcatggagaaacaacgaatcatcagggaacacgcagtcgaaggaagaagggaaacagttcgcactcacagggccgatcgatggaccccgccatcttcgccttccccacccgcggtccgacctcgattcctcgcagggtaatcgagtccccgagcctcgccgctcgccgatgaaccagggtttccggcggaggaatgcgcggagacaggaggggcacgagaatggagagagatggctcgtttgaaattgattgtttttcttttgatttaggaggaatattttgatgcttttgttttgggggagaggggaagagaagcttctgttttcttttcatcggtggaggaaggggacagggcaagaggggagggggtgttacacgtatcctctcgtggaccgggtccataggctcgcaacaaccgcgacgctgcatcagcctgcacgtaggcgtgccacgtgggcggctcacatcggctctggtccgtcgacctggcgagcgcgtgccacgcgtcgcgcatgggcgcacggtacgcccgtaatatgaggagatcgagccggtgtagagcggctagagcccactatggtgaaccagctccgtttgatctgcagatgccgatgcttatgagccgttgatttctccttggaggttctgattggcctgatcgggacacgctcgcaggctcgcagcagtggacggcgctggtgatttttttttccctttttttgagattcgctggtggggtttcacgtctatggagtatggacaaggttcaccgaaatttattctggacgtgacggttcgaggcttttgggccgggctggaacttgagagtacagttgttggttcgggccgaaacttagttcggagcaaaacaggtattcaccgcaaactaaataggcatacaaattcaaatcagaagcacgaggattcgtgaaagcaatttgcttaacgttttgctaaaatcaatcgtgagtgacaaacatgggcaccttttgagtcaattttactaccaacgccaccacgaatgaaagcacccaaaatcatgttctagtatgtatatgtatctatgtataggttcttctgtaagtatttacaa

SEQ ID NO: 11191 - DNA, 3044 bp, Oryza sativa
  unsure (1)..(3044): unsure at all n locations
nnnnnnnnnnnnnnnnnnnnnnnnnnnnnnnnnnnnnnnnnnnnnnnnnnnagttcggagcaaaacaggtattcaccgcaaactaaataggcatacaaattcaaatcagaagcacgaggattcgtgtaaagcaatttgcttaacgttttgctaaaatcaatcgtgagtgacaaacatgggcaccttttgagtcaattttactaccaacgccaccacgaattgaaagcacccaaaatcatgttctagtatgtatatgtatctatgtataggttcttctgtaagtatttacaaagttcttcttgatgtttggctttatgcacttcaggcgggactagtatgtacacctcccttcaggaactgatcaagaaaagtgaattgtcatcctgtcagtttgatcgagctagtgtacgtgaaagttgacaaagaaattgactatatgaagatttcaagaatggcatgggcgactgttacctgttaaatcatgttctttttctttgcccggaacatgaaaagctgatctctgtattgagctgaaacagatgataccagatattagccgccatgaacattctgctgcatatatttgtgagtcgggaggcggataaaaaaaaacaaagacttcccatttagggcccattttgaacgcaggaattttgtacgaattagttgcaatttccacaaaagaaaaactataaaatttatctgttccagaggaggcaaaataatgcaatgcaacactgtcacaatgtatgactattttactatatgcattttaagccaacaagagcttaccagcatctttgtagcgttcctcaacagcagcgaccagcatattgcggaccaaatcaaactcttgggcctcaaagcaaggttgatcgtcaggccttcaaatggtacgggatgcattagcagtgctttaaaataaacctttctttactgaaacctatgaagctacttttgttacaaacctgtcaagtcttgtgtattggaattggtctgagcttacatagctctcagatggtgttggttgtacaactttcaatccattgttatacgctatacgcctattcacttgtataggaacctatgtaaagttagaataaattggaatgagtatcataaacatccatttagcagcaaaacaccaagaagatcaggatttttccacattctttgactgctgtactcaaatcattggttacgaaaatttcctcaaatgatttaaaaggaaataaaaaggagtacctctagaagtattgcatgcaaatcatatcatccacaaataacaaggttaagcaacagcaccaaaaaatagatcacttttctgacaggacaagggaatcctgtttgctggttttacagttttgtggctagcgctcaaacagatagatgcatgttataatccccaacatgcaactaagtcacagcacttccaatattctgggattagcagccttaaaggaaatatggccagcactcagcaattaatcagaagcacagctgcacaggagatgaatgcacaccttacaccggaaagcaatgttgatggcatctgatggcttgagatctaagctaatagtctcctcttcattgccaatctggatatcatgacaccatacttcagacaaaagtaaaatagatactccctccgtactcgtaaagaaaatcgtttagaacaatgtttaagtcaaaccttaggaatataaatcatgaataactctcaagttgttgagtttgaaaatgtaaaaattatatgaatagatttgtcttgaaaaatactttcataaaagtatacatatatcacttttcaataaatatttttatagaaacaagaagtcaaagttgtgttttggagaccgtgttgctgtccaaaacgacttcctttacgagtatggagggagtagttcatgtgaagtcattttaccttagcaagatacaatcgagaatagtatgcatcatggaccatttctgtaatccgcaccaaacgtacctaaagggaacagatctgaagtaatcaagtaactgataaatgaacatattatatgacatttaagagaacagatctgcagaccgtgaactctggaaaacagctttccactaggacactttagaaaagatgtatgtattgtccgagtgcatgataaccagcatacattaagtaataaaactaaaatagtaacacacataagcacacccatgaaacactaaacagaaaacctaaaccatgaagccacacgaaagttgcaaaagaaagtctgcttataagatctcatcttaaactcaccgcatatcccatcctttcggtcatctcctttaccacattataaatagttggccttggctggaaagacagaatagtcatgcaaatcagatatagtacatgaaaacaatttaaaaccagaatcatgtggatgcttaacatctaacatatatttattaaagctacatccaactcttacaattcgaatgttccgaagggcagccagcaacataatacttggtgtttccactggaaaaaagtaatgtgagtatatcacacaattagaaaagcatctgcataagtggaaagcatgcccaagcaagaattaatacgtactgacgataattggaagcaaaagatcacttccatcttccatcttcagaacaatagcatggtgaggtgcagaatcccgcaatcttaatacccgcgggttgttttggacacatctaaggtttttgccatcacgcattttaatcacaaatccatcagatacacttctgagctcaactgcaaggacagataaaaccacaagtttaatctcagaaatgtacaatggttgtttggcaatcggcataaatgatatactagtgatatgtaactaatactgcaacagtagcttggcataaacggtatgtagctgatcaaacaacagcaactgtttcaaaggctcacagcgaacttcccaactcccaacaaacagtgggccggacccggacattgctcgaacgactatgcatcaaaacccaatgaagttacaagttacagtgtaacagaagtaagcaat

SEQ ID NO: 11192 - DNA, 5843 bp, Oryza sativa
  unsure (1)..(5843): unsure at all n locations
nnnnnnnnnnnnnnnnnnnnnnnnnnnnnnnnnnnnnnnnnnnnnnnnnnnnnnnnnnnnnnnnnntgttttggacacatctaaggtttttgccatcacgcattttaatcacaaatccatcagatacacttctgagctcaactgcaaggacagataaaaccacaagtttaatctcagaaatgtacaatggttgtttggcaatcggcataaatgatatactagtgatatgtaactaatactgcaacagtagcttggcataaacggtatgtagctgatcaaacaacagcaactgtttcaaaggctcacagcgaacttcccaactcccaacaaacagtgggccggacccggacattgctcgaacgactatgcatcaaaacccaatgaagttacaagttacagtgtaacagaagtaagcaattaccagcctccatcacgctggagttgacgaactcctcgccgctggcgtcgtaatccgcggcagcggcgccgtccccgtcggaagacgagccgtaactgcaacaaacaggccagacccagccgcttcgcgcatgccgctcggacgggaaaccgaagaacctgcgcgccgcccggtagtggtctccctgcaacccacaggctcgtctcctcaggtgcacgcgcctaagcagctgcccgctgatcttcgcgtcggaggtcagggcgccggtcgccggagcagcatagcgcgggagaaccggcccgttgatgatctccatccttgaatttttaccataaaccaaaccgtcataaacgaactcaaaggcaacagaaacatcagaactcaacttggagaaaggaatcgatgcgattttcaccgaacgagaggtccaattagcgaaatgagaccacagcgaattggcagaaaccaccaaattgaagagttgacgttctagagattgagggatgaactagcttaccaccgatcctggcggggagaagggcctgaatgcctgatccgagctgaaagacgcaggaatttcggaggattttggtaaagtttttggctcgaaaattttttagccaaatgttaaaacccttatcgctaaacccgacggcttttatggcggatgcggttgnnnnnnnnnnnnnnnnnnnnnnnccttagatatttatggcagcagcggacgctttttaagggtgttttggggaatacggatgaccggatggagtggccatttctgtccgtttgactgtaatggagagatcgctccatcaggatattttttctttggatagaaagcgtaagcgtgatgtggaaaggcggaagatatttcatactatacgaagaatatacttcctccgtttcatgatgtaagagtttctagcattacttatattcatatagatgttaataaatttagacatatatatgtatttagattcactaacatctatataaatataggcaatgctaaaaagtcttacaatatgaaatggatggagtagctatttaacccaacaggagttctattttactattgttataaaatgtaacatatgaaggttgtatttgccaagtcccaagttggccaagtaacatcaacaacatgctacaatttttagtgggaaaattggaaccatgccattataattttgcaaaatttgttatatgccatcctgatccacatgtcattgactcatgtgggtcttacatgtcattgagataccgataacatatctcaaactttacaaagttataatggcatggtaaagtttatttcggtccttgaatttggctcaaagttcatttttcaccctaggtgctaaaaaataattgattttatatatacgtggtgcaatcgatcgcccacccaccaaaaaaaaaagatggcatgtagatcatcacatgtaattgtgacaagtttgtggtgtttgagttcaacaaacaaaatttacttatattctagtatcaagatattttcagtgaaaagtactctctccatctcaatttgatcatcccctaaggtttctaagatcttcctaaaatgatcatcatttaactagtgtcttttcgtttatttatgaaatgagtaaatgtacatcattgcatgtgttgcatgtaactaaaattgattaatttctattagtgcaatatcataatatttaaaataagagcagttcacgggatacgaagcgatggaacaccttagcattaatttaagaatgatggatatgttggtgtccttggtcttggtacgctttgcttagaggatggtcaaactgggatggatggatggaaggagcattgaggacattaaaacaaatggatatatactatctatatagttactgaaaggtgaagatgtagcttagagggtgtagacccccgattttggaaatcggaaatcttctgtgtttatccgtaccaatctctggatcagtagttggtacacacatacatagttggatcacaacatatcacgaatgaattcaggctaaaagagttaaatacttacattagggccaggtaggccaacaactatcagagaacatcagcggaagacaaaataatataagggcccggttaacatgccacaggcagtcgactggggaacgagacctagaacaagaccgcactccgatcatcttgttggatacgcaagcgtaccgacaagggcttctcttcaacactctcctaaaagatatataaacagcaagggtgagtaccaaccatactcagcaagccaccacagcaacgatgcatatgatagagggtatttcaaggaatggcttcaggttcctttgcgcaaagcaagttttacaaatcttttcacaagcctaaggcctagcatagactgatcaagttttaataccagtgttcacattaaacaacgatgggtctgtccaccatccattgtaatcccaaggatagcttcccgccattgagtcgtcatggttttctgaggacgtccaccttccctcctctcaggaagtggctccatcagcataaaattcatcatgcaatatcccatcccacacaagttaagaatttagagtctagcgaagtgtaatacatgtcccggtgctcaataaccgtgagcacggctattcgaatagattggtttactcacactgcagtggatgtacactttacccgcactccgcaactgcccaatacatgagcctcgtcccaacacatgagatgtgtcacggcaaagcttttcgataacctcgcattggcagtacccgctccatgaacttttacatcctcatgcactctaggcgtatacggtttctagcagtaagaggagttctggcgcaccttggaagggaagactcacacatgcattaagttataattatgtttagattctcacatggcagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgacggggggtcgttcatacttaacttcatggctcggtccttaattgaccagggacggcactagccttttccggacaccacccaatccttcagcggcccagtcgaaaacagttgtttcactttattttcgtttcacaaatcatgtcatcaatatcatggaaatgtggcgctcatgtctccacatgccgcatttcaattaccttcccaaaggtaattgcccaagcatatagcatttgacaaatatgagtatacatgattctagagtggcatctctaagcatttgtcatagttgactagagactcatacgtaatcatggttacaagggaataaggttaaacaataatcaaggtatggcatattcacaaataggatgttcatcattgcatgcaatcttatttgtaaataaaaataatttcgcaattgggatcaacatgttcaaggaatagtgatgacttgcctgctcaggataatccttattattgatataatcttgatcaaccttcacctcctggaagttgcagacgttgcctcacgactaaccgatacacaaggtctataatacgcgagaaaaaccaatattcaaacaacaatcaaatatgcgcaacaaaatgtactattcgtgtttgctaatggatcccaatcatgctaaggctaaagtttcttaatctttctattgtcatcgtggcctatttaggagttaaccaacatagcatttatgggatacatatatatttggctaatcggtggtttagtctatcaaatagctatggaaggattatggctacgtatgcatatatctaaatagcacggttacatatcagaggttctgttgttagatggatttaggatcaatcaaataattacagtgaatcatttgtattattattttattgatggaagctttactttaattatgaacatattttacttgccattataaattataaaagggctaataattatccatgctctatatgttaaattcgggaggtttataatattatagttacagattatctcttaatgaacaatccggagttacaattgaactatgaacatatgaggtcaagatttataattagtacttatctactatgcatgtttgttatatactccccagtttaatatatgaaaaagataaattaattgtataactataatgggatgtccaatatatgtgtgcaacaacgtataatgttttggtcgcctactgtacatgagcttatttagaaagtgtactacccaatgctccaagtgattcctgaatatattgtagtttaattatacattagctagtttctatgagtgatattgtatatgtgatgcgacaagtttaagcactggttctattgggttactaataagtggtaatcaatttaggcatatatatgctattctatatggtattgcatcgattaatttacttagtgattcctccacatttagctctattattattctcctaaacagattcatctatgtgtgtttatattttagttacataatcataaggctacacttgatttaaataacctataagccatggatttaattatatggccatcgaatattaaataagtactagtattttccaatacatccattcatttgagacatcacataaaattagtttgtgtggttgttacagtggcaagacatgttagagacaaatattattacatctactctaccgtacaatactaattttatttattaacatatttttaagttgactattatgcatcatcttgatattaattatttaatatttataaatatattttatcaaatagtgaattatatatcattggaaagcttatgaatttagatgaatttaggttcaagtttcactcaaatcggagctaaaatgaataagttatgctagtgtaaagattcaaatttgaataaatccgagaaattgtaaaaaggcactgttcctaattcatttatttataatacaaccttatccacaagctatagtgactgacagggggggtcttcctattttctttttcttttcttttagtggtcttcctaaaggaatttataggagcaaatgacaggtggggcccactctaccctgtcttctcttttctccctctacctttgtctgtcttctcctctctctctcacggccgagcggcgcgtcgcggctaccggcaacgaagggagggggcggaaggcttaccgacggcggcggcggcgacggtggcggcggcggcggcgacgcacggcgcggcacacggcgcggcgcggcggtactgagggcggcggcgcggtggagaggaaagaggggaggaagaggggaatggggaaatggtgtggggtggaaaggg

SEQ ID NO: 11193 - DNA, 1325 bp, Oryza sativa
ccaaattttaatattacccatattttattcttatatatatttttcaattgtattatttaaatgaggtctaattctaaaattagcctagataattttggaggctttgagggttctaaaatatcctagtgtggcccttattattacaatagcacattgaatgaacttatagcaatatattttacacggataggttgaatctatttattctataaatagtatattaagactcggtacaacattaatctaattttaaacactcacatattcttgtttatatataaggattaatttatttatatgaccattattttatatgagtgattttcatgtcatgagtaactcggcgacatgttgcaagtatcgatctatatattccggtgaattacttatttataaacacgatcactatagtggtgatcatcatttcatgtgttcttatatttcatgtgagattggattcaaatgaattggatttaatcttactatttctttagctaattgtgacatcaagctatcaatcatggttcgaatatttaatacctgatttgtaatttgtaatagaaattaatatttgactttactatcttttgcataattatttgtaggattaaatatattctcgtaaattatatctattgcttaaatatcgatcttttcttttctttctttgtgatcatttacggtttggcaagccatagcaatcataacaaccagcatgatgcaaaagttttaaaaagtttgaaattttagtgatttttattgttagggattttcaggatgttacagaggggggtgaataggctaaccctgaaaatcactaaaaaaattcgtaacgatcaaatttaaacaggacccgcgaacttcctagtgatgaacaccggaacttcctggtagctataggcagctcggaacttccggagttcaagaacaggaacttccgggtactggaaatactgagaaaatacttcaaaagagagagaacaacaggtcctattaggtcaatatggttcacagtagactatagcagtatataaaacataggggcaagcacaaagcattcacggaagagataaagaggatttttttcccaaagttcggatgcacggatcctactctcctttgaggagcttcaaaaagctgggtctcaattaaacccttgcctctcttgtgcaaagatcctagaagaggtccacagccttcaatccaacacccctagatccttctctagaagttgagtgaccaccaagatccaactcaaccttctagagacaaccacaagtgaggtttgctctactaggactacctctaaaaactcggcacaattt

SEQ ID NO: 11194 - DNA, 1193 bp, Oryza sativa
ccaatcatctttttcttactatgcagtgctaacataaagaaacttaacaccgagcatctcttccactccacttcggcaatcatattatccgtctaaactgataacacgtgaaaagcaaaaggaatgcagcacaaattcatgtgtttcactggaaaccgtaccttctctgttaaccactcctatgggaaatgggtcgctaggacgaagaacaaccagttcccgaggcccctccagtgcagatgggttctagaatcaaaaacacaagatgaacagtcataactcctgaggaggacaacatggttcgaatacactaatgcaatgaaaccacacataccaggatagtgataaggtgaccagaggcaacagccaccaggttctcagtcgaccaagcgattgcatttgggtacgacggcgacgcgatcaaggtggcagcctggtaatgcgaagccatggcactcacaacaaaaccaggcggaaattaacgcgggacaagggggttcagttgagccactgactgcacctgcacctcgtctaagttctatcatcctatatgtaagtccacagcatgcttgtttgacacatgggggaaaatcctcactgcagatggatcgggtttaatcccccaccacccaattcctcttcgctacggagaaatttcagctaagccctaggaaaggaaaggaatgaatagtggcggagagctaaaactgcaggagtataagagggggatgctcaagagtcgacctgtaggcatgcggtggagcagccgttgcagtcgccggagtcgggaagagcgcggcagcgcttccccgaggccggccggactcgccgcgccggctcccaccccggtgctgcgacgcggagtggagcggacgagcggaggggcgcggcagcaaccggcagccgagcgaagggccgcggcgtgcggggggcgtggggcggcgggcgagcggagcgcgtgctgtcctcctccgccctatgtcgcctcagccctcaagccgccttccgcccattgttgtatgttcggaggcccaattggttttccgtgatttaggccggcccagttgccagctttcgaatgggagtctgggccaatcgttccatcgtttccttttccaatcgttccatagtttccatttcttcttaactcctaacaatccttccatcaagttcaaaaaaaaaaaaaaacaatc

SEQ ID NO: 11195 - DNA, 771 bp, Oryza sativa
  unsure (1)..(771): unsure at all n locations
nnnnnnnnnnnnnnnnnnnnnnnnnnnnnnnnnnnnnnnnnnnnnnnnnnnnnnnnncacccagtgtggaaagggctacttctaaatagagttatgccagagtttagttggcttaagaataaacactaataagagtctgattattagaggtgactgcttatttttctttgatatttagctgggaatcaggcagtcatccatgggaatcggacacaaattcgtacttatgtagctaaagctagttttctatttttgtgtttgtttccaacacttacatatggtaatatgcaaattatatcacattccaaataacaaaacaaatcaagtcaaacttacatatggactgtcattaaatctctaccattaaaatctagtcatatcacaatacaacggttaatatttttctctttttctccgattaatgtgggaatttctagcccccacagcgaacgtgatgcctcctttcaaagctatcttaataatataatagattgaaatgcccatcttgcactttctagttccagctaatgcctttctgttattaaatatactgctccaaacgttgtactgtcaagtcactactgattcattaccaccagtctcctcaatctcattatctgcaccatctcatcatcaagactcagttaatctggcaattggaatagcatctgggtcactagaagcatggtcgtggaacatatctagtaacaaaattcagaaaattcatgcatgtgacgctcatgatcaagtggtaaaatttcattttacctt

SEQ ID NO: 11196 - DNA, 713 bp, Oryza sativa
gaaatacacctaagcttattaagtcaaataggtggcaaagtgaccacccacctttctttctttctttaatattcagagatacacggctgaacaaaatattcacagttttaaaattggacaaagagtccaacttacaagtattcagttgacagaagaacacgaaaccttcgaggagaaaagcaagcaagccactctggtacttagaagcagaacctctttttctgcatataatggatgaacacatatgaattggctagctcagtgttatgagatattctttacattttttttcctaatactatatgatgttgttgacttttagatatatggttgaccattcatcttattaagaaaactatgcaagtattatttattttgttatgatttatttttttattaaagatacttcaagcataacttatattttttatatttacactttttttaataaaacgaatggttaacgtatgttaaacattaatggcgtcatatatttaaaaacagagggagtacgatagaacagggatgtgtgcgaaccaaatcatgaagttccctttgactcaatctagtttaacttaaaaaaacacacacttagcaacaaagaataattcatttttatataaactagcgggtcaataggtacttctgggtgaactcactcacatccataactaaagagtagttggcatcaagaacaagcatttctcaaaagg

SEQ ID NO: 11197 - DNA, 460 bp, Oryza sativa
  unsure (1)..(460): unsure at all n locations
atattttcacagaatcatattatgctatcatatagtaatagaaaccagtggatattaatgagaatgtgtggacacaataaaggaagacaagctttcatggtcactgtcgtcctcgaatcaatccatgccacccatgccacccataccgcccataccacccatgccacccatcatctcagccatgccacccatgccacccataccacccatgccacccatcatatcacccattccgcccattccacccattccacccatgccaccaaaattctataaaaaaagacataaagaaaaacattagtttaaaaaacaatatatgcatgagcaaaaaggaaatctaggaataaacatgaaatctgaaaagaactaattaccgaaaagtccactccatccacgttgacannnnnnnnnnnnnnnnnnnnnnnnnnnnnnnnnnnnnnnnnnnnnnnnnnnnnnnnnt

SEQ ID NO: 11198 - DNA, 541 bp, Oryza sativa
cgaatgcgcgggctaccttcctagtttatttaaattgtgattagttttagcatatatgaaatactatcaaggaactcagtttaaaattttatatccaccatggtttaaaatttgaagtatagtcatactcaatatatataggagtagagttttgtgaaacttgataattataataatatctgagaaaaggttaaaataactaggttttatgatactttgttttttaaaaaaaaaaaagaagtaggagctcaagtggccgttcccaaattgatttctcgcctccactcgtttgtgggggtgatccagtcgcgcgctcctccttccacgcgccaaaaccccagccaccaccaccatctcccgtcccgttcccaccaaaatctccccctccgatttcgcgcggctgcggtggtggtgcgtgtgctgctgccactgacgttgcggcgggagagcgcgatcgatgtctgtgcagtgcgcggtccggccgctcgcggcgctcccggcggcggcggacacgtcgcgctcgcgccgcgttggcggggcg

SEQ ID NO: 11199 - DNA, 393 bp, Oryza sativa
  unsure (1)..(393): unsure at all n locations
nnnnnnnnnnnnnnnnnnnnnnnnnnnnnnnnnnnnnnnnnnnnnnnnnnnnnnnnnctaaacaaatacaattgatatgtctcaacatgtcatatgcctcattgcctctcctcttgtacatgtcacatgggggatagttcttgccttcaatgccatgccgatgatggtgagtggaaaaccatatgttagcataagtgcagaccactccgaaccaggaagcaggttgaaatacgccccgaatccatacctgaaatcacaagaacgcaccaaatcaagcctttcaagctacttcatcattctgaataatgccaagcacaattgtgcaatcccaacttacgacaagagggtgccaccgacacctagcccaatcacaccgaacgaaacctgggtacc

SEQ ID NO: 11200 - DNA, 416 bp, Oryza sativa
  unsure (1)..(416): unsure at all n locations
nnnnnnnnnnnnnnnnnnnnnnnnnnnnnnnnnnnnnnnnnnnnnnnnnnnnnnnnnnnnntcttcgaacacaataattttgcagaattttcaccggataacaggacttagttcaaatcttccaaaaatcctgtaaaatttcctcaggggccaggtgactagtaccgcttttgctaggcaggatcttttctgtagtttgcttggggaaagaatttcagcacatgtttttgtaccctcgtaacctcgcccttaaaaggtatagtaactttgtaacagtgatgtagaactagatagtacagcatccttctgaatcttcttagtttctcttcaataggtcatacgacttgttttcttttagacatgaaagcgctaagcatnnnnnnnnnnnnnnnnnnnnnnnnnnnnnnnnnnnnnnn

SEQ ID NO: 11201 - DNA, 1590 bp, Oryza sativa
cggtcgcagcagacaaagcaggaggcgccgtcgcagggatcgcggccaccacggccagagcgagagacgacttcgcggccggagtgggaagcgacatcgtggccgtagcgggatggtcacgcagggtcgtcgagcggctgggatgacacgatgtgattcgtgcggatggagcgaaggaattggatggcgtgtgggcgcgagcacgacccgtgaagcgatggcgccgtggagccatgcatggggcaacgaagcgacgacggcatggggtaatgcgcgggataatgaagcgccggcgcagcataccttgctcgatgcacagcttggagtacgaatcaaaggagaaagggagtcagtgctccttggtctcactgccatggtggaatacgccaatcattttagaacggaggaagtattactaaaacagattagcagtgctgctctatctgtaccggtttgttaaaaatcatcactactagaagattttccatctactagataagtgtatgtcctggcaataatgattgcacatcagtgctagttctttagatgaactgatgtattcataaaagaaaatcatgcccaccttgaaaagactacatgagacctacttggacttttaccaggactataccgaaaacttccaacaatacctttgtgagttcttctaggatacagctgtacagtaaacattgaaagacaagccacaacccgtccagccaagatcaagcccaagatccactaggagcccgagaaatttgacttgtgatcgtctaaccactatctcatcggaactttcgagactataagatagggctaggaacacataccctccttttatactcatattatctatatatcaataaagatcacatggcgctgaaaacatagggttattactttgagtatggtctaaacatgtatacaaatcctcccgagtttagctggcatccctcataagagatcacacgtaaacataactagatgtatagattttttgttgtcaagatttttatcgacgactcaaagtattaaattggttgatctatacatttgttatgtagatttactggctcctttgcgccgaaaccacaccattgccgccatgtccgtgcggcgtggtgcgaaggtcaccgcggcgccggtgcccgtgcggcgggagggacggctggcgctcgcggccaggtccgccgccacggccggccccattgccggcggctagagaggcagggggtggggggagggggagggggagaacagagcgtaattgccggctttgacacacatggcggccatacggtgggggaggaacgaaggcgctctagtgccgtgggaggagatgggacgggtaggggaggatagagtttggggatgggatgggagagggtagatgcggttgtttttgggaaaaacccttgtgtttttcgttttaacagcgctatccatgtaggcagaattttcccttcttcgtgttgtattttttctgaaagacgagtggtttttcgtataaaatggaatagggtgtcggtcggtgggaggatgtgcgtgctattccgttcaaacaagaggagctttttttgcataaacaccatc

SEQ ID NO: 11202 - DNA, 3611 bp, Oryza sativa
gtccctgactccctgttaacatgatctccaatgaataaggaagatagggttaactcatattataagattaacagcatcaagacaactaaaaaaatgcattccaaagaggaaaaaaccgaggatgctgaatattcagtttcttgagcttcatttgttttcttataagctgtaataaagttaatctatttttttatagaaaaataaatgaagttatgttgcatctaactcatattattgaaagtaaaatgcggttcaagttgcaaaagaactataggttacaagtcatggtagtcttgtatttggagtataggttatcaactaaactgttgggttgtcttcaatttttttagataatgtgggttgtcttcaattagacgggggaatccaattaacagcctcgactcgtatcctaacttgtctaagaactagcttcgcttcaaccaattctttcgtaccctcagctctactcatgttagctttggctatttcaagtgcctgttgagcttcttcctgatcaatgtcactacccagttccacatcattccctaaaatgatgatctcattattaactttctggcaaaactgctccacagaaccgccgttaaccattgatcattgaggaggcgattctcaagggacccatatctacagctgtgttaattggggggaggggggggtatggtttggtaatatggcaatttggccactactagtagataaaatgatttctttcacttcacaatcccaaatgattcgcttagtgcataaacatttaatttcatttcttcaatttgttctcctcttctaagtttatagctttcgtgctagcttcatcgatgttacccaccaaataaaaagcttgttcaggtagggcgtctaattccccggaaaggattagttgaaatcccataatagtttctgcaagaccaacatactttcccggagaaccagtaaaaacttctgccacaaaaaaacggttgtgataaagaagcgctcaatttttcgtgttcttgctacagttttatctacaagtttagtactattgattatcaaggatctcattatctttttcttttaatagttgtatctttcgctctccctcaactatagtgacaactgatggcagtcttgtgttctgctaacaagttcttttctatctgtgccgttcatactaatggtgcccctcattatttttaggcctcattcgcccgtcacatgtctaaccagggatttgatacatggattgtcgaagtgagaggttctggtctgagcatacgtgatcatgataattctgcttcatctccatcaggcgctttcgatgatatatctaatggcacattggctcttgataaatcaagcacattggaggttgcttcagttcaaagttctggtttctctggtattgattatgatgaccttggaatagttgcgttggatgacccacctttactgatggagatgactagtttctttgatcgaatttcaaaacttctggaagaggctagtttaaataaaaattttcatgagatcacagataagatttcggttctatctgaaatggtagaaagctctgccgttattggtccaatgagagaagaaagtctgcgtcttctgaagaactttcaagagcagattgactcatgggaacactttgtggcaactcagatgaatctaaattctgaatataattgggacttcgaccattacttggaggaggatatacctactgcggtgaggcgtcaccatccttttgtgagctataattgttgaatagttggcactgttgttatattcagtgagctaacagtgtaacagtgttttttaattattccatttgataatttcatcattagtgttataagattgtttttgtggaatatcgcttgacacacagttactacaggtggaatatattagacaacatagtagagtaaaagatgggaagctgcttgccattggacactcaatgggaggaattttgttatatgcaatgctgtcaaaatatggtgagacattacactgtattttgctgatgactgtttgcctgccctttactgttgctttttctatggaagtataattctactgctgctgctagaattggagccactattcaattatccaatgtaaagggaacattctagctgtaggcaatcaacaactactgcgcttgttttgctcagctttctggagttaacggtagattgttggacgtcttacaagttttacctttatatttattctagaaacacagtcaaattgttcatctgataagcaatatcatgatcgtttacagctcagcctactatctttcggttgtggatttttaaagtcacgacttattatttttcccttaatctcaaaggtttcgaaggagttccatcaaacttagcggctattgttactttggcttcctctgttgactacacgacatccaattcatcactgaagatgttactgccacttgtgagttcgtagtcgattgacagtttcaacttgataaagatgtttattacttttcatttttaaagtttttcttccttcattgtcatgaataaaactaatgagttcacttctcaggttcatcctgcgcaagcccttaatgtccctgctgttccattgggtacattattagcggcagcatatccctgggcatctggtccaccttatcttttttcctggcttaatcatcaaatatcagcacaggatatgatgcacccggagttgttgtccaagcttgtttttaacaacttctgtgagtactctttaattacacactgtcacactggattctgcatgtcatgcattttaagatttcagctttgccagaatgttactttaaagggtgttgccagaatattgttcaagaacacacagcactgtatatatgccatagtatccatatataggatttctgtactccagaattaattcataatacactgcattattaaccttttatgctatgatataaatatgggatgtctgtttcagcaacttttgtcaatggggttggatatgttcatttaagttgttatcatgtaatttgcaggtacagtgcctgcaaaggttgtccttcaacttacaacagcttttcgggaaggggggctatgcaatagaactgaaactttctcatacaaagatcatttgcgatattgtcagacccctgtcctagcactagctggagataaagatctcatctgtcctcctgaagccgtttatggtaagatgtggtgcttttcttgtctgctatctcagttgcttctatgaagattgctaactttttgtacatcatactcccatcttgtcagaaactgtcaagctcatacctcagcacatggtgaaatatggggtttttggaaagccagaaggccctcattatgcacactatgacttagttggaggtcgactggtacatattctcagtctcttcacataaaataaaatttgctgctccaattctgaaaagtcaaatctttttgtcatcctcttactcatgatttacacatgtttgtcccttgtacaggcaacggatgaagtttacccatgcatcatagagttcctttctcaccatgatcagtagtttatgtaacagtgaagctcctgaaatt

SEQ ID NO: 11203 - DNA, 5878 bp, Oryza sativa
tgactttagtgattctcagatgagcaagctaaagcattgtccaatactatatccatctcaactagatcttgctgtatgctttctaacaactaacaaggcacattgctgtatgctctatggtcttccattgaagaagggggccaggaccaccctatcctggatggctggacatagcttaggacaagatatactaccactcttttcttttttgagatggaagatcaccactaataataagttaataactgtgcttaggctcttgtttctgttcttttgtgccaagcatgatgctgtccaggcataaagcttggagaggtagggcatggttgagaatttggcttcttttccgcttttattggatcctagttacccggtggcctacacaaaaggaagcaacgtgactatggcttgtcacgcgcaatgcacagctcatgctggctgttgcaatcataagcaccattgagtgaacattggcttttgtcttctttggaatcttgagaaattagtttatgccacaataagtgtttgggaaattgggatgtcccagatgtaaattaacatatggttatacacatgtgcttgctatctcctattttcgacttatttattaagcattaacttagggtgcgatcgtttcagcggtggtggtggacagcttaggcgcacacaaaacgagaaatacgattagcatatgattaattaagtattaatatataatttttttatgaataaatttgttggtttttttaacaacttctttataggaagtttttgtacgaaatatactgtttagcagtttaaaaagcgtgttaatggaaaacgaggagaatctaatcctgtaagctggaaagagcacacccttaggttatgctctttaccctatttttctaattcattttcttcgttttccgcacatacgcttttcaaattgataaacggtgtattttttgaaaaaaaaaaacaattctatacgaaagtttttttaaaaattcatgtaaaaaatagctaatacttaattaatcatacacaaatgagttgttccgtcttgcatgcacgagggattagttcccagccctaacagctgaacacaacatttaagtcgtagaacagtgtttttgacaagtaaaaaaataagagtgcaaattttaaatttacaataaaatcaataagatcaaagtgaaaaacagtataattgctcgaacgggtacgctcaaaaaaccattaattatgcctaatcgcaaaagaaaattttccttctgtttttaaaaaaagggtttgaccgttgactgccaaaaaaaaaagagaggggtttagcctctgccgtttacggtggcccgtggggtctataaccgacggccacagatgcatcacagccaccggtgcgtggcccatctccaattctccagttgcttccttttcgttcccctccgcggcttcaccccgtgtccccgtcactctccggccagcgcctccactccactcccctccccacactcccccgcgtctccagcgccgccgccgcggtaatgtgacctcgcgcgcggcactccgggattatctaggtgcgtcttttctttctttctttctttatttctttttttgtttcattttcttccgtgggtggaagattctcctgcaactgcagattgctttggtgtaacctttattgttggatttttttttctttgttttgttttttgcccccctttgtttttgtaggaagagcacgaggaggaggcgccgatctgtagggctcgttgttagtcatctcgaccaagggaccggtgaagctgttggttcttgatttctttcgttgcttttattattgttctaaagagaaatcctcgttttcttcctgtgagatttatgcacatatctcttagggcactcttacctgggaatatttcgttgtttttgcagtgattctcgttagtgatttcgttgtttttgcagtgattctcattcgtttatgggtgcctatttttaggattattgggtgttttctaggttgttattgctagaaatgctaggtttttttggttcaactggataaggttgtttaagtttgttgtttaccttttcagcggctgtggtttggactggtgacgtatccagtcaactctagacatcttttgtcgactcatcagtaaacagattacgcccctttctataaatttgctgctgattcttctgtcttggatttttaacagctcataagctcatataacctgcaactgatttatggatccgttgaattgtttttattcccctagtctttactgttcactaaagtaaaaaaatgaatggcacatattaataatgataaactgctgcttattactgtttcatacaagggggaaattctacctagaaatgcacaccatggcatcaataaaaaaaaagaagaaaaaaatcagattactactcaatcacatgctgtttagtttaggttgaatgagtttttgtgaatgtgataggttttctagctttgtaattgggtttgaaatgaaatggatggttatcatcaacttcctggaatttctagtttgttgtcgtgttttggatatcacaacaggtccagttattaggcattacaatcctgaaccttctttcatgttcttgtttgttcaaactttttcaaataccctttgccctttcaagttgtgagggatatacagcaaggtcaaggcgtgaggcatataaaaagggttgcggcttgccaatacttgcagaacatcttctcagtttttagcgatacatgatttgacatggatattcaaacttcaagacttggtctcctgcacaaaagttctatctcatttttcgtgtttcttttctaggactgggtttgactttgtattaattctgcatctccctttcgttttctaaacaacaatgtactatttaactgtatttaatctaacaggaagttttccattaaatttttttataaatgataaaatatgcttgaagggcttcaaagatgtaggtattctagactactgggctttatagagtcaaaatattattgctgtctgaagacaggtaaaatgtgaccaatgcatgatttcagcctatcaagaaacctttctcatcctttctgtttgcacactcatatgatcactagttcatattgaccacgttcatgttagttatatttgccctgctgattccaagcttcctttttgattttacagggaaaaatgcctgatatccagttagggtgccacactataaggtcccatggaaccagtgtggcaagactccacatgtatgactggataatacttctctttcttgctgttgttgatgggctgctaaacataattgagccttttcaccgctttgttggacgtgacatgatgacagacttgagatatccactaaagggcaacacaattccattttgggccgttccagtatgttctcgttatgccagataaaattttcttatggtttcatctatcgtttgaggcatgcaattctttcttgacttgcagcttattgcaattgtgctgccctgggttgtctttggtggaatttacttcaaaaagaaaaatgtctatgatttacaccatggcatactgggtatacgatgctctcatttgtagatatctattgaagttacatctttggttcatgctgaaccatataatttaaccatagagtttgtgcagggattctatattcggtacttataactgctgtgattactgatgcaattaaggatggtgttggtcgtcctcgcccagatttcttttggcgttgtttccctgatggaatacctgtaatctccttgtgctagtgtcctgatctcagatattaaacttcatgtagtctgcaggttatattgaagtaacaaatcgtttcatttttcacaagtttgataatgtcactacaaatgtcatatgccatggagaaaagagtgttatcaaggaaggccacaagagctttccaagtgggcattcttcatgtaagacatgcaacgcatcggtacttttaagttttgaagtaccgttgtatgtttctgagttgatatcgagctttacatgccttgcaacatgcattttttacatctgtttctccacattctctacatacatttccaaggatttttctccaattttttcttttgcaacagttccgagtattttagtagttgcctcagccttcatgtagggcattgttcggagtactgctctccaatctgatgtgctcctggtaactatgcaggacatttatgaataaatgaaattcttgactagtttaaattcaatgctatattctcttggtaactatgtaggacatttattgaaaaattgaatttattcatgttggtacccttaacacctatatgttgtatctatgattaagactccgaggctatcaaataaatggtgtagctcatctttttcttataattgtttatacttcctcctgtacagaaaaatgtgtttctggacatcctcatgatatctgacatacaactttgaccactgattttatagtaaattatttgtataatcagattaaagtatagtgctataaaattgtcaaacaaatctatgaatatagttttcatttatctaataataattaaagagatttgatgttgaagttttgaaagttttgctagaggggtgttcaaaacaatagcttttcatgaccagaggagagggagtatataattttttcctggcatgtagcaccatatacagtttgttctccatatattttcgaatttcattacttggtggatctgttgtctgtaatctgacgtatgtgttgtggttctcactcaccttctgcagggtcttttgctggtctaggttttcttgcgtggtacttggctggtaaacttaaggcttttgatcgcaaaggccacattgcaaagttatgcatagtatttctgcctctacttgttgcgtcccttgtggcagtctctcgagttgatgattactggcatcactggcaagacgtatttgcaggtggcattataggtttgttattttgaagcctttctctcaaccatttagaacactctcgttgtcagaaagtaggcatggatctcgtctcattcttctttcccctttttcaggtcttacggtttcttcgttttgttatctgcagttcttcccatatccatttgatgctgatggtacgtttcccttctgatatagatgatatgttggaccttgatcgacatattttacagtatattcatgttcctttgcatttgcagctgtatggccccatgcatacttccaacagctagctgacacacaaagcaacggcattgcaaactcatacaacatgggaccaacagacattgagattgctgacgaaggccatggtgccatttccctgagagacaccagtcctattttagacacgatggagtctggtaggagaggctgaaacatgaggcgacaagtatcttgatgttgtgtggattcttcggcctttctgagttttaagttctacaacatgactagttcgtacggttcccccatttccatgtacattgcgcaagaataggtagagttttgccaggtagaattgtgcttgtcatctcaggtgatcgtctcatcattgagagttccttgcaactcggtgctggccgttatatgctgacttaaactcgttgtgggtgttggctgtaaattacagtgggagtttgcactcttaatcatattccacagtcctctttgttaccctgctgatgtacctatcctacgctctggttgtgctgaaattggtcccaatgtaaattacaaatgttgctgatttgtctgatccagtttattgcagttttagttgctccgttgtgtaaatgctcatagttattttttgttttgtttttgaaggctgctcatag

SEQ ID NO: 11204 - DNA, 3320 bp, Oryza sativa
tcgaactttttaaaaaaatccactcccgactagaagtcctgtccaaagaaggccttttaagaagagagaatggcttttatcagattcgcggtggacacgtgtccatcagagaagagaaggacttttctcccctcatcttctgctgcgggatgctgcttccgcgttgcctcctctctcctgcactcctgctgctactcagcatcgtctccatccatccattcgctttcgcggccgcgcggcaagccggggaatgcgacgctgcgggcgactccggcgccgagatcccaggtgagcaccctgtgcagtctgcagcacgcattttcttcttcttttttacattctcatttccaatctatttcatgtatggattctcagattagattctcctgccgaccacttgggttgggggggtgaccgtgttctttacttcttgattttatttttctttatctggcagaactgtaacatatctcgtcggtgcgagctggaggaggaggagccattggtatctcgccagcggggcagtgagcctgtcagttattcttttcttcctgtgaaattcattagaaagaacctgttgtgctctccgtgtggagttctcgataatttgagattttttttcttagtttttccctttccaaagattgttaaggtgctttaggggtagtttgtacttcattatgttgttacttttgttttattaataacatgataaggcttttgtttagatctgttatcattttttagtgatatgaggtttggacttatgtggggtggtcaactctattagtattatggaagtttaacaacaagtacaaccaaacgaattataatcaaacaatttaaaaaattactgatggtgaaagtttgaatattaattgtcatgttaagtattgtcatactgaatacttcatactctgtaaatactggactcagggattgcatgaatattgtttccaagcaaagtccaaagtggccacatgacagtgatgaaattttaatatcgggccatgagtataatcttatcaataaaacactcatacttcagtactcaatcaggtggctggttcaggacttcagcttagattgaatgaattgttgctactgaaatgggtgattattgtgaattgctggctacattgaagtgtttgaccacagccttggaacttctaccttttgtaggctatcgatatcgtaaattgtttgtattattctgaattttcaaatagtacatgcccttcgaagtgccaagtaaattggatcccacagaataagatgatctcacttgtgtggtgtatgccttttgtaaatacagttatacgttagaatttacatgagttctgatgccacttttttccaccctatactgcaatttcattaactgttttctgattgctgcaaacatgtagttttcattttttttcaatactttatacttttgatcaaacagcatctacgttctatatattctggagaaccccaactgaaaagttttattgctttgtcaagacagaaaatagcaactcggaacacatttatgattatgatctatcatgacatcctttgttgttccttattcatttccatgttcctaacaccactggattacatccatcaccttcatgttatttacaattttccttctctgactatgaactcatttctgtttattttcaattttaggggataatggctgatacccagttagggtgccatactataggatctcatggcattaaagtggcaaaattccatttgtatgattggatgatacttatctttctagctgttgtttatgggctgttcaacataattgagccttttcaccgcttcgttggaagtgacatgctgacagacttgagatatccactgaagggcaatacagttccattttgggctgttccagtatgttcttgctttgtgagatttaattttcttataagatcatctattgacttgtctgtggtgcatgacatgtctctgaggaagtttggtttttcttgatttccagctgattgcaattgtgctgccctgggccatctttggtggaatttacttcaaaaagaaaaatgtctatgatttgcaccatggcattctgggtatatggtactctcatatgtagatatctatcaaattacactttcacttttttagttcatgctgaactggacactttgtacagggattctatattcggtgcttataactgctgtgattactgatgcaattaagaatggtgttggtcgcccacgcccagatttcttttggcgttgtttccctgatggaaagcctgtaatatccttttgtaaattctgatttctctccttaagcaatttcattcctatcgacatgtacttggtttagttctgtttatttcttttttttttacagaagttatggaaaataaaaccttttatgttaaggacatgcagattaatatgacctgtacagggattccatttacttctatgatttacttgcttaaagaattattttttgtgccatagattaagcaaattgtacagaaacaaggtaaacatcctttaccttattaaaagtaatcaattatttttgtttttgtagaatttcaataatgtcactggtgatgtcatatgccatggagaaaggagtgtcatcaaggaaggctacaagagcttcccaagtgggcattcttcaggtaataaacagtgcacagttgtactctagatatgatgtcttatgctttaggttttttttttttgaagttgtaacttaactgtaagtaattttctcattggttcaaatttcattatgatttatgccttatgtttttgtggtgctcctcattatttttgagtacttgtgagttgtgacatgcatttatttacatcagtttatcccacactctctacatcatgtacgtttccacggattttctccaatggttattttgcatcactgctgtttagtctagtggttgtttcaggttttatacctgagcattatttgatactgctcttgcaatattaatatctcatgtatatatgtgctcctggcttcctgggaactatgtaggaaagctgggaagaaggtttaactatgaactgtttctctactagtttaaatcccatgctattgagcagttagtttttttttttttaacaattgaaattgtatttgaatgcatctcttaatgcatataggttgtatttgcgagttcaggtgccaggagccagcagattaatttttttaatctcattcttgttttcttccaaattgtttgtatttaggtttttttgttccatcatgcatccccatatcagcagtttgttctctataaa

SEQ ID NO: 11205 - DNA, 7919 bp, Oryza sativa
  unsure (1)..(7919): unsure at all n locations
annnnnnnnnnnnnnnnnnnnnnnnnnnnnnnnnnnnnnnnnnnnnnnnnnnnnnnnnctctatacagtggtggtgtggagatggctctttcatggccatacccataacatgttatgacttcactatgtgtctggtcagatgcatctgtatgttctttggtttcccatactataatgatggcatacaggggcattctcctggtctgggttttcttgcgtggtacttagcaggcaaacttaaagcttttaaacgtgaagggcatattgcaaaactatgcctagtctttctgcctctacttgttgcatcacttgtggcagtctctcgggttgacgattactggcatcactggcaagatgtatttgcaggcggcattataggtctgtagtttcaacgcttctgtaccactttaaacattcttgctctcaagataagtacatgtaattcatctcattctctaccttattcaggtctcacagttgcttcgttttgttacctgcaatttttcccatatccatttgatgctgatggtacattcccctcctatatatcgatgatgatttagacgttgatcgacaacattttactaaagtgttatgtttctcttcatccgcagctatatggcctcatgctcacttccaactgctagccgagtcacgaagcaacggtaatgaaaactcacacaacatgggatggacagagaccgacgctttccatgaaggcgctggtgctgttgcgctgagagacacaagcctggttctagactcgatggagtctggcaggaggttttgaaacatgtgaaagggaagtatattgaagatgttcattgttctgtcttcatcagagttgaaactctgacgtgattagttaatgtggtatgtacagggtgaaactgaagtgcaggtagagtactatcattattcagagtatttggaactcactattgtttttattcacctttctgtaatgcagtatgccattgttttagtttatgcagaagcatgatatatatataaaaaggatttttgtagtttcttctgaagcacgatgatactgaataatagatttataaacagtaacgcactatcattctcaaacagctgaggttttcagggtgggtagcaactacaaattcagtatcacatcagaatgaggcaattgggtttgtgcttcatccattggcattccttgtgttgaacctgttttgtcgatgttgtcatctagaatttaccacgagtggttgattatcgtggcagatgagactaccattttagttctgacacttcatcatctaacagctcgtctgcctctgtaaacccttcctgaaccttgcgaagtgtataaatctaaacacaagagtcactgccatttgggaacttattacagctccaagttttccccacttttccagattttgttttgggaagcaaattgtttaacatttcacccaaatgtttttgctattagcaacaaaaattattgcaatttagcatgaaggctgagagaaatgaagcgttgacactaagcaatcatatcgatttgatgcacagaaatattcagaatctggtgcaagaagaacaaattcactacattttgttatgcctttttcctgtaatattaagcagtctacaaaagggtcaacaaattaatttagttggaaactgtacatgactggctgcaattgaggtagctagagtttgccatcaaaatacaaattacataaccagacacctacactagaaatctaaaaactgaatggatcacctgaaggcatccactacaaaaaaaggacccaagaagtgaggacaaaaactgaagaaaactaactcaaagcatttgctacttacaagaggtgaactaattatgtgatggatttgatttgcttgagggaactctcttcaagctctcaaacaccgccttcggagtcttctcgaaccttccaagcccgtccacacgtgtcgagcatgaacccgtgccatcgcattgcgacaacaaccttctactccttagaacagaaggttgttcatggggtgatgatgttgaagagttgcaaagaaggaagaagaggagaagcagagcagagaggatagccacagctggcttggcaaaggtagtactactcctcatggttcctttgagaaatggagaagaaagggagtttggaatattgtgtatggaccttggacaacatatttatagcatcaatctcattgatgtcatgtgaacttcatatgtgtgccttgaccatcaagtacacacaaagaaaattaatgtaccatatcaaggttggaaaaataatgaaatccacaataaagttattcctccttatatgattagctagaagttgggtactcattgagttgttaaatgtaaacacactttcagttaaagtgatggccttctggccctggtttttgtcaaaaggctgatctggttaacaatctttcctagtagtagtccacaggttaagtgagatcaaaagtgcattagagacaactagaagatagttgtaaagggtaatgtgacacttggggggaaggaagattaaagattaatctaaagcctaattgagaaaacctgcatcttagcagtagcagtctgcaggcatgcagaggaggagggagggaggcatgcttccacatgagaggtctgaacaacaaaacagcatggcaaattgtacccacatgcaatgcaatgagcaccagcgaggctggttagctcaccaacaccccccccccccccccggcgtgtcagcgcgtgcgccggcgggaggaagatctgaatgccgcgccgtgcacggactccgatgcacgtgacggcgtggaggaagaacatgcattgctttttctcaatttgctcgtagatttttggctgcagctgcctgcatcgtgacagctgattcagcatttcagcattgtgagtgtgatttgttttatgggaagacgaacggttgagcttgtgaagaaaatgtaatgccaaacctgaagaaatgtggggggtgaaaatgtttaagtttcattgcattttggttttgtatttctgttcattacattgatatggcgttggcttagagtagccgttctttttccttgaaaaaatcgatccctatcttaatgcctgtattgattcttttttttcttttgccgggatgaccgaaggaggtcatccaaatgttattaagatagagggaaaaaaaggttacaagaaagtttttcgctgtcgaggaaagatgtgcaccaaaacacacgccccgacaccacatgccaaccgcaccaacacaagctacagagaggagagccgaacaccgaaccggccgctgctatgcgaggccggtcgccaccgggcttgcaacaacaccacagagcagaaattccaaaaacaacgccttcatgaaggttgcgacgccaaaagacgctgtcgatgaaaaactttctttgcgacgccaaaagacgttgtcgatgaaaaactttcttgtatgattctttttttcgttctttcagcttttccaacctggttcatggaagatctagatccacatttttacttagttaaatgaagaagtgcagaacacctttggtatttgcatcaaggacgcacacagccatggagatctaggacacatcagcattgcaaatcttgtatggatcaagcagagctcaattagtgatgggatcacgaaattgttagttattcttcaaaggacaataacatagttggctggtcataagattccttatttgaccatgacatgcatcagcatcaccctacattcctactaaccattttcttcagtagcgacttagtgagtgatcacagtctaaacgcccctttttaggcctaaattagagaaaaaaaacatgtgttcctcatagaggcatatgacttgcatcacctgagtggaaattgcacaaatacatccatatgtcacatgccccatgcactggtttctaccctcaaaaagtagcttctctttttgcatgtgcagcctgtttacagatgaaactgctattgtcagtctgtgtattgtgctgttaacaaccattctgatttcattggtcaggggatctgtcattttgaaatctactctggattcacctgaagcttctgtagatggaattggattcaaaacaattgacttctgcaacattcagttttctgccctgccatctggtaaaaatttatcttctggtccaggttctggtcctgttgagattgtaattaattatgctcatataagaaggatataccattgccagcagtcagttatgtccagatccagatcagatcctaaaaagagatggtttgtgttattgttcatcttctgtggtcctcagatctgtcataggaaggaatattttctacatcttctacagatgttccagtccttcactgaaaagttcacttgtttgcatgtgaacataagttcagccataaactatcttcaattaaccctggtaaacgatatttcagaaattgtgacaatttatgaatgtaagaaaccaggataattctactgctccaagatttccaaaataatgtcagctactattttactacgtatggagaactctgtgaatccagtcaatttacatgcatattacagccacattttcatttgtgcatgtgcacaaaagcacatgaaaaatgctatttctccgtcacacagactataaccagtagacagaaaagcagccatgatgcatataatggcagaactctgagaatactaacatcatatacacaaattagtggaacaagggaaaaaaacatttttctggtatattagcagaaaaggaaactgcgagtcctgtgtgtttcctaagtagtttctgagataagacgaacttcatatagatcatcaccaccttttcctgtatcatcagaaacataaattgacaatggatgatatagacaaaccaagcttcaaaatctaatggagctaaagaaaaaataatacaactcaccaatttctgccttaatcccaggaccaaaaaaggatgtgaatttggcctgcgtgggaaaaatgtttgcaaggaatcagtaatgttaatatttaattctattttggatcataagcatgacgacagtatgtattgttctcgaacagctcgcccaagtacacagtacatcaaagaaatagtttatgggagctatctaggcacagaattttgtcatttttgagcatcaagttttgggttacactttcttctactgctaatttttgaacctcatcttttccacaacccaaagctgctaaaaattcatgtatttgtaacatgagattagtttagtatagagcttaagactagtacatgtatctagatctgaccacaaaggcataccacatgcatctcagtccacaatggaagccgtgctgtattatatttagaaattaggagaggggattcacctgtctcttctcaaaatcggatatctccaatgctttggcttcaaatacaagtactaaactgtacttcccatcatcagttacctacaaggggaaaactactgagtcctttaaccaagaatcgcacccagtgaacaagacattctttctgtaacccacgaagatgttttttggggtaaaactggagatatcaataaacaaatataacccattggaatctccacaaggcatttggacagtttcaaagattgtctgaattatttttgtgcaattccttcatcatgagttcagccaaaagctatatcatttacacttgaggaatatcagatgaagaacaactaggaaacattaacatataactgggccatgttcattaactgggtaaagtagaatcaactacagggcctaaggcttgtctcgaagagaaaagaaggggccgagccctctaaggcctagtactaccttgtccaatgaacaaaagttgacaataatttcaataaaaataaaatcaagccaaaggatctttggcaccactcttaccaacattggctgtgcctttgccctgagatcagtgctaacagtgtactaattgaagccattaaacaaaggaaacaatgaccaaggaaaactacggagatctagaaatagcatttgatgctagctgaaaaatctgctattaatttgacttaatatcatttgagttcatctgtcatgactttaatgatgatacaatcgattgggacaaaacttccattagaaatggagggatgcaggatttttagatgcatggtggacacagaaacatcaatgaggaattatttcccacaagaaaaatacatatttatgatattcatatttaaatttcctgcctccttttcatgtatctatagttcaagaacaccacaaattggccattatgtaacaagttgacatttgacatgctaatcactgcactaatccttttagtagtctggttagagtaaaagggtctaggccattaaaaatcgctactttgcccatttatattcttttacaggcaaatattttgaatcatcaactttgcttgatgttactgtaggaattgtttcagtaacatcctacagtccacattgaagtaacaggtgccaaatgccaattcacatgcggcagatattgtgtgaacaatttggaccggtcttggatggcatgttaagtaaatcatccttacaggattagttgggtttgtttgatatcagcttcagataaatctgaagctcacccaagcagggtctaaagtggcttcttttaaacttgatggaccaaagtaaccttttgtgaaacttgaggggtccattttgtaattaaactcttccaacgagtatgaaatataaactatgaaaatgatatgtgtgatttacattatgcaatattttggaaagactacttcacagaaaaaaataaatgtattgggaacttacttcttcccgaatgttttgtaaaataggtgcactacgccttggaattccaccaccctgtcagttggattgtgcaaaaggaaggcagatcaataagtaggataaagcaaggaagttcttgccttgcaaaacttctaataacagaacatggaattattgataaaaaatagatgagccaaaacaatgtccagttagtaaaaaagggcaaaaaaaggaattaccaaaccatattgaaagatcctcttcagtgcttcatccaggtgctgctcatcaccgtatctgtaacgtgtaacatcactcctgacctagaggtaagtaaagctggaagatcaatactattgccggtgttatctttccaaaatccacaaattcgctaatgtctactcacgcctcttcctacaattttcaacacttaaatcccccctggcaccaatggtaagaaatccactaagaggattgtactcatcatgtagccttatttttctccaaataagaagaaaacagattataaacagctcaagtacaccatgaataaatagttaaatttgagcagtggaagtggagcatatgtcctagataatggaaattgaatagtacctgattgaggataggggtagcacacttttctcttagagcaaaagcatcggcgtaggttgtgcaaggcaccggtttcagttcagcatactgcatgtagaaaaatttaagaatcagtgcacactgcaacaaagaagctgacaaccttcaacctaaactccaaactaaggacagctgctcatctgaaactccaacacagtaaactgcattctattgctgcagagttattttcaagtatgtaatatgaaggtgcaaactcaatgaaaggccaatgactgctaattgccaaaaggcaccttcctgaggaaggtcttaagttgaccagtatggtcaaacaatctaaacaaatacaattgatatgtctcaacatgtcatatgcctcattgcctctcctcttgtacatgtcacatgggggatagttcttgccttcaatgccatgccgatgatggtgagtggaaagccatat

SEQ ID NO: 11206 - DNA, 3212 bp, Oryza sativa
acattttacattgattgattataaaagtaatggtccatacaaatctttgtgccggtataactattggccaacgatcaatagaacttgatagttacttttggtgttccttttagtatgtagaaaatgggctacatattttacaacttactgtatctttggtgagatgcacctgctatttttttctatatgttggctagattgtttcattgttattaatcgataccttgggtgcatgtaacactatatatatttcaaacaaaaaagccttctcgggtctaaattgatttcgcagtgtgggagacaattcatttgttccgtgcactgtggtatgattgttgtcatgatttaaatatttttgctctaaaatttatgattaaacattagaaatttacgtgatccaaacgatcactgtttgtgattttatgttagctaacgtccattgggcatttagtgacaatatttatattgcataatcttaaatgtgaagcctaccatgcttaccctattttatcttttttgtttgaaagaattagccatttatacaatcatggtagtttgaatactaaatagtttttatcttttaagtttctaaaataattggtagataaagctcttagctcggtcatctgtgatatacacctgtactcccaagctaatttggcccctatcacacatgtagtcacaagctaatttggcccccatgctgatggtgttcccattaatgtcgatgggggcaaaactgtgaccgatcaggagtcttaagcgtttctaggatgttcacgtggtggcttgagagttcttttaggaggtttaatggacttttagtatataatagataaatataattatattattttgacttaccatagttttagaatgcggggaataattttttttaacaccactcatagttaagtttattttacttttaccgttgttgatctaatttaattattgtgaatacattgataaaaatatatatgattattttttcatattttttatatttatctaaatgacatatataaaagtcagaaattataaccaaaatgtgacttttttgaaagttgaaatataatgaatatgatctttaaccatatatttagtcataaattatctaacgatataaacagataaaaaatatccatttagatttgtggtttctaaccaacattgcatacaaatagttataatagaggcccccactaaagataaatagagggacctcgaaaaaaatcccgtacttacgactccatgcgcactaaaatttttaattacatgaaaagatatgtacttattatgagtattgtgcatatctaatatgatgaaaagatatgttcgagagcgatgaattctagactaccaagagcgatgaattctaccaccatgcagaaagatgcggtgttttttttttctttttcatggagataattacaaataatccacaactttgcacgacaaaggcgcatgcacataattctggtgctcataacaatcatatgcgtatactgatagaatttgcaacaacattagagctaattaagtcgttttaccggacagggagtcagcaatgccattggcaacgcaatacgctatggacagtacggtgatcatggggttgatgcccactgcggtgggcagcacgctgtcattgcacacatacagttgctccacctcccagctctcgccatgggcgtcgacggtgccgttgcccaccgcggtgcccatccggcagcaacccatgtggtgcatcgagcagaagaggccccacgtctcttttagagattgatctaatggttaaaaatattgggtccaccggattaaatgaaattcaatagtttttgcctttttctaagagattttaagaatttctctaatttatcagagtgccacgtggtggcttaggagcatttataggttatacgtggcagcttagaagcgtttgtagaaagtttcatgacttttaatgtataatattatgtaccaaaacatggtcaatatggatcaaacaaaaaaaatcaaatatgttaaaaaatataaagccatctaatcattgattttttttaactcttgagctagaaacctaatagagcaagtgaggagatcggagactcatcatcagttaggtcatatgcgtgattcatcaacactactcttgtcatagatgatcttacttcttagatggattatccgtacagacatatctcaaacattcaacgttttgatccgttcgttagtatgagagctatcataaatgatttgtcaaggatggcttcgcttaagcgtgtcataaattgaatgtgtagattggcttaaaaaagtcattatttatttatgtcgccaagatcattcatatataaattaaagttccatgtaaaaatagatctaataatttttatagtaacaaattatggtgcatacccttaatacgataatagaagaagagagagaatactgagtgggaggagcagatgtggtggttcgtacgttttatacgtacctgtagctccaagagaaaagggtgatcggatcggtggatttaatgtaatggttagtattaccgggtctcctgttttacttaaaaataacagctagatatttttctttttttctcagaaattattagagcgtcacgtggcggtttagaagcttttgtaggaatcccacgtgccggtttgagagcgtttgtagaaagtttaatggacctttagtatataatatataataatatatttattttttggctagcccattcttcaaatttacattgcacgggctataatattgatactataggattcctcgacttatgagtgtttatagagtgccatgttaaatcatatctaccctggtgcaagtgaacttaggggtcatccgatggctaagatgagcccttaattagttgatgtcgtttcatatcagaaccgaaacaacatggaagtttgaacggcatttttcttaaaaaaaacagcaaaagtagtttgcagatcaaagtttgaaccaaatcttaattcataaattgcaccggagcagtatatgtttggggactcaagagtttggatggatccacatcgatggactcatggcactcacggctgtttttgtggcgcagatcttctggtgcagggcgatcactcagtgaaagaggtctacgtatatgtagtcgttgtttcgtcgcgcgtgcagaacgtaaggctaacgtagcacgttct

SEQ ID NO: 11207 - DNA, 424 bp, Oryza sativa
tacatggtgggctgtgggtgcatggttttgctagacgtgccccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagctgtacacctctgatcagagtaa

SEQ ID NO: 11208 - DNA, 468 bp, Oryza sativa
aacaatgtcaaaagtccatcacatagtcctcacatagtccatcacattttatatcacatagtgcaccacatatgtcatactaccaaccaatagattaacttcatacaaattacttcttccgttggcgccgaattgcttgcgagcccggagtgtacctacatttgaaaatccaatgtttaaaacattttaaaaacaaaataagggaaatcaaataacatttgagaatggtaagctcattttacctctttttcgctgcccgagtggatcgcaaattgtattgcgtgggttgcgtcccctgaggcgcgtcgggaagctgtgacatgtctatctcctcggcgtctggtgcgacgtagtcctcatcctcctcgtcctcgtcgtcatcatcgtcgctaggtggagccggcgccttcccctttcccctcccttgcttaatgcgtgacgacgacaagccaccaactcagtcacgct

SEQ ID NO: 11209 - DNA, 2478 bp, Oryza sativa
tgcaagcttccaccacttttatgcattcctcaatctctaacgaaagcaactactggtactagcgtttttttctacatctcaaaagttacactttggcatgacatctccttaatttggagagacttgagtagaccacgccaccatttaaattaaagtgcgttgatcgccggtcaactaaacagtgtatgagtatgacatcagacagcgactgttaattgattagcaaacaaaatacatcaaatcgagcaagcattcaggtatacttactactctaaatctattataagttacatccacctaaaatcccttacaatttaaaataaagggagtacctgacgttcatgttcctagttttcatcagcgaatgatggcatgatcaaatcctagccacggccccacccaccctgatagaaagatttgttcttttaagagcaggtacaatagcaagctataagccagctgcaaacatattttaagaagataaataaggagagagaagagcagcgggatacagatttgtagccaggtgtagcacgggctccaagacgtaatgtgtgtatgacaggtgggaccagatattaatagtgtaatatgtaactattgtatgaatgagctattagattggctatatatgaattggagctattagttggctatactattaaactttctcttagacctgaaacaactagaattacatatgttaatttatttcgagacaggtcaacacatgttaatttgaacttgtggaaccatacagtaataaatctcctacaagattttgcaactgattttgatcgataccgttccgtcccaagctagccagtagcaatatcagttcagctgtttttcatgtgcccgatcctctactttagccctaacttaatgcagcttgactttgtaccggcagtcaaggtcaaggtcaagtatatatgtagatagagctaatttaagtctacaagtagaaaagaagaaccaaattaacaaatctccctctctttctcggttagcagaccaaaagaaactgaacgtacaaaagttccattcttctatctttttttttaaaaaaaaagtaaagtaaaacccatgacaaaagctccatttttattttaaaaaatttatcaaatcccatgctttatggtaaaaaattaaaaaaatcgcatgtattatagcttgtaatacatataattgcatgttttagttttgtggttcaagtgttacatcagtcttgttgaaatctcaattaattttagtgtgtcggaaacaatactaggttttgaagtagtgaagagttaaaataaataacctaataaagaaatcaaaaatatattttacactcaatactctaaaattttaagtaaatataacttcaaaactcctgtcaccagaagttcagaatacctgaactttgctaaataaaaatatgttctataatccaggccaggatgggccgggatggatagaagcatgcccgtatgggctggaaattgcaataggaataagttcactttaggtcccttaatttgtcagctagtctaaatttcgtccctgtttcgcaataccagatatggcacgtcccgcaactctcaaaacagtataaataaggatctaaggcagtttggatggcggtttcggctgacgtgacacttatgtggtgttgatatggcacttcaagcaaaaagaaaccgttggacccacgtatcatccggttaaaaataaaaacaatacagtgggacccacgctatcaacccatatctttcccttttatcactcttcctcctctctcatcctacccaaccgtgcgcccaaacccgcgtgcgctctttggagcgtcggaggcgacagtggcacgcccctggggtgcgcctgaccggccatcgccgtcgcgctcttcggcgttgggttcctcctccttgacccgctcctcgacagcatccactcccgtgacgcgctcatatcctggtgacagtgactcgtccatccttcatccacactccttgtccacgcagtacatggaggaaccgagcgagtttgtacactaaccgtcaccggtggtgaacgagtagaggttgcttgtggcaaacgcacccttggcagcccatccaagcgtcatctctgcggacaacatcgcaaagaagggcacggacaccacatatgtgtccctccagtagatgtcggggtcgtagttgagcgcgcgggcacggatgcgaccagtagaggtcaaggaggccttagttgggtgcgcgagcgagtttctcaacgtagaccctgaggccacgatcggcaatttgctgctgtgggaagaggagcagcagggaggtggggcgcaggaggaagaagaagagggagcggaggagcatggtggggacggggaggcacgccatggccgtcttccaaaatcctccggccttcccctttttgggccctttctgggcctttttttcccaaggcaattgggggggaaaaaaaggggggggg

SEQ ID NO: 11210 - DNA, 3125 bp, Oryza sativa
  unsure (1)..(3125): unsure at all n locations
nnnnnnnnnnnnnnnnnnnnnnnnnnnnnnnnnnnnnnnnnnnnnnnnnntttctcaacgtagaccctgaggccacgatcggcaatttgctgctgtgggaagaggagcagcagggaggtggggcgcaggaggaagaagaagagggagcggaggagcatggtggggacggggaggcacgccatggccgtcttccaaatctcgctctgcttgcttcagatggaaggagccaccatggtctcgctcattctgtttgcttcacctactctctcccgctgctcccctttttcacttccacgaccattctcctggggctttccatcatgaagttggatgtggacaagagcggcgacaacgcgggggcagctggtcttctgttgcttctagtggcgcccgctgtgtccgtcataggtatactgctttggctcgcgcgtgcgcggtcaaacctcgagcccgcctgtcctcaccctcagcttcctctccccacgcccgaccatcttcgtctcgaggcatgtcgtcccccaccgtgcgctcgtccggtgcaacaccgcgtttgccagccggccgcctgccattgtgcctttctgcgtgctcactactagccagtgcaccgtcagctccacaccgtgtcccaacatgtgggttactcactaacacgtgggtcccactttttatctaacttgaagtgccctgtcagcgccacgtaagtgctatgtcagccaaaaccgtcgttcaaactatgttgagaccttatttgtattggttttggaagctgaggagacatgttttatctagtattgcgaagttcagactcggcgacaacttgaggtacctgaaatgaacttattccattgcaatatacgggctgaacacggacagatgggcccagaaaaaaaaatatcccacactccaaacggacatccgcctctcattctccgtctcctctccccaactcctcgcctcgccatggcgccacctcccctgcacctcttctccccgtccccgcggccgccgtcgccgaccccgccgccgtggctccacggcccgcatgtcccctcgacgtccgtctccccgccggaccccgccaccgaggcccctccggctccgaagcagcaccgtgggcccagaccggcgccaagaaaccccggctccgccaagcccctcaccgccggcgtccccggcggccgcacccgccgcgcggtcctcggaatcatccgcaaggtccgctccctcgagctctccgacccgcgcacacccagccccaatggtggtggtggtagtagtagcagtagcaccgcgaccgcgcgcgtccccttccacctcccgatacatccgccgccgccggagcgggaggaggaggaggagaagaaggggattcgcagggcggtgccgtgggccgcggcgagggacgaggagaccaaggtggtgctgcggcgggagaagaagacgcgggtgccgacgcgcgcggagacggagctggaggccggcgagctggagcggctgcggcgggcggcgcgggggaaggagcggtgggcgcgggccaagaaggccgggatcaccgacgaggtggtggaggaggtgcgggggcagtgggcgaagggccaggagctcgccggcgtgaggatcgtggagccgctccggcgatgcatggaccgggcaagggagattcttgaggtgattgcttcacattgctatctgctgctacttgatttcctggacgatgagcttcttgttgtggtgatgcaaaagcatttgttgcatctttgtgaaactttggagttcatctttagcttcatgtacagcaatgtagctaagtaacttagtttcgaaaatggaaagggggacgatcttgtctctctttcttcaaaaaaaaatgtagagcaatgtagctagggtgggttcatttttggcatcatgaaccacaattctgctaggaagttgcaaatgtgaccagcattttctggcagataaaatgattgaattgatgcaggtggtgctacacccgttggtggactgctggtgcttgattcaagatttttattggctgaaattgttaggttggcttagctgatgaattatgtttggcttagttaaactatggttaaacagagaaactattttaacgacaccctctttaccttgaattatttaagtccaaatcattattatcaattcaaaacctttgatatttatttttttaattctcttttcattagattaaaacaggaggcttagttgtttggacaagagggggcatacattttgtgtacagaggaagcagttacctagaaaacgcaaagcggcatcgtgactttgttaattataatgaggaactttccccagtaacatctaacaatcctacatcccaagggaaatattggagtaaagatgaaactttaaccaatgataatgatgaagctgatgataaggacgacaaacctatcaagggaacactatatgaaagagaagtcaacagactactggacagtttgggccctcgatttatcgattggtggtggaacacaccattgcctgttgatgctgatctccttcctgaggttgtccctgacttcaagactccatttagacaatgccctcctggtgtgagaccagcactagcagatgaggagctgacctacctgcggaagcatgcacggcctttgccaacacattttgtcctaggtgagtttgctattagtccccatattctgcacttgtcagtcactttattgatagtttcaaatgaatatgctttataggatgatttaagtgttgattgtcactactatctattgtaacatcttatgcacacataacctatttccttaaagttccacaagcattattgtatattcataagtaacccatcataagatgtttatatatgtagcccaactataatcttgactaatttctggcaggtagaaatacaaaactgcagggtttggctgctgctatactaaagctttgggaaaagagccttataccgaaggttgcagtgaaagtgggtatccaaaataccaatcatgaacagatggccagaaatcttaaggtgtgtattgttctcatgaaatatattagagtcattaggatttctttgatatccatatgttcaatcttcatctgtg

SEQ ID NO: 11211 - DNA, 2788 bp, Oryza sativa
tggctgctgctatactaaagctttgggaaaagagccttatagcgaaggttgcagtgaaagtgggtatccaaaataccaatcatgaacagatggccagaaatcttaaggtgtgtattgttctcatgaaatatattagagtcattaggatttctttgatatccatatgttcaatcttcatctgtgacactgaatcttctcagtgcagcgtcttacaggaggaactgtcatattgaggaacaaggattatattattatatatagaggcaaagattttcttcccggtggcgttgctgaatcagttattgaacgggagtctcaggtacatgaccagcaggcgaaagaagaggaggctcgattaaagatggctgactcacttcaaatgattgttggactatcatcggagagaagttatgtgggaactttcagagagtatcaggatttccatgatagccatgcacgtagaacaactgaaaacaacttcagaattcaactagaggcaaagaagcatcgattggaaaaggaactgaaagaccaggaatggagactttccatggtatgctttgatctaactcgtcttgtaccttcttttgaattcccgaacttccaatggtaatgtaaaaatggtacgtactgcagcttaccaagaagattgaaagatcaaaccaagtgctggcaaagcttcatagttcttggagcccttcaaagaaagatggagacagagaactcttgacagaggaggaaaggaggatattccgaaaaattggcctaaaaatggatgaacatgtgctgcttggtatagccttttgtatcaaactgcaatattccatgcctatatgtgtctctatccttgaaaccaagaaaagctatttaccatcctatgatgaaaggtattcatccatggttttcccttgcagggagacgtggtgtctttgaaggcgtaattgaagagattcatcaacactggaaacataaagaggttgtgaaagtaattaccaagcagaaccaagccagccagatcacgtacacatctatgatgcttgaggttgagacaggaggcacattaatagcaatagagaggttcactaccagccatgccataatactttaccgaggaaagaattatcgtcggccaacaaaatcagcacccagtaatctcctgacaaaaagagaagcattacaaagatcaattgaggttcagcgacgaggggtatgaattgacatataattctcccttctccccttaatttccaattttctggctgtctgggtatctcatttcctcattcgttttgcagtcaatgaaatacttcgctcaggagaggaaaaagtccattgatgaattgaagagagaactggttagtttacatgctgtttatatcaatacgacgaaatgaaacttcatatgcttaagcaactggaattttatgtacttgatttatcactcttgtgttacagaggaatgtgacatgggaaatcaggaagctaaaccatgatactgaacagtcttggacagcatgatcgctatcaacattgaagattggaataacgattcatcctctcttttttttttcgtttttaacatgataactacaaagaacaaagtacacagaggccactagatctggtaggtatggtagatatggccacaatgaattatcttgcaagtgtgaagatgtttttttttttgtttatgtacatgtgatacactaaagcacatgagagcagaatcattcaatttggctctgatactacgacgaaatacgaactgattactgggtgttgattaaagctcggggagtttgctgaatatgcttagcgctttcatgttctaaaagaaaacaagtcgtatgacctattgaagagaaactaagaagattcagaaggatgctgtactatctagttctacatcactgttacaaagttactataccttttaagggcgaggttacgagggtacaaaaacatgtgctgaaattctttccccaagcaaactacagaaaagatcctgcctagcaaaagcggtactagtcacctggcccctgaggaaattttacaggatttttggaagatttgaactaagtcctgctatccggtgaaaattctgcaaaattattgcgttcgaagatcccaataaactatgcattggtcgcccaaacgacagcactcaagcagaaggacacagagaagcacaagtgctgaagaatctcactggacggcagatggcaagctttgcattcatcagcttcattgttcttgccgtcccgtccttcatggtttgcgaggctctcccctgaactgctgctgctgctgctgctgccgatgatgatctctcttgggcctctgcggcgcgttcttgggattggtgaaccacgtggtgtaaacgaactgcttgtgccgcccgtcttggtcccaaatgaggcggagcttctgcttctcccccatccaccgcatcatgatcttcatctgcctcttgctcgtcaggcccctcagcccaacgtcctgcacacgaaaatgccaaagattttctcgctcgtcagggatgcatgcgatcagggtggcaatcagaggaacacaagatcgctcagggatgacagtttccatctgtcaagcactgctggttcattttgacactgtgagacattacgtccaacaggtggcccccgccaccgggggggccatggcaaaccgctgccaggtgacgggtgggcgccgcggacacggagaatgagcacccaccaagatgcgccggccgccatccagaccggtagcatgaaggcgtgactaacct

SEQ ID NO: 11212 - DNA, 9770 bp, Oryza sativa
  unsure (1)..(9770): unsure at all n locations
nnnnnnnnnnnnnnnnnnnnnnnnnnnnnnnnnnnnnnnnnaccctgtcgagcactgctggttcattttacactgtgagacattacgtcgaacaggtggcgcgcgccaccgggggggcgagggcgaacggtttgcgaggtgaggggtgggcgcggcggacagggagaaggagcagcagcaaggatgcggcggcggcgatcgagacgggtagcatgagggcgtgacgaaccttgacgtggtcccagacgtcggagatggtgagcgggccgtgctccctgacgacgtcgaagatggtgcgcgtgatggactgcgcctgctccggcggcgccgggagctcgatcggcgccatcttcggcttcccctttttcgccgcccaccgcgccgacgtcgccagcatcctctccgacgaggggacgggaagcaagcagcaaacacgcggcggcgccggccgacgaggtgaacagagcagagcttaccgggttgggggtgggatagtttggctctcagattcgagtgtacggtcctcgctcccatcaaacactccccgtcgaaaactacaccaaactcgtatgacatattctaatactacaaatctaaacgtatgtctggatttataataaattatatcaaattttgaaataataatttttcgatattatgtcaaattgtcatatttgtaaaagttaaattgctagatgcagctacaaaataggggcaaatacataactaataaataaattaggggaaattgagagtatgaatgtcttttcgccaaaaatttaatattgttaacatgtctatttaaaataggggcaaaacttagttttgtttgaaaaaacaggagtgaaccgatataaaaataggggtaagaacgagatttccccttatagtaaacatgtaacatattacactcatctatgtatggcgtgaatatattatacaaatagcaccggtctataccactgtttatgttttttttataaaactaataactgattttagattgtatcaatgacgtgggtttagacagtgatcgatatggttttgtagagtattttccatacccaaccttaggctggcctgaattcgagagcgagccttgcctactaacacggaaaaccaaacaaagaattagtacataattaattttaattaagtattagttaaataaaaactttaaaataaattaatattgtttttttaaagcaacttttctagagaaaattttcgcaaaaaatggtaccgtctactgatagttttggaggcttgtacacgaaaaacaagatatgggagactgggaaagttgagagaagaaccgctccttgcccccgtgaaagagaagccatcctgtacaaccaccatcacaccttcacaaaaggctcactattcattagtcaactaatatttctggaactatctatctatatattggtgatttctaaaaaaaaacatacagattttttctacccttagatttacacccaaggtactataaaagaaaataacaaaaacatatttacttgcatattatttttatcaaaattactatgaacttacatatcatatcagctgaatttacaaatgttattttaatgttttcctttacaggttaaagtccaaattacctccggactattacgacagtttgaattactcccctaaactacaaaacagaacatttaacactcaacttttttggactggatgaataacccccagtacaaatttggttttgatcttacgtggcatagaacgtgacaatataatccaatttttaatcctaggtggcagtgagccagtgaggcccacccatcatcttgtccgccacctcatgacgcctgtcacctcctctaggtcatgttgggtgtgtatgagatagagagatagagagagagagagatggatatgggaggtgaaagaaaggagaagattggaagtaggttgtcaacaagccgagctcaagtgagctttcacgtctaggctcgagctcgacaaaagctggagccgagcccgaattgagcctaatcctccttcgagcttttaagcaggctcgcgagctcgaccaagtataggataatatataatttgatgataaaattttgtaaaaataaaaatttaattaataatattgaagaaaaatattaggtgtcacaccctgagaattcaaaatatgtaaattattgtttaaatggaatttttagaatttatttttaaaagcctagaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatctaaattgaaaaaggttttaaaaagtcttcttttggctttgggccgaaagtcggcccaaaaccttctctctctctctccccggcccaagtcggcccagtccgcaaccgagccgcccgcgcgcgccctcgctgccgctgacaggtgggtcccgcttgtcagtcgtcgtcttcctcgcgcagccgccgcccgaaaccctagcgccgcgccgccgccgttcctttccaaatccggccgcccctttccttctccggccgaattgatagaggggaaatgatcctcgggatctcctctaccttttctcctttggaaacatcggctaaatcgttttggaagttcgtggaatcgagttcgattcggatcggcctctttccttcaagccacgaagtttcctcctcgtcgccggccgccgtgggccttcgtcgccgcctccgagcccctttaaaaggaccccgagctcttctctacccgccgccacccttgccttcgcctctcgtcgtcggaaatgccctagcgccgtgtgccctagcgccgccgtcgccgccgtcgctccagccgtgcgctgccgccgttccagacgtcgccgtcgctcgggaaggacgtcatcgtggtcgccaagtcgtcgccgtcctcgtccgccgcttcgccaccgtcggagaccgccggagcatcgtcgccgccgtcgacccgaagagcttcgccgcttcctcctcgtcgccgtcgccgtccgttgatcttccgccgtcgctttggtcgccggtgagtccgtcgtgccgtccgctacccgttggtgccctccgttcgtgccgtagtgccgccgttcgccggcgagcgtgcgccgtccgagccgccgagccgccgccgccggtggtgacgtcaccgctgacgtcatcggggccgttcgtcgtagaccggtcgtggaccgatcgatctcggccgtccgttttggatcaagtcgatctcggccgtccgttcgtgtgaaccgccgccgtgcgcccggtccaccgcaaaccctagcctgctgacgcaataaatccccttttccttttcaaaaataattcattattgcgtcataattcaattaaaatcaatataagtgttttaatccgattaaatcttcaaaaattcatatctaattcatcttagctccgatttagttggttcaagtctctaattttttctaaaattgagatctacatgttaaaaatatccacatgtactgttcatgcttgtttatgtgctgttttggtgtttttgctcttttctgtttagattccgtcttttccggagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcccttttgttcttgattactttattccttgataccttgggttattataacttgactagttgagctttatatattggttcaactagatattagatataattgcttagccctgcttagaaacattagctcactattgggataacttatgactcactgttatttaatgatggtttaatgatagttcacgatggtcaatcgtgactggttaattaattaatgtgccaactaaaacctggtaatggtgggttgtgagcacatggttttgatggttgtgctcatgacaattaaggaccggttcacgagtttcggttgtgaaacattaaccgtgccaaccacaagccagcatgggcaacggctttatcttttgtgtagcatggttcattgcggggcaccagactgagaagtggcggagataagcccacgggggtcgctggggagtccatgccttgtttataagggggtgattatgatctaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccacaatagaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgaagcccttgtcaagctgcctgtggagtggagccgtctgcgccgtttatcttattttccgctgcttagatatttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacattaggagaacttaagattaatatatcatgccaaaatacacaatttttttcacatgaatatatactaatttatccttgagctactaacttatcatataaaagataagctcgagctcagctcgacaaagctcgtgagcttgcagctaggctcgagttcggatcattaagagttcgaaccgcgctccaatctagtatgagcctcacgagctcgagcttttttgacagtcctaattggaagtagcaatgataggtcagcctcactgacttatttttaactggactgccacgtaggttcaaaactactccagactaagttgttgggggactgtggggtaatttgcaccattgcaatagttcaagggtgtaatttggactttttcctcttttgtatacttccttttcttttttaaaaaatacagtacaaacgcaagcctttcactcccactgggtgatcatcgctaccactgccccaaccaagtgtgttgccacactccgtctcgacgacaccataccaccgccggctaggctagtcattgtgtgatcccatgtcccgtctcctaaccacaagacatgtctcagcctcaccgccaccggcgccttcttactcactcatctcctgtcacacccaaagttttcccttcccttaggtttcaaatcactaataaatggcttcaagaatttgctttggttaaccactagaaaaccctagttaacaatacatttaatagtcggaattgtcagggagaatttttttcgaaatctctttgctctaaaaatcactaacaagacttaaagagtcaatatcagatcacggaggcaatgttgctaagttaaaagtggcaagttaattcttcttcctttgcctttggtcgtgaattgtgcccaattcactcccctctcagcccgtggtcttgttttgcatgaggaaccatatacgtgtcagtttgcggaaccatttcctttcctttccgtataggtagtcgagttgtctagccgtaggtgcaaccctaggttcctaccggccaatcgtttgccgtaccggggctttaccgtgaatcgtgtctagcccgccggtttagctgcagtcgttgttgtgtcgttcactcgttcatttgaacgaggtgttccctgtggttcgttcgttcgtccgtcccgagtcgtcctttaggttagagccgttcagagccgccggctcctttcaccggtttcgattgatcatttgggtgatcctgtgtcacgtagaattgactcgttgagtcggtatcacgtgaggcacgcttgccaatcaatctatcctttgatcctatgttctttcgggcttaaatccctgtcaattgattaaggtttttctgttaatagtaatagcacagagcatcttctaaaattcataacttaataatctgagctccgttttaacccattcaaattgcagtgaattcgttaaatgtcaagaatccattaaaattggtttcttttgttgtttcagtagctttttagcatgtatttattgtgtaccttgtttgtcgtttagactccggcacttctgacgctccggtttattttgaagtggtcgccgaggtcccgtcaattgaagagcaaggcaagtcatacagatatcattgatcatattgagcctatttgcaaaaacccctgcttttctctcaaaattgcattacttttataatgtcatgtgggatggtttctacccatactcagcctttgtttaccttaattcattgatattctgggataaaaatttgactagatgattggtctaggattgcttagccaagcttagatcaactagctcacaatgggattcactataatttagtccttaatttgattatgctatgccttcttggcatatggttaattaattaaaatatgctttacttggtgggtcgtgggcacatgcatgatgatttatttggtggttgtgcccatgacaattaaggaccggttctcgggaatccctggaagatatactcgtactaatcataagccatatgggctctaggctgaatcttaagtataatattttctagctagcacaccattggcgaggatagatgtgatggagtatggatggacctggattttggtctatgctgcttccggatttacctaggcacgagcggaggctgcctgctcctggattttggagtgggggcgaaactggaggtgggcatgctggttaggggtggttatatggagggttttgtcacgatttccccctttgcagtatcgtggcggtacttggggcatggtttcatgtgtggaatcgtgtcttgtgggtaaagttgtacacctctaatcagagtaaaactattcgaatagccgtgcccacggttattgggcggtcaaccagctcaccatgattagtctcaccttaataatttgccttaatgaactagtgtagttcaggtggttttggtttgggcctgtcgcaacgtggtttagcgttggacagtgatgatgttaatactacttaattatatattgttttactgctttcaacttatgatttacaaatgatgtttttactgcaaaatatcctatgagccaatcctttgttttatccttgcatcataccttccccttggtatgacttgttgagtacggtggttgtactcagtcttacttctttttcccaatcccctagaagcagaagttggttcagatggtgagttctatgaagtttaggattgtgccagccgtcaagagtttgcctgtggagttatggaggaagcttcgcgttgctgtgaagattaaatttagttctctagttttttcgctgcgtatgagtttattttgttatttttgtaaaacgtggaactatatcaaattgtcatctgtgtactatagttgatgtctggacagaggttaaatgcacagatagccggtgattcgggttattaaatccttgggtgagacatctccaccgcccctaattgttcttccatcgccctagtcatcactataaagccgccctgaaccccctcccccccccccctccctagtaacctccaaccttgaaaccataatccggtaaagcctatcggagttcgttagggtgttagtgatgaggcttgccaaggaggttgtggtcgccattgtcgtgactgccaccatcattgtccttcacgctcgctgtttgatctgatgacattcatcatagtctattgagatttttgggaaatgtaagtaaaccaatgaaagatacaattactttggtaactctgtgaacatatcctatgcacataagctttccgtgcacaccaactagcaaatgttacgaataattatacaaaaaaaattgaacatttacttataatagtattacacatatatgcaaagtcttattttcaaattaattatattttaaccctaaaaaaagtgaaaaatctgacaactttttgagttaaaatatattagaattttgttttttttttgggttacggctaaaatataacaaatttgaagataagatttcacacttaggtgtaatactattgaaactatgtgtctaattttttctagaattttatgtgacatttgttaattgatgtgtatggaaaatttgtgtgcatagtatatattcctggtaagtcctatctacatttatcattgtcatcattcttgaggctcttgataccatccatttggccttgtttctttctccatgtcttatcttatgtttgcactgaactctcaaggtttaaggtcatacctacaacaaacccagtgaacatggagtgtggtgagctaacaagccgggttggttgtggtcacatggactcgtcggctcaacgagtaaccgaaccataaatgcatgcagtagctaagctaggcccagccacccagaaattacgccggtcgaatgtggtcacatccacagctccagacctgaaccgccgatggaaaactctgaaaactgaagcgaatagatgaacatgctgaaaaatcccagcatcaggcatcagcttcgtgcctcgagcccgtcccgatcccgaccggagtactacgagctaccactacctcctccgttgactccggcggccatggccatggctgcaagcacgatggtacaagtgtgtactggtagtagaagtagtaccaatgtacgagcacagtacattcttggcaagtgagcagtacagtggtagtaatgatggctttgctgctgctgctgctgtgctgatgatgatgatgacaagatcatcgtggcctgtagcagcgtagcgtgtcgcagtttgaggagaggagaaaagaaatggtgaatttgtgatgaactgatgatgcatgcagagtaaaactagagcgaatttgcaatttggggtcagattgattgattgggtgatggtggtgatttggtattccatattcacagcggcaaatctcctacaacaagaagtggatcaaaactaatgaaaagaagaaaccaaagagaggaagaagaagacgcaagaaacagagcaagaagaggaacaagatggggacgagcggaagacatgtcctcttcagggtttcttgatctcttctcttccgtcgttgctgctcctgctgttcgnnnnnnnnnnnnnnnnnnnnnnnnnnnnnnnnnnnnnnnnnnnnnnnnnnnnnnn

SEQ ID NO: 11213 - DNA, 2094 bp, Oryza sativa
actctggccaccacttcctaccatctcagtgtttagtttcaggcgaggaaattctacatcagcagaaaaagagttgcagtgagagaaatctctgctcaccccgggggagagatcgaacccgatggcgttcgtcccgactcccgacagaagcatcagcgggtggttcctcgccggcgcctgcacgaacacgggcgagatcaaatcaaatcaagcacggctctggaaattggaaaacaacgggaagaagcaccaccggtcgtacatgaggcggcggcctgtaccgccagagcgcgagacgccacccggcgccggagacgggcgcgtggtggagctcgtcggcggtgcagacgggcggcttcgccggccgcgagggggccgccgcggagaggtggatcgggggcggcgcgtcggcgcggatcgcgcagaggacgcggcggcggaggcgagcggtaggaggaggggagagtccctcggcggagctccggcgagcgccggcgccggcgccggagatgggctggagaagcatcggagttgccgttttgggcattttttggttttatttgaaataaatttttgggtcgttataaacggcgctctttctgcgcttctttcagccatcaacctggcataaacactttaaacagtctgttagcattaattatatactactagtggtagttgcaattttggtaatgtcggaaaaaaatcagtttacttccaaaaaaaatacactttatgtagaatttggagttaacaccttaacctttgcaattaaggtgacacatgatgtacgtgccttatggtttataatattgcaccgttatctttcagtttccacggtaacattatacggtaactctatcatttttttcgtgctaaccatgataatatcgggaaacggtaacccctaccggaacagtaacggaaaacttagtattaggtgtagcccatagccattcaatcaaaatacgagatttaaactgtttgtcgcaacaaaagtatcgtggtttaaaacatactagtatattgtatacttcggtacatagacgatctcaactcccaaggtaagaaaaaaaaaagaagttttcttgttgtgtatatgcgacacctattgtgttaattgaaaagatatatatcgtcccccgcaaaaaaaaaaaagaaaagaaaagatatatatatcgcccattttatattaaattttaaaagctttagtattagcatctttttagtatgatatatgccaatcacatgtcagattatatcacattataattttattggggtaaaataatttaaaataaaactagtgaataaaataattttaaagactatataaacatcaaaaatgtcaaatttttaaattggatggagaattaagacataaaaacagcggctctttttgagttattgaattggagaaaaaaaatagcaaccattttatatattgtgtcactaagagtaccttgtttcgttagaatggatataagggcatgttcaactattgagaccgattcaggcttataagttatccacgtcacacaagatctcttagtgctctctagtcatctcttgcaacttgttgtagtttaccaacgttgcattgtatattatgtctacaatatatgacggaagtcacttatcctctttcctcatcctcatgcataataagatagtaaagcctcgtagggctccgtttttgtccttttttgaaattttttttctcctcgatagttgtggtatgtggtttgcagatgcagaagctcctcgattgggtgagcagtggagccgttccttctttctttgtccggtttccctcactggttgtgccggtctcacgctgcatgcgcgccacgcacttccttatcattttttttatcctgagagtaaatgacgtgtgatggtgtttatgcaaaaaaagctcctcttgtttgaacggaatagcacgcacatcctcccaccgaccgacaccctattccattttatacgaaaaaccactcgtctttcagaaaaaatacaacacgaagaagggaaaattctgcctacatggatagcgctgttaaaacgaaaaacacaagggtttttcccaaaaacaac
